United States Patent 9,834,782 (ISOLATED POLYNUCLEOTIDES AND POLYPEPTIDES, AND METHODS OF USING SAME FOR INCREASING PLANT YIELD AND/OR AGRICULTURAL CHARACTERISTICS) - sequence listing, part 4

SEQ ID NO: 5609 - DNA, 1113 bp, Helianthus annuus
tcttcctcacaaaccctctcattcttcattaccaaatcttgaagacacaaagatttacatacaaacaatggcttcaactgcttgtgcttcttctgccattgcagctgttgctttttcttccccaagttcacagaaaagtggatctattgttggatcagcaaaggcttcttttcttggtgggaagaaactgagagttagcaagttgggtgcaccatccggttcacgatcatttggaaccgtttgcgctgtggctgaccccgatagacccatttggttccctggaagcaccccaccagaatggctcgatggcagcctaccgggagacttcgggtttgatcctcttggtctaggatctgatcccgagacgttgagatggaacgtacaagcagaactagtacactgcagatgggcaatgttaggtgcagccgggatcttcatccccgaattcctgaccaaaatcggaatcctaaacactccttcatggtacactgctggtgaacaagaatacttcaccgacaaaaccacactattcatcattgagcttattttcattggctgggctgaaggaagaagatgggctgacatcatcaaacccgggtgtgttaacaccgaccccatcttccccaacaacaagctaaccggaacagatgttgggtacccaggtggactatggtttgacccactcggctggggaactggttcacctgcaaagctcaaggaattgaggacaaaagagatcaagaatggaagattggccatgttggctgtcatgggtgcatggttccaagccatctacactggaaccggacccattgacaacctgtttgctcaccttgctgacccgggtcacgctaccatttttgctgcattcaagggctaaactgcatgaaaaactgttggcaggaggattgattataagggtttttggccaagtgatgatcatgtttgtgtattattagaaatcctatcttatctctactgtagaaaagttaatgcaatgtacaaatatctcttcattaatttcaactcaaaatgctgcatatatataagcttgtatgtctttaaagtactttacatataacaaaaatggatcaacaacaccattgtgttgca

SEQ ID NO: 5610 - DNA, 1420 bp, Lactuca sativa
caaaatcgcccttaaggatccagaatcctgtgagtgggttttatcctgaaagccacacgtaatttactacacgaaccacaagtgtaagtttatctggttacatatcagcaagaatagattctgttagggcccacgtggcaacccgcacagccaatcacagcattctttcttctactcctatccttggagataagctcataacgccttacattaacacacacccctttcttccacacaaacctactcattcttcatcactaattcttgaaggcaaagaattgcagagacaacaatggcttccactgtctgtgcttcttcagccatcgcagctgttgctttctcttctccagcttcacagaagaatggatcttttgttggatcaacaaaggcttcctttctttgtgggaagaaactaagagttagcaaggtcactgcaccaaccgtggcacgatcttccgggacagtatgcgttaccgccgaccccgaaagacccatttggttccccggcagcacccctccggaatggctcgacggcagcctaccaggagacttcgggttcgatcctcttggtctaggatccgacccggagaccttgaggtggaacgtgcaagcggaaatagtacactgcagatgggctatgttaggagcagctgggatcttcatcccggaattcctaacaaaaatcggaatcctaaacactccttcatggtacacagccggtgaacaagagtacttcacagacaaaaccacactgttcatagtggagcttattttcatcggttgggcagaaggaagacgatgggctgacattctcaaacctgggtgtgttaacaccgatcccatcttccccaacaacaagctaacaggtacagatgttgggtacccaggtggactatggttcgacccactcggatgggggagtggttcacctgcaaagcttaaggaattgaggacaaaggagatcaagaatgggagattggctatgttggctgtcatgggtgcttggttccaagcaatctacactggaactggacccattgataacctctttgctcaccttgctgacccgggtcacgccactatttttgctgcattcaagggttaaatagcaaggggttgttgagatcatgatcttcagatgatgctggagagggaaaatggtggatttaacagtttttggcaagtcatgtgtgtgtatcattagaaattgtatcttgtctctactgtagaaacttaatgcaatgtacaaatacctctttgaacttaaaatgattcagatatataagcttgtatgttggtaaagtactgcataactcttgccacctgatacccgaaccaaggtatttattatcattacacaagggaaactttggtttatgctctaataacaatagaaaaaaaaaatcatcttttccaaatt

SEQ ID NO: 5611 - DNA, 992 bp, Flaveria ramosissima
tctccatcatcaaatcctcaagcccaaattatttacacaccaacaatggcttccactgcttgtgcttcttccgccattgcagctgttgctttctcttctccaagttcacaaaagagtggatctattgttggatcaacaaaggcttcttttcttggtgggaagaagctgagagttagcaattgggtgcaccatccggttcacgatcgttcggaaccgtgtgcgttgcggctgaccccgatagacccatttggttccccggtagcaccccacccgaatggctcgatggcagcctacctggagacttcgggttcgatcctcttggcctaggatccgaccccgagaccttgaaatggaacgtgcaagcggaactcgtgcactgcagatgggcaatgttaggtgcagccgggatcttcatccccgaattcctaacaaaaatcggtatcctgaacacgccttcatggtacaccgcgggtgaacaagagtacttcaccgataaaaccaccctcttcatcatcgagcttattttcatcggttgggccgaaggcagaagatgggctgacatcatcaaacctgggtgtgttaacactgacccaatcttccccaacaacaagctaaccgggaccgatgtgggctacccaggaggcctatggttcgacccactcgggtggggaaccggctcgcctgcaaaactcaaggagttgaggaccaaagagatcaagaatggaagattggctatgttggctgtgatgggtgcatggttccaagccatttacaccggaaccggacccattgacaacctgtttgctcaccttgctgacccgggtcacgccaccatcttcgctgcattcaagggctaaagatattggcttgaagaatttaaagagtttgtgacaagtggtgtttgtgtaacattagaaattgtatgtgtagaaaagtttaatgcaatgtacaaatacctctttcaactccaaatggtgtatgtcatattgtca

SEQ ID NO: 5612 - DNA, 1122 bp, Rosa hybrid cultivar
aaagaaagaaaaaggagcttgagttggttaaatctcatagtcaaaaatggcttctgcttgggcttcatctgccattgcagctgtgtcttctcccagctcgcagaaagctgggtctgctttggcagcaacaaaggcttcgttttttggcgggaggaagctgagagtgagaaacgtggcagcaccgagtggatcatcatcaacttcttttagagtatgtgctactgctgctgaccctgacagacccctatggttcccgggaagcacccctcctccatggctagacgggagccttccaggagactttggctttgatccgcttggtctttcatctgaccctgacagcctaaagtggaacacacaagccgagctcgtacactgccggtgggcgatgttgggcgccgccggtatcttcatcccagaattcttgacaaagattggcatcctaaacactccttcatggtacacagcaggagaacaagagtacttcactgacactaccacccttttcattgttgagctgattttcatcgggtgggccgaggggaggagatgggctgacattctcaagcccgggtctgttaacaccgacccaatcttccccaacaacaagctcaccgggacagacgtaggatacccaggcgggctctggttcgacccacttggatggggaagtggctcacccgagaagatcaaggagttgaggacaaaggagatcaagaatgggagattggctatgttggctgtgatgggtgcttggtttcaacacatctacaccggtaccggccccattgacaacctctttgctcaccttgctgatcccggccacgccactgtttttgcagctttcaagtgaggaaatattgtgggagaattccgtttggattcaagtttggaagaaggggcaactatggtgatcacatatcattaatctgaggacagaggattacggttatgtttgaagccaagggaaatttgtaggactaagacctgtaaacttgttatgtgatttgatagaaccatcttctggtgtacaaatatctgtttggacttgaactccataaatatgtattaaatcagttgttaacgtgcaatgtttgttaagtgaaaaaaaaaaaaaaaact

SEQ ID NO: 5613 - DNA, 1069 bp, Cucumis sativus
tttccattcaaacaatcctccacacaaccatccagccatctccgtcactccccaatttttcctttagaaaacaccactaatggcttccgcttgtgcttcttccgccattgctgccgtggcaatttcttcctcaagttcatcgaagaatggctgccccaagctggcttctaatttccttactggcaagaagcttaggctcagaaacttaaatgctgctgctactgctgtcgttgctcctcgaacggttccggtatgcgcagcagccgatccggatagacctctttggttccctggcagcactcctcctccgtggctcgatggcagccttcccggtgactttggctttgaccctcttggtcttgcgtctgatccggagagtctgagatggaaccaacaggcggagctcgtacactgccgatgggcaatgttgggggcagctggaattttcatcccggaattcttgacaaagatcggtatattgaacactccttcgtggtacactgccggtgaattggaatatttcaccgacaccaccactctgttcatagtggaactcattttcatcggttgggctgagggtagacggtgggccgatatcctcaaacccggatgcgtcaacaccgacccgattttccctaacaacaagctgaccggaaccgacgttgggtaccctggtgggctctggtttgacccactcggatggggcagcggatcaccggaaaagattaaggaattgagaacgaaagagattaagaacggacgattggctatgttggcggtgatgggagcttggttccaacacatttacaccggcaccggtcccattgataacctttttgctcaccttgctgatcctggccacgccaccgtcttcgccgcattcacaccaaagtgaagaaattgaggagcaaataggagagatgtagtgatgtttgttgtgggttgagggacaaatttatgtattgaatcacaactttgatctaatctctgtgtttatgtgtatgatggaccatatcattatcaatttaatgtacaaaatgagatcaacaaattaagcaaatttaggccc

SEQ ID NO: 5614 - DNA, 1185 bp, Arachis hypogaea
tccaatcatggcttccgcttatgcttcctctgccattgcagctgttggcatctctagtccaaacacaaaagcttcattcctaagtgggaggaagttgaagagggcggctaagcaggcagcaggcgttagaggagtatcgagcacaagagtatgtgcagcagcggctgaccctgagagacccctgtggttcccgggaagcacgcctcctccatggcttgatggcacccttcctggagactttgggtttgatccacttggtctggggtctgatcctgagagcctgagatggaatgtgcaggcagagctggtgcactgcaggtgggcaatgctgggtgctgcgggcatcttcattcctgaattcctaacaaagattggcgtgctcaacacgccatcgtggtacacagctggagaacaggagtacttcacggacacaaccacgctcttcatagttgagctcatcttcattggatgggcagagggaaggaggtgggctgacatcatcaagccaggctgtgtcaataccgaccccattttcccaaacaacaagctcactggcaccgatgttggttaccccggtggcctctggtttgaccctctcggatggggcactggctctcctgaaaagatcaaggaattgagaactaaggagatcaagaatggcaggctcgccatgttggctgtcatgggtgcttggttccagcacatctacaccggcactggtcccattgacaacctctttgcccaccttgctgatcccggccatgctaccatttttgctgctttcacccccaagtgatgacaacactggcaagtaagaagtagaagtaagaacaactatggatcggatgagattgcaatcctgggggaaacattgctgcatttgtttaacccaagtgattaggaaggagggtctgtcatctatgcatgtgagttgaaagaaattgtaacatggttactacttctatatcatgcacagaatgcatgataattcgatgtacaaacacctatctaataaatctatagatgccatgaatgtaagttcaggtaactagcatagaggtggggatctcgcgtccttgttaacctgctgaatctttacttgacattttgccgatgctctgaaataacgaaaagcagactccactacaaaaagtctaatgaaagaacacaaatttacctaaaaaa

SEQ ID NO: 5615 - DNA, 968 bp, Flaveria ramosissima
catactatttctccatcatcaaatcttcaaccccaaattatttacacaacaacaatggcttccactgcttgtgcatcttctgccattgcagctgttgctttctcttctccaagttcacagaagagtggatctattgttggatcaacaaagggcttcttttcttggtgggaagaagctgagagttagcaaattgggtgcaccatccggttcgcgatcattcggaaccgtgtgcgttgcggctgaccccgatagacccatttggttccccggtagcaccccacccgaatggctcgatggcagcctacccggagacttcgggttcgatcctcttggcctaggatccgaccccgagaccttgaaatggaacgtgcaagcggaactcgtgcactgcagatgggcaatgttaggtgcagccgggatcttcatccccgaattcctaacaaaaatcggaatcctgaacactccttcatggtacaccgcgggtgaacaagagtacttcaccgataaaaccaccctcttcatcatcgagcttattttcatcggttgggccgaaggcagaagatgggctgacatcatcaagcctgggtgcgttaacactgacccaatcttccctaacaacaagctaaccgggaccgatgtgggctacccaggtggactatggttcgacccactcgggtggggaaccggctcgcctgcaaagctcaaggagttgagaaccaaagagatcaagaatggtagattggctatgttggctgtgatgggtgcatggttccaagccatttacaccggaaccggacccattgacaacctgtttgctcaccttgctgacccgggtcacgccaccatcttcgctgcatttaagggctaaagatattggcttgaaggatttgaagagtttgtgataagtggtgtttgtgtaacattagaaattgtatgtgtagaaaagttttaatgcaatgtgtacaaat

SEQ ID NO: 5616 - DNA, 909 bp, Ambrosia trifida
atggcttgtgcctcttctgccattgcagctgttgccttctcttctccaagttcacagaagagtggatcaattgttggatcaacaaaggcttcttttctcggtgggaagaaactaagagttagcaaggtgggtgcaccatccggttcacgatcgttcggaaccgtatgtgcagcagctgaccccgatagacccatttggttccctggcagcactccaccagaatggctcgatggcagcctacctggagacttcggttttgatcctcttggcctaggatctgatccagagaccttgagatggaacgtacaagcggaacttgtacactgcagatgggcaatgctgggtgcagccgggattttcatcccagaattcctaacaaaaatcggaatcttaaacactccatcatggtacactgctggtgaacaagaatacttcaccgacaaaaccacactcttcatcattgagcttattttcattggttgggccgaaggaagaagatgggctgatatcattaaacctgggtgtgtcaacaccgatcccatcttccccaacaacaagctgaccgggacggatgttggatacccaggcggactatggttcgacccacttgggtggggaagtggctcacccgcgaagcttaaggaattgaggacaaaagagataaagaatggaagattggctatgttggctgtgatgggtgcatggttccaagcaatctacactggaaccggacccattgacaacctgtttgctcaccttgctgacccgggtcatgccaccatcttcgctgcattcaagggctaatgcatatggaaggaaggacttaaaagagttttggcaagtggtgtttgtgtgttattagaaattgtatcttcatcttaatttactgtagataagttttaatgcaat

SEQ ID NO: 5617 - DNA, 862 bp, Flaveria ramosissima
ttcaactgcttgtgcttcttctgctattgcagctgttgctttctcttccccaagttcacagaaaagtggatctactgtcggatcaacaaaggcttcttttcttggtgggaagaaactcaaagttagcaggttgggtgcaccatccggttcacaatcgttcgcaaccgtgtgcgctgcggctgatcccgatagacccatctggttcccgggcagcaccccaccagaatggctcgatggcagcctacctggagacttcgggttcgatcctcttggtctaggatctgatcccgagactttgagatggaacgtacaggcggaactagtacactgccgatgggcgatgttaggtgctgccgggatctttatccccgaattcctgacaaaaatcggaatccttaacactccgtcgtggtacaccgctggtgaacaagaatacttcacagacaaaaccacactcttcatcattgagcttattttcattggttgggctgaaggaagaagatgggctgacatcatcaaacctgggtgcgttaacacggaccccatcttccccaacaacaagctaaccgggaccgatgttggctacccgggtgggctatggtttgacccactggggtgggggagcggttcacctgcaaagctcaaggagttgaggaccaaagagatcaagaatgggaggttagccatgttggctgtgatgggtgcatggttccaagccatctacactggaaccggacccatcgacaacctgtttgcgcaccttgcggacccgggtcacgccaccatttttgctgcattcaagggctaaaacagcattataagggcttttggcaaagttgatgtttgtgtattattagaaact

SEQ ID NO: 5618 - DNA, 1030 bp, Ipomoea nil
gaagcctttctcacttctttccccacacagcaatcacacccaccctgcattgtacagctcgaaatctgtcgacatggtgtctgcctgtgctgcttcgtccaccattgcggccgctgcattctcgtccccgagttcgcagacaaaggcgtctttcctctcggggagaaaactgagggtgagcaagtactcggcccctgccacgtcgcgatcttttacggtttgtgctacggctgagcccaaccgacccctctggttcccgggcagcacccctcctccatggctcgatggcagcctccctggagactttggttttgatccccttggtcttgcatctgatcccgagagcttgaaatggaaccagcaggcggagattgtgcactgcagatgggcgatgttgggggctgcgggtattttcatcccggagttcctcacgaagatcgggattctgaacacgccttcgtggtacactgcgggcgaacaagagtacttcaccgatacaaccacgctctttgtcatcgagttgatactcatcggctgggctgagggaaggcggtgggcagacatcatcaagcctggatgcgtgaacacggaccccatcttccccaacaacaagctcaccgggactgacgtaggctatccaggtggcttatggttcgacccactcggttggggatctggttctcccgaaaagatcaaggagttgagaaccaaggagatcaagaacggaagattagccatgctggcagttatgggcgcatggttccaacacatctacaccggaacaggaccaatcgacaacctctttgctcacctggctgatcccggtcacgccactgtttttgctgctttcactcccaagtgagaagaaaagtatcgagctgctgaagaacgtcttagagcaagaatttgacaattatttgtccgatcatatgttgtatgaatacaatcatgttccttcagtctttgtctgatgtagaaaagattatgcagtgtgtacaaatactttaagctctcgcaacttcggaaccta

SEQ ID NO: 5619 - DNA, 1064 bp, Petunia hybrida
tcgagcactgttggccactggaattaactcacttgcattcaagaaaccattaaccaacatggcctctgcttgtgcttcatcaaccattgcagctgttgcattctcttctccaagttcccagaaaaatggatcaattgtaggagcaacaaaggcttctttccttggagggaaaagattgcgagtgagcaaattcatcgctccagttggatcaagatcggtcgctgtctctgctgttgctgctgatccagacagacccctctggttccctggaagtacccctcctgaatggcttgatggaagcctccctggtgactttggtttcgaccctcttggccttggatctgacccggagagcttgaaatggaacgcacaggcagaacttgtgcacagcagatgggctatgctaggtgctgcaggaattttcatcccagaatttctgacaaagattggtgttcttaacacaccttcatggtacactgctggtgaacaagaatacttcaccgatacaaccactcttttcgtcattgaattggtacttattggctgggctgagggaagaaggtgggcagatatcatcaagcctggatgtgtaaacacagatcccatcttccccaacaacaagctcacaggaacagacgtcgggtaccccggaggcttatggtttgatcccttaggttggggatctggttctcctgcgaagatcaaggaattgaggacaaaggagatcaagaatggaagactcgctatgttggctgtcatgggtgcatggttccaacacatctacactggaacaggaccaattgacaaccttttcgctcaccttgctgatcccggtcacgccactatttttgctgctttcagtccaaagtgagaagcaggaggcaccatttgttggcattagtgtgttggggtgacactcagaagaactgaagaaagatttgtagaaattgttttcccacttaatgtatcggtatacttgagtttccactgtgtctatcttcagtgtacaaaatataatatcaggacctcattaggctgcacccatgtgcatgattcaagatctt

SEQ ID NO: 5620 - DNA, 908 bp, Ambrosia trifida
atggcttgtgcctcttctgccattgcagctgttgccttctcttctccaagttcacagaagagtggatcaattgttggatcaacaaaggcttcttttcttggtgggaagaaactgagagttagcaaggtgggtgcaccatccggttcacgatcgttcggaaccgtatgcgcagcagctgaccccgatagacccatttggttccctggcagcaccccaccagaatggctcgatggcagcctacctggagacttcggttttgatcctcttggcctaggatctgatccggagaccttgagatggaacgtacaagcggaacttgtacactgcagatgggcaatgctgggtgcagccggaattttcatcccagaattcctaacaaaaatcggaattttaaacactccatcatggtacactgctggtgaacaagaatacttcactgacaaaaccacactcttcatcattgagcttattttcatcggttgggccgaaggaagaagatgggctgacatcatcaaacctgggtgtgtcaacactgatcccatcttccccaacaacaagctgaccgggacggatgttggatacccaggtggactatggttcgacccacttgggtggggaagtggctcacctgcaaagctcaaggaattgaggcaaaagagataagaatggaagattggctaggttggctgtgatgggtgcatggttccaagcaatctacactggaaccggacccattgacaacctgtttgctcaccttgctgacccgggtcatgccaccatcttcgctgcattcaagggctaatgcatatggaaggaaggacttaaaagagtttttggcaagtggtgtttgtgtgtcattagaaattgtatcttcatcttaatttactgtagataagttttaatgcaat

SEQ ID NO: 5621 - DNA, 795 bp, Flaveria ramosissima
gcttgtgcttcttctgctattgcagctgttgctttctcctccccaagttcacaaaaaagtggatctactgttggatcaacaaaggcttcgtttcttggtggaaagaaactcaaagttagcaagttgggtgcaccatctggttcacgatcgttcgcaaccgtgtgcgccgcggctgatcccgatagacccatctggttcccgggcagcaccccaccagaatggctcgatggcagcctacctggagacttcgggttcgatcctcttggtctaggatctgatcccgagactttgagatggaacgtacaggcggaattagtacactgccgatgggcgatgttaggtgccgccgggatctttatccccgaattcctgacaaaatcggaatccttaacactccgtcgtggtacaccgctggtgaacaagaatacttcacagacaaaaccacactcttcatcattgagcttattttcattggttgggctgaaggaagaagatgggctgacatcatcaaacctgggtgcgttaacacggaccccatcttccccaacaacaagctaactgggaccgatgttggctacccgggtgggctatggtttgacccactcgggtgggggagcggttcgcctgcaaagctcaaggagctgaggacaaaagagatcaaaaatgggaggttagccatgttggctgtgatgggtgcatggttccaagccatctacactggaactggacccattgacaactgtttgcgcaccttgcggacccgggtcacgccaccatttttgctgcattcaaggg

SEQ ID NO: 5622 - DNA, 1310 bp, Malus domestica
atgaagggcccactctcagattctgcatgccacatggcaccccaaaagccaatcggacaccactctcctatcctacaagataagccccttcaattctttacattaactcatctgcgtctctctccccaaacactccaaaccccatacagtttcacagatcaaataagcaacaaagtttggtcgaagcctcgaaaaatggcctccgcctgggctacctcttccgccattgcagccgtcgctgtatcgtcgcgctcccagaagggtgggtcttctttggcggcaactaaggcttctttctttggtgggaggaagctgagagtgagaagcttcacagccaccaaaggatcatcgtcatcttttacagtacgtgcggctgctgctgaccccgatagacctctgtggtttccaggaagcacccctcccccatggctcgatggaagcctgccaggagacttcggcttcgatcctcttggtctttcatctgacccagacagcctgaaatggaaccagcaagcagagcttgtacactgcagatgggcaatgctcggcgcagccggaatcttcatccccgaattcttgaccaaaatcggcattctaaacaccccgtcatggtacacagccggagagcaagagtacttcacagacaccaccactctcttcgtcgttgagcttgttttgatcgggtgggccgaggggaggagatgggccgacatcctcaagcccggctccgttaacaccgacccaatcttccccaacaacaagctcaccgggacagatgtagggtacccgggagggctctggttcgacccacttggatggggaagcggctcgcctgagaagatcaaggagttgaggacaaaggagattaagaacggaaggctagctatgttggctgtgatgggggcttggtttcaacacatttacactgggactggccccatcgacaacctcttcgctcacctcgctgatcccggccatgccaccattttcgcttctttctcccccaagtgaggaacgaaggagaattctaactggggctttcaagtgcgggaggagaaggagcaacgttgtcatcgatccgggaaaagaggctgagaagtattgtgttgttccaagggaaatttgtaggactaaaaacttgtaatttgatgtgcttgtgtacaaaaatctctttggaaccttcgttccaatatgtatgaaatcagctggtgacctacaaacttattccaactgcatatgcatggcatgcaacaatgttaactgatgttcttcttatcaaactagcttgggatttataaacagtaaaatcg

SEQ ID NO: 5623 - DNA, 1279 bp, Coffea canephora
acgtcaaatagattgaagagatatttgccgacatggcctcagcctgtgcttcctccgcgattgctgccgtcgccttctcttcttccccaagctctcagaagaatggatccatcctgggagcaacgaaagcttctttccttagtgggaggaaactgagagtaagccagtacacttctcctcctgctggagcacgatcactgaccatctgtgctgcagctgctgacctcgagagacccatctggttccccggcagcacaccacccccatggcttgatggcagcctcccaggagactttggctttgatcctctgggtctgggatctgacccagagaccttgaggtggaatgtgcagtcggagatcgtgcattgcagatgggccatgttgggtgcagcgggtatttttatccctgaattcttgacaaagattgggatcctgaatacgccatcatggtactctgctggagaactagaatacttcaccgacaccacaacactcttcgtcgttgagatgatcctcatcggttgggccgagggaagacggtgggcggacatcatcaagcctggatgtgtgaacactgaccccatcttcccaaacaacaagcttactggaactgatgttggctacccaggcggcctgtggtttgaccctcttggctggggaaccggctctcctgagaaagtcaaggaattgaggacaaaagagatcaagaatggaaggttggcgatgttggctgtaatgggtgcatggttccaacacatctacactggtacaggaccaattgacaacctctttgctcaccttgctgatcctgggcataacaacgtttttgctgctttcaccaacaagtgagggaaggaagcagcagctcaaaagattcaagtgctgaagacacgggggacagcatcatgatggaaaacattttagaactgtgttttctaagtgatgatgtattgtttgaaatcttgtattgtctctgtctctgtctgctgtagagaatacctaatgcagtgtacaaactccaccccattattttgaacccatgttctcgagaaaagtaacaatagatccacccatatgcataacagggaaattcccagagtgacttggtggactaactaatacagcgggtacatataagcctccagatagataagcatgaagcaccaaatctcaggattgatggtgtttacaatcagcaaacaacatagccggtatgaatgaagacaatttaacgtcagctaccggatcggttttcttggtctgaactttgtaggagg

SEQ ID NO: 5624 - DNA, 1301 bp, Quercus alba
acaacttcactctcctatcctttaagataagcccctgcttacattaactacattttcatgtattttgttcccatacaccaatcaagcgcaacaccaattctttgaagaaaatcttggccgatagcctaaaatggcttctgtttgtgcttcttctgccattgcagccgtggccatctcttcccccagttcccagaagaatggatctatattgggaggaacaaaagcttctttcctaagtggggggaaactgagagtggtgagaaaatatacagcacccaacgcaaaacgttcagtttcggtgtgtgctgtagctgaccctgataggcccctctggttcccaggaagcgtccctcctccatggcttgatggaagcctcccaggagactttggttttgatcctctgggtcttggatctgatccagagaccctgagatggaatgtacaatcagagattgtgcactgcagatgggcaatgttaggtgctgcaggtattttcattccagagttcctaacaaagattggtatcttgaacaccccttcatggtactctgctggagagttggaatacttcactgacacaaccaccctcttcattatcgagctaatcttaatcggctgggccgagggaagacggtgggcagacatcctcaagccagggtccgtaaacacggaccccatcttccccaacaacaagctcacagggacagacgttggttatcctggaggactttggttcgacccacttggatggggaagtggttctcccgagaaagtcaaggagttgagaacaaaagagattaagaatgggaggctggctatgttggctgtgatgggtgcatggttccaacacatttacacaggcacaggccccattgacaacctctttgcccaccttgctgatcctggtcatgccaccgtttttgctgtaagtgaagcccttaagagttgaagcagtacaacttgctataattattaattacatcaatatcaagtaccatgaaatagatttagttgtatatgctaactgtttgtatggtttattgcaggctttcaccccccaagtgagaaagcaaggaagaatgctgtctatgattagaagtgtgggagagacattggatgaacatgttgacctaagaaggccgcttagaatgtgtattttcagaaaggaatgcttgtttaattgaaacttgtattgtctttgtatgtcttctacagaatgttaatccaatgtacaaatacctcttttaatttagatgccgtgaatataagttcaggtagtaattaatgagaaaaaaaaaaaa

SEQ ID NO: 5625 - DNA, 1210 bp, Vinca minor
agtaggaaatggcctctgcctttgcttcttccaccattgccgccgccgtcgccttttcttcttccccaagctctcagaagaatggatccattattggagcaactaaagcttctttccttggagggaggaaagttagagtaagcaaatttaccagtagtccggcaggagggcgatcagtcactactgtctgcgctgcagctgaacctgacaggcccctctggttccctggtagcagccctcctccatggcttgatggcagcctccctggagactttggttttgatcctctaggtcttggatccgaccccgagacattgaaatggaatgtgcagtcagagctagtacactgcagatgggcaatgttgggagctgcaggtatattcatcccagagttcttgacaaagataggaatcctcaatacgccatcttggtacacagctggggaacaagaatacttcacagacacaaccaccctcttcgttattgagttgattcttatcggttgggctgagggaagaagatgggctgacatcctcaagcctggaagtgtgaacactgatcccatcttccctaacaacaagcttactggtactgatgttggataccctggtggtctttggtttgatccactcggttggggaagcggttctcctcagaaactcaaggaattgaggacaaaagaaatcaagaacggaagattggcaatgttagctgttatgggagcatggttccaacacatctacaccggtactggaccaattgacaacctcttcgctcaccttgctgatcctggacacgccactgtcttcgctgcttttacctcaaagtgatagaagaaaggaagagttgcttggattcaagtgttgagaaataccaagtgatgaaatatcattaaatcttgtattaccgctgtctatgtctgctgtagagaaaagctaatccattgtacaaatacctcaagaacttctcagcatcataatgaacccaagttctcatggaaattgcttataactggtaaatatcataagagaaacctagattagttaacatagcttaagactggtagaaacaagatactacctcctagtggtaagacgttttgtttcaaaatcaaaagcaattactatccaactagactagcagcacctgcaagaactatttttttgtttgtctaattcggcatcctagtggtaaacttacttgacctaat

SEQ ID NO: 5626 - DNA, 1176 bp, Flaveria ramosissima
ggaaactacctatttctccatcatcaaatctacacccaaatatttacacaacaacaatggcttccactgcttgtgcatctctgccattgcagctgttgctttctcttctccaagttcacagaagagtggatctattgttggatcaacaaaggcttcttttcttggtgggaagaagctgagagttagcaaattgggtgcaccatccggttcacgatcgttcggaaccgtgtgcgttgcggctgatcccgatagacccatttggttccccggtagcaccccacccgaatggctcgatggcagcctacccggagacttcgggttcgatcctcttggcctaggatccgaccccgagaccttgaaatggaacgtgcaggcggaactcgtgcactgcagatgggcaatgttaggtgcagccgggatattcatccccgaattcctaacaaaaatcggaatcctgaacactccttcatggtacaccgcgggtgaacaagagtacttcaccgataaaaccaccctcttcatcatcgagcttattttcatcggttgggccgaaggcagaagatgggctgacatcatcaaacctgggtgtgttaacactgacccaatcttccccaacaacaaactaaccgggaccgatgtgggctacccggggggcctatggttcgacccactcgggtggggaaccggctcccctgcaaagctcaaggagttgagaaccaaagagatcaagaatggtagattggctatgttggctgtgatgggtgcatggttccaagccatttacaccggaaccggacccattgacaacctgtttgctcaccttgctgacccgggtcacgccaccatcttcgctgcattcaagggctaaagatattggcttgaaggatttgaagagtttgtgataagtggtgtttgtgtaacattagaaattgtatgtgtagaaaagttttaatgcaatgtacaaatacctctttgaactccaaatgttgtatgtcattcaatcgaactacttcacatggatttgaaatccataagcaaaacaggcacatcactacaatcaagtggttattacaaattaaaacataattagaggcttttccaaaagttttatttgcgtagaatttggtatacattttagtgtcatttatctaatactaattaccaacttaattaatt

SEQ ID NO: 5627 - DNA, 1246 bp, Arnica chamissonis
tcgatattcatggatcacccaatcagtcttttcgcctttcggagctcttcctctataaaaaacaagtgttttcttcatacccacaagcgatttctctttgaaaatctccttatcttttcctgtagctttccaataccctgcacttgtagctctgttcgttcttgatccagtcgggtacttccgatctcgaacactaaaaaagaaccattcttgctcaccaaatcttgaaggcaaaataattacagaaaaacaatggcttccactgcttgtgcttcttccgccattgcagctgttgctttctcttctccaagttcacagaagagtggatcaattgttggatcaacaaaggcttcttttcttggtgggaagaaactgagagttagcaagttgggtgcgtcatccggttcacgatcgttcggaaccgtgtgcgttgcggctgaccccgatagacccatctggttccctggcagcactccaccagaatggctcgatggcagcctacctggagacttcggttttgatcctcttggcctaggatccgatccggagaccttgaaatggaacgtacaagcagaactagtacactgcagatgggcaatgttaggtgcagccgggattttcatcccggaattcctaacaaaaatcggaatcttaaacaccccttcatggtacaccgccggtgaacaagaatacttcaccgacaaaaccacactcttcatagttgagcttattttcattggttgggcagaaggaagaagatgggctgacatcatcaaacctgggtgcgtcaacactgaccccatctttcccaacaacaagctaacgggaaccgatgttgggtacccgggtggactgtggttcgacccgctcgggtggggaagcggctcacctgcaaagctcaaggaattgaggacaaaagagatcaagaatgggagattggctatgttggctgtgatgggtgcatggttccaagccgaatacactggaaccggacccattgacaacctgtttgctcaccttgctgacccgggtcacgccaccatctttgctgcattcaagggctaaacatattgcaggaggaaggatttgaagagtttttggcaagtggtgtttgtgtatcattagaaattgtatctctatctttactgtagaaaagttttaatgcaatgtacaaatacctgtttcaactccaattaattattgcatatataatcaagcttctatgtcatccaatccaacttcacat

SEQ ID NO: 5628 - DNA, 986 bp, Cicer arietinum
gagattctacatgccacatggcaacactccatctaataccaaattcacattcctatcctttaagataagaaacatttgcatacattaataaaaatttgcacattttctttctcattcaccatccaaataattcacatcaacacaaactcactaagcttagtcactttatcccttgagggcaaaggcagctatcatggcttctgcttgtgcttcttctgccattgcagctattgccatctctaccccaagttctcagaagaatggatcagccttaggaatcacaaaagcttttcttgggaggaaactgaaggtgaacaacaacacatcagttagagtaagatctgctgccacaacaaagtgtgcagtagctgagcctgataggcctatttggttcccaggaagcacacctcctgcatggcttgatggcagtctccctggagtattttgggtttgatcctcttggtcttggatctgatccagagagcctaagatggaatgttcaagcagagctagttcactgcagatgggcaagtgttaggtgcagctggtaattttcattccagtaattcctaacaaagtattggtatcttgaacacaccatcatggtacactgctggagagcaagagtatttcacagacaccaccacactcttcataattgaactccttttcattggttgggctgagggtagaagatgggctgacataatcaatcctggttgtgtcaacactgaccctatcttaccaaacaacaagctcacaggaactgatgtgggcctacccaggtgggcttttggtttgacccacttgggtggggaagtgttctactaaaaaactaaggagttgagaacaaaggaattaagaatggaagattggctatgttggctgtgatgggagcttggttccagcatatatacacaggcactggtcctattgataacctctttgctcaccttgctgatcctggacatgctactatttttgct

SEQ ID NO: 5629 - DNA, 986 bp, Flaveria ramosissima
tcttcttcctcacaaacctattatttctccatcatcaaatcctcaagcccaaattatttacacaacaacaatggcttccactgcttgtgcttcttcagccattgcagctgttgctttctcttctccaagttcacaaaagagtggatctattgttggatcaacaaaggcttcttttcttggtgggaagaagctgagagttagcaaattgagtgcaccctccggttcacgatcgttcggaaccgtgtgcgttgcggctgaccccgatagacccatttggttccccggcagcactccacccgagtggctcgatggcagcctacctggagacttcggtttcgatcctcttggcctaggatccgatcccgagaccttgaaatggaacgtgcaagcggaactcgtgcattgcagatgggcaatgttaggtgcagccgggatcttcatccccgaattcctaacaaaaatcggaatcctgaacactccttcatggtacaccgcgggtgaacaagagtacttcaccgataaaaccaccctcttcatcatcgagcttattttcatcggttgggccgaaggcagaagatgggctgacatcatcaaacctgggtgtgttaacactgacccaatcttccccaacaacaagctaacggggaccgatgtgggctacccaggtggactatggttcgacccactcgggtggggaaccggctcgcctgcaaagctcaaggagttgagaaccaaagagatcaagaatggtagattggctatgttggctgtgatgggtgcatggttccaagccatttacaccggaaccggacccattgacaacctgtttgctcaccttgctgacccgggtcacgccacaatctttgctgcatttaagggctaaagatattggcttgaaggatttgaagagtttgtgacaagtggtgtttgtgtaacattagaaattgtatgtgtagaaaagttttaatgcaatgtacaaatacctc

SEQ ID NO: 5630 - DNA, 1109 bp, Flaveria ramosissima
cttcctcacaaacctaccatttctccatcatcaaatcttcaagcccaaattatttacacgtacaacgacaatggcttccactgcttgtgcttcttctgccattgcagctgttgctttctcttctccaagttcacagaagagtgggtctattgttggatcaacaaaggcttcttttcttggtgggaagaagcttagagttagcaaattgagtgcaccatccggttcacgatcgttcggaaccgtgtgcgttgcggctgaccccgatagacccatttggttccccggtagcaccccacccgaatggctcgatggcagcctacccggagactttgggttcgatcctcttggcctaggatccgaccccgagaccttgaaatggaacgtgcaagcggaactcgtgcactgcagatgggcaatgttaggtgcagccgggatcttcatccccgaattcctaacaaaaatcggaatcctgaacactccttcatggtacaccgcgggtgaacaagagtacttcaccgataaaaccaccctcttcatcatcgagcttattttcatcggttgggccgaaggcagaagatgggctgacatcatcaaacctgggtgtgttaacactgacccaatcttccccaacaacaagctaacggggaccgatgtgggctacccaggtggactatggttcgacccactcgggtggggaaccggctcgcctgcaaagctcaaggagttgagaaccaaagagatcaagaatggtagattggctatgttggctgtgatgggtgcatggttccaagccatttacaccggaaccggacccattgacaacctgtttgctcaccttgctgacccgggtcacgccacaatctttgctgcattcaagggctaaagatattggcttgaaggatttgaagagtttgtgacaagtggtgtttgtgtaacattagaaattgtatgtgtagaaaagttttaatgcaatgtacaaatacctctttcaactccaaatgttgtatgtaatccaatccaactacttcacatggatttggaaatcacaagcaagacatgcacttcactacaatcaaataagtaaagtttgatttgcaaaaacaaacatc

SEQ ID NO: 5631 - DNA, 901 bp, Flaveria ramosissima
caacaatggcttccactgcttgtgcttcttccgccattgcagctgttgctttctcttctccaagttcacagaagagtggatctattgttggatcaacaaaggcttcttttcttggtgggaagaagctgagagttagcaaattgggtgcaccatccggttcacgatcgttcggaaccgtgtgcgttgcggctgaccccgatagacccatttggttccccggtagcaccccacccgaatggctcgatggcagcctacccggagacttcgggttcgatcctcttggcctaggatccgaccccgagactttgaaatggaacgtgcaggcggaactcgtgcactgcagatgggcaatgttaggtgcagccgggatattcatccccgaattcctaacaaaaatcgggatcctgaacactccttcatggtacaccgcgggtgaacaagagtacttcaccgataaaaccaccctcttcatcatcgagcttattttcatcggttgggccgaaggcagaagatgggctgacatcatcaaacctgggtgtgttaacactgacccaatcttccccaacaacaagctaaccgggaccgatgtgggctacccagggggcctatggttcgacccactcgggtgggggaccggctcgcctgcaaagctcaaggagttgagaaccaaagagatcaagaatggtagattggctatgttggctgtgatgggtgcatggttccaagccatttacaccggaaccggacccattgacaacctgtttgctcaccttgctgacccgggtcacgccaccatcttcgctgcattcaagggttaaagatattggcttgaaggatttgaagagtttgtgataagtggtgtttgtgtaacattagaaattgtatgtgtagaaaagtttta

SEQ ID NO: 5632 - DNA, 1498 bp, Vitis vinifera
caaaataatgagggagagagggaggggaggcaaagatgtgatagtgacatgagatatgaggggaatgggcttagaatatgaaccaccagcttctgattattccaggtaggcttatgaaactggaggtggatgtgcttcttattagattcttccttccacatggcaacccaccagccaatcacacccctattctccctatcctttaagataagccccctctctttcatacattaacaagtaacaccctcctcatgtctttacttcttctccatatcccaccaccaatcaattaaccttctccattgctgatcacaaaccctcctccatggcctctgtctgtgcctcctccgccatggctgctgttgccaccatctctcccagttctcagaagactgggtctgttgtgggagcaaccaaggcctcttttcttggggggaagagactgagcctgaagaagttcacggcaccggcagctgggacgcggtcttttactgtatccgcggcggcggcagatcctaacaggcctctttggttcccaggcagcacccctcctccatggcttgatggcagccttcctggagactttggtttcgatccccttggccttggatctgatccagagacactgaaatggatggttcagtcagagatagtgcactgcagatgggcaatgttgggagcagctggaattttcatcccagagttcctaacaaaaattgggatactaaacaccccatcctggtacactgctggagaattggagtacttcaccgacaaaaccacactcttcattgttgagatgattttcatcggttgggctgaggggagaagatgggctgacatcatcaagcctgggtgcgtcaacactgaccccattttccccaacaacaagctcaccgggactgatgttggctacccaggtgggctctggttcgaccctcttggctggggaagcggttcgcccgacaagatcaaggagttgagaacaaaggagatcaagaatgggagattggctatgttggctgtgatgggtgcttggttccaagccatctacactggcactggccccattgacaacctctttgcccaccttgctgatcccggacatgccaccatttttgctgctttcacccccaagtgacagaagcaaaggagaatggtatcttctaggaaaacattggtgaaacatgtttggagaccaagaaaggacatgggaaaatgtgtgtttttcagagaaatgtttgtatcattggaacttgtattgcctctgattatgtcttctaaagaatgctcatgcagtgtacaaatacctctattaacttagattccatttaaacaagttggtcgtcacaaaatatgtccatgaaagtatccatttgtctaacagatggaaagaaaatagtaaaaaactggcaaagaaactcaaagcccatgattgtagatttataaaatggtagagatcttgttgaagaactctcttactgaaaatttgaacaag

SEQ ID NO: 5633 - DNA, 1021 bp, Lactuca sativa
aacctactcattcttcatcactaattcttgaaggcaatatctgaagagacaacaatggcttccactgtttgtgcttcttcagccatcgcagctgttgctttctcttctccaacttcacagaaaaatggatcttttgttggatcaacaaaggcttcgtttctttgtgggaagaaactaagagttagcaaagtcactgccccaaccgtcgcacgatcttccggcacagtatgcgtcaccgccgaccccgaaagacccatttggtttccaggcagcacccctccggagtggctcgacggcagcctacccggagacttcgggttcgatcctcttggtctaggatccgacccggagaccttgaggtggaacgtgcaagctgaattagtacactgcagatgggcgatgttaggagcagctgggatcttcatcccggaattcctaaccaaaatcggaatcctaaacactccttcatggtacacagccggtgaacaagaatacttcaccgacaaaaccacactgttcatagtggagcttattttcatcggttgggcagaaggaagacgatgggctgacattctcaaacctggctgtgttaacaccgatcccatcttccccaacaacaagctaacaggtacagatgtcgggtacccaggtggactatggttcgacccattcggatgggggaatgcttcacctgcaaagcttaaggaattgagaacaaaggagatcaagaatgggagattggctatgttggctgtgatgggtgcttggttccaagcaatctacactggaactggacccattgataacctctttgctcaccttgctgacccgggtcacgccactatttttgctgcattcaagggttaaatagcaagggtttgttgagattatgatcttcagatgatgctggggaggaaaaatggtggatttaacagtttttggcaagtcatgtgtgtgtatcattagaaattgtatcttgtctctactgtagaaacttaaatgcatgtacaaatacctcttt

SEQ ID NO: 5634 - DNA, 1019 bp, Elaeis guineensis
ctagctaccaccagaaacagggcaacatggcttcagtctgtgcctcctcttctgctgttgccgctgttgccagttctcagaagactgggaatggactgggtgcaacgaaggcatccttcctcggaggaacaaaattaaggcagaagaagtggacagcacccaccgcacgccgagcactttcagtgtctgctgaagcaatatctgagaggcccctctggttcccaggcagcacccctcctccatggcttgatggaagcctcccaggagattttggatttgaccccctaggccttgggtctgacccagagagcttaagatggaaccaacaggcagaactcgtgcactgccgatgggcaatgttgggggccgcaggaatcttcatccctgaattccttacaaagattggcattctcaacactccctcatggtacacagctggagagctggaatacttcacagacaccaccacccttttcgttattgagctcatcttcattggttgggctgaggggagaaggtgggccgacatcatcaagcctgggtgtgtgaacactgatcccatcttccccaacaacaagctcactgggactgatgtaggatacccaggtggattctggtttgacccactgggatggggaagtggttcccctgagaaggtcaaggagctgaggaccaaggagatcaagaatggaaggctggcaatgttggcagtgatgggtgcctggttccaagccatctacactggcactggcccaattgataacctctttgctcaccttgcagacccaggccacgcaactatctttgctgctttcactccaaagtgaaggaggatcagatgagcattgtctgtggtcaacatggggcagaatgatgtaaatcttttgcagaaatggaagctgagctgaagagaggagagtaatgtcatggatgcttgtatcattaaaaataatgcttgctttatgcttaagtgattaatgtaacaagtggatagtgtacaaataactttagaagtcttg

SEQ ID NO: 5635 - DNA, 950 bp, Olea europaea
atggcggcccctgcctgtgcttcatcgaccattgcagccgttgctctctcatcaaccagagcaacaaaggcttcgttcttatcagggagaaaactgagagtaagcaagaatgttacatcaaccggagtgagatcagttactgtctgtgctgcagctgatcctgacagaccattgtggttccctggaagtacccctccaccgtggctcgatggcagtctccctggagactttggctttgatcctcttggcctagcgtctgatcctgagagcttgaaatggaaccagcaagcagagcttgtacactgcagatgggccatgttaggtgctgcagggattttcatccccgagttcctgacaaagattggcatcctaaacactccttcatggtacactgctggcgaacaagaatacttcactgataccacaacactcttcatcgttgaattgattttcattggttgggccgagggaagacgatgggcagacatcatcaaacctgggtgcgtgaacaccgaccccatcttccccaacaacaagctcacaggaactgatgttggctaccccggtggcctctggttcgacccactaggatggggatctggatctcctgaaaaagtaaaggagttgaggacaaaggagatcaagaatggaaggttggccatgttggccgtgatgggagcatggttccaacacatttacaccggaacaggacctattgataacctctttgctcaccttgccgatcccggccatgccaccatttttgctgctttcagccccaagtgaaagaagcaatgaagtcactttaacgcggaagtatgggagaaacaccagcaacaatcattttggacaaagtattgacagcgtgttttcccaattgatgttgtatcatcgagatatgtattgcctacatatttgtctgctgtagaaaaaggtttatgcagtgtaac

SEQ ID NO: 5636 - DNA, 1072 bp, Flaveria ramosissima
tatttctccatcatcaaatcctcaagcccaaattatttacacaacaacaatggcttccactgcttgtgcttcttcagccattgcagctgttgctttctcttctccaagttcacaaaagagtggatctattgttggatcaacaaaggcttcttttcttggtgggaagaagctgagagttagcaaattgagtgccccatccggttcacgatcgttcggaaccgcgtgcgttgcggctgaccccgatagacccatttggttccccggtagcaccccacccgaatggctcgatggcagcctacctggagacttcgggttcgatcctcttggcctaggatccgaccccgagaccttgaaatggaacgtgcaagcggaactcgtgcattgcagatgggcaatgttaggtgcagccgggatcttcatccccgaattcctaacaaaaatcggaatcctgaacactccttcatggtacaccgcgggtgaacaagagtacttcaccgataaaaccaccctcttcatcatcgagcttattttcatcggttgggccgaaggcagaagatgggctgacatcatcaaacctgggtgtgttaacactgacccaatcttccccaacaacaagctaacggggaccgatgtgggctacccagggggcctatggttcgacccactcgggtggggaaccggctcccctgcaaagctcaaggagttgagaaccaaagagatcaagaatggaagattggctatgttggctgtgatgggtgcatggttccaagccatttacaccggaaccggacccattgataacctgtttgctcaccttgcggacccgggtcacgccaccatcttcgctgcattcaagggctaaagatattggcttgaaggatttaaagagtttgtgacaagtggtgtttgtgtaacattagaaattgtatgtgtagaaaagttttaatgcaatgtacaaatacctctttcaactccaaatggtgtatgtcatattgtcatccaatccaactacttcacatggatttggaaatcacaagcaaaacatgcacttcactacaatcaaataaaggtt

SEQ ID NO: 5637 - DNA, 1159 bp, Mimulus guttatus
acttctcacacatcaaacacacacatcaaacacaccacaaacacacacatcaaacacttgcagaaaaacactccaacaatggcttccgcctgtgcttcatcagccatcgccgctgtcgtcgccgtttcttccccaagttcacaaaagaatggagcgattgtgggagcaacaaaggcttctttctttggaggaagaaaattgagagtgagtaagtttgcagcaccttccaacacaagatcggttgccgtgtgcgttgcggccgatccagatagacctatctggttccccggtagcacccctcccgaatggctcgacggcagcctccccggagatttcggattcgaccctcttggcctaggatccgacccggatagcttgaaatggaacgcgcaggcggagctagtgcactgcaggtgggccatgctaggcgccgccggaatcttcatccccgaattcctcaccaaaatcggaatcctcaacactccttcatggtacacggccggcgaacaagagtacttcaccgacacaacaacactcttcatcgtcgagctcgttctaatcgggtgggccgagggtagaagatgggccgacatcatcaagcccggaagtgtgaacaccgaccccattttccccaacaacaagctcacgggtaccgacgttggctacccgggcgggctttggttcgacccccttggatatggatccgggtcgcccgcgaaaatcaaggagatcaggactaaggagatcaagaacgggagacttgccatgctggcggtgatgggtgcgtggttccagcacatctacaccggaacgggccccattgataacctatttgctcaccttgccgatcccggtcatgccaccattttttctgcattcagccccaagtgagggagaatgttggagagatgccagccagcagccacgatttatctgggaaaggagtcgatttttttctcagtgtgttttttttttcttttccccaaaaatttaatgttgcattgttagatatgtaatgatattatatatctatatgtgatgtagaaaagagcttgtgcagtgtacaaatatttaccttcaagagatcgtaaaccccataaagccctgttcataaatctcggaatttgcacgatcgaagaaacttaaaagtcaatttatc

SEQ ID NO: 5638 - DNA, 1697 bp, Fragaria vesca
gttccaggtaagctcaagaactggaggtgaagaaggtgaagggggcctagtatcagattctatatgccacatggcaccccaaaaaccaatcggacacctctctcctatcctttaagataagcaaacccttcatacattaacacattttcattgtcatactatatcaaagaaagaaaaaagcttgaattggttacatcctcatagtcaaaaatggcttctgcttgggcttcctctgccattgcagctgtatcttctcctagctcgcagaaagctgggtctgctttggcagcaacaaaggcttcgttttttggcgggaggaagttgagagtgagaaacgtggcagcaccgagtggatcatcatcaacatccttcagggtatgtgccgctgcagctgaccctgacagacccttatggttcccaggcagcaccccacctccatggctcgatggaagcctcccaggagactttggctttgatcctcttggtctttcatctgaccctgacagcctaaagtggaacacgcaagctgagattgtacactgccggtgggcgatgttgggtgccgccgggatcttcatcccggaattcttgacaaagattggcatcctaaacactccttcatggtacacagcaggagaacaagaatacttcactgacacaaccacacttttcattgttgagctgattttcatcggctgggctgagggcaggagatgggctgacatcctcaagcctgggtctgttaacactgaccctatcttccccaacaacaagctcactggcacagacgttggatacccaggagggctctggtttgacccacttggatggggaagtggctcacctgagaagatcaaggagttgaggacaaaggagatcaagaatgggagactggctatgttggctgtgatgggtgcttggtttcaacacatttacaccggtaccggaccaattgacaacctctttgctcaccttgctgatcctggccacgccactgtcttctctgctttcaagggatgaaaaaatatgggagagttccgattggattcaagtttggaagaaggggcaactatggtgatcacatatcattaatctgaggacagaggcttacggtttatgtttgaagccaagggaaatttgtaggactattactcgtaaacttgttatgtgatttgattagaaccatcttctggtgtacaaatatctgtttggacttgaactccataaatatgtattgaatcagttgttaacggacaatgtttgttaagtgaagcaccactcctgtgatggaaaatctccaatgattaacatgaatctgcaattcatgcaacatattgaaacacctaacacaaagaaatcgaaacttcgaaacccatgtcacagattaaggtttaaactttaaagagagcatgactttcaccagatctgagcatcaaatcctcacttgtgcagaacataaagaatactcatttagaactacaaaaacttagctctcatttcttttggattccagctaactatcacaaggttaatgcctcaaatttttttattcgggaagaggcaagtctgatagtcagatgagcagttacatatttagtcgtctgatattccatattatatcagatacagaggataaagtcatattggtattcaagatctacctcaccatttcctcaagttgataaaagaaaaacatt

SEQ ID NO: 5639 - DNA, 1101 bp, Carpinus betulus
cacgtatttgatttccatacaccaatcacacgctcaccgaagaaaatctagtctgaaaagctacaatggcttctgcttgcgcttcctctgccgttgcagccgtggccatctcttcccccagttcccaaaaggctggatgtttagtgggtgcaacaaaagcttgtttccttagtgggaggaaactgagagtgagaagctatacagcagccaccggaaggcgttcactttcggtgtgtgccgcagtggcagagcctgataggccaatctggttcccaggcagcgtccctcctccatggcttgatggcagcctccctgcagactttggttttgatcctctcggtctaggatctgatcctgagaccctgagatggaacgtacaatcagagatagtgcactgcagatgggcaatgttagggccgcgggtattttcattccagagttgctaacaaagatagggatcctcaacaccccatcatggtacagtgctggagagctggaatacttcactgacaccaccaccctcttcattattgagctcatcttaatcggctgggcagagggaagacggtgggctgacatcctcaagccagggtccgtaaacacagaccccatcttcccaaacaacaagctcacaggcacagacgtcggctaccctggagggctttggttcgacccacttggctggggaagtggttctcctgagaagatcaaggagttgaggactaaagagatcaaaaatggcaggctcgctatgttggccgtcatcggtgcctggttccaacacatttacaccggcaccggacccatcgacaacctttttgcccacctcgccgaccctggccatgccaacgtttttgctgctttcaccccgaagtgaggagcaatgctgtgtggtagtactatgattacaagtgtgggagtacgtgagactgggcggacatgttttcctaagaaggcaactgcttaaaggatttgtgttttctgaaaaggaatgtttgtaccaatggaacatgtttgtgtctttgtttatgtcttctagagaatgctcattgcaatgtacaaatgcctcttttaactagagatgtcatgaatataataata

SEQ ID NO: 5640 - DNA, 920 bp, Ambrosia trifida
aaaaacaatggcttgtgcatcttctgccattgcagctgttgccttctcttctccaagttcacaaaagagtggatcaattgttggatcaacaaaggcttcttttcttggtgggaagaaactgagagttagcaaggtgtgtgcaccgtctggttcacgatcgtttggaaccgtatgcgttgcggctgaccctgatagacccatttggttccctggaagcaccccaccagaatggctcgatggcagcctacctggagactttggttttgatcctcttggcctaggatccgatccagagactttgagatggaacgtacaagcggaactcgtacactgcagatgggcaatgttaggtgcagccgggattttcatcccggaattcctaacaaaaattggaatcttaaacactccatcatggtacactgctggtgaacaagagtacttcaccgacaaaaccacgctcttcatcattgagcttatattcatcggttgggcagaaggacgaagatgggctgatattatcaaacctgggtgtgtcaacactgatcccatcttccccaacaacaagctgaccgggacagatgttgggtacccaggtggactatggttcgacccactcgggtggggaagtggctcacccgcaaagcttaaggaattgaggacaaaagagataaggaatggaagattggctatgttggctgtgatgggtgcatggttccaagcaatctacactggaaccggacccattgacaacctgtttgctcaccttgctgacccgggtcatgccacaatcttcgctgcattcaaaggctaatgcatatggaaggaaggacttaaagagtttttggcaagtggtgtttgtgtgtcattagaaattgtatcttcatcttgatttactgcatgtagagaagttttaatgcaat

SEQ ID NO: 5641 - DNA, 1075 bp, Tragopogon dubius
atcactaaatcttgaaggcaaagatttgcagacaacaatggcttcctgtgcttcttcagctattgctttctcttctccaagctcacagaagagtggatctgttgttggagcaacaaaagcttctttccttggtgggaagaaactgaaagttagcaagttcgctgcacctgccggagcacgatcggtgagcccagtatgcgttgcagccgaccccgaaagacccatttggttccctggcagcacccctccggagtggctcgatggcagcctaccaggagacttcgggttcgatcctcttggtctagggtccgatccggagactttgaaatggaacgtgcaagcggaaatagtacactgcagatgggcaatgttgggagcagctgggatctttatcccggaattcctaactaagatcggaatcctaaacactccttcttggtacactgccggagaacaggaatacttcaccgacaaaaccacactgttcatagtggagcttattttcattggttgggcagaaggaagacgatgggctgacattctcaaacctgggtgtgtgaacaccgatccaatcttcccgaacaacaagctaacaggcacagatgtcgggtacccaggtggactatggtttgacccactcggatggggaagcgggtcacctgcaaagatcaaggagttgaggacgaaggagatcaagaatggaagattggccatgttggctgtgatgggtgcttggttccaagcaatctacaccggaaccggacccattgacaacctctttgctcaccttgctgatcccggtcacgccaccatctttgctgcattcaagggctaattaaacagcaaagggttgatgatattatgacctttggagagcagaaatggtggatttaaacagtttttggcaagtgatgtgtgtgtatcattagaaattgtatcttgtctctactgtagaaagttaatgcaatgtacaaatacctctttgaaatcaaaccgatgcatatataggcttgtatgttaatgaaatgctccactacaaaacggaaaaactttaacctacgctaaataagaaaaa

SEQ ID NO: 5642 - DNA, 1045 bp, Linum usitatissimum
gatcaaaccaaagtggatatggcttctgtttgtgcttcctccgccattaccgcagtctcttctccaagctcacagaagaatgggtcgtcggcggggttcctgagcgggaagagattgacgggtgtgaacaggttttcgtcgccgtcgatcagtggtcgtcgacggggaggtctgaccgctgtttgtgcagtggctgatccagagagaccgatttggttccctgggagcactcctcctgtttggctcgacggcaccctccctggtgactttggctttgatccacttggcctaggatccgacccggaaaccctgagatggaacgtacaagccgagctagtccactgccggtgggcaatgctgggagccgccgggatcttcatcccggagttcctcaccaagatcggaatcctcaacactccgtcgtggtacaccgccggcgagcaggaatacttcactgacacaaccactttgttcattgtcgagctcatcttcatcggttgggccgagggcaggagatgggccgacatcttgaagcccggttgcgtcaacaccgacccaatcttccccaacaacaagctgactggaaccgacgtgggctacccgggtgggctgtggttcgaccccctcgggtggggaagcggttctcccgaaaagctcaaggagctgaggacaaaggagatcaagaacggcaggttggctatgttggccgtgatgggtgcttggttccaacatatatacaccgggaccggcccgatcgataacctcttcgctcacctcgccgatcccggtcacgccactatttttgctgcattcacacccaagtgaggaaatgaatgggccatggcaaggaagggagatttgaattctagggtttttggtattgtgggaaagcaaaatttgtgatgttgtaagtggtggaagtttgtgcttgactctttggtaatgggttgtctagtggaaatgcttgttgaatgtacaaaatcttagaaaattcctctttgtacgtatttgatgcctatgaacaatatatgcccactgatctagc

SEQ ID NO: 5643 - DNA, 1084 bp, Linum usitatissimum
ggcaaaataaaaccaaatggcttctgtttgtgcttcctccgccattaccgcagtctcttctccaagctcacagaagaatggatcgccggcggggttcctgagcgggaagagattgacgggtgtgaacaggttttcatcgccggcgatcagtggtcgtcgacggggaggtctgacggcggtttgtgcagtggctgacccagagaggccgatttggttccctgggagcactcctccagtttggctcgacggcaccctccccggagactttggcttcgatccacttggcctaggatccgacccggaaaccctgagatggaacgtacaagccgagctagtccactgccggtgggcaatgctgggagctgccgggatattcatcccggagttcctcaccaagatcggaatcctcaacactccgtcgtggtacaccgccggcgagcaggaatacttcaccgacacaaccaccttgttcattgtcgagctcatcttcatcggctgggccgaaggcaggagatgggccgacatcttgaagcccggttgcgtcaacaccgacccaatcttccccaacaacaagctgaccggaaccgacgttggctacccgggtgggttgtggtttgacccgctcgggtggggaagcggttcacccgagaagctcaaggagctgaggaccaaggagatcaagaacggcaggttggctatgttggctgttatgggtgcttggttccaacatatatacaccgggaccggtcccatcgataacctcttcgctcaccttgccgatcctggtcacgccactatttttgctgcattcacacccaagtgaggaaatgaatgggccatggcaaggaagggagattcaaattttagggtttttggtgttgtggggaagcaaaatttgtgatgttgtaagtttgtgcttgactctttggcaatgggttgtctagtggaaaagcttgttgaatgtacaaaatcttagaaattccctctttgtacttataacttgatgcctatgaacaatatatgcccactaatctacctatttcgagctatccacgtgatttttcatcgtgagtgtgccgggtat

SEQ ID NO: 5644 - DNA, 1179 bp, Malus domestica
tctctctccccaaacatccaaaccccatacaatttcacagatcaaataagcagcaaagtttggttgaagtctcacaaaatggcctccgcttgggcttcctcttccgccattgcaaccttcgccgtatcttcacgctcccagaagggtggggctactttggcagtgaccaaggcttctttctttggtggaaggaagctgagagtgagaagcttcacagcacccaccggatcatcgtcatcttttacagtacgtgctgctgctgctgaccctgatagacctctgtggtttccgggaagcacccctccaccatggctcgatggaagcctcccaggagactttggctttgatccgcttggtctttcatctgacccagacagcctgaaatggaaccagcaagcggagcttgtacactgcagatgggcaatgctcggcgcagccggaatcttcatccccgaattcttgaccaaaattggcattctaaacaccccatcatggtacacagccggagagcaagagtacttcacagacaccaccactctcttcgtcgttgagcttgttttgatcgggtgggccgagggaaggagatgggcggacatcctcaagcccgggtctgttaacacagacccaatcttccccaacaacaagctcaccgggacagatgttgggtacccgggagggctctggttcgacccacttggatggggaagcggctcgcctgagaagatcaaggagttgaggacaaaggagatcaagaacggaaggctggctatgttggctgtgatgggagcttggttccaacacatttacactgggactggccccattgacaacctcttcgctcacctcgccgatcccggccatgccaccatttttgcttctttttccccgaagtgaggaaagaaggagaattctaattgggattcaagtgcgggaggagaaggggcaacgttggtaggacaaaaaacttgtaattttatctgcttgccttgtgtacaaaaatctatttggaaccttcattccaatatgtatgaaatcagctggtgacctacaaaatcggaacttataaatatgtaaactactgttttgcgatattagaggagggcacgatcgaacctagaaccaccacaaatgtattaataagtattctaaatcactcaagttacaaatccacttcaaaat

SEQ ID NO: 5645 - DNA, 1049 bp, Vinca minor
atctgcctgtgcttcatccacaatagccgctgtcgccttttcttcttccccaagctctcagaagaatggatccattattggagcaagtaaagcttctttccttggaggaagaaaagttagagtaagcaaatttagaagtagtcgagcaggaggacgatcattaaccaccgtgtgcgctgcagctgaacctgatagacccctctggttccctggtagcactcctcctccatggcttgatggcagcctccctggagacttcggttttgatcctctaggtcttggatcggaccccgagacattgagatggaatgtgcagtcagagatagtacactgcagatgggcaatgttgggagctgcaggaatatttataccagagttcttgacaaagattgggatcctcaacacaccatcttggtacactgctggggaacaggaatacttcacagacacaaccaccctcttcgttgttgagttgatcctaatcggttgggccgagggaagaagatgggctgatatcctcaagcctggaagtgtcaacactgatcccatcttccctaacaacaagcttacaggtactgatgttggataccctggtggtctctggtttgatccactgggttggggaagtggttctccacagaaagtcaaggaattaaggacaaaagaaatcaagaacggaagattggcaatgttggctgttttcggagcatggttccaacacatctacaccggtactggaccaatcgacaacctctttgctcaccttgctgatcccggacacgccactgtcttcgctgcatttacctcaaagtgatggaagaaaggaagagttgctgggattgaagtgttgagaaatacctggagaacatcatggggaaattttttattatatgttttccaagtgatggcatatcattaaatcctgtatttgtcactttctatgtctgcttgtagagaaatgctaatccattgtacaaataccttcgaacttctcagcatcatttatgaacccaagttctcatgaaaattgcttataactggttaaaata

SEQ ID NO: 5646 - DNA, 1086 bp, Vaccinium corymbosum
aaaaccgcaaattgtaagcaagaaaaaactgcccacaaatggcctcctctgtttgtgcttcttcagctattgcagcaacaggcctctcttcccccaagttcccagaagagtggatcaattgtgggagcaacaaaggcttctttctttggaggaagaaagctgagcctgagaacatacacagcgccagcaagaacacggtcggtaactgttcgtgctgctgcagccgatcccgagaggcccctttggttcccaggcagcacccctcctccatggctcgacggcagcctccctggagacttcggatttgacccccttggccttggatctgacccggagacattgaaatggatggtacaatcagagatagtccactgcaggtgggccatgttgggcgctgccggtatcttcatccctgagttcctaaccaaaatcggaattctcaacaccccatcgtggtacactgctggcgagcttgaatacttcactgacaaaaccactctattcattgtggagctgattttcattgggtgggccgaggggaggcggtgggcggatatcctcaagccgggttgtgtgaatacagaccctattttccccaacaacaagctgaccgggacagatgttgggtacccaggtgggctctggttcgacccacttggctgggggagcggttcgcctgagaaggttagggagttgaggacaaaggagataaagaatggacgattggctatgttggccgtgatgggtgcttggttccaagccatctatacgggtaccggaccgattgacaacctctttgctcatcttgctgatcctggtcatgccaccatttttgctgctttcagccccaagtgaaacgagcatgggttgcatatcaaaactgggattttgtgctggaggaacaattcacaaacatctttgtgcaaagaaggaattaggcatttggttttctaagtttgatatctgtatggctagaatttgcattacctatctgtctgtctgctgtagaaagatcatgcgatgtacaaacagctctttgcttaaacatgaccaccgccactataattcaggaagtaatgaaatttt

SEQ ID NO: 5647 - DNA, 1276 bp, Aquilegia formosa
atgacccgaaaacccgataaaactaaacccaaacctgtttatcttggtcaggttcgtgccgggttaacgggttgcgggtcattttgccacccctactcgtggccatatacaaaatggggccacagccttaattccaatcaaacatttcccaagaaaacaaaattcgttgcaatggcttctctctgtgcttcttctgctcttgcaactgtagccatcacttcttccagttcccagaagagcggtggatcttgtttgggtgcaaccaaggcttcttttctggttggaagaaaacttagagagaggaaatttatagcgtatacaggacaagggggattttcagtgcgcgcagcagcagctgatgcagaaagacctctttggttcccaggcagcaccccacctgcatggcttgatggcagccttccaggagactttggatttgacccacttggtcttggatctgacccagagagtctcagatggaatgcacaagctgagctggtgcactgcagatgggcaatgcttggtgcagctggtatattcattcccgaattcctaaccaaaatcggcattttaaacaccccttcatggtacactgctggggaacaagagtacttcacagacaccaccactctcttcatagttgagctaatctttattggctgggctgagggtagacgatgggccgacattattaaacccggttgcgtgaacacagacccaatattccctaacaacaagctcaccggaactgatgttgggtacccaggtggtctttggtttgatccattgggttatgggaaaggctctcctgaaaagatcatggaattgagaacaaaggagatcaagaatgggagattggctatgctagcagtgatgggtgcatggttccaacacatctacactgggacaggtcccattgataacctctttgctcaccttgctgacccaggccatgctaccattttccaagctttcaccccaaagtgaaagaagcacgcacagactcacagtggacatgttgctgagattaagatggggaagaattcatgtaaatttaagtgagaattgggatttaagagagtcgatcaatgtggtttaagctggaatgttatatattcatgtaggatatatctcaagttggcaacttttttcaatgtgttctgtattgtacaaatacctacaagctatatagtagtatgcatgttttaatattgatggaagctaggtggtaaaccgttaatgtgactatatgatgcagtatggacatttttttttt

SEQ ID NO: 5648 - DNA, 1197 bp, Vaccinium corymbosum
aagcctcttcatacgttaacaagtactagttctcccatcctccagcaggcattcaaaccagaatcaaaaaccgcaaattgtaagcaagaaaaaactgcccacaaatggcctcctctgtttgtgcttcttcagctattgcagcaacaggcctctcttccccaagttcccagaagagtggatcaattgtgggagcaacaaaggcttctttctttggaggaagaaagctgagcctgagaacatacacagcgccagcaagaacacggtcggtaactgttcgtgctgctgcagccgatcccgagaggcccctttggttcccaggcagcacccctcctccatggctcgacggcagcctccctggagacttcggatttgacccccttggccttggatctgacccggagacattgaaatggatggtacaatcagagatagtccactgcaggtgggccatgttgggcgctgccggtatcttcatccctgagttcctaaccaaaatcggaattctcaacaccccatcgtggtacactgctggcgagcttgaatacttcactgacaaaaccactctattcattgtggagctgattttcattgggtgggccgaggggaggcggtgggcggatatcctcaagccgggttgtgtgaatacagaccctattttccccaacaacaagctgaccgggacagatgttgggtacccaggtgggctctggttcgacccacttggctgggggagcggttcgcctgagaaggttagggagttgaggacaaaggagataaagaatggacgattggctatgttggccgtgatgggtgcttggttccaagccatctatacgggtaccggaccgattgacaacctctttgctcatcttgctgatcctggtcatgccaccatttttgctgctttcagccccaagtgaaacgagcatgggttgcatatcaaaactgggattttgtgctggaggaacaattcacaaacatctttgtgcaaagaaggaattaggcatttggttttctaagtttgatatctgtatggctagaatttgcattacctatctgtctctgtctgctgtagaaagagcatgcgatgtacaaacagctctttgcttaaacatgaccaccgccactataattcaggaagtaatgaaattttcatataactaacaatgtgcatgatgacagaaaacccaaaactgg

SEQ ID NO: 5649 - DNA, 1087 bp, Vaccinium corymbosum
aaattgttagcaagaaaaaactgcccacaaatggcctcctctgtttgtgcttcttcagctattgcagcaacaggcctctcttcccccagttcccagaagagtggatcaattgtgggagcaacaaaggcttctttctttggaggaagaaagctgagcctgagaacatacacagcgccagcaagaacacggtcggtaactgttcgcgccgctgcagcagatcccgagaggcccctttggttcccaggcagcacccctcctccatggctcgacggcagcctccccggagacttcggatttgacccccttggccttggatctgacccggagacattgaaatggatggtacaatcagagatagtccactgcaggtgggccatgttgggcgctgccggtatcttcatccctgagttcctaaccaaaatcggaattctcaacaccccatcgtggtacactgctggcgagcttgaatacttcactgacaaaaccactctattcattgtggagctgattttcattgggtgggccgaggggaggcggtgggcggatatcctcaagccgggttgtgtgaatacagaccctattttccccaacaacaagctgaccgggacagatgttgggtacccaggtgggctctggttcgacccacttggctgggggagcggttcgcctgagaaggttagggagttgaggacaaaggagataaagaatggacgattggctatgttggccgtgatgggtgcttggttccaagccatctatacgggtaccggaccgattgacaacctctttgctcatcttgctgatcctggtcatgccaccatttttgctgctttcagccccaagtgaaacgagcatgggttgcacatcaaaactgggatttcgtgctggaggaacaatacacaaacatctttgtgcaaagaaggaattaggcgttttggttttctaagtttgatatctgtatggctagaatttgcattacctatctgtctctgtctgctgtagaaagagcatgcgatgtacaaacagctctttgcttaaacatgaccaccgccactataattcaggaagtaatgaaattttcatataa

SEQ ID NO: 5650 - DNA, 1038 bp, Aquilegia formosa
ctagattccaatcaaacatttcccaagaaaacaaaagtcgttgcaatggcttctctctgtgcttcttctgctcttgcaactgtagccatcacttcttccagttcccagaagagcggtggatcttgtttgggtgcaaccaaggcttcttttctggttggaagaaaacttagagagaggaaatttatagcgtatacaggacaagggggattttcagtgcgcgcagcagcagctgatgcagaaagacctctttggttcccaggcagcaccccacctgcatggcttgatggcagccttccaggagactttggatttgacccacttggtcttggatctgacccagagagtctcagatggaatgcacaagctgagctggtgcactgcagatgggcaatgcttggtgcagctggtatattcattcccgaattcctaaccaaaatcggcattttaaacaccccttcatggtacactgctggggaacaagagtacttcacagacaccaccactctcttcatagttgagctaatctttattggctgggctgagggtagacgatgggccgacattattaaacccggttgcgtgaacacagacccaatattccctaacaacaagctcaccggaactgatgttgggtacccaggtggtctttggtttgatccattgggttatgggaaaggctctcctgaaaagatcatggaattgagaacaaaggagatcaagaatgggagattggctatgctagcagtgatgggtgcatggttccaacacatctacactgggacaggtcccattgataacctctttgctcaccttgctgacccaggccatgctaccattttccaagctttcaccccaaagtgaaagaagcacgcacagactcacagtggacatgttgctgagattaagatggggaagaattcatgtaaatttaagtgagaattgggatttaagagagtcgatcaatgtggtttaagctggaatgttatatattcatgtaggatatatctcaagttggcaacttttttcaatgtgttctgt

SEQ ID NO: 5651 - DNA, 861 bp, Arnica chamissonis
tggcatcaactgcttgtgcttcttctgccattgcagctgttgctttctcttccccaagtgcacagaaaagtggatctattgttggatcaacaaaggcttcttttcttggtgggaagaaactgagagttagcaagttgggtgcaccgtccggttcacgatcgtttggaaccgtgtgcgttgcggctgaccccgatagacccatttggttccctggcagcaccccaccagaatggctcgatggcagcctacctggagacttcgggtttgatcctctcggtctaggatccgaccccgagactttgaaatggaacgtacaagcggaactcgtacactgcagatgggcaatgttaggtgcagccgggatcttcatccctgaattcctaacaaaaatcggaattctaaacactccttcatggtacaccgcgggtgaacaagaatacttcaccgacaaaaccacgctgttcatcgttgagcttattttcatcggttgggccgaaggaagaagatgggcagacatcatcaaacctgggtgcgttaacaccgaccccatcttccccaacaacaagctaaccggaaccgatgttggctacccaggtggactatggtttgacccgctcggttgggggagcggttcacctgcaaagctcaaggaattgaggacaaaagagatcaagaatgggaggttggccatgttggctgtgatgggtgcatggttccaagccgaatacaccggaaccggacccattgacaacctgtttgctcaccttgctgacccgggtcacgccaccatttttgctgcattcaagggctaaacaagaagaaaaactgttggcaggaggatatatagattttaagggtttt

SEQ ID NO: 5652 - DNA, 783 bp, Flaveria ramosissima
tgcttcttctgctattgcagctgttgctttctcttccccaagctcacaaaaaagtggatctactgttggatcaacaaaggcttctttttttggtggaaagaaactcaaagttagcaagttgggtgcaccatccggttcacgatcgttcgcaaccgtgtgcgccgcggctgatcccgatagacccatttggttcccgggcagcaccccaccagaatggctcgatggcagcctacctggagacttcgggttcgatcctcttggtctaggatctgatcccgagactttgagatggaacgtacaggcggaactagtacactgccgatgggcgatgttaggtgccgcggggatcttcatccccgaattcctgacaaaaatcggaatcctaaacactccgtcgtggtacaccgctggtgaacaagaatacttcacagacaaaaccacactcttcatcattgagcttattttcattggttgggctgaaggaagaagatgggctgacatcatcaaacctgggtgcgttaacacggaccccatcttccccaacaacaagctaaccgggaccgatgttggctacccgggcgggctatggtttgacccactcgggtgggggagcggttcacctgcaaagctcaaggagttgaggacaaaagagatcaagaatgggaggttagccatgttggctgtgatgggtgcatggttccaagccatctacaccggaaccggacccatcgacaacctgtttgcacaccttgcggacccgggtcacgccaccatttttgccgc

SEQ ID NO: 5653 - DNA, 990 bp, Flaveria ramosissima
cttgtgcatcttctgccattgcagctgttgctttctcttctccaagttcacagaagagtggatctattgttggatcaacaaaggcttcttttcttggtgggaagaagctgagagttagcaaattgggtgcaccatccggttcacgatcgttcggaaccgtgtgcgttgcggctgaccccgatagacccatttggttccccggtagcaccccacccgaatggctcgatggcagcctacccggagacttcgggttcgatcctcttggcctaggatccgaccccgagaccttgaaatggaacgtgcaggcggaactcgtgcactgcagatgggcaatgttaggtgcagccgggatattcatccccgaattcctaacaaaaatcggaatcctgaacactccttcatggtacaccgcgggtgaacaagagtacttcaccgataaaaccaccctcttcatcatcgagcttattttcatcggttgggccgaaggcagaagatgggctgacatcatcaaacctgggtgtgttaacactgacccaatcttccccaacaacaagctaaccgggaccgatgtgggctacccagggggcctatggttcgacccactcgggtggggaaccggctcgcctgcaaagctcaaggagttgagaaccaaagagatcaagaatggtagattggctatgttggctgtgatgggtgcatggttccaagccatttacaccggaaccggacccattgacaacctgtttgctcaccttgcggacccgggtcacgccaccatcttcgctgcattcaagggctaaagatattggcttgaaggatttgaagagtttgtgataagtggtgtttgtgtaacattagaaattgtatgtgtagagaagttttaatgcaatgtacaaatacctctttaaacttaacaaaaaaaaaaaaaaaaactaaaaagtactactagtcgttagaactacctactgtaccttagtagaacgacgtacg

SEQ ID NO: 5654 - DNA, 990 bp, Scabiosa columbaria
tcatttacaccccccttccttcacatttataatttatttttgctttgccgacaaattaaaactattaaaaccacatggcttctgtttgtgcttcctcagccattgctgctgctgctgctgctttttcttcacccagaacccagaaaaatgggtcagtgttaggagcaacaaaggcgtttttcctaggtggtggaaaacttaaagtagccaaatccgcaagaacctttggagcacgttccactgctactgtgtgcaccgtagctgaccctgaaaggcctatctggttccctggcagtacccctcctccatggcttgatggcagcctaccaggagatttcggctttgatcctctaggtctaggatctgatcctgagacattgaaatggaatgtgcaagcggagatagtacactgcagatgggctatgttaggtgctgctggaattttcatccctgaatttctaacaaagatcggcgttctaaacacgccttcatggtacactgctggtgaacaagagtatttcaccgacaaaactactttgttcatcgtagagcttgttttgatcggttgggctgagggaagaaggtgggctgatatcttaaagcctgggagtgtgaacacggacccaatcttccctaacaataaattgacagggaccgatgttggctaccctggtggtctttggtttgacccactcggatggggaagtggttcaccagaaaaaatcaaggagttgaggacaaaggagattaaaaatggaaggttggccatgttagccgttatgggtgcctggttccaagctaactacaccggaactggccctattgacaacctatttgctcaccttgctgaccctggtcatgcaactattttcgctgctttcagtcccaagtgatagaagaagatgaaggtagaattctgactgcaaccgtacggaaaaactttggtgtgcatcattaagagatgaaggctctaccatgtccttttttttt

SEQ ID NO: 5655 - DNA, 1063 bp, Helianthus annuus
ttcttcttgtagacaaaaaacacaatggcttgtgcttcttctgccattgcagctgttgctttctcttctccaagttcacagaagagtgttggatcaacaaaggcttcttttcttggtgggaagaagttgagagttagcaaggtgggtgcaccatccggttcacgatcattcggaaccgtgtgcgttgcggctgaccccgatagacccatttggttccctggcagcactccaccagaatggctcgatggcagccttcccggagactttggttttgatcctcttggcctaggatcggatcccgagactttgagatggaacgtacaagcggaacttgtacattgcagatgggcaatgttaggagcagccgggattttcatcccggaattcctaacaaaaatcggaatcttaaacactccatcatggtacactgctggtgaacaagaatacttcaccgacaaaaccacactcttcatcattgagcttattttcatcggttgggccgaaggaagaagatgggccgacatcatcaaacctgggtgtgttaacacagaccccatcttccctaacaacaagctgaccgggacagatgtcgggtacccaggtgggctatggttcgacccactcgggtggggaaccggctcgcctgcaaaactcaaagaattgaggacaaaggagatcaagaatggaagactggctatgttggctgtgatgggtgcatggttccaagccatctacactggaaccggacccattgacaacttgtttgctcaccttgctgacccgggtcacgccaccatcttcgctgcattcaagggctaagcatcatgcatatggaggaatttaaagagttcttggcaagtggtgtttgtgtgtcattagaaattgtatcttcatcttaatttacaaatacctcttaatttcaactcttaatgttgcatatatagtcagggaaaaatcaagttaattttggctaggaaggataggaagccatagaattatgacatgtggcaacatttaaaataaagaaaaaggtattttagtcaatccaactccttcttcttcc

SEQ ID NO: 5656 - DNA, 1304 bp, Aristolochia fimbriata
ttagattctgtgcgccacatggcggaagttgagcgggtcggagagccctcctcctatctctcaggataagcccttgcatatatcatatctccgagaccaccgagcacccacttcagagaaaaaataatggcctcggtctgtgcttcttcttccgccattgcggccgttgccatctcttcttccagctctcagaagagtggaaatggcttgtctgccactaaggcctctttcctcggaggaagaaaactgaggcgggggaaggtcaccaaatcaggggctgcaccaagatccttcacggtctcagcagcagcagcatccgagaggcctctctggtttccaggcagcactcctccaccatggctcgatggcagccttcctggagattttggattcgatcccctaggcctcggatctgacccggagacattgagatggaaccaacaagcagagcttgtgcactgcagatgggcaatgctgggggcagccggcatcttcatcccggaacttctgaccaagttagggatcctgaacactccctcatggtacacagccggagagcttgaatacttcacagacaccaccaccctcttcatcatcgagctcatcttcattggatgggcagaggggagaagatgggcagacattatcaagcctgggtgtgtgaacacagatcccatattccccaacaacaagctcaccgggaccgaggtcgggtaccctggcgggctctggttcgaccctctcgggtggggaaccgggtcccctgagaaactcaaggagttgaggacaaaggagatcaagaatgggagattggccatgttggccgtcatgggtgcttggttccaggccatctacacaggcactggccccattgacaacctctttgcccaccttgccgatcccggccacaacaccattttctctgctttcactcccaagtgaagatggcagagaggtagctagaagtgggactgaattggggtattgagttctagttagtgtgtaaattatttggcaaatggaagctgaaagagttgtaagatctgtgtcattggagaagtttgaagttgtgtcatgtactcaatacgtactaattaagcctgcagtgaaatgtacaaaaggaaactttcttcccgatggatcctacactagttatgtctgttactacttttaaattatcaattctttactaaaaccaaaaaaaaaaaaaaaaaaaacaaaaaaaaaaaaaaacaaaaaaaaactgcgaacacgacaacggagggaagtacggacgaaacggaccaacaacggaaggggagtag

SEQ ID NO: 5657 - DNA, 1098 bp, Gerbera hybrid cultivar
caaaaatggcttccactgcttgtgcttcttcagccattgcagctgttgctttctcttctccaagttcccagaagagtggatctattgttggatcaacaaaggcttcttttcttggtgggaagaaactaagggtgagcaagtttagtgcaccatctggggctcgaaccgtcagcacagcctgtgttgcagctgacccagaccgacccatttggttcccgggcagcgtccctccaccatggctggatggcagcttacctggagatttcggctttgatcctcttggtctagggtccgacccggagaccttgaaatggttcgtacagtccgaaatagtacactgccgatgggcaatgttaggagccgccggaatcttcatcccggaatttctaaccaaactcggaatcctaaacacaccttcatggtacactgccggtgaactagaatacttcactgacaaaaccacactcttcatagttgagctaatttttatcggttgggccgagggaagaagatgggctgacattatcaagcccgggtgcgttaacaccgacccgatcttccctaacaataagttaactggtacggatgttgggtacccgggtgggctgtggttcgacccactggggtggggaagcgggtcacccgcgaaggtcaaggagttgaggactaaggagattaagaatgggagattggctatgttggctgtgatgggtgcttggttccaagccatctacactaaaaccggaccgattgataacctttttgctcaccttgctgacccgggtcacgcaaccgttttcgctgcgttcaagggagaatagaaagggactgcttgttaagtttttcgtatcgtcgagaagcataaaagggaaaacgttggcacaacgatggatttaacactttttgccaagtgatgtgtgtgtattattagaaattgtattctatctctgctgtagaaaagctaatgatatgtacaaatacctctttgttgaactcgaaacgccacatctatacacgcttgtgtatcaatagtagtacgtacctacaccaatttgacaaagcggaaaactgtttcactgaaaaaaaaaaaaaaaaaaa

SEQ ID NO: 5658 - DNA, 924 bp, Olea europaea
atggcggcctctgcctttgcttcatccaccattgcagccgttgctctctcaccaaccagagcaacaaaagcttccttcttgtcgggaaggaaattgagagtaagcaagaatgctacttcaaccagagtgcaatcggttaccgtctgtgcagcagcagatcccgacagaccattgtggtttcccggaagcacccctccaccgtggctcgatggcagtctccccggagacttcggctttgatcctctgggcctgtcatctgatcccgagagcttaaaatggaaccagcaggcagagcttgtacattgcagatgggccatgttaggtgctgcaggtattttcatccccgaattcttgacaaagattggcatcctaaacactccttcgtggtacactgctggtgaacaagaatacttcactgataccacaacactcttcgtcgttgaattgattttcattggttgggctgagggaagacgatgggcggacattattaaacctggctgcgtgaacaccgatcccatcttccccaacaacaagctcacaggaactgatgttggctaccctggtggcctatggttcgatccacttggatggggatctggatctcctgaaaaggtgaaggaattgaggacaaaggagatcaagaatggaagattggccatgttggctgtgatgggagcatggttccaacacatttacactggaacaggacccatcgataacctctttgctcaccttgccgatcctggccatgccaccatttttgctgctttcagccccaagtgaaacaggtaatgaagtcacttcaacacgagtgtgttgaagaaacaccagcaacaattggtatgggaagaagtgttggaagtgtgtttttccaattcatgttgtatcgttgagatatgtgttgcctacatctttgtctgc

SEQ ID NO: 5659 - DNA, 897 bp, Senecio madagascariensis
acacacaaacatacacatttccttattaccaaatcttgaaggcaaagttttcatttcaacaacaccaatggcttccactgcttgtgcttcttccgccatcgcaccggtcgctttctcttcgccaagtgcacagaagagtggatccattgttggatcaacaaaggcttctttcttcggtgggaagaaactaagagttagcaagttcgctgcaccaaccggtgcacgatcacttagcaccgtgtgtgttgcggctgaccccgatagacctatttggttccctggaagcaccccaccagaatggcttgatggcagcctacctggagacttcgggttcgatcctcttggtctaggatctgaccccgagaccttgagatggaacgtacaagcggaactagttcactgcagatgggcgatgttaggagcagcagggatcttcatccccgaattcctaaccaaaatcggaattctaaacactccttcatggtacactgctggtgaacaagaatacttcaccgacaaaaccacactcttcatagttgagcttattttcatcggttgggcagaaggaagaagatgggctgacattatcaaccccggatgtgtcaacactgaccccatcttccctaacaacaaactaaccggcacagatgttggctacccaggtggactatggttcgacccactcggatatggaaatgcttcaccagcaaagcttaaggaattgaggacaaaagagatcaagaatggaagacttgccatgttggctgttatgggtgcatggttccaagccgagtacactggaaccggacccattgacaacttgtttgctcaccttgctgaccctggtcacgccaccatttttgctgcattcaaaggttaaacaaatagcaagcggaa

SEQ ID NO: 5660 - DNA, 1058 bp, Helianthus annuus
gcccattatgcctttaacaccatccaacttcttcctcacaatcctactcattcttcatcaccaattcttcttgtagacaaaaacacaatggcttgtgcttcttctgccattgcagctgttgctttctcttctccaagttcacagaagagtgttggatcaacaaaggcttcttttcttggtgggaagaagttgagagttagcaaggtgggtgcaccgtccggttcacgatcattcggaaccgtgtgcgttgcggctgaccccgatagacccatttggttccctggcagcactccaccagaatggctcgatggcagccttcccggagactttggttttgatcctcttggcctaggatcggatcccgagactttgagatggaacgtacaagcggaacttgtacattgcagatgggcaatgttaggagcagccgggattttcatcccggaattcctaacaaaaatcggaatcttaaacactccatcatggtacactgctggtgaacaagaatacttcaccgacaaaaccacactcttcatcattgagcttattttcatcggttgggccgaaggaagaagatgggccgacatcatcaaacctgggtgtgttaacactgaccccatcttccctaacaacaagctgaccgggacagatgtcgggtacccaggtgggctatggttcgacccactcgggtggggaaccggctcgcctgcaaaactcaaagaattgaggacaaaggagatcaagaatggaagactggctatgttggctgtgatgggtgcatggttccaagccatctacactggaaccggacccattgacaacttgtttgctcaccttgctgacccgggtcacgccaccatcttcgctgcattcaagggctaagcatgcatatggaggaatttaaagagtttttggcaagtggtgtttgtgtgtcattagaaattgtatcttcatcttaatttactgtagagaagttttaatgcaatgtacctcggacgcgaccactctaatcgaattccctcggtcgccatggccgtcgggagcatgcgactaccggc

SEQ ID NO: 5661 - DNA, 839 bp, Antirrhinum majus
attcggcacgagacttgcagaaaaaaagaataatcagtcgatatggccacaacctgtgcttcatcagccattgcattctcttctccaagttcacagaaaaatggaggcattgtgggagcaaccaaggcttctttctttggtgcaagaaaattgagagtaagcaaattctccgccaaaagatcggtggccgtttgcgccgcagctgatccagaaagaccaatctggttcccagggagcacccctcccccatggcttgatggcagcctgcctggagactttggctttgatcctcttggcctagcatccgacccggatagcttgaagtggaacgcgcaagcggagctcgtacactgcagatgggccatgttaggagcagctggtattttcatcccggagttccttacaaagatcggtatccttaacaccccttcatggtacactgccggcgagcaagagtacttcaccgacaccacaactctcttcattgtcgagttggttcttattgggtgggccgagggaagaagatgggcggatatcatcaaacccggtagcgtgaacacggatcccatcttcccaaacaacaagctcaccggtactgatgttgggtacccgggcgggctatggtttgacccacttggatgggggtctggatctccagcaaagataaaggagttgagaacaaaggagatcaaaatgggaggttggctatgttggcggttatgggagcgtggttccaacacatttacacgggtactgggcctattgataacctcttcgcccaccttgcagatccgggtcatgccaccatttttgctgctttcagtcccaagtgagagaag

SEQ ID NO: 5662 - DNA, 930 bp, Ambrosia trifida
caaataatatttcaaaaacaatggcttgtgcatcttctgccattgcagctgttgccttctcttctccaagttcacaaaagagtggatcaattgttggatcaacaaaggcttcttttcttggtgggaagaaactgagagttagcaaggtgtgtgcaccatccggttcacgatcgtttggaaccgtgtgtgttgcggctgaccctgatagacccatttggttccctggcagcaccccaccagaatggctcgatggcagcctacctggagactttggttttgatcctcttggcctaggatccgatccagagactttgagatggaatgtacaagcggaactcgtacactgcagatgggcaatgttaggtgcagccgggattttcatcccagaattcctaacaaaaattggaatcttaaacactccatcatggtacactgctggtgaacaagagtacttcaccgacaaaaccacgctcttcatcattgagcttatattcatcggttgggcagaaggacgaagatgggctgacattatcaaacctgggtgtgtcaacactgatcccatcttccccaacaacaagctgaccgggacggatgttgggtacccaggtggactatggttcgacccactcgggtggggaagtggctcacccgcaaagcttaaggaattgaggacaaaagagataaagaatggaagattggctatgttggctgtgatgggtgcatggttccaagcaatctacactggaactggacccattgacaacctgtttgctcaccttgctgacccgggtcatgccaccatcttcgctgcattcaagggttaatgcatatggaaggaaggacttaaaagagtttttggcaagtggtgtttgtgtgccattagaaattgcatcttcatctaaattcactgcatgtagagaagttttaatg

SEQ ID NO: 5663 - DNA, 787 bp, Flaveria ramosissima
tcaatggcttcaactgcttgtgcttcttctgctattgcagctgttgctttctcttccccaagttcacagaaaagtggatctactgttggatcaacaaaggcttcttttcttggtgggaagaaactcaaagttagcaagttgggtgcaccatccggttcacaatcgttcgcaaccgtgtgcgctgcggctgatcccgataggcccatctggttcccgggcagcaccccaccagaatggctcgatggcagcctacctggagacttcgggttcgatcctcttggtctaggatctgatcccgagactttgagatggaacgtacaggcggaactagtacactgccgatgggcgatgttaggtgctgccgggatctttatccccgaattcctgacaaaaatcggaatccttaacactccgtcgtggtacaccgctggtgaacaagaatacttcacagacaaaaccacactcttcatcattgagcttattttcattggttgggctgaaggaagaagatgggctgacatcatcaaacctgggtgcgttaacacggaccccatcttccccaacaacaagctaaccgggaccgatgttggctacccgggtgggctatggtttgacccactcgggtgggggagcggttcacctgcaaagctcaaggagttgaggaccaaagagatcaagaatgggaggttagccatgttggctgtgatgggtgcatggttccaagccatctacactggaaccggacccatcgacaacctgtttgcgcaccttgcggacccgggtcacg

SEQ ID NO: 5664 - DNA, 1132 bp, Scabiosa columbaria
cttattcttgtccttgcaaatcatcattgttgttggacacaaaatttgtcgacatggcatctgcctgtgcttcatccgccattgctgcagctttctcttctgcttcatcaagttctcagaagaatggggcaattgttggagcaacaaagacttcttttctaggtgggagaaaactgagagtcaccaagtacaaatcggctgcaactggagcccggtccgtgggaccggtgtgcacattggctgaccctgataggcccatatggttccccggaagcaccccacccccttggctcgatggcagcctacctggagacttcggctttgatcctctaggtctaggatccgatcctgagacactaaaatggaaccaacaagcggagctagtacattgccgatgggcgatgttgggtgctgccggtattttcatcccggaattcttgacaaagatcggaattctaaatacaccttcatggtacacggccggtgaacaagaatacttcactgacaaaactacactcttcattgtggagttgatcttcattgggtgggccgagggacgaaggtgggctgatatcttaaagcccggatgtgtgaacacggaccccatcttcccaaacaataagctcactggaactgatgtcggttacccaggtggcttatggttcgacccactaggttggggaagtggatcccctgcgaaaatcaaggaattgaggaccaaggagatcaagaacggtaggctagccatgttggcggttatgggtgcgtggttccaggctaactatactggaactgggcccattgacaacctctttgctcaccttgctgatcctggtcatgccaccatttttgctgctttcagccccaagtgaaacaagcaaaggagaataaatctaactgtggtcggtgaagaaccacttagcgcgatggtggagagttatcagtttttcatgtgattcttgttataccattagaactttatattcaccgtgtgttgtgtctgttgtagaaagcttgttccgtgtacaaatacttctatgaacttgaactatatgtacatgttcaagtcccagtcaatatccattgttgatatgtgcatcaatgtgtatgtgtgttcgatgaataatcctag

SEQ ID NO: 5665 - DNA, 1017 bp, Flaveria ramosissima
gaccactacgacagtacgaaccgaatgggaacgaaacactccattcttctatatcaatcataggcttcaactgtctgttccttctctgctattgcagctgttgtctttctcctccccaagttcaacaaaagtggatctactgttggatcaacaaaggcttctttcttggtggaaagaaactcaaagttagcaagttgggtgcaccatccggttcacgatcgttcgcaaccgtgtgcgccgcggctgatcccgatagacccatttggttcccgggcagcaccccaccagaatggctcgatggcagcctacctggagacttcgggttcgatcctcttggtctaggatctgatcccgagactttgagatggaacgtacaggcggaactagtacattgccgatgggcgatgttaggtgccgccgggatctttatccccgaattcctgacaaaaatcggaatcctaaacactccgtcgtggtacaccgctggtgaacaagaatacttcacagacaaaaccacactcttcatcattgagcttattttcattggttgggcagaaggaagaagatgggctgacatcatcaaacctgggtgcgttaacacggaccccatcttccccaacaacaagctaaccgggaccgatgttggctacccgggcgggctatggtttgacccactcgggtgggggagcggttcacctgcaaagctcaaggagttgaggacaaaagagatcaagaatgggaggttagccatgttggctgtgatgggtgcatggttccaagccatctacaccggaaccggacccatcgacaacctgtttgcacaccttgcggacccgggtcacgccaccatttttgccgcattcaagggctaaaacagcattataagggcttttggcaaagtgatgtttgtgtattattagaaactctatcttatgtttactgtagatcaaagttaatggaatgtacaaacacctcttaatttcaactcaaaatggtgcatatagataaattacataa

SEQ ID NO: 5666 - DNA, 1168 bp, Cirsium arvense
ttctgccattgcagctgttgctttctcttctccaagcacccagaagagtggatcaattgttggatcaactaaggcttcttttcttggtgggaagaaactgagagttagcaagttcagtgcaccaactggggcacgatcagtgggcacagtctgtgttgcagccgaccctgaccgacctctttggttccctggcagcacccctccagaatggctcgatggcagcctacctggagatttcggctttgatcctcttggtctaggatccgatcccgataccttgaaatggaaccaacaagccgaactagtacattgcagatgggcaatgttaggagcagccgggatcttcatccccgaattcctaacgaaaatcggaatcctaaacactccttcatggtacacggccggcgaacaagaatacttcaccgacaaaaccacattgttcatcgtcgagcttattttcatcggttgggccgaaggaagaagatgggctgacattattaaccctgggtgcgttaacaccgaccccatcttccccaacaacaagctaaccggcacggatgtcggctacccaggtggcctatggttcgacccactcggatggggaagtggttcacctcaaaagctcaaggaattgaggacaaaggagatcaagaatggaagattggccatgttagccgtgatgggtgcttggttccaagccatctataccggaaccggacccattgacaacctcttcgctcaccttgctgaccctggtcacgccaccatttttgctgcattcaaggggtaaatagcaagaaacaagtgttgggaaatggaagaagatacgatggctttgaagagtttttggcaagtggtgtgtgtttatcaagtattattattagaaaatgtatggtatctcatctactgtagaaaagctaattaatgcaatgtacaaacacctcttttcaactcaaaatgcatcatccatatatttaagcttaattaattcttttttgatcaatttaaggtccatcatctccatctcgaatcaaattcagatatcagagcactccaccaaacaataatggcgggtccgaaacccttgcttgaaaacaaccaaaggtcgccggacattaatcggtccttcgccgggagacccatctccgccgcgaatacaagtggtcac

SEQ ID NO: 5667 - DNA, 1273 bp, Citrus sinensis
tgagaagaactcgagattaatccaagtaaccaggaaaattcgaggtagaggagcaggatatcagattctgcatgccacatggcatcacataagccagttagagatccactcttctatccttaaagataagcccctgcatccattaacattaaacaagtttttgtatcttctgttcactgccaattgtattctactttacacgcacacaaacgccagtcataattttgctgaaagcctttgcctggtagtaaaaatggcttccgtttgtgcttcccctgccgttgcagccatctcatcccccagttctcagaagagtagatcagttgcgggagcaacaaaggcttctttccttggtgggaagaagctgaaattgagaaaaaacggagcaacagcgggaacacgatcggtttcagtgagtgcggctgcagctgatcctaacaggcctctctggttcccaggcagcactcctcctgaatggctcgatggtagcctccccggagacttcggcttcgatcctcttggtcttggatctgatcctgagacgctgagatggaacgtgcaatcagaaattgtgcactgcagatgggcaatgttaggagctgcaggaattttcattccggaattgttaacaaaacttggaatcctcaacactccatcctggtacacagctggggagctagagtacttcacagacaccaccaccctgttcattgttgagatgatattcataggctgggcagagggcagacggtgggccgacattataaagccaggctgtgtgaacactgacccgatcttccccaacaacaagctcaccggcaccgatgttgggtacccaggtgggctttggtttgacccacttggctggggatccggttcgcccgagaaggtaaaggagctgaggactaaggagatcaagaatggaagattggctatgttggctgtgatgggtgcttggttccagcacatttacaccggcaccggccccattgacaatctcattgctcaccttgctgatcctggtcatgccaccgtttttgctgccttcacccccaagtgagatgatgacgagcaaagggagagaaatttgggccaagaggaagcttgagatcaaaggaattggtgtttctcttagggaaaggttgtatgattagaacttgtattaattgcctctatctatgtacaaagacttgtgtgatcacttagatgccatgaatataaaaaatattcaggtggaaacgaaacttgtctataaattaaaacttaaatacac

SEQ ID NO: 5668 - DNA, 1426 bp, Citrus clementina
acaaaatcgacacaaatctcatctcaatcgaaatcatttagctgtgaaataacataaataagagtaattgcgtgtaattaaaatatgtgacagagctgggttagccacagggtccctagccgatattttttatgcatggggcacaatgaacttacaatctgaaccaccaactcgagatttttttttttttgagaagaactcgagattaatccaagtaaccaggaaaattcgaggtagaggagcaggatatcagattctgcatgccacatggcatcacataagccagttagagatccactcttctatccttaaagataagcccctgcatccattaacattaaacaagtttttgtatcttctgttcactgccaattgtattctactttacacgcacacaaacgccagtcataattttgctgaaagcctttgcctggtagtaaaaatggcttccgtttgtgcttcccctgccgttgcagccatctcatcccccagttctcagaagagtagatcagttgcgggagcaacaaaggcttctttccttggtgggaagaagctgaaattgagaaaaaacggagcaacagcgggaacacgatcggtttcagtgagtgcggctgcagctgatcctaacaggcctctctggttcccaggcagcactcctcctgaatggctcgatggtagcctccccggagacttcggcttcgatcctcttggtcttggatctgatcctgagacgctgagatggaacgtgcaatcagaaattgtgcactgcagatgggcaatgttaggagctgcaggaattttcattccggaattgttaacaaaacttggaatcctcaacactccatcctggtacacagctggggagctagagtacttcacagacaccaccaccctgttcattgttgagatgatattcataggctgggcagagggcagacggtgggccgacattataaagccaggctgtgtgaacactgacccgatcttccccaacaacaagctcaccggcaccgatgttgggtacccaggtgggctttggtttgacccacttggctggggatccggttcgcccgagaaggtaaaggagctgaggactaaggagatcaagaatggaagattggctatgttggctgtgatgggtgcttggttccagcacatttacaccggcaccggccccattgacaatctcattgcccaccttgctgatcctggtcatgccaccgtttttgctgccttcacccccaagtgagatgatgacgagcaaagggagagaaatttgggccaagaggaagcttgagatcaaaggaattggtgtttctcttagggaaaggttgtatgattagaacttgtattaattgcctctatctatgtacaaagacttgtgtgatcacttagatgccatgaatataaaaaatattcaggtgga

SEQ ID NO: 5669 - DNA, 925 bp, Taraxacum officinale
  misc_feature (802)..(802): n is a, c, g, or t
tggcttcactgcttgtgcttcttccgccatcgcagctgtcgctttctcttctccaacttcacagaagaacggatcgtttgttggatcaacaaaggcttcgtttctcggtgggaagaaactaagagtcagcaagttcaccgcaccagccgtgacacgatctgccggcgctgtatgcgtcgccgccgaccccgacagacctatttggttccccggaagcacccctccggaatggctcgacggtagcctacccggagacttcggattcgatcctcttggtctaggatccgacccggaaacattgaaatggaacgtgcaagcggaaatagtacactgcagatgggctatgttaggagcagccgggattttcatcccggagtttctaaccaaaatcggaatcttaaacactccgtcatggtacaccgccggcgagcaagaatacttcaccgacaaaaccacgctgttcatagtggagcttattttcatcgggtgggcagaaggaagacgatgggccgacattctgaaacctgggtctgtgaacaccgatcccatcttccccaacaacaagctaacaggtacagatgtcgggtacccaggtggactatggttcgacccacttggatggggcagcggttcgcctgcaaagctcaaggaattgagaacaaaggagatcaagaatggaagattggccatgttggcagtaatgggagcttggttccaagcaatctacaccggaaccggacccattgataacctctttgctcaccttgctgacccgggtcacgccaccatttttgctgcattncagggttaagtagcaaggagaaatatgatgttgaaatggtggagagggagaatggtgaatttaacagttttttgcaagtgaaatgtgtgtgtatcattagaaactgtatcttgtctctactgt

SEQ ID NO: 5670 - DNA, 1088 bp, Euphorbia peplus
tcaatctcaatttcaacacaactcaaaccaactaaccttagaagaaaaataatttagaaaaaaaggcctgaaatggcttctgtttgtgcttcttctgccattgccatctcttctcctagttcccagaagtgtggagctattgtcggaacaacaaaagcttcattcctaagtgggaagagattgaagtgcagacagacaagttcaagtgttgttagttcaagatgtgttacagtttgtgctgttgctgatcctgatagacctctgtggttccctggaagctcccctcctgaatggctagatggcagccttccaggagactttggatttgatcctttgggtcttggatccgacccggaaacccttagatggaatgtacaggcagaactcgtacattgtagatgggcaatgcttggagcagctggaattttcatcccagaattcctaaccaaaattggaattttaaatactccatcttggtatgaagccggaacacaggaatatttcaccgatacaaccacactattcgttattgagctcatatttatcgggtgggcagagggtagaagatgggcagatatattgaaacccgggtgtgttaacaccgacccaattttccctaacaacaagctcaccggaaccgatgtcggttacccgggcgggttatggttcgacccgcttggatggggaagcggatcgcccgcgaagctcaaggagttgaggacaaaagagattaagaatggaagattagcaatgttggctgtaatgggtgcttggtttcaacacatttatacgggtactggcccgattgataacctttttgcccatcttgcggatccgggtcacgccacggttttccaagctttcactcctaagtgaaagtaagtgaaagagattgaaaaagttgtatttgtcgaaaagaatttgtttgtatgactagaaattgttactggctttgttaattatggttaatcttatagaatgttgcatgtggaatgtacaaaagttttcaactaattagataattaatgcttataaatatgttttcaattggcttgttatcaatcttataaaagttgagaaaattctag

SEQ ID NO: 5671 - DNA, 981 bp, Flaveria ramosissima
tcttctgccattgcagctgttgctttctcttctccaagttcacagaagagtggatctattgttggatcaacaaaggcttcttttcttggtgggaagaagctgagagttagcaaattgggtgcaccatccggttcacgatcgttcggaaccgtgtgcgttgcggctgaccccgatagacccatttggttccccggtagcaccccacccgaatggctcgatggcagcctacccggagacttcgggttcgatcctcttggcctaggatccgaccccgagaccttgaaatggaacgtgcaggcggaactcgtgcactgcagatgggcaatgttaggtgcagccgggatcttcatccccgaattcctaacaaaaatcggaatcctgaacactccttcatggtacaccgcgggtgaacaagaatacttcaccgataaaaccacactcttcatcatcgagcttattttcatcggttgggccgaaggcagaagatgggctgacatcatcaaacctgggtgtgttaacactgacccaatcttccccaacaacaagctaaccgggaccgatgtgggctacccagggggcctatggttcgacccactcgggtggggaaccggctcgcctgcaaagctcaaggagttgagaaccaaagagatcaagaatggtagattggctatgttggctgtgatgggtgcatggttccaagccatttacaccggaaccggacccattgacaacctgtttgctcaccttgctgacccgggtcacgccaccatcttcgctgcattcaagggctaaagatattggcttgaaggatttgaagagtttgtgataagtggtgtttgtgtaacattagaaattgtatgtgtagaaaagttttaatgcaatgtacaaatacctctttaaactccaaatgttgtatgtcatccaatccaactacttcacatggatttggaaatcacaagcaagacatgcacttcactacaa

SEQ ID NO: 5672 - DNA, 1426 bp, Citrus sinensis
acaaaatcgacacaaatctcatctcaatctaaatcatttagctgtgaaataacataaataagagtaattgcgtgtaattaaaatatgtgacagagctgggttagccacagggtccctagccgatattttttatgcatggggcacaatgaacttacaatctgaaccaccaactcgagattttttttttttttgagaagaactcgagattaatccaagtaaccaggaaaattcgaggtagaggagcaggatatcagattctgcatgccacatggcatcacataagccagttagagatccactcttctatccttaaagataagcccctgcatccattaacattaacaagtttttgtatcttctgttcacttccaattgtattctacttcacacgcacacaaacgccagtcataattttgctgaaagcctttgcctggtagtaaaaatggcttccgtttgtgcttcccctgccgttgcagccatctcatcccccagttctcagaagagtagatcagttgcgggagcaacaaaggcttctttccttggtgggaagaagctgaaattgagaaaaaacggagcaacagcgggaacacgatcggtttcagtgagtgcggctgcagctgatcctaacaggcctctctggttcccaggcagcactcctcctgaatggctcgatggtagcctccccggagacttcggcttcgatcctcttggtcttggatctgatcctgagacgctgagatggaacgtgcaatcagaaattgtgcactgcagatgggcaatgttaggagctgcaggaattttcattccggaattgttaacaaaacttggaatcctcaacactccatcctggtacacagctggggagctagagtacttcacagacaccaccaccctgttcattgttgagatgatattcataggctgggcagagggcagacggtgggccgacattataaagccaggctgtgtgaacactgacccgatcttccccaacaacaagctcaccggcaccgatgttgggtacccaggtgggctttggtttgacccacttggctggggatccggttcgcccgagaaggtaaaggagctgaggactaaggagatcaagaatggaagattggctatgttggctgtgatgggtgcttggttccagcacatttacaccggcaccggccccattgacaatctcattgctcaccttgctgatcctggtcatgccaccgtttttgctgccttcacccccaagtgagatgatgacgaacaaagggagagaaatttgggccaagtggaagcttgagatcaaaggaattggtgtttctcttagggaaaggttgtatgattagaacttgtattaattgcctctatctatgtacaaagacttgtgtgatcacttagatgccatgaatataaaaaatattcaggtgga

SEQ ID NO: 5673 - DNA, 1052 bp, Flaveria ramosissima
tcatcaaatcctcaagcccaaattatttacacaacaacaatggcttccactgcttgtgcttcttcagccattgcagctgttgctttctcttctccaagttcacaaaagagtggatctattgttggatcaacaaaggcttcttttcttggtgggaagaagctgagagttagcaaattgagtgccccatccggttcacgatcattcggaaccgcgtgcgttgcggctgaccccgatagacccatttggttccccggtagcaccccacccgaatggctcgatggcagcctacctggagacttcgggttcgatcctcctggcctaggatccgaccccgagaccttgaaatggaacgtgcaagcggaactcgtgcattgcagatgggcaatgttaggtgcagccgggatcttcatccccgaattcctaacaaaaatcggaatcctgaacactccttcatggtacaccgcgggtgaacaagagtacttcaccgataaaccaccctcttcatcatcgagcttattttcatcgttgggccgaaggcagaagatgggctgacatcatcaaacctgggtgtgttaacactgacccaatcttcccacaacaagctaaccgggaccgatgtgggcgtacccaggggccgtatggttcgacccacctcgggtggggaaccggctcgcctgcaaagctcaaggagttgagaaccaaagagatcaagaatggtagattggctatgttggctgtgatgggtgcatggttccaagccatttacaccggaaccggacccattgacaacctgtttgctcaccttgcggacccgggtcacgccaccatcttcgctgcattcaagggctaaagatattggcttgaaggatttgaagagtttgtgataagtggtgtttgtgtaacattagaaattgtatgtgtagaaaagttttaattgcaatagtacaaatacctctttaaactaccaaatagttgtatgtcatccaataccaactacttcacatggatttggtaaatacataaagacaagacatgcacttcactacaataac

SEQ ID NO: 5674 - DNA, 1180 bp, Flaveria ramosissima
cgtagggtaagtctaagacctaggagtaaccgactgggaaaccgtacgatttacgtctacgcatcaaatactgtacccaaactattactacactacaatgggttcccactgcttgtgtcatcgttactgccattgccagctgttgctttctcttctccaagttcacagaagagtggatctattgttggatcaacaaaggcttcttttcttggtgggaagaagctgagagttagcaaattgggtgcaccatccggttcacgatcgttcggaaccgtgtgcgttgcggctgaccccgatagacccatttggttccccggtagcaccccacccgaatggctcgatggcagcctacccggagacttcgggttcgatcctcttggcctaggatccgaccccgagactttgaaatggaacgtgcaggcggaactcgtgcactgcagatgggcaatgttaggtgcagccgggatattcatccccgaattcctaacaaaaatcgggatcctgaacactccttcatggtacaccgcgggtgaacaagagtacttcaccgataaaaccaccctcttcatcatcgagcttattttcatcggttgggccgaaggcagaagatgggctgacatcatcaaacctgggtgtgttaacactgacccaatcttccccaacaacaagctaaccgggaccgatgtgggctacccagggggcctatggttcgacccactcgggtgggggaccggctcgcctgcaaagctcaaggagttgagaaccaaagagatcaagaatggtagattggctatgttggctgtgatgggtgcatggttccaagccatttacaccggaaccggacccattgacaacctgtttgctcaccttgctgacccgggtcacgccaccatcttcgctgcattcaagggctaaagatattggcttgaaggatttgaagagtttgtgataagtggtgtttgtgtaacattagaaattgtatgtgtagaaaagttttaatgcaatgtacaaatacctctttaaactccaaatgttgtatgtcatccaatccaactacttcacatggatttggaaatcacaagcaagacatgcacttcactacaatcaaataagtaaagtttgatttgacaaaaacaacatctaaaccttttttttataacttatggatcacaaacaatgt

SEQ ID NO: 5675 - DNA, 1207 bp, Actinidia deliciosa
gtcctcatatccctccttgtcaccccaatcaaacacagttcaaagaaaaaatctgcccgcatggcctcctctgtttgtgcttcttcagccattgcagctgttggcctctcttcaaccagtgcccagaagactggatcaattgtgggagcaacaaaggcttctttccttggaggaagaaacctgagactgacaaaatacaccacacggaaatctggaccacggtcggtcaccgtttgcgctgcagccgatcctgacagacccatctggttcccgggcagcatccctcctccgtggctcgacggcagcctccctggagacttcggatttgatccccttggccttggatctgatcccgagaccttgaaatggatggtacaatcagagatagtgcactgcaggtgggcaatgctgggcgctgccggtatcttcatccccgaattcctaacaaagctcggaattctaaacactccttcatggtacactgctggcgagctcgagtacttcaccgataaaaccactctcttcatcattgagttgatcttcattgggtgggctgaggggagacggtgggcggacatcctcaaaccggggtgtgtgaacaccgaccccatcttccccaacaacaagcttactgggaccgacgttgggtacccgggtgggctgtggttcgacccacttggctggggaagcggttctcctgagaaaatcaaggagttgaggacaaaggagatcaagaatgggcggttggccatgttggcggtgatgggtgcttggttccaagccaactacacgggcactggaccgatcgacaacctctttgcccaccttgctgatcctggtcatgccaccatttttgctgctttcacccccaagtgataggcgcatgagatcaagcatgctaaatgggatttatgtattggagaaacattttgggtgcaaggaaggacttagacgtgtttttccaagtgatgattgtctgaatttttcattgcccatctatttatgtctgctgtagaaagatcatgcagtgtacaaacacctctttctttgaacttaaacgctatgaatataattaaggtagtaatgaaaattgagcgcataagtaaccatttatatgatggaaacaaaccccagactggtaatgtatcatctttatgagaaatagggagacccaagcttaatttgcatatagcacatggcttgttac

SEQ ID NO: 5676 - DNA, 1558 bp, Actinidia deliciosa
  misc_feature (988)..(988): n is a, c, g, or t
  misc_feature (1039)..(1039): n is a, c, g, or t
caccccaatcaaacacagttcaaagaaaaaatctgcccacatggcctcctctgtttgtgcgtcttcagccattgcagctgttggcctctcttcaaccagttcccagaagactggatcaattgtgggagcaagaaaggcttctttccttggaggaagaaacctgagaccgacaaagtacaccacacggaaatctggaccacggtcggtcaccgtttgcgctgcagctgatcctgacagacccatctggttccctggcagcatccctcctccgtggctcgacggcagcctccctggagacttcggatttgatccccttggcctcggatctgatcccgataccttgaaatggatggtacaatcagagatagtgcactgcaggtgggcaatgctgggcgctgccggtatcttcatccctgaattcctaacaaagctcggaattctaaacactccttcatggtacactgctggcgagctcgagtacttcactgataaaaccactctcttcatcgttgagttgatcttcatcgggtgggccgaggggagacggtgggcggacatcctcaagccggggtgcgtgaacaccgaccccatcttccccaacaacaagcttactgggaccgacgtagggtacccaggtgggctgtggttcgacccacttggctggggaagcggttctcctgagaaaatcaaggagttgaggacaaaggagatcaagaatgggcggttggccatgttggcggtgatgggtgcttggttccaagccaactacacaggcactggaccgatcgacaacctctttgcccaccttgctgatcctggtcatgccaccatttttgctgctttcacccccaagtgatgggagcaagagatcaagcatgctaactgggatttatgtattggagaaacattttgcttgaaaggaaggacttaagacgtgtttatataagtgatgattgtctgaatttttcattgcccatctgtttatgtntactgtagaaagatcatgcagtgtacaaagacctctttctttgaacttaanccgctataatataattaaggtagtaatgaaaattgagcacataaggtagtaaaccccagactggcaacgtatcatctttatgagaaatagggtacacgagacccaagcttaatttgcatatagcacattgcttgttactcaccaaagctcaaagaattaacaaggtaatagatatacagtttagaaaggaactagaattaatcacacaaggaaatgttccagcatgtgctgcctaattgtatggtacattatcatttttacataggtctggcacaagtctctgtccaatattaataacatgcagcttcctttgtacgttcaaagattatggggggtttagagcagcaacagactcattaaagttgtgtttggatgttggattagccaaggaatttgatgcctttgtagttttggggaagaagaaaggcagataggacagttagtagaagatttaatctttgaccaaattagtgtacagttatatgtactacttgtgagtttcttcttaaaaaaaaaaaa

SEQ ID NO: 5677 - DNA, 1133 bp, Tripterygium wilfordii
gacacctacgtataactaaagaaaaaaaatgggactttcgggtttgtgcttcttctgccattgcagctgttgctgtctcttctcccagctcccagaagagtggatccattgttggggcaacaaagactgcattcctcggtggaaagaaactgagatcagcgaagaaattcacagcaccagctgcgagatcatcggttgctgtatgtgcagtagcggatcctgataggccactctggttcccaggcagcactcctcctccatggcttgatggcagtctccctggggactttggttttgatcctcttggactttcatctgatcctgacagcctaagatggaacgttcaatcagaaattgtgcactgcagatgggcaatgttgggtgctgctgggattttcattccagaattcctaacaaagattggaatcctaaacactccttcgtggtacacagctggagaacaggagtacttcactgacacaaccactctcttcgttgttgaaatgatctttattgggtgggcagagggaagaagatgggctgacattatcaaaccagggtgcgtcaacactgacccaatcttccccaacaacaagcttactgggactgatgttgggtacccgggggggttatggtttgacccacttggatggggaagtggatctcctgagaaagtgaaggagttgaggacaaaggagatcaagaatgggagattggccatgttggctgtgatgggtgcttggttccaacacatctacactggcactggacctattgacaacctctttgctcaccttgctgatccgggtcatgccaccgtttttgctgctttcactcccaagtgagaagagaaggcaataagagtagggtggacattgatgaagatgtttgccaagagaggaggttgaagatgtgtgtcctcagaaagagcctttgtatcagtagaacttcgaatgcccctgtttgtgtattttatggaatgttcatgcaatgtacaaatacatctttaattttagatgctaagtaagtatacagaatatgatcagtagctagaattgttcgcaaaagcatatgcatattggattttcacaaacgcacagaaaaagttaaattaataacaataatacagaacc

SEQ ID NO: 5678 - DNA, 1340 bp, Musa acuminata
gctattaccagaaccagagatcggagagagcttcctccatggcttccgtctgtgcttcctcctctgcagttgcagcagtcgccagttctcagaagaatggagctgctcttgccgcgaccaaggcatcgttccttggtggaggaaggaaggtgaggcagggaaagtgggcgacaaaaactgctcgccgggccttctcggtgtccgctgcagctgtgcctgagagaccgctttggttcccaggcagcacccctccgccatggctggacggcagcctcccgggagacttcggctttgatcccctgggccttggatccgaccctgagagcctgaggtggaaccagcaggcggagatcgtccactgccggtgggcgatgctgggagccgccgggatcttcatcccggaattcctcacaaagatcggcatcctcaacaccccttcatggtacaccgccggccagctggagtacttcaccgacaccaccaccctcttcgtcatcgagctcatcttgatcggatgggccgaggggaggcggtgggcggacatcatcaagcccgggtgcgtcaacaccgaccccatcttccccaataacaagctcaccggcaccgacgtcggctaccccggcggcttctggttcgaccccctcggctggggcagtggctcgccggagaaggtcaaggagctaaggaccaaggagatcaagaacgggagactcgcgatgctggcggtgatgggggcgtggttccaagccatatacaccggcacgggtcccatcgacaacctcttcgcccacctcgccgatcctggccatgcaacagtgttcgctgctttcacccccaagtgaatcagtgtcggagctgtctcaaaatagcggtgcaatattgaatgcttgaatgtaacctcaaaacagattcatctttctgctgatgtattattataagtagcaatggacagttcacatgttgcttcacatcgtttcgttgcctgtggccaagaaagaacaagttgagcctcggatgtttcagaatgaatccactttctcacaagaaaacatgttgactaataagagaaattctactgccatctttcgggcatcaattccatgaacagttatcgcagattaatattatattttggtttaaaagagaacaaaaagtggtcttaaagttccagcagaaacgagacaatattattcataaaagccacataaaacaaagcgtttccagtagaagaaggcaaatatatggcagattagggtgctaccgaattacaactagaacaaaaactttgtttagcttacaatggtcattgacgattgatgacatctacctcggcaattaat

SEQ ID NO: 5679 - DNA, 1058 bp, Musa acuminata
ctctctcaagagaattcggccattacggccgggggctattaccagaaccagagatcggagagagcttcctccatggcttccgtctgtgcttcctcctctgcagttgcagcagtcgccagttctcagaagaatggagctgctcttgccgcgaccaaggcatcgttccttggtggaggaaggaaggtgaggcagggaaagtgggcgacaaaaactgctcgccgggccttctcggtgtccgctgcagctgtgcctgagagaccgctttggttcccaggcagcacccctccgccatggctggacggcagcctccccggagacttcggctttgatcccctgggccttggatccgaccctgagagcctgaggtggaaccagcaggcggagatcgtccactgccggtgggcgatgctgggagccgccgggatcttcatcccggaattcctcacaaagatcggcatcctcaacaccccttcatggtacaccgccggccagctggagtacttcaccgacaccaccaccctgttcgtcatcgagctcatcttgatcggatgggccgaggggaggcggtgggcggacatcatcaagcccgggtgcgtcaacaccgaccccatcttccccaacaacaagctcaccggcaccgacgtcggctaccccggcggcttctggttcgaccccctcggctggggcagtggctcgccggagaaggtcaaggagctaaggaccaaggagatcaagaacgggagactcgcgatgctggcggtgatgggggcgtggttccaagccatctacaccggcacgggtcccatcgacaacctcttcgcccacctcgccgatcctggccatgcaacagtgttcgctgctttcacccccaagtgaatcagtgtcggagctgtctcaaaatagcggtgcaatattgaatgcttgaatgtaacctcaaaacagattcatctttctgctgatgtattattataagtagcgatggacagttcacatgttgcttcacatcgtttcgttgcctgtggccaagaaagaaccaagttgagcctcggatgtttcgc

SEQ ID NO: 5680 - DNA, 1089 bp, Lippia dulcis
tacattcctgcacacacaaacggcctctgcctgtgcttcatcagccattgctgctgctgccttctcccagagctcacagaaaaatggatcaattgtgggagcaactaaagcctctttctttggacgaaaaacgttgagagtcagtaagcttacagcaccttcggacaagagatcagtggccgtctgtgcggcagctgatcccgacagaccgttgtggttccccggaagcatccctcccccgtggctcgatggcagccttcccggagacttcggcttcgatcctctcggcctagcgtctgacccagagagcttgaaatggaaccagcaggcggagcttgtccactgcagatgggccatgctgggcgctgccggcattttcatccccgagttccttaccaagatcggcatcctcaacaccccttcgtggtacactgccggtgagcaggattacttcactgacacgacgacactctttgttgttgagttgattctcatcggctgggctgagggaagaagatgggcagacatcctcaagcccggatctgtcaacactgatcccatattccccaacaacaagcttactggaaccgatgttggctaccctggtgggctgtggtttgacccactcgggtggggcactggatcaccagaaaaactgaaggagctgagaacaaaggaaatcaagaacggaaggctggcaatgttggcagtcatgggagcatggtttcaacatatctacaccggaacaggacccatcgataacctctttgctcaccttgctgatcctggccacgccaccatatttgcttctttcagccctaagtaagaaagacaacaaagtcgatagcacaagtgtgagacaaacagcagcaaccaattgtggatggaagaggacattcttagtttgtttttccaattaatgttgcattgtttagatgtgtactgctacatccttatgtatgtagataagtgcttaagccatgtacaaatgcatccaagagatcctatatcacatcatgtccatatatataccaatatgcatgcattcatgaagacagtttatggaatcttagattagtcaaaaaagaa

SEQ ID NO: 5681 - DNA, 1465 bp, Amborella trichopoda
gagaaaatacctataacaaggaagaatccaaaagatccacatttgccctaacaagaaccaccagctcctcattgtacacttcagcatggatctagaggctggggggctcatattagattccgtgtgccgcgtgtcaacacctgatccaatcagaaacacatctcctatctccattggataagccccttccatgcttacaaatccaataccctctcccactgtcaaaaactgagaaaggaaaaaccaggagagaaaaaagagaggaaaaggtagttgcagaaatggcctctgtttgtgcatcttcttcgacaatcgctgctgcgaccatctccgcttccaggcagctctcagaagaatgttaaagcttccttcttgggaggaaggtcacttagacagggcaaggtatgggttcctgtctccaggagatccctgacagtgtctgcagctgttgcctctgaaaggcctctctggtttcctggcagcacccctcctgaatggcttgatggaagccttcctggagacttcgggttcgatcctcttgggcttggttctgaccctgaaagcctaagatggaaccaacaagcagagctggtccactgccggtgggctatgcttggtgctgcaggcatcttcatccctgaattccttacaaaattgggcattctcaacaccccctcatggtacacagctggtgagcaagagtacttcaccgataccaccaccctctttgtagttgagctcatattcatcggttgggctgagggtagaaggtgggccgatatcataaagccagggtgtgtcaatactgacccaatcttccctaacaacaagcttacgggcaccgatgtgggttacccaggtggcctatggtttgacccacttggttggggatctgggtcacctgagcagcttaaggagctaaggactaaggagatcaagaatgggagattggctatgttggcagtcatgggtgcatggttccaagccgtctatacaggcactggacccatcgataacctttttgcccaccttgctgaccctggccatgccaccatcttcagtgccttcacccctaagtgaggaaaggtacatcggctttggaggtattgctggatcagaaatcagacatggctgtaatattttgactggatcaggagttgtatttctaaggaggaggacttgtaatgtaatcctggattggagtgtatgtatttatataatttgtttaagttcactgtatctgtcatagcagttctgctcttagcatagtggtttgggcctcaaacttctcgaggtacatttggtaactagaagcaagggatttcctgaaatctggaagctaaaactgtggatatctggaagttttcgaataccttcttgataatgtctacaagttctcaactacagaacaagctccatggaaatctaagaacgcttcacggagactaggcttcacacacacaca

SEQ ID NO: 5682 - DNA, 1156 bp, Epimedium sagittatum
acagagagggagagacacaaaacactttctgagatggcttcggtctgtgcttcttctgcaatttcgactatttccatctcttccagttcacagaagagtggatctttaggaggaatcaagaattctttccttctagggaaaaaaccgagtcggagatccagatctttgacacttgtgcgtgcagcagcaactggtgctgatagacccatctggttcccaggcagtactcctcccccatggctcgacggcagtcttccaggagatttcgggtttgacccacttggtctttcatctgatccagacagtttgaaatggaacgtccaatcagaaatcgtccactgcagatgggctatgctcggtgctgccgggatcttcatccccgaattcctaaccaagattggaatcctaaacaccccttcatggtactctgctggtgagctggactacttcacagacaaaaccaccttattcattgttgagctcatcttcatcggttgggcagagggaagacggtgggctgatatcattaagcctggatgtgtgaataccgacccaatcttccctaacaacaagcttacagggactgacgtcggatatccaggtggtctatggttcgacccactcggttggggaagcggatctcctgagaagatcaaagagttgagaacaaaggagatcaagaacgggagattggctatgttggcagtcatgggcgcatggttccaacacatctacacgggtacaggacccattgacaacctcttcgcccaccttgctgaccctggccatgctacaattttctctgctttcacccccaagtgaagacagcacggaagaacctccatgagatccatgtcgggagataaatgtaaatcctatgtgaccaagggaattgaaatttgaaaagagtattttggttgccttctgtatcatctaaacttgtactgtttttctgtttacatgtcttttataatatgtccatgctatgtacaaatacctacatcagccttatataacttagtaaatgatgcaaaaccttggcaggtagactttgaagtttgttaagagttgtgaattgtgcttaaatcaacaaccttatcattgtgcattttcaatcatttaaagatcatgaagcctttgtacttcagacttaaac

SEQ ID NO: 5683 - DNA, 919 bp, Helianthus annuus
attcttcttgtagacaaaacacaatggcttgtgcttcttctgccattgcagctgttgctttctcttctccaagttcacagaagagtgttggatcaacaaaggcttcttttcttggtgggaagaagttgagagttagcaaggtgggtgcaccctccggttcacgatcattcggaaccgtgtgcgttgcggctgaccccgatagacccatttggttccctggcagcactccaccagaatggctcgatggcagccttcccggagactttggttttgatcctcttggcctaggatcggatcccgagactttgagatggaacgtacaagcggaacttgtacattgcagatgggcaatgttaggagcagccgggattttcatcccggaattcctaacaaaaatcggaatcttaaacactccatcatggtacactgctggtgaacaagaatacttcaccgacaaaaccacactcttcatcattgagcttattttcatcggttgggccgaaggaagaagatgggccgacatcatcaaacctgggtgtgttaacactgaccccatcttccctaacaacaagctgaccgggacagatgtcgggtacccaggtgggctatggttcgacccactcgggtggggaaccggctcgcctgcaaaactcaaagaattgaggacaaaggagatcaagaatggaagactggctatgttggctgtgatgggtgcatggttccaagccatctacactggaaccggacccattgacaacttgtttgctcaccttgctgacccgggtcacgccaccatcttcgctgcattcaagggctaagcatgcatatggaggaatttaaagagtttttggcaagtggtgtttgtgtgtcattagaaactgtatcttcatcttaatttactgtagagaagttttaatgc

SEQ ID NO: 5684 - DNA, 1033 bp, Amborella trichopoda
  misc_feature (949)..(949): n is a, c, g, or t
tcccactgtcaaaaactgagaaaggaaaaaccaggagagaaaaaagagaggaaaaggtagttgcagaaatggcctctgtttgtgcatcttcttcgacaatcgctgctgcgaccatctccgcttccagctctcagaagaatgttaaagcttccttcttgggaggaaggtcacttagacagggcaaggtatgggttcctgtctccaggagatccctgacagtgtctgcagctgttgcctctgaaaggcctctctggtttcctggcagcacccctcctgaatggcttgatggaagccttcctggagacttcgggttcgatcctcttgggcttggttctgaccctgaaagcctaagatggaaccaacaagcagagctggtccactgccggtgggctatgcttggtgctgcaggcatcttcatccctgaattccttacaaaattgggcattctcaacaccccctcatggtacacagctggtgagcaagagtacttcaccgataccaccaccctctttgtagttgagctcatattcatcggttgggctgagggtagaaggtgggccgatatcataaagccagggtgtgtcaatactgacccaatcttccctaacaacaagcttacgggcaccgatgtgggttacccaggtggcctatggtttgacccacttggttggggatctgggtcacctgagcagcttaaggagctaaggactaaggagatcaagaatgggagattggctatgttggcagtcatgggtgcatggttccaagccgtctatacaggcactggacccatcgataacctttttgcccaccttgctgaccctggccatgccaccatcttcagtgccttcacccctaagtgaggaaaggtacatcggctttggaggtattgctggatcagaaatcagacatggctgtaatattttgactggatcaggagttgtatttntaaggaggaggacttgtaatgtaatcctggattggagtgtatgtatttatataatttgtttaagttcactgtatctgtcatagc

SEQ ID NO: 5685 - DNA, 1198 bp, Flaveria ramosissima
cggtttttactcgcaaaacactcattcttgattatacaatacatggcttcaactgcttgtgcttcttctgctattgcagctgttgcttctcttccccaagttcacagaaagtggatgtactgttggatcaacaaaggcttctttcttggtgggaagaaactcaaagttagcaagttgggtgcaccatccggttcacgatcgttcgcaaccgtgtgcgctgcggctgatcccgatagacccatctggttcccgggcagcaccccaccagaatggctcgatggcagcctacctggagacttcgggttcgatcctcttggtctaggatctgatcccgagactttgagatggaacgtacaggcggaactagtacactgccgatgggcgatgttaggtgccgccgggatctttatccccgaattcctgacaaaaatcggaatccttaacactccgtcgtggtacaccgctggtgaacaagaatacttcacagacaaaaccacactcttcatcattgagcttattttcattggttgggctgaaggaagaagatgggctgacatcatcaaacctgggtgcgttaacacggaccccatcttccccaacaacaagctaactgggaccgatgttggctacccgggtgggctatggtttgacccactggggtgggggagcggttcacctgcaaagctcaaggagttgaggaccaaagagatcaagaatgggaggttagccatgttggctgtgatgggtgcatggttccaagccatctacactggaaccggacccatcgacaacctgtttgcgcaccttgcggacccgggtcacgccaccatttttgctgcattcaagggctaaaacagcattataagggcttttggcaaagtgatgtttgtgtattattagaaactctatcttatgtttactgtagatcaaagttaatggaatgtacaaacacctcttaatttcaactcaaaatggtgcatatagatatattacataagctagcttgtatgtcattaaagtatttcacatataacatcgaagaatccttgttaaatcttgtaacactttaagcgtcaaatgaaacgcttgtgatctatctggtttctgtaatagttgacacgcgatagctcatccggattggaatgttacactatcttcctcctacactacactgcagacacatacattcattacaaag

SEQ ID NO: 5686 - DNA, 1169 bp, Phalaenopsis aphrodite
ttggtttcaacgctcaacgaatatggcctgtgtgtgtgctccttccgccgtcgccgctgttgccatcgtctcatccaacgttcagaagaacgggaatggactctgtgcaaccaaagaacatttcctggttggaaagggagtgaggcaaagtacggcagttgtcgccggcaagcggcgatctttctcagtgtcagcggcggcaattgagagaccactttggttccctggaagcactccacctccttggcttgatggcagccttcctggtgactttggtttcgatccacttggccttggatcggacccagagagcttaagatggaacgtgcaatccgaactagtgcactgtcgatgggcaatgcttggtgctgccggcatcttcgtccccgagttcctcaccaaaataggcattctcaatacaccttcttggtactccgcgggcgagctcgaatacttcaccgacaccaccaccctcttcatcatcgagcttattctcatcggctgggccgagggtcgacgttgggctgatatcatcaagcccggttgcgtcaacaccgaccctatattccccaataataaactcaccggcactgatgttggctatcctggcgggctctggtttgacccgctgggctggggcagcggttcgccggagagagttaaggagctgaggaccaaagagatcaagaacggacgccttgccatgcttgccgtcattggcgcgtggttccaacacatctataccggcaccggtccaatcgacaatctcttcgcccaccttgccgaccccggccacgccactatcttcgctgctttcacgccgaagtgagaatctagaagagaaggttcgtgttgggcctcagacgaacatgcttggaagatggtttgttgctgggatttgctctagtatgtttaccgctatggaagctgtttgtaatgtgataagtagtgttacggaaacttaagggagaaatggcttcagtacaaattttttctttgtggtgtggaatatgccgtcattcggtcttcaaagtacgcgaaaattatatcgaaagctttagtaataatcgaatgtcacatcaagaatcttatcgaatatagatgtgaatatagatgtttgcttaagcgatacttaactttggggcttcatacatattatttagcaaata

SEQ ID NO: 5687 - DNA, 1218 bp, Sarracenia psittacina
caatcaaacacaaagttccaagaaaaaaatctagaccccaaaaatggacctcctgtgcctgtgcttcttcggctattgcagctgttgccctctcttcttcacccagttcccagaagagtggatcaattgtgggagcaacaaaggcttctttccttggagggagacaactgagagttagaaagtatagagcacaggcaggaacacaaagggtttcggcaggaacacgatcggttaccgttgtgccgtagctgatcccgaaaggcccctctggttcccaggcagcacccctcctccatggcttgacggcagcctccctggagacttcggatttgatccccttggccttggatcggatcctgagacattgagatggaacgtacaatctgagatagtgcactgcagatgggcaatgctgggtgccgccggtatcttcatccccgaattcctaacgaagatcggcattctaaacacgccgtcgtggtacaccgccggggagcttgaatacttcacggacaagaccacgctcttcgttgtcgaactcattttcatcgggtgggcggagggaagacggtgggctgacatcatcagtccggggagcgtgaacaccgacccaatcttccccaacaacaagcttacagggacggatgttgggtacccgggtgggctatggttcgacccacttgggtggggaagcggttcgcctgagaaaataaaggagctgaggacgaaagagatcaagaatgggaggttggcgatgttggccgtgataggtgcttggttccaagccatctatacgggtactggacccattgacaacctctttgcccaccttgctgatccgggtcatgccactatttttgctgctttcagccccaagtgatgggagcaggtgatcaagcaagctaactgggattgaaacattctgtaaacacgtttgtacacggatggacttacaagaagtgtgtttttcctagtgatgtttgtctgagtagaatctgcaatcacctatctgtttgtgtctgctgtagaagattgtacattgtacaaacatctctttgctttcaactttaaatgccataaatatgatctgggtagtaatgaaatcatccatataatgacattatggacagaaaccctaaataggccatgttccacctttatgaaaatcgacatacacgaatgttgttctgtggttaattttcgtaaaagacgtggctt

SEQ ID NO: 5688 - DNA, 1038 bp, Antirrhinum majus
agtacaatacctacacacattaactctaacactcgcacaataatcccacatggcctccgcctgcgcttcgtcggccgttgccttctcgtcgtcaagttcccagaaaatcgaaagcattgtgggatcaactaaggcttctttcttcggagcaaggaaattgagagtaagcaagtacacagccccatccagctcaagatcggtggcggtatgtgtggcggctgatgcagatagaccactgtggttccccgggagcacgcctcctcaatggctcgacggcagccttcctggagactttggctttgatcctcttggcctaggatctgaccctgagagcttgaaatggaatcagcaagcggagcttgtacactgcagatgggccatgttaggtgcagcgggtattttcattcccgaattccttacaaagattggcatccttgacactccttcctggtacgctgctggtgagcaagaatacttcactgataccacaacactcttcattgttgagttggttcttattggatgggccgagggaagaagatgggcggatatcattaaacccggaagtgtgaatactgatcccattttccccaacaacaagcttactggaactgaggtcggataccccggcggactatggttcgacccacttggatggggtgccgggtcgccgcaaaaggtgaaggaattgaaaacaaaggagatcaagaatggcaggttggcgatgttggctgttatgggagcgtggttccaacacatttacacgggtacaggacccattgataacctttttgctcacctcgcggatcccggtcacgccaccatttttgctgcattcagccccaagtgagagacgggaagtcacttcaacaggagtgtagaagaaataccaacactatcattcaggggccaaaggatagactctgcattttccaatcaatgatgaatttttagatatgtgtctatatctttatgtgctgtaaaagagcttatgcgatgtacaaatatcttcaaaagatatataatcttcataaatac

SEQ ID NO: 5689 - DNA, 975 bp, Flaveria ramosissima
ttgctttctcttccccaagttcacagaaaagtggatctactgttgcatcaacaaaggcttcttttcttggtgggaagaaactcaaagttagcaagttgggtgcaccatccggttcacgatcgtttgcaaccgtgtgcgctgcggctgaccccgatagacccatttggttcccgggcagcaccccaccagaatggctcgatggcagcctacctggagacttcgggttcgatcctcttggtctaggatctgatcccgagacgttgagatggaacgtacaagcagaactagtacactgcagatgggcaatgttaggtgcagccgggatcttcatccccgaattcctgacaaaaatcgggatcctaaacacgccgtcatggtacactgctggtgaacaagaatacttcaccgacaaaaccacgctcttcatcgtcgagcttatctttattggctgggctgaaggaagaagatgggctgacattattaaaccagggtgcgttaacacggaccccatcttccccaacaacaagctaactgggaccgatgttggctacccgggtgggctatggtttgacccactcgggtgggggagcggttcgcctgcaaagctcaaggagctgaggacaaaagagatcaaaaatgggaggttagccatgttggctgtgatgggtgcatggttccaagccatctacactggaactggacccattgacaacctgtttgcgcaccttgcggacccgggtcacgccaccatttttgctgcattcaagggctaaaacagcattataaaggcttttggcaaagtgatgtttgtgtattattagaaactcttatcttatgtttactgtagatcaaagttaatggaatgtacaaatacctcttaatttcaactcaaaatggtgcctatagatatattacataagcttgtatgtcattacagtatttcgcatataatatcaacagacccatgttaaatct

SEQ ID NO: 5690 - DNA, 1021 bp, Papaver somniferum
aagtttcagcagaacatagcagaaacatttttgattttgaaacaaaaatggcatctgtttgtgcttcttcagcagttgcagctgttgccatctcttccagttctcagaagagtagtggagctattttgggagcaacaaagacatctttccttgttggaagaaagcttagtcaaaggaaagccattacagcatcacctgtaagaggatcaaactccttttccgtgtctgcagcggcgacccccgactctgaacggcctctgtggttcccaggaagcgtccctcccccatggcttgatggcagtcttccaggagactttggatttgatcctcttggtctatcatcggatccagagagtctaaaatggaaccaacaatcagagctagtgcactgcagatgggcaatgttgggtgctgctggtattttcatcccagagttcctaacaaagattggaatcctaaacacaccttcatggtacactgctggagaacaagagtacttcacagacacaaccacccttttcattgttgaactcatctttatcggttgggccgaaggtagaagatgggccgacatcatcaaacctggcagtgttaacaccgatcccatcttccccaacaacaagctcaccggaactgatgttggataccccggtggcctctggtttgacccactcggctggggaaacgcttccggtgagaagcttaaggagttgaggacaaaggagatcaagaatggaagactagccatgttggctgtaatgggtgcttggtttcaagctatttacactggcacaggccccattgacaacctcttcgctcatttggctgaccctggacatgccaccattttccaagctttcacccctaagtgagaaaggatggatctacaaaactgacagaaaatctacatgcatggatgcaaatcaatgtttatgtgaagatcaatgtggcagctagggttgtgaatgggttcctcaagtgattgtctgtaattttaagcttgtattgccttctattcata

SEQ ID NO: 5691 - DNA, 1111 bp, Primula obconica
catacacataaccaaaacacaaatttgagaaagtagaatttggtgacatggcatcttctgtctgtgcttcttcagctattgcagctgttagcctctcttctcccagttcccagaagagtggatcaatagtgggagcaacaaaggcttcttttgtaggagggaaaagattgagggtgaacaagtacacgtcatcagctggtgctcgtacacggtctcttaacgtgcgcgcagttgcagcagatcccgagaggcccttgtggttccctggcagcacccctcctgaatggctcgacggaagccttccgggagattttggtttcgatccccttggtcttgggtctgacccagagaccctgaagtggaatgtacaatcagagctggtccactgtaggtgggccatgctcggtgccgcggggatcttcatccctgaattccttaccaagatcggtatcctcaacaccccctcgtggtacacagctggcgaacaggagtacttcactgacaccaccaccctctttatagtcgaactcatcttcatcggctgggccgagggccgacgttgggccgacatcctcgagcccgggtctgttaacaccgacccaatttttcccaacaacaaactgacaggtactgatgtggggtacccaggcgggctctggttcgacccattgggatgggggaacgcgtcgccggagaagctaaaagagttgaggactaaggagattaagaatgggaggctggctatgttggcagtgatcggggcttggtttcaagctaattataccggcactggccctattgataacctatttgctcacctttctgatcctggtcatgccaccatcttcgccgctttcagctccaagtgaaaaagtgatgaagcgggttaaatggtcgagtttgtgtattttgcaatttcatggtgtgacgaagaaattaatgttaattttattgttcgaacagaatttgcgttgtctatttgcttgtgtttaatgttgaaagataatgcaatgtacaaacctctctttgttccgtgtacttggtagaatattggtaatagtcaaatagaaagcacacagtgcaaccggtgatataccggttttgtcataaa

SEQ ID NO: 5692 - DNA, 1104 bp, Phalaenopsis aphrodite
cgaatatggcctgtgtgtgtgctccttccgccgtcgccgctgttgccatcgtctcatccaacgttcagaagaacgggaatggactctgtgcaaccaaagaacatttcctggttggaaagggagtgaggcaaagtacggcagttgtcgccggcaagcggcgatctttctcagtgtcagcggcggcaattgagagaccactttggttccctggaagcactccacctccttggcttgatggcagccttcctggtgactttggttcgatccacttggccttggatcggacccagagagcttaagatggaacgtgcaatccgaactagtgcactgtcgatgggcaatgcttggtgctgccggcatcttcgtcccgagttcctcaccaaaataggcattctcaatacaccttcttggtactccgcgggcgagctcgaatacttcaccgacaccaccaccctcttcatcatcgagcttattctcatcggctgggccgagggtcgacgttgggctgatatcatcaagcccggttgcgtcaacaccgaccctatattccccaataataaactcaccggcactgatgttggctatcctggcgggctctggtttgacccgctgggctggggcagcggttcgccggagagagttaaggagctgaggaccaaagagatcaagaacggacgccttgccatgcttgccgtcattggcgcgtggttccaacacatctataccggcaccggtccaatcgacaatctcttcgcccaccttgccgaccccggccacgccactatcttcgctgctttcacgccgaagtgagaatctagaagagaaggttcgtgttgggcctcagacgaacatgcttggaagatggtttgttgctgggatttgctctagtatgtttaccgctatggaagctgtttgtaatgtgataagtagtgttacggaaacttaagggagaaatggcttcagtacaaattttttctttgtggtgtggaatatgccgtcattcggtcttcaaagtacgcgaaaattatatcgaaagctttagtaataatcgaatgtcacatcaagaatcttatcgaatatagatgtgaatatagatgtttgctt

SEQ ID NO: 5693 - DNA, 1277 bp, Beta vulgaris
ctttgaaccatcaaaaagcccatttggcaattatattgcccaaaaaaaacactctcattgaggaaaaacaataataatggcttctttgtgtgcttcttcagcctcaacagctatttgtgcttcttctcacagttcacagaagaaaggcagtgtgttgggagcaacaaaggcatcatttcttggaggaaagaagttgagagacaccaaatacaaggcaccaactgcctcaaagtccttgagtgtctcagcagcagcagctgaaccagagaggcctatttggttccctggaagcacccctcctccatggcttgatggaagccttccaggagactttggctttgatcctcttggatttggttctgacccagagacattgaaatggatggtgcaatcagaactagtccattgcagatgggctatgttgggagcagctggtattttcatcccagaattcctaacaaaacttggcatcctaaacaccccttcatggtacactgctggagaacttgagtacttcacagacaccaccacactcttcataattgagatgatcttaattggttgggccgagggccgaagatgggccgacatcctcaagcccggttgtgtcaacactgacccaatcttccccaacaacaagctgactggaactgatgtgggctacccgggtgggctttggtttgacccattgggctggggttcgggctcacctcaaaaaacaaaggagttgaggaccaaggagattaagaatgggagattggctatgttggctgttatgggggcctggttccaacacatttacactggcactggcccaattgataacctctttgcccaccttgctgatcctggacatgccacaatttttgctgcttttacccccaagtgatgagatgaagatcaaatgcatagctgttggttgttatgggatcaaataggaagttcaaaagggtattttcggacaagtacgaggtcggcacaatttgatcggttttttagttgttgcacctacgaattgttggagctttgtacaaatacctcttggatttagtacataattatgaatattatcatctaatcttagatttactctcattaactcgtctaaaatttttaaaatatttatgctgtgattaatgtcatttggttgatattgatatcatgatatgcatggattatgcatgacaaaacatatgtgtaaatcatataacggcttgccttattagagagccttgacactatttatttatattaaaaatataaattatagatattac

SEQ ID NO: 5694 - DNA, 1192 bp, Beta vulgaris
  misc_feature (914)..(914): n is a, c, g, or t
  misc_feature (1115)..(1115): n is a, c, g, or t
  misc_feature (1128)..(1128): n is a, c, g, or t
  misc_feature (1130)..(1130): n is a, c, g, or t
  misc_feature (1136)..(1136): n is a, c, g, or t
  misc_feature (1148)..(1148): n is a, c, g, or t
gctttgaaccatcaaaaagcccatttggcaattatattgcccaaaaaaaacactctcattgaggaaaaacaataataatggcttctttgtgtgcttcttcagcctcaacagctatttgtgcttcttctcacagttcacagaagaaaggcagtgtgttgggagcaacaaaggcatcatttcttggaggaaagaagttgagagacaccaaatacaaggcaccaactgcctcaaagtccttgagtgtctcagcagcagcagctgaaccagagaggcctatttggttccctggaagcacccctcctccatggcttgatggaagccttccaggagactttggctttgatcctcttggatttggttctgacccagagacattgaaatggatggtgcaatcagaactagtccattgcagatgggctatgttgggagcagctggtattttcatcccagaattcctaacaaaacttggcatcctaaacaccccttcatggtacactgctggagaacttgagtacttcacagacaccaccacactcttcataattgagatgatcttaattggttgggccgagggccgaagatgggccgacatcctcaagcccggttgtgtcaacactgacccaatcttccccaacaacaagctgactggaactgatgtgggctacccgggtgggctttggtttgacccattgggctggggttcgggctcacctcaaaaaacaaaggagttgaggaccaaggagattaagaatgggagattggctatgttggctgttatgggggcctggttccaacacatttacactggcactggcccaattgataacctctttgcccaccttgctgatcctggacatgccacaatttttgctgcttttacccccaagtgatgagatgaagatcaaatgcatagntgttggttgttatggcctatgggatcaaataggaagttcaaaagggtattttcggacaagtacgaggaatcggcacaatttgatcggttttttagttgttgcacctacgaattgttggagctttgtacaaatacctcttggatttagtacataattatgaatattatcatctaatcttagatttactctcattaactcgtntaaaatttttaananatttangctgtgattagngtcatttggttgatattgatatcatgatatgcatggattatgcc

SEQ ID NO: 5695 - DNA, 987 bp, Gossypium hirsutum
acctcattgtaggcaaaatggccactgtttgtgcttcttctgccgttgcagccgttgccatctcatcccccagttcccagaggagtggatcagtagtgaggacaacaaaggcttctttccttacagggaagaaacttcgatcagtcaaaaagtacacaaaaccagcagcagtccgaaccgttccggtgtgtgcagtggctgaccccgaccgacctctttggttcccaggcagtactcctccccccatggctcgatggcagcctccctggagacttcggtttttgatcctctaggccttggatcagaccctgagaccttgaaatggaacgtacaggcagagctcgtccattgcagatgggcaatgttaggagccgctgggattttcatcccagagttcctaaccaaaattggcatttttaaacactccatcatggtactttgctggaaccgaggaatacttcactgacacccccccccttttcatcgttgagcttattttcatcgggtgggcagaagggagaagatgggctgacattttcaagcctgggtgggtaaacaccgaccccattttccttaacaacaagttcacgggcaccgatgttgggtcccctggtgggctgtggttcgccccttttggttggggaactggctcccctgagaagatcaaggaattgaggactaaagagatcaagaatggtcgattggctatgttggcggtaatgggtgcttggttccaacacatttatactggcactgggcccattgacaccctttttgcccccctcgccgatcctggtcacgcccccatttttgctgctttcactcccaagtgagacagaattaagagacaccctttaagggcgattaaaatgttgggatgacaatgatgatcatccccttccatacgttggaagaagagcggaagacttgtaatgttgtgggggaatgtttgtattagtagaaactgtaatccctctgtttgtattg

SEQ ID NO: 5696 - DNA, 1128 bp, Eschscholzia californica
aaaaaaaaggttactaccactactactagaggactactatggcatccttttgtgcttctcctgctgtggcagctgttgccatctcttccagttctcagaagagtagtggtactatattgggagcaacaaaggcttctttcctcgtgggaaggaagcttacacagaggaaatctcttacttcttcaccactaagtagatcattcactgtgactgcagcagctaccgatgctgaaagacctctttggttccctggtagcacacctcctccatggctagatggcagtcttccaggagacttcgggttcgaccctcttggtctttcatctgacccagaaagtttgagatggaaccaacaagcagagctagtacattgcagatgggcaatgttaggtgcagctggtattttcatcccagaattcctaacaaagataggaattctaaacacaccttcgtggtacacggccggtgaacaagagtacttcacagacacaacaactcttttcatcgttgaactcattttcatcggatgggctgaaggtagaagatgggctgatatcctcaaacctggatctgttaacaccgacccgatcttcccaaacaacaagctcactgggaccgatgtcggatacccgggtggcctttggtttgacccacttggttggggaactgcttctcctgcgaagcttaaggagttgaggacaaaggagatcaagaatggaagattggctatgttggctgttatgggtgcttggtttcaagccatttacactggtacaggtccaattgataacctgtttgctcatctagctgatcctggacatgccactattttccaagcttttgcacccaagtgaagaaaatgatgtacaaggtgactaaggagatctagggcatgatggggaaacataattctgtggcaaaagatgaatatgaggatatttggaagggaacttgttatgaatgtgtttctttttaatgggtgtatgtaatttaaaagaacttgtagtggttacctttatattcacttctttctagttgtggtacattccttcttagtttttatgtacaaatacctaaaattggctcttaaatatttatttcattgtaaacatgaaagagcacaaaggc

SEQ ID NO: 5697 - DNA, 1197 bp, Mesembryanthemum crystallinum
gaaaaaagaaagaaagaaaaatattgagcactagagcacaaccactaagagcatcaacaatggcttctgtctgtgcttcttctgccacaacagctgtttccatctcttctcccagttcaacaagggcttccttcctaggagggaagaaggtgagagtagccaagtacagagcaccagttgggtcgacaaagtcattctcagtctcagcagtagcagctgaaccagacagacctctttggtttccaggcagcacccctcctgaatggcttgatggcagtctaccaggagactttggctttgatcctcttggccttggatctgacccagagacattgagatggatggtacaagcagaaatagtccacagcagatgggcaatgttgggagcagctggtattttcatcccagaattcctaaccaaaattggcatcctaaacactccttcatggtacactgctggtgaacaagaatatttcacagacaccaccaccctctttgttgttgaactggtcttgattggttgggccgagggccgtagatgggccgacatcctaaaccccggttgtgtcaacacggacccgatcttccccaacaacaagcttaccgggaccgatgtgggctaccctggtgggctttggttcgatccattgggctgggggtccggctcggcccaaaaggttaaggagttgaggactaaggagatcaagaatgggagattggctatgttggctgttatgggagcctggtttcaacatatctatactgggactggcccaattgataacctctttgctcaccttgctgatcctggccatgccaccatttttgctgcttttagccccaagtgatcttgatagaagcaaattcaaagaaggttgaggttaaatggggatttgttattttgagatgaaactagctacgagaaggcaaaagggatcattgaggacgttggagcaattagccgatcttgcatcttgattagttgtttagttggtattgaatgcatctacaaattgctggtgccttagcttgtacaaatacctcttgaattccagtacataactatgaaatatcatctaatcctagtttcacttataaattaaatcctttatatctatacaggaatttaatcatgatgatgtctcatatattgcatgtaacaagctcgtatcaattagcccgatcagattaaccaat

SEQ ID NO: 5698 - DNA, 1141 bp, Phalaenopsis aphrodite
tgtgtgtgtgctccttccgccgtcgccgctgttgccatcgtctcatccaacgttcagaagaacgggaatggactctgtgcaaccaaagaacatttcctggttggaaagagagtgaggcaaagtacggcagttgtcgccggcaagcggcgatctttctcagtgtcagcggcggcaattgagagaccactttggttccctggaagcactccacctccttggcttgatggcagccttcctggtgactttggtttcgatccacttggccttggatcggacccagagagcttaagatggaacgtgcaatccgaactagtgcactgtcgatgggcaatgcttggtgctgccggcatcttcgtccccgagttcctcaccaaaataggcattctcaatacaccttcttggtactccgcgggcgagctcgaatacttcaccgacaccaccaccctcttcatcatcgagcttattctcatcggctgggccgagggtcgacgttgggctgatatcatcaagcccggttgcgtcaacaccgaccctatattccccaataataaactcaccggcactgatgttggctatccgggcgggctctggtttgacccgctgggctggggcagcggttcgccggagagagttaaggagctgaggaccaaagagatcaagaacggacgccttgccatgcttgccgtcattggcgcgtggttccaacacatctataccggcaccggtccaatcgacaatctcttcgcccaccttgccgaccccggccacgccaccatcttcgctgctttcacgccgaagtgagaatctagaagagaaggttcgtgttgggcctcagacgaacatgcttggaagatggtttgttgctgggatttgctttagtatgtttaccgctgtggaagctgtttgtaatgtgataagtagtgttacggaaacttaagggagaaatggcttcagtacaaattttttctttgtggtgtggaatatgccgtcattgggtcttcaaagtacgcgaaaattatatcaaaagctttagtaataattgaatgtcacatcaaaaatcttatcgaatatagatgtgaatatagatgtttgcttaagcgatccttaactttggggcttcatacatattatttaacaaaaa

SEQ ID NO: 5699 - DNA, 1044 bp, Euphorbia peplus
ccctaagtatattagaaaaaaggacctgaaatggcttctgttgtgacttctctgccattgccatctcttctcctagttcccagaagtgtggagctattgtcggaacaacaaaagcttcattcctaagtgggaagagattgaagtgcagacagacaagttcaagtgttgttagttcaagatgtgttacagtttgtgctgttgctgatcctgatagacctctgtggttccctggaagctcccctcctgaatggctagatggcagccttccaggagactttggatttgatcctttgggtcttggatccgacccggaaacccttagatggaatgtacaggcagaactcgtacattgtagatgggcaatgcttggagcagctggaattttcatccagaattcctaaccaaatttgaattttaaatactccatcttggtatgaagccggaacacaggaatatttcaccgatacaaccacactattcgttattgagctcatatttatcgggtgggcagagggtagaagatgggcagatatattgaaacccgggtgtgttaacaccgacccaattttccctaacaacaagctcaccggaaccgatgtcggttacccgggcgggttatggttcgacccgcttggatggggaagcggatcgcccgcgaagctcaaggagttgaggacaaaaagagattaagaatggaagattagcaatgttggctgtaatgggtgcttggtttcaacacatttatacgggtactggcccgattgataacctttttgcccatcttgcggatccgggtcacgccacggttttccaagctttcactcctaagtgaaagtaagtgaaagagattgaaaaagttgtatttgtcgaaaagaatttgtttgtatgactagaaattgttactggctttgttaattatggttaatcttatagaatgttgcatgtggaatgtacaaaagttttcaactaattagataattaatgcttataaatatgttttcaattggcttgttatcaatcttataaaagttgagaaaattctag

SEQ ID NO: 5700 - DNA, 1146 bp, Tamarix hispida
  misc_feature (845)..(845): n is a, c, g, or t
  misc_feature (1014)..(1014): n is a, c, g, or t
  misc_feature (1032)..(1032): n is a, c, g, or t
ggggaccgatcattctaagggcaggcgtgttgcacaaagaaacgagggaaggaggaattacaaaaaaaaaaggctaaaaaagaaacaaaagaagaatggcttcagtttgtgcctcgtctgccatggcagctgcttccatctcttcacccagttcacaaaagacaagtaatgttgttggagcaacaaaggcctctttccttggaggaaagaagttgagagtgacaaagtgcagaagaccagatgcagcagctcaatcaaaatcatcctcaactgtgagtgcagcagcagctgatcctgctgagagacctctatggttcccaggcagcacccctcccgcatggcttgatggaagcctccccggtgactttggcttcgatcctcttggacttggttctgatccagaaactctaagatggatggtacaagcagaactggtgcactgcagatgggcaatgctaggagctgctggtattttcatcccagaactcctaacaaaaatcggcatcttaaacactccctcatggtacacagctggcgaacaagaatacttcaccgacacaaccacactctttgtaatcgaactcatcttaattggttgggccgagggtagaagatgggctgatatcctcaaacctggttgtgttaatacagatcctatattccccaacaacaagctaactggcacagatgttgggtatccaggtggattatggtttgatccattaggttggggatctggttcacctgaaaaagttagggaattgaggactaaggagattaagaatggaagattggctatgttagctgttatgggtgcttggtttcaacatatttacactggcgtnggtcctatcgataatctttttgctcaccttgctgatcccggtcatgccactattttcgctgcatttagccccaagtgatggaaggacaggagggaaaagctcggttaaagagtttctgttcagtgcttgtggaggatacataacggatgaaattggggatatgttgaanatctagctatataaggtncatgtgatcgatagaggttaattaatgtcgttattagagatctggcctcaaggagaattttaatgttcatgcatgttaattaattgattaatgtacaaatagttttacgcgtgg

SEQ ID NO: 5701 - DNA, 968 bp, Flaveria ramosissima
ctgttgctttctcttctccaagttcacagaagagtggatctattgttggatcaacaaaggcttcttttcttggtgggaagaagctgagagttagcaaattgggtgcaccatccggttcgcgatcattcggaaccgtgtgcgttgcggctgaccccgatagacccatttggttccccggtagcaccccacccgaatggctcgatggcagcctacccggagacttcgggttcgatcctcttggcctaggatccgaccccgagaccttgaaatggaacgtgcaagcggaactcgtgcactgcagatgggcaatgttaggtgcagccgggatcttcatccccgaattcctaacaaaaatcggaatcctgaacactccttcatggtacaccgcgggtgaacaagagtacttcaccgataaaaccaccctcttcatcatcgagcttattttcatcggttgggccgaaggcagaagatgggctgacatcatcaaacctgggtgcgttaacactgacccaatcttccctaacaacaagctaaccgggaccgatgtgggctacccaggtggactatggttcgacccactcgggtggggaaccggctcgcctgcaaagctcaaggagttgagaaccaaagagatcaagaatggtagattggctatgttggctgtgatgggtgcatggttccaagccatttacaccggaaccggacccattgacaacctgtttgctcaccttgctgacccgggtcacgccaccatcttcgctgcatttaagggctaaagatattggcttgaaggatttgaagagtttgtgataagtggtgtttgtgtaacattagaaattgtatgtgtagaaaagttttaatgcaatgtgtacaaatacctctttaaactccaaatgttgtatgtcatccagtccactacttcacatggatttggaaatcacaagcaggacatgcacttcactacaatc

SEQ ID NO: 5702 - DNA, 766 bp, Acacia harpophylla
attcttcactcagatcattcagcgctctcatggcttctgcttgtgcttcctccgccgtcgcctccgccgccatctccaccccaagttcccagaagaatggaatcatcttgggatcaaggacttcatttctgagcggccggaagttgaaggtgaacaagttcaccgtcggaggccgatctgtgagtagcaaagtgtgtgcggtggcagctgatcccgacagacctctctggttccccggaagcactcctcctccgtggctcgacggcagcctccccggagacttcggctttgatcctctcggtcttggatctgatccagagagcttgagatggaatgttcaagcagagctggttcattgcagatgggcaatgttaggagctgctggtattttcatcccagagttcttaacaaagattggaattctcaacactccttcatggtacactgctggagagctggaatacttcacagacaccaccacactcttcatcatcgagctcatcttcatcggatgggccgagggaaggagatgggctgacatcctcaagcctggcagcgtcaacaccgaccccatcttccccaacaacaagctcaccggcactgatgtggggtacccaggcgggctctggttcgacccactcggctggggctctggctcaccagagaaggtcaaagagcttagaacaaaagagattaagaatggaagattggccatgctggctgttatgggtgcttggttccaacacatctacactggcactggtcc

SEQ ID NO: 5703 - DNA, 1093 bp, Utricularia gibba
gtccaaaatccgtcgacatggccgcctccgcttgcgcctcatcagccatcgccgccgtggccttctcatccccaagttccagtaccaagacctcctttttcggatcgagaaaactcaggggcggtggcaaatctgcaactcagacgagctcccgatcggttgccgtctgcgctgcggcagatccagatagacccctttggttccccggcagcactccgcctccgtggctcgacggtagccttcctggagatttcggcttcgaccctcttggactaggatctgatccggagaccttgaaatggaaccaacaatcggagatcgttcactgcagatgggccatgctgggagccgccgggatcttcatccctgaattcctcacgaagatcggagtcctcaacaccccctcatggtacacggccggcgaacaggagtatttcactgatacaaccacgcttttcataatcgagctcattctcatcggatgggccgagggtcggagatgggcggatatcatcaaacccggcagcgtgaacaccgatcccatcttccctaacaacaagctcaccggaaccgacgtcggttacccaggcggactctggttcgatcccctgggctggggatctgggtcaccggaaaaagtgaaggagatccgaacaaaggagatcaagaacgggagattagcgatgctggccgtcatcggtgcctggtttcaacatatctacactggaacaggacccattgataatctcttcgctcatctcgcggatcccggccacgccaccatcttcgccgctttcaccccaaaatgagagcagctcctggagatggttttggtggtagagagtggagttgctgcatctactacccccttcccgtttccatttcctgtaatgagcgttcctgaacaacgcaagtgattgtacaaatatttcatctttcaagaaaaatcacttacttttacacagttgttacacgatggagaataagaaaacctgcctaagacaatagtgagttcaaacaacaccactatatcacgatgcaggtctcggaaaccgagtccttcaaaaagattgttgccttcacgttggccagc

SEQ ID NO: 5704 - DNA, 1081 bp, Allium cepa
tattaatggcttctgtgtgcgcttcttcttctgccattgcatccattgccagtaaaaagagtggaagtgcatcaatttctgcatcaaaagcatcctttttaggaggaagcaagaaattcagaaccagcaaatcatcagcaacaactggcaagaaaagcctccaagtcacagcagctgcagcagaaagaccactctggtttccaggtagcactcctccagaatggctcgatggcagccttccaggagactttggatttgatcctcttggcctcggatctgacccagaaagcttgagatggaacgcacaggcggaactagtgcactgcagatgggcaatgctgggggcagcaggcatcttcattccagagttcctcaccaaaatcggaatactaaatactccttcatggtacacagcgggagaacaggagtacttcaccgacaaaaccaccctcttcatcgtcgaactcattcttatagggtgggcagaaggaagaagatgggctgacattatcaagcccggttgtgtgaacacagacccaattttccctaacaacaaattaacgggtacagatgtgggctacccaggtgggctttggttcgatccattggggtggggttcgggctcacctgaaaagatcaaggagttgaggctcaaggagatcaagaatggtagactggctatgttagcagttatgggtgcttggtttcaagctaattatactggaactggccccattgataacttgttcgctcatcttgctgatcctggtcatgccactatcttcgctgctttcactcccaagtgagagaaaaatgtggaacatggattatcagctatggcgaaaattatgtaaaaattggttaggctggtaaatgatgatgtataatatcggcttgtactttgttaattgtctgtgatgaatttggtgactaaaagatgtacaaattgtttgtaagttttgcaagctaaagaaatgtctaggtaattggactataaacttcaaaactcggtacacactcggaaaaaatgctaaattatgctaactattaatagttatttagcattatattgtttttcaac

SEQ ID NO: 5705 - DNA, 1045 bp, Fagopyrum esculentum
catacaataacttcactctttaactctctctctctctctaacacaacaatggcctctgtctgtgcttcctctaccatggtctctgcacccatcagttcacagaagactagtacagttgtagggatcaccaaggcctctttccttggaggaaagaaacttagagttaccaaattctgtgcacctggttcgagcaccgcgaagccatccttcgcggttcgcgctgttgcgtctgaaccagacaggcccttgtggttccctggtagcaatcctcctgaatggctcgacggaagccttcccggtgacttcggatttgaccctcttggcttcggctcagacccagaaaccctaagatggatggtacaatcggagatagtacacgccaggtgggcaatgctgggtgcagccggaatcttcatcccggaattcctgaccaagatcggaatcttaaacacgccctcatggtacacagctggtgagctcgagtacttcaccgacacaaccactctatttgtcattgagctggtcctgatagggtgggcggaagggcgaagatgggcagacatcatcaagccgggttgtgttaacactgacccaatattccccaacaacaagctgactgggaccgatgttggatacccgggtgggctatggttcgacccgttggggtggggatcagggtcccctcagaaggtaaaggagttgaggactaaggagatcaagaatggaaggttagctatgttggctgtgtttggagcttggttccagcacatttacactgggactggccctattgacaacctttttgctcaccttgctgatcctggtcatgctacaatttttgctgctttcgccccaaaatgagagggaagagattaatgaagaccctttaaatgggatagatggatggttatggtgtgtgcaggagaatgttttgttttggtggtggttatgagaaaatttaattctatttatctagtggacgttacatgtacaaatacctctcttgtaatatcctatgaaaaatgtattttacttaaatgactct

SEQ ID NO: 5706 - DNA, 976 bp, Brassica juncea
gaccactttgagtcttgaagaaggtcaacaacttcgagaataatggcttctctttgtgcttcttctgccatagccgctatttcttctccaggtttcttgggagggaagaaactgaggctgaacaagaagttgaatgttccagctgtttctaggtccggtacgtcggtgcgcgctgtggcagcggatccagatagaccaatttggttccctggaagcacacctccagagtggcttgacggtagcctccctggtgactttgggtttgatcctcttggtctttcatctgacccggatagtctaaagtggaacgcacaagcagagctagtccactgccggtgggcaatgctcggcgccgccgggatttttatcccggagtttctaaccaagataggaatcctcaacacgccgtcgtggtacacagcgggagagcaagagtatttcaccgacaaaaccacactcttcgtcgttgagctcatcttaataggatgggcagagggacgtagatgggctgatatcattaagccaggtagcgtcaacactgacccaatcttcccaaacaacaaactgacggggacagacgttggatacccgggtgggttatggtttgacccgttgggttggggatctggtagcccggctaaaatcaaggagttgaggactaaggagataaaaaatggaaggttggctatgttggcagtgatgggtgcttggttccaacacatctacactgggactggtcctattgataacctttttgcacatcttgctgatcctggccatgccactatcttcgctgctttcacacccaagtgagatgtcaagaaaggaggatttgggagggagaatgcatttgtgtgatcatgtttgtacaaatatggtttttgaacttaaaatattatgtatttatacatattgtggtcgaatgcaaattagggtttcgcggtaacattgcgcttttcctgactaaatgctcata

SEQ ID NO: 5707 - DNA, 972 bp, Brassica juncea
atcatcatcaacgtcgagaataatggcttctctttgtgcttcctctgccatcgccgccatttctgctcctagtttcttgggaggcaagaaactaaggctgaacaagaagttgagtgttccagctggttccaagtcagctgcgactgtgcgcgccgttgcggcggatcccgagagaccaatctggttccctggaagcactcctccagagtggctcgacggtagcctccctggtgacttcggatttgatcctcttggtctttcatctgacccggatagtctaaaatggaacgtacaagcagagatagttcactgccggtgggcaatgctaggcgccgccgggatttttatcccggagtttctaaccaagatcgggatcctcaacacgccgtcatggtacaccgccggagagcaagagtatttcacggacaaaaccacactcttcgtcgttgagctcatcttaatcggatgggccgagggacgtagatgggccgatatcattaagcccggtagcgtcaacaccgaccctatcttcccaaacaacaaactgacgggtacagacgttggatacccgggtgggttatggttcgacccgttgggttggggatccggtagcccggcaaagatcaaggagctgaggaccaaagagatcaagaacggaaggttggctatgttggcagtgatgggtgcttggttccaacacatctacactgggactggtcctattgataacctttttgcacatcttgctgatcctggccatgccactatcttcgctgctttcacacccaagtgagatgtcaagaaaggaggatttgggagggagaatgcgtttgtgtgatcatgtttgtacaaatatggcttttgaacttaaaatattatgtatttatacaaactgtggtcgaatgcaagttagaattcgccgtaacactggctcttttcctgactaaatgctcatacattgtggttcgtggt

SEQ ID NO: 5708 - DNA, 1009 bp, Brassica juncea
gagtcttgaagaaaggtcatcatcatcaacgtcgagaataatggcttctctttgtgcttcctctgccatcgccgccatttctgctcctagtttcttgggaggcaagaaactaaggctgaacaagaagttgagtgttccagctggttccaagtcagctgcgactgtgcgcgccgttgcggcggatcccgagagaccaatctggttccctggaagcactcctccagagtggctcgacggtagcctccctggtgacttcggatttgatcctcttggtctttcatctgacccggatagtctaaaatggaacgtacaagccgagatagttcactgccggtgggcaatgctaggtgccgccggaatttttatcccggagtttctaaccaagatcgggatcctcaacactccgtcgtggtacaccgccggagagcaagagtatttcacggacaaaaccacactctttgtcgttgagctcatcttaataggatgggccgagggacgtagatgggccgatattattaagcccggtagcgtcaacactgacccaatcttcccaaacaacaaactgacgggcacagacgttggatacccgggtgggttatggttcgacccgttgggttggggatccggtagccccgctaagatcaaggagctgaggactaaagagatcaagaacggaaggttggctatgttggcagtgatgggtgcttggttccaacatatctacactgggactggtcctattgataacctttttgcacatcttgctgatcctggccatgccactatcttcgctgctttcacacccaagtgagacgtcaagaaaggaggatttgggagggagaatgcatttgtgtgatcatgtttgtacaaatatggtttttgaacttaaaatattatgtatttatacatattgtggtcgaatgcaaattagggtttcgcggtaacattgcgcttttcctgactaaatgctcatacattgtggttcgtggtctatgagagttaatctttt

SEQ ID NO: 5709 - DNA, 897 bp, Brassica oleracea
tcatcaacttcgagaataatggcttctctttgtgcttcttctgccatcgccgctatttcttctccaggtttcttgggagggaagaaactgaggctgaacaagaagttgaatgttccaactgtttctaggtccggtacgtcggtgcgcgctgtcgcagcggatccagatagaccaatttggttccctggaagcacacctccagagtggcttgacggtagcctccctggtgacttcgggtttgatcctcttggtctttcatctgacccggatagtctaaagtggaacgcacaagcagagctagtccactgccggtgggcaatgctcggcgccgccgggatttttatcccggagtttctaaccaagataggaatcctcaacacgccgtcgtggtacacggcgggagagcaagagtatttcaccgacaaaaccacactcttcgtcgttgagctcatcttaataggatgggccgagggacgtagatgggctgatatcattaagccaggtagcgtcaacactgacccaatcttcccaaacaacaaactgacggggacagacgttggatacccgggtgggttatggtttgacccgttgggttggggatccggtagcccggctaaaatcaaggagctgaggactaaggagataaaaaatggaaggttggctatgttggcagtgatgggtgcatggttccaacacatatacactgggactggtcctattgataacctttttgcacatcttgctgatcctggccacgccactatcttcgctgctttcacacccaagtgagacgtcaaaaacttcgaaaaaggatgggcttgtgtgatcatgtttgtacaaatattgtttttgaacttaaaactattatgtacttatataaactgtggtcgaatgcaa

SEQ ID NO: 5710 - DNA, 1500 bp, Brassica rapa
gtttcttgacggcccatatctttctctgaaaacatggaaaacaaatatttaacttaggcttttctattctttttctggcccaatcctttgagacactagttgatagttttattttgtgcagctattgtgaaatagagaatctaaaatatggcggacgaaggtgccacgttccactagttggccaatgagaaaacatagtgcgttatccatagagataagcagaatctagttctgtcatatacatcactccatcgtttcttctatttttcctaacactaccactttgagtcttgaagaaggtcaacaacttcgagaataatggcttctctttgtgcttcttctgccatagccgctatttcttctccaggtttcttgggagggaagaaactgaggctgaacaagaagttgaatgttccagctgtttctaggtccggtacgtcggtgcgcgctgtggcagcggatccagacagaccaatttggttccctggaagcacacctccagagtggcttgacggtagcctccctggtgacttcgggtttgatcctcttggtctttcatctgacccggatagtctaaagtggaacgcacaagcagagctagtccactgccggtgggcaatgctcggcgccgccgggatttttatcccggagtttctaaccaagataggaatcctcaacacgccgtcgtggtacacagcgggagagcaagagtatttcaccgacaaaaccacactcttcgtcgttgagctcatcttaataggatgggcagagggacgtagatgggctgatatcattaagccaggtagcgtcaacactgacccaatcttcccaaacaacaaactgacggggacagacgttggatacccgggtgggttatggtttgacccgttgggttggggatctggtagcccggctaaaatcaaggagctgaggactaaggagataaaaaatggaaggttggctatgttggcagtgatgggtgcttggttccaacacatatacactgggactggtcctattgataacctttttgcacatcttgctgatcctggccacgccactatcttcgctgctttcacacccaagtgagacgtcaaaaatgtcaaaaaaaagatgggcttgtgtgatcatgtttgtacaaatattgtttttgaacttaaaactattatgtacttatataaactgtggtcgaatgcaaattagagtaacactgctcttttcttgactaaatgcgcatatctttcttttacattgtcattccgggtcaatgagagtgaatatcatcattttttttgctcttttactaaacgtatacgtattctctcgtatacatttagttatctatcatgttgaaccagtttgagcaaacaaagttgaaccagtttggttcatgttagtttactttgagttccatctcaatcatggtgttgctctttataaacaagcgattaaaagctatgaattccatctcactgaataaaattagatattttaccaact

SEQ ID NO: 5711 - DNA, 908 bp, Brassica napus
ataatggcttctctttgtgcttcttctgccatagccgctatttcttctccaggtttcttgggagggaagaaactgaggctgaacaagaagttgaatgttccagctgtttctaggtccggtacgtcggtgcgcgctgtggcagcggatccagatagaccaatttggttccctggaagcacacctccagagtggcttgacggtagcctccctggtgactttgggtttgatcctcttggtctttcatctgacccggatagtctaaagtggaacgcacaagcagagctagtccactgccggtgggcaatgctcggcgccgccgggatttttatcccggagtttctaaccaagataggaatcctcaacacgccgtcgtggtacacagcgggagagcaagagtatttcaccgacaaaaccacactcttcgtcgttgagctcatcttaataggatgggcagagggacgtagatgggctgatatcattaagccaggtagcgtcaacactgacccaatcttcccaaacaacaaactgacggggacagacgttggatacccgggtgggttatggtttgacccgttgggttggggatctggtagcccggctaaaatcaaggagttgaggactaaggagataaaaaatggaaggttggctatgttggcagtgatgggtgcttggttccaacacatatacactgggactggtcctattgataacctttttgcacatcttgctgatcctggccacgccactatcttcgctgctttcacacccaagtgagacgtcaaaaatgtcaaaaaaaagatgggcttgtgtgatcatgtttgtacaaatattgtttttgaacttaaaactattatgtacttatataaactgtggtcgaatgcaaattagagtaacactgctcttttctt

SEQ ID NO: 5712 - DNA, 1019 bp, Brassica juncea
ggagtcttgaagaaaggtcatcatcatcaacgtcgagaataatggcttctctttgtgcttcctctgccatcgccgccatttctgctcctagtttcttgggaggcaagaaactaaggctgaacaagaagttgagtgttccagctggttccaagtcagctgcgactgtgcgcgccgttgcggcggatcccgagagaccaatctggttccctggaagcactcctccagagtggctcgacggtagcctccctggtgacttcggatttgatcctcttggtctttcgtctgacccggatagtctaaaatggaacgtacaagcagagattgtacactgccggtgggcaatgctaggcgccgccgggatttttatcccggagtttctaaccaagatcgggatcctcaacacgccgtcgtggtacaccgccggagagcaagagtatttcacggacaaaaccacactgtttgtcgttgagctcatcttgataggatgggccgagggacgtagatgggccgatatcattaagcctggtagcgtcaacactgaccctatcttcccaaacaacaaactgacgggcacagacgttggatacccgggtgggttatggttcgacccgttgggttggggatccggtagcccggctaagatcaaggagttgaggactaaagagatcaagaatggaaggttggctatgttggcagtgatgggtgcttggttccaacatatctacactgggactggtcctattgataacctttttgcacatcttgctgatcctggccatgctactatcttcgctgctttcacccccaagtgagacgtcaagaaaggaggatttgggagggggaatgcgtttgtgtgatcatgtttgtacaaatatggtttttgaacttaaagtatttatgtatttatacaaattgtggtcgaatgtaagttagagttcgccttgacgctgctcctttcctggctaaatgctcatacattgttgttcttggtctcttctattctttgtcggttaaaacat

SEQ ID NO: 5713 - DNA, 872 bp, Flaveria ramosissima
ttgctttctcttccccaagttcacagaaaagtggatctattgttgcatcaacaaaggctacttttcttggtgggaagaaactcaaagttagcaagttgggtgcaccatccggttcacgatcgtttgcaaccgtgtgcgctgcggctgaccccgatagacccatttggttcccgggcagcaccccaccggaatggctcgatggcagcctacctggagacttcgggttcgatcctcttggtctaggatctgatcccgagactttgagatggaacgtacaagcagaactagtacactgcagatgggcaatgttaggtgcagccgggatcttcatccccgaattcctgacaaaaatcgggatcctaaacacgccgtcatggtacactgctggtgaacaagaatacttcaccgacaaaaccacgctcttcatcgtcgagcttatctttattggctgggctgaaggaagaagatgggctgacattattaaaccagggtgcgttaacacggaccccatcttccccaacaacaagctaactgggaccgatgttggctacccgggtgggctatggtttgacccactcgggtggggagcggttcgcctgcaaagctcaaggagctgaggacaaaagagatcaaaaatgggaggttagccatgttggctgtgatgggtgcatggttccaagccatctacactggaactggacccattgacaacctgtttgcgcaccttgcggacccgggtcacgccaccattttgctgcattcaagggctaaaacagcattataaaggcttttggcaaagtgatgtttgtgtattattagaaactcttatcttatgtttactgtagatcaaagttaagtaatgtacaatacct

SEQ ID NO: 5714 - DNA, 948 bp, Brassica juncea
tgagtcttgaagaaggtcaacaacttcgataataatggcttctctttgtgcttcttctgccatcgccgctatttcttctccaggtttcttgggagggaagaaactgaggctgaacaagaagttgagtgttccagctgttttcaggtcggctgcatcggtgcgagccgtcgcagctgatccagatagaccaatctggttccctggaagcactcctccagagtggctcgatggtagcctccctggtgacttcgggtttgatcctcttggtctttcatctgacccggatagtctaaagtggaacgcacaagcagagctagtccactgccggtgggcaatgctcggcgccgccgggatttttatcccggagtttctaaccaagataggaatcctcaacacaccgtcgtggtacactgcgggagagcaagagtatttcaccgacaaaaccacactctttgtcgttgagctcatcttgataggatgggccgagggacgtagatgggctgatatcattaagccaggtagcgtcaacactgacccaatcttcccaaacaacaaactgacggggacagacgttggatacccgggtgggttatggtttgacccgttgggttggggatccggtagcccggctaagatcaaggagctgaggactaaggagataaagaatggaaggttggctatgttggcagtgatgggtgcttggttccaacatatatacactgggactggtcctattgataacctttttgcacatcttgctgatcctggccacgccactatctttgctgctttcacacccaagtgatgagacgttaacaaggaaggatgggtttgtgtgatcatgtttgtacaaatatctcttttgaacttagaagcattatgtatttatacagaactgtggtcgagtgaaaattagggttggttgtaacaatgctcttttcctgaact

SEQ ID NO: 5715 - DNA, 932 bp, Brassica juncea
gatcatcaatcataaacaagaaaaaacacaaatcaaatcaataataaacaaatggcagacaacaagacgagtttccaagccggtcaagccgctggtcgtgctgaggagaaaagtaatgtgttgatggacaaggtcaacaaacttcgagaataatggcttctctttgtgcttcttctgccatcgccgctatttcttctccaggtttcttgggagggaagaaactgaggctgaacaagaagttgagtgttccagctgtttccaggtcggctgcgtcggtgcgggccgtcgcagctgatccagatagaccaatctggttccctggaagcacacccccagagtggctcgacggtagcctccctggtgacttcggttttgatcctcttggtctttcatctgacccggatagtctaaagtggaacgcacaagcagagctagttcactgccggtgggcgatgctaggcgccgccgggatttttatcccggagtttctaaccaagataggaatcctcaacacgccgtcgtggtacacggcgggagagcaagagtatttcaccgacaaaaccacactcttcgtcgttgagctcatcttaataggatgggccgagggacgtagatgggctgatatcattaagccaggtagcgtcaacactgacccgatcttcccgaacaacaaactgacggggacagacgttggatacccgggtgggttatggttcgacccgttgggttggggatccggtagcccggctaaaatcaaggagctgaggactaaggagataaaaaacggaaggttggctatgttggcggtgatgggtgcttggttccaacacatctacactgggactggtcctattgataacctttttgcacatcttgctgatcctggccacgccactatcttcgctgctttcacacccaagtgagacgtcaaa

SEQ ID NO: 5716 - DNA, 996 bp, Triticum aestivum
aacactttgagtcttgaagaaaggtcatcatcatcaacgtcgagaataatggcttctctttgtgcttcctctgccatcgccgccatttcttctcctagtttcttggctggcaagaaactaaggctgaacaagaagctgagtgttccagctgtttccaaatcagctgcgtctgtgcgggccgttgcagcggatcccgagagaccaatctggttccctggaagcactcctccagagtggctcgacggtagcctccctggtgacttcggatttgatcctcttggtctttcatctgaccccgaaagtctaaaatggaacgtacaagcagagatagttcactgccggtgggcaatgctaggggccgccgggatttttatcccggagtttctaaccaagatcgggatcctcaacacgccgtcgtggtacaccgccggagagcaagagtatttcacggacaaaaccacactctttgtcgttgagctcatcttaataggatgggccgagggacgtagatgggccgatatcattaagcccggtagcgtcaacactgacccaatcttcccaaacaacaaactgacgggcacagacgttggatacccgggtgggttatggttcgacccgttgggttggggatccggtagcccggctaagatcaaggagctgaggactaaagagatcaagaacggaaggttggctatgttggcagtgatgggtgcttggttccaacatatctacactgggactggtcctattgataacctttttgcacatcttgctgatcctggccatgctactatcttcgctgctttcacacccaagtgagacgtcaagaaaggaggatttgggagggataatgcgtttgtgtgatcatgtttgtacaaatgtggtttttgaacttaaaaatattatgtatttaagcaaatggttgtcgaatgcaagttagggttcgccgtaaacactgctcttttcctgactaaatgctcatacattgtggttcgt

SEQ ID NO: 5717 - DNA, 1133 bp, Brassica juncea
agaataatggcttctctttgtgcttcttctgccatcgccgctatttcttctccaggtttcttgggagggaagaaactgaggttgaacaagaagttgagtgttccagctgtttccaggtcggctgcgtcggtgcgggctgtcgcagctgatccagatagaccaatctggttccctggaagcacacccccagagtggctcgacggtagcctccctggtgacttcggttttgatcctcttggtctttcatctgacccggatagtctaaagtggaacgcacaagcagagctagtccactgccggtgggcaatgctcggcgccgccgggatttttatcccggagtttctaaccaagataggaatcctcaacacaccgtcgtggtacactgcgggagagcaagagtatttcaccgacaaaaccacactctttgtcgttgagctcatcttgataggatgggccgagggacgtagatgggccgatatcattaagcccggtagcgtcaacaccgaccctatcttcccaaacaacaaactgacgggtacagacgttggatacccgggtgggttatggttcgacccgttgggttggggatccggtagcccggcaaagatcaaggagctgaggaccaaagagatcaagaacggaaggttggctatgttggcagtgatgggtgcttggttccaacatatatacactgggactggtcctattgataacctttttgcacatcttgctgatcctggccacgccactatctttgctgctttcacacccaagtgagacgtcaaaggaggatttggaaggaaggatgcatttgtgtgattatgtttgtacaaatattattttgaactttatgtatttatacaaaactgatcggtcgaatgcaaattaggattcatcgtagcactgctcttttcctgactaaatgctcaaaagaagtaccataccattctcattctctgttacagtaagtaggttattatattacacatgtgcggcagagtatgtgaacactgcaatgttgaaccattaacatcttttactatacttgtatagagttgtaccaaattctcaattgcttctaccttgatgacttccagtgaatgttgaaccattaacatcttttactatacttg

SEQ ID NO: 5718 - DNA, 1046 bp, Brassica napus
cccaacactttgagtcttgaagaaaggtcatcgtcatcaacgtcgagaataatggcttctctttgtgcttcctctgccatcgccgccatttcttctcctagtttcttggctggcaagaaactaaggctgaacaagaagctgagtgttccagctgtttccaaatcagctgcgtctgtgcgggccgttgcagcggatcccgagagaccaatctggttccctggaagcactcctccagagtggctcgacggtagcctccctggtgacttcggatttgatcctcttggtctttcatctgaccccgaaagtctaaaatggaacgtacaagcagagatagttcactgccggtgggcaatgctaggggccgccgggatttttatcccggagtttctaaccaagatcgggatcctcaacactccgtcgtggtacaccgccggagagcaagagtatttcacggacaaaaccacactctttgtcgttgagctcatcttaataggatgggccgagggacgtagatgggccgatattattaagcccggtagcgtcaacactgacccaatcttcccaaacaacaaactgacgggcacagacgttggatacccgggtgggttatggttcgacccgttgggttggggatccggtagccccgctaagatcaaggagctgaggactaaagagatcaagaacggaaggttggctatgttggcagtgatgggtgcttggttccaacatatctacactgggactggtcctattgataacctttttgcacatcttgctgatcctggccatgctactatcttcgctgctttcacacccaagtgagacgtcaagaaaggaggatttgggagggagaatgcgtttgtgtgatcatgtttgtacaaatgtggtttttgaacttaaaaatattatgtatttaagcaaatggttgtcgaatgcaagttagggttcgccgtaaacactgctcttttcctgactaaatgctcatacattgtggttcgtggtatgatcaatctcttttatttttattggttaatatatctcatgag

SEQ ID NO: 5719 - DNA, 1214 bp, Eutrema halophilum
ataagcagaatctagttttgtcgtcatagagctttatagtttatacatcattcctattggtttcttcttctcctaacactttgagccttgaagatcaacaacgtcgagagtaatggcttctctatgtgcttcttctgccatcgccgccatttcttctccaagtttcttgggtgggaagaaactgaggctgaagaataaggcgagtgttccggctgtttccagatcggctgcgttggtgcgcgccgtcgcagctgatcccgagagaccaatttggttcccgggaagcactcctccggagtggctcgacggtagcctccctggtgacttcggatttgatcctcttggtctttcctccgacccggatagtctaaaatggaacgcacaagcagagctagtccattgcaggtgggcaatgctcggcgccgccgggattttcatcccggagttcctaacaaagatcggaatcttaaacactccgtcgtggtacacggcgggagagcaagagtatttcacggacaaaaccacactattcgtcgtagagctcatcttaatcggatgggccgagggacgtagatgggccgatatcataaagcccggtagcgtcaacactgaccccatattcccaaacaacaagctgacgggtacagacgtgggatacccgggtgggttatggttcgacccgttgggttggggatccggtagcccggctaagatcaaggagctgaggaccaaagagatcaagaacggaaggttggctatgttggcagtgatgggtgcatggttccaacacatctacactggcactggtcctatcgataatctttttgcacatcttgctgatcctggtcacgccactatcttcgctgctttcacacccaagtgagacagcaaaaaagagaggatttgggaggaagaatgcgtttgtgtgatcatgtttgtacaaatatcgtttttgaacttaaaacagtattatgtatttatataaattgtggtcgaatgcaaattagggttcgccgtaacgctgctcttttcctgactaaatgctcatagcttgcttctacattaatgtcgccatcctaggcctatgagagccaatctctccaatcctttgttggtaattttatttatctcgtgagaatgaaactcatttctaacaactgccaattacaaaagaaaaactatggagatatattcaaattcataatgaagaatgt

SEQ ID NO: 5720 - DNA, 1315 bp, Eutrema parvulum
ttaatagtagttttcaaatagagaatctaagatatggtgggacgaaggtgccacgtgttgaagagttgaccaatgaggaaactcattgcgttatccatagagataatcagataagcagaatctagttttgtcatcaaatagctttatagtttatacatcattccttcgtttcctcttcttctcccaacactctgactcttgaagaaggctaataacgtcgagaataatggcttctctttgtgcttcttctgccatcgccgctatttcttctccaagtttcttgggtgggaagaaattgaggctgaagaaaaatttgagtgttccagctgtttctaggtcggctgcgtcggtgcgcgccgtcgcagccgatcccgagagaccaatctggttccctggaagcactcctccagagtggctcgatggtagcctccctggtgacttcggattcgatcctcttggtctttcatctgacccggatagtctaaaatggaacgcacaagcagagctagttcactgccggtgggcaatgttaggcgccgccgggatatttatcccggagtttttaaccaagatcgggatcctcaacactccgtcgtggtacacggcgggagagcaggagtatttcacggacaaaaccacactctttgtcgttgagctcatcttaatcggatgggccgaaggacgtagatgggccgatatcatcaagcccggtagcgtcaacactgacccaatcttcccaaacaacaaactgacgggcacagacgtcggatacccgggtggtttatggtttgacccgttgggttggggatctggtagcccggctaagatcaaggagctgaggaccaaagagatcaagaacggaaggttggctatgttggcagtgatgggtgcttggttccaacacatctacactgggactggtcctattgataaccttttcgcacatcttgctgatcctggccacgccactatcttcgctgctttcacacccaagtgagacgtcaaaaataagaggatttgggagggagaatgcgtttgtgtgatcatgtttgtacaaatatcgtttttgaacttaaaatatttatgtatttatataaattgtggtcgaatgcaaattaggattcaccgtaacactgctcttttcctgactaaatgctcatagcttgcttttacattgccactcggagtctatgagagtcagtctcttcgattctttgtacaatccataaaagatatccaaattcattatgaagaatatgcatgtaaaaatccaaacttatcaaattttagaagaatccaaactcatcatcttgaa

SEQ ID NO: 5721 - DNA, 989 bp, Thellungiella halophila
  misc_feature (7)..(7): n is a, c, g, or t
gctaacnctttgagccttgaagatcaacaacgtcgagagtaatggcttctctatgtgcttcttctgccatcgccgccatttcttctccaagtttcttgggtgggaagaaactgaggctgaagaataaggcgagtgttccggctgtttccagatcggctgcgttggtgcgcgccgtcgcagctgatcccgagagaccaatttggttcccgggaagcactcctccggagtggctcgacggtagcctccctggtgacttcggatttgatcctcttggtctttcctccgacccggatagtctaaaatggaacgcacaagcagagctagtccattgcaggtgggcaatgctcggcgccgccgggattttcatcccggagttcctaacaaagatcggaatcttaaacactccgtcgtggtacacggcgggagagcaagagtatttcacggacaaaaccacactattcgtcgtagagctcatcttaatcggatgggccgagggacgtagatgggccgatatcataaagcccggtagcgtcaacactgaccccatattcccaaacaacaagctgacgggtacagacgtgggatacccgggtgggttatggttcgacccgttgggttggggatccggtagcccggctaagatcaaggagctgaggaccaaagagatcaagaacggaaggttggctatgttggcagtgatgggtgcatggttccaacacatctacactggcactggtcctatcgataatctttttgcacatcttgctgatcctggtcacgccactatcttcgctgctttcacacccaagtgagacagcaaaaaagagaggatttgggaggaagaatgcgtttgtgtgatcatgtttgtacaaatatcgtttttgaacttaaaacagtattatgtatttatataaattgtggtcgaatgcaaattagggttcgccgtaacgctgctcttttcctgactaaatgctcatagcttgcttcta

SEQ ID NO: 5722 - DNA, 967 bp, Flaveria ramosissima
agttcacagaagagtggatctattgttggatcaacaaaggcttcttttcttggtgggaagaagctgagagttagcaagttgggtgcaccctccggttcacgatcgttcggaaccgtgtgcgttgcggctgaccccgatagacccatttggttccccggcagcaccccacccgaatggctcgatggcagcctacctggagacttcggtttcgatcctcttggcctaggatccgatcccgagaccttgaaatggaacgtgcaagcggaactcgtgcattgcagatgggcaatgttaggtgcagccgggatcttcatccccgaattcctaacaaaaatcggaatcctgaacactccttcatggtacaccgcgggtgaacaagagtacttcaccgataaaaccacactcttcatcgtcgagcttattttcatcggttgggccgaaggaagaagatgggctgacataatcaaacctgggtgcgttaacactgatccaatcttccccaacaacaagctaaccgggaccgatgtgggctacccaggtggactatggttcgacccactcgggtggggaactggctcacctgcaaaactcaaggagttgaggacaaaagagatcaagaatggaagattggctatgttggctgtgatgggtgcatggttccaagccatttacaccggaaccggacccattgacaacctgtttgctcaccttgctgatccgggtcacgccaccatcttcgctgcattcaagggctaaagatattggcaggaaggatttgaatagtttgtgacaagtggtgtttgtgtatcattagaaattgtatgtgtagaaaagttttaatgcaatgtacaaatacctctttcaactccataagcaagacttgcacatcacaacaatcaaataaatcatgtttgatttacaaaaacaaacatcatccttttttctaaaacacattaatcgcaatatt

SEQ ID NO: 5723 - DNA, 920 bp, Flaveria ramosissima
ccaagttcacagaagagtggatctattgttggatcaacaaaggcttcttttcttggtgggaagaagctgagagttagcaaattgggtgcaccatccggttcacgatcgttcggaaccgtgtgcgttgcggctgaccccgatagacccatttggttccccggtagcaccccacccgaatggctcgatggcagcctacccggagacttcgggttcgatcctcttggcctaggatccgaccccgagactttgaaatggaacgtgcaggcggaactcgtgcactgcagatgggcaatgttaggtgcagccgggatattcatccccgaattcctaacaaaaatcgggatcctgaacactccttcatggtacaccgcgggtgaacaagagtacttcaccgataaaaccaccctcttcatcatcgagcttattttcatcggttgggccgaaggcagaagatgggctgacatcatcaaacctgggtgtgttaacactgacccaatcttccccaacaacaagctaaccgggaccgatgtgggctacccaggaggcctatggttcgacccactcgggtggggaaccggctcgcctgcaaaactcaaggagttgaggaccaaagagatcaagaatggaagattggctatgttggctgtgatgggtgcatggttccaagccatttacaccggaaccggacccattgacaacctgtttgctcaccttgctgacccgggtcacgccaccatcttcgctgcattcaagggctaaagatattggcttgaagaatttaaagagtttgtgacaagtggtgtttgtgtaacattagaaattgtatgtgtagaaaagttttatgcaatgtacaaatacctctttcaactccaaatggtgtatgtcatattgtcatccaatccaactacttcacatggatt

SEQ ID NO: 5724 - DNA, 847 bp, Ambrosia trifida
tccaagttcacagaagagtggatcaattgttggatcacaaaagcctcttttcttgtggaaagaaactaagagttagcaaggtgggtgcaccgtccggttcacgatcatttggaaccgtgtgcgttgcggcgaccccgactagacccatttggttccctggcagcaccccaccagaatggctcgatggcagcctacctggagactttggttttgatcctcttggcctaggatccgatccagagactttgagatggaacgtacaagcagaactcgtacactgcagatgggcaatgttaggtgcagccggaattttcatccccgaattcctaacaaaaatcggaatcttaaacactccatcatggtacactgctggtgaacaagagtacttcaccgacaaaaccacactcttcatcatcgagcttattttcatcggttgggccgaaggaagaagatgggctgacattatcaaacctgggtgcgtcaacactgatcccatcttccccaacaacaagctgaccgggacagatgttgggtacccaggtggactatggttcgacccactcgggtggggaaaaggctcacccgcaaagctcaaggaattgaggactaaggagataaagaatggaaggttggctatgttggctgtgatgggtgcatggttccaagcaatctacactggaactggacccattgacaacctgtttgctcaccttgctgacccgggtcatgccaccatcttcgctgcattcaagggctaaacatgcatatggaaggatctaaagagtttttggcaaggggtgtttgtgtgtcattagaaattgtatcttcatcttaatttactgtagag

SEQ ID NO: 5725 - DNA, 950 bp, Flaveria ramosissima
cagaaaagtggatctactgttgcatcaacaaaggcttcttttcttggtgggaagaactcaaagttagcaagttgggtgcaccatccggttcacgatcgtttgcaaccgtgtgcgctgcggctgaccccgatagacccatttggttcccgggcagcaccccaccagaatggctcgatggcagcctacctggagacttcgggttcgatcctcttggtctaggatctgatcccgagacgttgagatggaacgtacaagcagaactagtacactgcagatgggcaatgttaggtgcagccgggatcttcatccccgaattcctgacaaaaatcgggatcctaaacacgccgtcatggtacactgctggtgaacaagaatacttcaccgacaaaaccacgctcttcatcgtcgagcttatctttattggctgggctgaaggaagaagatgggctgacattattaaaccagggtgcgttaacacggaccccatctttccccaacaacaagctaactgggaccgatgttggctacccgggtgggctatggtttgacccactcgggtgggggagcggttcgcctgcaaagctcaaggagctgaggacaaaagagatcaaaattgggaggttagccatgttggctgtgatgggtgcatggttccaagccatctacactggaactggacccattgacaacctgtttgcgcaccttgcggacccgggtcacgccaccatttttgctgcattcaagggctaaaacagcattataaaggcttttggcaaagtgatttttgtgtattattagaaactcttatcttatgtttactgtagatcaaagttaatggaatgtacaaatacctcttaatttcaactcaaaatggtgcctatagatatattacataagcttgtatgtcattacagtatttcgcatataatatcaacagacccatgttaaat

SEQ ID NO: 5726 - DNA, 928 bp, Guizotia abyssinica
accaacccaaatcttgaacacacaaacaaaaacaatggcttgtgcgtcttccgccattgcagctgttgctttctcttccccaacaacaacaacaaaggcttctttccttggtgggaagaaactgagagttaacaagttgggtgcaccaaccggttcacgatcatttggaaccgtgtgtgctgtggctgaccccgatagacccatttggttccctggcagcaccccaccagaatggctcgatggcagtctacccggagacttcggctttgatcctcttggtctaggatctgatcccgagacattgagatggaacgtacaagcagagctagtacactgccgatgggcgatgttaggcgcagccgggattttcatccccgaattcctaacaaaaatcggaatcctaaacactccttcatggtacacagccggtgaacaagaatacttcaccgacaagaccacgctgttcatcgttgagcttattttcattggttgggcagaaggaagaagatgggctgacatccttaaaccagggagcgttaacaccgaccccatcttccccaacaacaagctaaccggaaccgatgttgggtacccaggtggactatggtttgacccactcgggtgggggagcggttcacctgctaagctcaaggaattgaggacaaaagagatcaagaatgggagattggccatgttggctgtgatgggtgcatggttccaagccatctataccggaaccggaccaattgacaacttgtttgctcaccttgctgacccgggtcacgccaccatttttgctgcattcaagggctaaacatcaagaagatagattttaatggcagtgtgatgtttgtgtattaataaaaattgtaatcttatctttactgtagatcagggttaatgcaatgtacaaatacctcttaattac

SEQ ID NO: 5727 - DNA, 1025 bp, Arabidopsis lyrata
agagggcttttatagattacacatcattccttcgttcttcttctaacacactctgagtcttgaaggtcaacaacgtcgagaaaaatggcatcatctctttgtgcttcttctgccatcgctgccatttcttctccaagtttcttgggtggtaagaaactgaggctgaagaagaagttgactgttccagctgtgtccaggccagatgcgtcggtgcgcgccgtcgcagctgatccagatagaccgatctggttcccgggaagcactcctccagagtggctcgacggtagcctccccggtgacttcggatttgatccccttggtctttcatcggaccccgacagtctaaaatggaacgtacaagcagagctagtccactgccggtgggcgatgctaggagccgccgggatattcatcccggagttcctaacgaagattggaatcctcaacactccatcgtggtacacggcgggagagcaagagtatttcacggacaaaaccacactcttcgtcgttgagctcatcttgatcggatgggccgaaggacgtagatgggccgatatcatcaagcccggtagcgtcaacactgacccagtcttcccaaacaacaaactgacgggcacagacgttggttacccgggtgggttatggttcgatccgttgggttggggatccggtagcccggctaagctcaaggagttgaggaccaaggagatcaagaacggaaggttggctatgttggcagtgatgggtgcttggttccaacacatctacactggcactggtcctattgataacctttttgcacatcttgctgatcctggtcacgccacaatcttcgctgctttcacacccaagtgagacaagaaaaaagggttatggggaggaggagaatgcgtttgtgtgatcatgtttgtacaaatatcgttttgaacttaaaaatatttatgtatttatataaattgtggtcgaatgcaaattaggattcaccttaacactctcttttcctaactcaatgatcataagat

SEQ ID NO: 5728 - DNA, 1221 bp, Allium cepa
ggggagaagaaaaaggggaatccttgttctgtattaatggcttctgtgtgtgcttcttcttctgccattgcatccattgccaggcaattgatcttatttaaaaagagtggaagtgcatcaatttctgtatcaaaagcatcctttttaggaggaagcaagaaattcagagcgagcaaatcatcagcaacaagtggcaaaaaaagcctccaagtctcagcagctgcagcagaaaggccactttggtttccaggcagcactcctccagaatggctcgatggcagccttccaggagactttggatttgatcctcttggtcttggatctgacccagaaagcttgaaatggaacgcacaagcagaactagtgcactgcagatgggcgatgctgggagcagcaggcattttcattccagaattccttaccaaaatcgggatactaaacactccttcatggtacacagccggagaacaggagtacttcaccgacaaaactaccctcttcatcgttgaactcatccttatagggtgggccgaaggaagaagatgggctgacattatcaagcccgggtgtgtaaacacagacccaattttccctaacaacaaattaacgggtacagatgtgggttacccaggagggctttggttcgatccattgggttggggttcaggctcacctgaaaagatcaaggagttgaggctcaaggagatcaagaatggtagactggctatgttagcagttatgggtgcttggtttcaagctaattatactggaactggccccattgataacttgttcgctcatcttgctgatcctggtcatgccactatcttcgctgctttcactcccaagtgagagaaaaatgtggaacatggattatcagctatggcgaaaattatgtaaaatttggttaggctggtaaatgatgatgtataatatcggcttgtactttgttaattgtctgtgatgaatttggtgactaaaagatgtacaaattgtttgtgagttttgcaagctaaaagaaatgtctaggtaattggactataaacttcaaaactcggtacacactcggaaaaaatgctaaatatgctaactataatagttatttagcatatattgtttttcaacatttagacagatctctataattatcaaagtaacatattatactcccattacactatatagttgttgtgttgcttaaagtcatgttttactcttcct

SEQ ID NO: 5729 - DNA, 1161 bp, Allium cepa
ggggacaacaaagagaagaaaaaggggaatccttgttctgtattaatggcttctgtgtgtgcttcttcttctgccattgcatccattgccagtaaaaagagtggaagtgcatcaatttctgtatcaaaagcatcctttttaggaggaagcaagaaattcagagcgagcaaatcatcagcaacaagtggcaaaaaagcctccaagtctcagcagctgcagcagaaaggccactttggtttccaggcagcactcctccagaatggctcgatggcagccttccaggagactttggatttgatcctcttggtcttggatctgacccagaaagcttgaaatggaacgcacaagcagaactagtgcactgcagatgggcgatgctgggagcagcaggcattttcattccagaattccttaccaaaatcgggatactaaacactccttcatggtacacagccggagaacaggagtacttcaccgacaaaactaccctcttcatcgttgaactcatccttatagggtgggccgaaggaagaagatgggctgacattatcaagcccgggtgtgtaaacacagacccaattttccctaacaacaaattaacgggtacagatgtgggttacccaggagggctttggttcgatccattgggttggggttcaggctcacctgaaaagatcaaggagttgaggctcaaggagatcaagaatggtagactggctatgttagcagttatgggtgcttggtttcaagctaattatactggaactggccccattgataacttgttcgctcatcttgctgatcctggtcatgccactatcttcgctgctttcactcccaagtgagagaaaaatgtggaacatggattatcagctatggcgaaaattatgtaaaatttggttaggctggtaaatgatgatgtataatatcggcttgtactttgttaattgtctgtgatgaatttggtgactaaaagatgtacaaattgtttgtgagttttgcaagctaaaagaaatgtctaggtaattggactataaacttcaaaactcggtacacactcggaaaaaatgctaaatatgctaactataatagttatttagcatatattgtttttcaacatttagacagatctctataattatcaaagtaacatattatact

SEQ ID NO: 5730 - DNA, 1005 bp, Brassica napus
ggaagaaaggtcatcatcatcaacgtcgagaataatggcttctctttgtgcttcctctgccatcgccgccatttcttctcctagtttcttgggtggcaagaaactaaggctgaacaagaagctgagtgttccagctgtttccaaatcagctgcgtctgtgcgggccgttgcagcggatcccgagagaccaatctggttccctggaagcactcctccagagtggctcgacggtagcctccctggtgacttcggatttgatcctcttggtctttcatctgaccccgaaagtctaaaatggaacgtacaagcagagatagttcactgccggtgggcaatgctaggggccgccgggatttttatcccggagtttctaaccaagatcgggatcctcaacactccgtcgtggtacaccgccggagagcaagagtatttcacggacaaaaccacactctttgtcgttgagctcatcttaataggatgggccgagggacgtagatgggccgatattattaagcccggtagcgtcaacactgacccaatcttcccaaacaacaaactgacgggcacagacgttggataccccgggtggggttatggttcgacccgttgggttggggatccggtagcccggctaagatcaaggagctgaggactaagagatcaagaacggaaggttggctatgttggcagtgatgggtgcttggttccaacatatctacactgggactggtcctattgataacctttttgcacatcttgctgatcctggccatgccactatcttcgctgctttcacacccaagtgagacgtcaagaaaggaggatttgggagggagaatgcatttgtgtgatcatgtttgtacaaatatggtttttgaacttaaaatattatgtatttatacatattgtggtcgaatgcaaattagggtttcgcggtaacattgcgcttttcctgactaaatgctcatacattgtggttcgtggtctatgagagttaatcttttc

SEQ ID NO: 5731 - DNA, 1037 bp, Brassica oleracea
ctcccaacactttgaatcttgaagaaaggtcatcatcatcaacgtcgagaataatggcttctctttgtgcttcctctgccatcgccgccatttcttctcctagtttcttgggtggcaagaaactaaggctgaacaagaagctgagtgttccagctgtttccaaatcagctgcgtctgtgcgggccgttgcagcggatcccgagagaccaatctggttccctggaagcactcctccagagtggctcgacggtagcctccctggtgacttcggatttgatcctcttggtctttcatctgaccccgatagtctaaaatggaacgtacaagcagagatagttcactgccggtgggcaatgctaggcgccgccgggatttttatcccggagtttctaaccaagatcgggatcctcaacactccgtcgtggtacaccgccggagagcaagagtatttcacggacaaaaccacactctttgtcgttgagctcatcttaataggatgggccgagggacgtagatgggccgatatcattaagcccggtagcgtcaacactgacccaatcttcccaaacaacaaactgacgggcacagacgttggatacccgggtgggttatggttcgacccgttgggttggggatccggtagccccgctaagatcaaggagctgaggactaaagagatcaagaacggaaggttggctatgttggcagtgatgggtgcttggttccaacatatctacactgggactggtcctattgataacctttttgcacatcttgctgatcctggccatgctactatcttcgctgctttcacacccaagtgagacgtcaagaaaggaggatttgggagggagaatgcgtttgtgtgatcatgtttgtacaaatgtggtttttgaacttaaaaatattatgtatttaagcaaatggttgtcgaatgcaagttagggttcgctgtaaacactgctcttttcctgactaaatgctcatacattgtggttcgtggtatgatcaatctcttttatttttcattggttaat

SEQ ID NO: 5732 - DNA, 1063 bp, Brassica napus
gaagaaaggtcatcatcatcaacgtcgagaataatggcttctctttgtgcttcctctgccatcgccgccatttcttctcctagtttcttgggtggcaagaaactaaggctgaacaagaagctgagtgttccagctgtttccaaatcagctgcgtctgtgcgggccgttgcagcggatcccgagagaccaatctggttccctggaagcactcctccagagtggctcgacggtagcctccctggtgacttcggatttgatcctcttggtctttcatctgaccccgatagtctaaaatggaacgtacaagcagagatagttcactgccggtgggcaatgctaggcgccgccgggatttttatcccggagtttctaaccaagatcgggatcctcaacactccgtcgtggtacaccgccggagagcaagagtatttcacggacaaaaccacactctttgtcgttgagctcatcttaataggatgggccgagggacgtagatgggccgatatcattaagcccggtagcgtcaacactgacccaatcttcccaaacaacaaactgacgggcacagacgttggatacccgggtgggttatggttcgacccgttgggttggggatccggtagccccgctaagatcaaggagctgaggactaaagagatcaagaacggaaggttggctatgttggcagtgatgggtgcttggttccaacatatctacactgggactggtcctattgataacctttttgcacatcttgctgatcctggccatgctactatcttcgctgctttcacacccaagtgagacgtcaagaaaggaggatttgggagggagaatgcgtttgtgtgatcatgtttgtacaaatgtggtttttgaacttaaaatattatgtatttaagcaaatggttgtcgaatgcaagttagggttcgctgtaaacactgctcttttcctgactaaatgctcatacattgtggttcgtggtatgatcaatcctcgtgccgaattactgcagcccggggatctcctagtctaaagcggccgccaccgcgggagctccagtat

SEQ ID NO: 5733 - DNA, 1127 bp, Raphanus sativus
aacacttttgagtcttgaagaaaggtcatcatcatcatcaacgtcgagaataatggcttctctttgtgcttcttctgccattgccgccatatcttctcctagcttcttgggaggcaagaaactaaggctgaacaagaagttgagtgttccagctgtttccaaatcagctgcgtctgtgcgggccgttgcagcggatcccgagagaccaatctggttccctggaagcactcctccagagtggctcgacggtagcctccctggtgacttcggatttgatcctcttggtctttcatctgacccggatagtctaaaatggaacgtacaagcagagatagttcactgccggtgggcaatgctaggcgccgccgggatttttatcccggagtttctaaccaagatcgggatcctcaacactccctcgtggtacaccgccggagagcaagagtatttcacggacaagaccacactcttcgtcgttgagctcatcttaatcggatgggccgagggtcgtagatgggctgatatcattaagccaggtagcgtcaacactgacccaatcttcccaaacaacaaactgacgggtacagacgttggatacccgggtgggttatggttcgacccgttgggttggggatctggtagcccggctaagatcaaggagctgaggactaaagagatcaagaacggaaggttggctatgttggcagtgatgggtgcttggttccaacatatatacactgggactggtcctatcgataacctttttgcccatcttgctgatcctggtcatgctactatcttcgctgctttcacacccaagtgagacgtcaagaaaggaggatttgggagagagaatgcgtttatgtgatcatgtttgtacaaatatggtttttgaacttaaaatattatgtatttaagcaaatggtggtcgaattgaagttagggttcgccgtgtcactactcttttcctgactaaatgctcatacattgtgattcgtggtatgatagtcaatctcttctattctttgttggttaatgcatctcatgagaatcatacgcacttctaacaactgctaattacaacaccaaacatatcttcaaatgtagagatttggaaaatgtaaaaa

SEQ ID NO: 5734 - DNA, 1088 bp, Valeriana officinalis
ttacggatcatacttattggagttttggaattttacactccatacagagtcatggaaacatatggtgggaaaagtagttaaaaatagagaaagaataagagccatgaagtggagataaaatgtaagattgtggtggacacgtggcaaattctctagccaatggaagcagttgttctatccttacagataagcaagcaatctctcttgcccttcataatttcaaaaatcacactccattttccattgtgacaaatttgacatggcgtctgcttgcacagccattgttgctgctgctttctcttcctccagttgccagaagaatggagcagttgcaaagagttgttttctgggtgggaaaaaattgagattgaatgtgagtaaatgcaagagtgtttcgcgttctttcggtactaccacggtgtgcacgttggctgatccagaaagaccgatctggtttcccggcagcacccctccggcttggctcgacggcagcctacccggagacttcggtttcgatcctctaggtttaggctcagatcccgagactctaaaatggaacgtccaagcagaaatcgtacactgcagatgggcaatgttaggcgccgccggaatcttcatcccggaattcctaacaaagatcggaatcctaaacacaccgtcgtggtacacagccggcgagcaagaatacttcacagacaagaccacactatttatagtggagctgatttttatcgggtgggccgagggaaggagatgggcggatataatcaaacccggatgtgtcaacaccgacccaattttcccgaacaacaagctgaccggaaccgatgttggatatccgggcgggttatggttcgacccgttgggttggggaagtgggtcgcctgcaaaattaaaggaattgaggactaaagagatcaagaatggaagattagctatgttggctgttatgggagcttggttccaggccaattataccggaactggtcctattgataatctctttgctcatcttgctgatcccggtcatgccaccatttttgctgctttcaccccctaagtgagggagaagaagtattctaactgca

SEQ ID NO: 5735 - DNA, 785 bp, Flaveria ramosissima
acaaacactcattcttcattatcaaatcaatggcttcaactgcttgtgcttcttctgctattgcagctgttgctttctcttccccaagttcacagaaaagtggatgtactgttggatcaacaaaggcttcttttcttggtgggaagaaactcaaagttagcaagttgggtgcaccatccggttcacgatcgttcgcaaccgtgtgcgctgcggctgatcccgatagacccatctggttcccgggcagcaccccaccagaatggctcgatggcagcctacctggagacttcgggttcgatcctcttggtctaggatctgatcccgagactttgagatggaacgtacaggcggaactagtacactgccgatgggcgatgttaggtgccgccgggatctttatccccgaattcctgacaaaaatcggaatccttaacactccgtcgtggtacaccgctggtgaacaagaatacttcacagacaaaaccacactcttcatcattgagcttattttcattggttgggctgaaggaagaagatgggctgacatcatcaaacctgggtgcgttaacacggaccccatcttccccaacaacaagctaactgggaccgatgttggctacccgggtgggctatggtttgacccactggggtgggggagcggttcacctgcaaagctcaaggagttgaggaccaaagagatcaagaatgggaggttagccatgttggctgtgatgggtgcatggttccaagccatctacactggaaccgcccatcgacaacctgtt

SEQ ID NO: 5736 - DNA, 932 bp, Ambrosia trifida
ttgcagctgtttgccttctcttctccaagttcacagaagagtggatcacaaaggcttcttttcttgtgggaagaaactaagagttagcaaggtgggtgcaccatccggttcacgatcgttccgggccgtatgcgcagcggctgaccccgatagacccatttggttccctggcagcactccaccagaatggctcgatggcagcctacctggagacttcggttttgatcctcttggcctaggatctgatccagagaccttgagatggaacgtacaagcggaacttgtacactgcagatgggcaatgctgggtgcagccgggattttcatcccagaattcctaacaaaaatcggaatcttaaacactccatcatggtacactgctggtgaacaagagtacttcaccgacaaaaccacactcttcatcattgagcttattttcatcggttgggccgaaggaagaagatgggctgatatcattaaacctggatgtgtcaacatcgatcccatctttcccaacaacaagctgactgggacggatgttgggtacccaggtggactatggtttgacccacttgggtggggaactggctcacccgcaaagctcaaggaattgaggacaaaagagatcaagaatggaagactggctatgttggctgtgatgggtgcgtggttccaagcaatctacactggaaccggcccattgacaacctgtttgctcaccttgctgacccgggtcatgccaccatcttcgctgcattcaagggctaatgcatatggaaggacttaaaagagttttttggcaagtggtagtttgtgtgtcattagaaaattgtttacttcatcttaatttactgtatataagttttaatgcaaatgtacaaatacctcttaaatctcaaaaaaagtaaaaaagtaccgaactagacgttagg

SEQ ID NO: 5737 - DNA, 935 bp, Cirsium arvense
gctcccaaaagagtggatcaattgttggatcaaccaaggcttcgtttcttggtgggaagaaattgagagttagcaagttcagcgcaccaaccggggcgcgatcattcggcacagtctgtgttgcagccgaccctgaccgacctctttggttccctggtagcactcctccagaatggctcgatggcagtctacccggagattttggctttgatcctcttggtctcggatccgatcccgacaccttgaaatggaaccaacaagccgaactagtacattgccgatgggcaatgttgggagcagccgggatcttcatcccagaattcctaaccaagatcggaatcctaaacactccttcatggtacacggccggcgaacaagaatacttcaccgacaaaaccacactgttcatcgtcgagcttattttcatcggttgggccgagggaagaagatgggctgacattctcaacccggggtgcgttaacaccgacccaatcttccccaacaacaagctaaccggcacggatgtcggatacccgggtgggctatggttcgacccactcggatggggaagtggttcgcctcaaaagctcaaggaattgaggacaaaggagatcaagaatggaagattggccatgttggccgtgatgggcgcttggttccaagccatctatactggaaccggacccattgacaaccttttcgcgcatcttgctgaccctggtcacgccaccatttttgcggcattcaagggctaaatagcaagaaagatgttgggaaatgaaacaagatggatttgaagagtttttggaagtgatgtgtgtttattattattatgaattagaaattgtatggtatctctctactgtagaaaagctaattaatgcaaatgtgtacaaacacctctttcaactcaaaatgcatgttccatatataag

SEQ ID NO: 5738 - DNA, 967 bp, Flaveria ramosissima
agttcacagaagagtggatctattgttggatcaacaaaggcttcttttcttggtgggaagaagctgagagttggcaagttgggtgcaccctccggttcacgatcgttcggaaccgtgtgcgttgcggctgaccccgatagacccatttggttccccggcagcactccacccgagtggctcgatggcagcctacctggagacttcggtttcgatcctcttggcctaggatccgatcccgagaccttgaaatggaacgtgcaagcggaactcgtgcactgcagatgggcaatgttaggtgcagccgggatattcatccccgaattcctaacaaaaatcggaatcctgaacactccttcatggtacaccgcgggtgaacaagagtacttcaccgataaaaccaccctcttcatcatcgagcttattttcatcggttgggccgaaggcagaagatgggctgacatcatcaaacctgggtgtgttaacactgacccaatcttccccaacaacaagctaaccgggaccgatgtgggctacccagggggcctatggttcgacccactcgggtggggaaccggctcgcctgcaaagctcaaggagttgagaaccaaagagatcaagaatggtagattggctatgttggctgtgatgggtgcatggttccaagccatttacaccggaaccggacccattgacaacctgtttgctcaccttgcggacccgggtcacgccaccatcttcgctgcattcaagggctaaagatattggcttgaaggatttgaagagtttgtgataagtggtgtttgtgtaacattagaaattgtatgtgtagagaagttttaatgcaatgtacaaatacctctttaaactccaaatgttgtatgtcatccaatccactacttcacatggatttggaaatcacaagcagacatgcacttcactacaatcaaataagtaaagtttgatttac

SEQ ID NO: 5739 - DNA, 1710 bp, Oryza sativa
ccgccacgtcagcgtgacccggagccaaaggattggattcccggcgccgcgtggcgcgacgcggccgcgctcgctatcccctcgcggataagccgcccatcccagctacgcttcccgcgcgtgcagatcccttaaaccgcccctcaccacacgcgccgtctcctcgatcaccacacgcgcacacgacacgacgcaccaatggcgctcgtctccgcctcctcctccaccaccgccgtcgcggcgctccccggcgccgccagggcctcctccttcctcggcggcgccggcaggagcggcaggctgctgctgaggcaggccgagtcgtcgtccgcgcgggcgtcgttcgccgtgcgcgccgcggcgcccgacaggccaatctggttccccggcagcaccccgccgccgtggctcgacggcagcctccccggcgacttcggcttcgaccccctgggtctcggatcggacccggagagcttgcggtggaacgtgcaggcggagctggtgcactgccggtgggcgatgctgggcgcggcgggcatcttcatcccggagttcctgaccaagatcggcatcctcaacacgccgtcgtggtacaccgccggcgagcagcaatacttcaccgacaccaccaccctcttcatcatcgagctcatcctcatcggctgggccgagggccgccggtgggctgacatcatcaagcccggctgcgtcaacaccgaccccatcttccccaacaacaagctcaccggcaccgacgtcgggtaccctggtggtctgtggtttgacccgctcggctggggcaccggctcgccggagaagatcaaggagctgcgcaccaaggagatcaagaacgggcggctcgccatgctcgccgtcatgggagcttggttccaggcagagtacaccggcaccggccccatcgacaacctcttcgcccatctcgccgaccccggccacgccaccatcttccaggccttcacccccaaatgaggagttcttcaggtgttggagtgttagcaatggctgccaatggaggaagatgaaaagactgttcgtcgacgcgacttacctctcttttttgggatcggagtaggctgtgaatggtggtggtgtattgggatgtaattgtggatggagcactgcatgccttgttgattgtgtacctgtactatgatgtaaccgatgtaaaaaacaagttgatactcttttagaagtgaagttctcttcatcactgaatcagagttgtgatttatgtagcagagtagtaccgtagtagtaggctcagtaatgttgatgagatcatgattcatgcacgggttcagtgttcagaggcagtttgcagcgacagggtaaagaaaaccgtagaagaagtagaagtgagaccagcgaatgcagctttagtgcaaaacatagttagaagctgtttacacacgactgatttgattaatcggtaggtttcatcgtctcgtcgtggtcaaaattatgagagcgttaaaacaaacgcactgatttctccctcaggcctcaaccagttcaatatgatattcagaagttttttatcctcttgattcagattgagaaggtagggacatacaggcaagccaagcatgggtttccattgattcatttcaatctacctaattaacctttgcacaatcagtgacaccgtacccttatttcttagtttcataagaggaggtaggcaggggt

SEQ ID NO: 5740 - DNA, 1019 bp, Arabidopsis thaliana
ataagcagaatctgattttgtcaccagagtgcttttatagattacacaacacacgttcgtttctttcttcttctaacacactctgagtcttgaaggtcaacaacgtcgagaataatggcatcatctctttgtgcttcttctgccatcgctgccatttcttctccaagtttcttgggtggtaagaaactgaggctgaagaagaagttgactgttccagctgtgtccaggccagatgcgtcggtgcgcgccgtcgcagctgatccagatagaccaatctggttcccgggaagcactcctccagagtggctagacggtagcctccctggtgacttcggatttgatcctcttggtctttcatcggacccggacagtctaaaatggaacgtacaagccgagatagtccactgccgatgggctatgctaggagccgccgggatattcatcccagagttcctaacgaagatcggaatcctcaacactccgtcatggtacacggcgggagagcaagagtatttcacggacaaaaccacactctttgtcgttgagctcattttgatcggatgggcagaaggacgtagatgggccgatatcatcaagcccggtagcgtcaacactgacccagtcttcccaaacaacaaactgacgggcacagacgttggttacccaggtgggttatggttcgacccgttgggttggggatccggtagcccggctaagctcaaggagttgaggaccaaggagatcaagaacggaaggttggctatgttggcagtgatgggtgcttggttccaacacatctacactggcactggtcctattgataacctttttgcacatcttgctgatcctggtcacgccacaatcttcgctgctttcacacccaagtgagacaacgaaaaagggttatggggaggtgaatgcgtttgtgtgtgatcatgtttgtacaaatatcattttgaacttaaaattattatgtactttatataaattgtggtcgaatgcaaattaaggttccccgt

SEQ ID NO: 5741 - DNA, 1002 bp, Allium cepa
cgtcatcatacacaacaaagagaagaaaaaggggaatccttgttctgtattaatggcttctgtgtgtgcttcttcttctgccattgcatccattgccaggcaattgatcttatttaaaaagagtggaagtgcatcaatttctgtatcaaaagcatcctttttaggaggaagcaagaaattcagagcgagcaaatcatcagcaacaagtggcaaaaaaagcctccaagtctcagcagctgcagcagaaaggccactttggtttccaggcagcactcctccagaatggctcgatggcagccttccaggagactttggatttgatcctcttggtcttggatctgacccagaaagcttgaaatggaacgcacaagcagaactagtgcactgcagatgggcgatgctgggagcagcaggcattttcattccagaattccttaccaaaatcgggatactaaacactccttcatggtacacagccggagaacaggagtacttcaccgacaaaactaccctcttcatcgttgaactcatccttatagggtgggccgaaggaagaagatgggctgacattatcaagcccgggtgtgtaaacacagacccaattttccctaacaacaaattaacgggtacagatgtgggttacccaggagggctttggttcgatccattgggttggggttcaggctcacctgaaaagatcaaggagttgaggctcaaggagatcaagaatggtagactggctatgttagcagttatgggtgcttggtttcaagctaattatactggaactggccccattgataacttgttcgctcatcttgctgatcctggtcatgcactatcttcgctgctttcactcccaagtgagagaaaaatgtggaacatggattatcagctatggcgaaaattatgtaaaatttggttaggctggtaaatgatgatgtataatatcggcttgtactttgttaattgtctgtgatgaatttggtgactaaaagaaaa

SEQ ID NO: 5742 - DNA, 1037 bp, Brassica juncea
gttttatacatcattcttcgtctcttcttcttctcccaacactttgagtcttgaagaaaggtcatcatcatcaacgtcgagaataatggcttctctttgtgcttcctctgccatcgccgccatttcttctcctagtttcttgtgtggcaagaagctaaggctgaacaagaagctgagtgttgcagctgtttccaaatcagctgcgtctgtgcgggccgttgcagcggatcccgagagaccaatctggttcccaggaagcactcctccagagtggctcgacggtagcctccctggtgacttcggatttgatcctcttggtctttcatctgacccggatagtctaaaatggaacgtacaagcagagatagttcactgccggtgggcaatgctaggcgccgccgggatttttatcccggagtttctaaccaagatcgggatcctcaacacgccgtcatggtacaccgccggagagcaagagtatttcacggacaaaaccacactcttcgtcgttgagctcatcttaataggatgggcagagggacgtagatgggctgatatcattaagccaggtagcgtcaacactgacccaatcttcccaaacaacaaactgacggggacagacgttggatacccgggtgggttatggtttgacccgttgggttggggatctggtagcccggctaaaatcaaggagttgaggactaaggagataaaaaatggaaggttggctatgttggcagtgatgggtgcttggttccaacacatatacactgggactggtcctattgataacctttttgcacatcttgctgatcctggccatgccactatcttcgctgctttcacacccaagtgagatgtcaagaaaggaggatttgggagggagaatgcgtttgtgtgatcatgtttgtacaaatatggcttttgaacttaaaatattatgtatttatacaaactgtggtcgaatgcaagttagaattcgccgtaacactggctcttttcctgactaaatgctcatacattgtggttcgtggtcg

SEQ ID NO: 5743 - DNA, 985 bp, Brassica juncea
gagtcttgaagaaaggtcatcatcatcaacgtcgagaataatggcttctctttgtgcttcctctgccatcgccgccatttcttctcctagtttcttgtgtggcaagaagctaaggctgaacaagaagctgagtgttgcagctgtttccaaatcagctgcgtctgtgcgggccgttgcagcggatcccgagagaccaatctggttccctggaagcactcctccagagtggctcgacggtagcctccctggtgacttcggatttgatcctcttggtctttcatctgacccggatagtctaaaatggaacgtacaagccgagatagttcactgccggtgggcaatgctaggtgccgccggaatttttatcccggagtttctaaccaagatcgggatcctcaacacgccttcgtggtacactgccggagagcaagagtatttcacggacaaaaccacactctttgtcgttgagctcatcttaataggatgggccgagggacgtagatgggccgatatcattaagcccggtagcgtcaacactgacccaatcttcccaaacaacaaactgacgggcacagacgttggatacccgggtgggttatggttcgacccgttgggttggggatccggtagcccggctaagatcaaggagctgaggactaaagagatcaagaacggaaggttggctatgttggcagtgatgggtgcttggttccaacatatctacactgggactggtcctattgataacctttttgcacatcttgctgatcctggccatgccactatcttcgctgctttcacacccaagtgagacgtcaagaaaggaggatttgggagggagaatgcatttgtgtgatcatgtttgtacaaatatggtttttgaacttaaaatattatgtatttatacatattgtggtcgaatgcaaattagggtttcgcggtaacattgcgcttttcctgactaaatgctcatacattgtggttc

SEQ ID NO: 5744 - DNA, 1346 bp, Brassica juncea
cccaacactttgagtcttgaagaaaggtcatcatcatcaacgtcgagaataatggcttctctttgtgcttcctctgccatcgccgccatttcttctcctagtttcttgtgtggcaagaagctaaggctgaacaagaagctgagtgttgcagctgtttccaaatcagctgcgtctgtgcgggccgttgcagcggatcccgagagaccaatctggttccctggaagcactcctccagagtggctcgacggtagcctccctggtgacttcggatttgatcctcttggtctttcatctgacccggatagtctaaaatggaacgtacaagccgagatagttcactgccggtgggcaatgctaggtgccgccggaatttttatcccggagtttctaaccaagatcgggatcctcaacacgccttcgtggtacactgccggagagcaagagtatttcacggacaaaaccacactctttgtcgttgagctcatcttaataggatgggccgagggacgtagatgggccgatatcattaagcccggtagcgtcaacactgacccaatcttcccaaacaacaaactgacgggcacagacgttggatacccgggtgggttatggttcgacccgttgggttggggatccggtagcccggctaagatcaaggagctgaggactaaagagatcaagaacggaaggttggctatgttggcagtgatgggtgcttggttccaacatatctacactgggactggtcctattgataacctttttgcacatcttgctgatcctggccatgccactatcttcgctgctttcacacccaagtgagacgtcaagaaaggaggatttgggagggagaatgcatttgtgtgatcatgtttgtacaaatatggtttttgaacttaaaatattatgtatttatacatattgtggtcgaatgcaaattagggtttcgcggtaacattgcgcttttcctgactaaatgctcatacattgtggttcgtggtctatgagagttaatcttttggtttaacatgtcttttattcttgtcacgtcatctcgagtacacactataacgacccagtctaattacatgtctcaccccttagttcttattatggtaattgtacccttccctaatgtgtgtatcttcgtgaaagcaaccacggctttgcctgagagacccggtccatgagcagaaagacacggacggcaggcaaaggctccaacgggatgccgaactggccgagccgatggcatgagaatcctcttatttatgtcatttagggttacatcttcttctcgaccacctggtttcaccactccaaatggatacaccactctcttcttc

SEQ ID NO: 5745 - DNA, 1024 bp, Brassica juncea
aacactcttgagtcttgaagaaggtcaacaaacttcgagaataatggcttctctttgtgcttcttctgccatcgccgctatttcttctccaggtttcttgggagggaagaaactgaggctgaacaagaagttgagtgttccagctgtttccaagtcggctgcgtcagtgcgggccgtcgcagctgatccagatagaccaatctggttccctggaagcactcctccagagtggctcaacggtagcctccctggtgacttcggttttgatcctcttggtctttcatctgacccggatagtctaaagtggaacgcacaagcagagctagtccactgccggtgggcgatgctaggcgccgccgggatctttatcccggagtttctgaccaagataggaatcctcaacacgccgtcgtggtacacggcgggagagcaagagtatttcacggacaagaccacactctttgtcgttgagctcatcttaataggatgggccgagggacgtagatgggccgatatcattaagccaggtagcgtcaacactgacccgatcttcccaaacaacaaactgacggggacagacgtcggatacccgggtgggttatggttcgacccgttgggttggggatccggtagcccggctaagatcaaggagctgaggactaaggagataaagaacggaaggttggctatgttggcagtgatgggtgcttggttccaacacatctacactgggactggtcctattgataacctttttgcacatcttgctgatcctggccacgccactatcttcgctgctttcacacccaagtgagacgtcaaaggaggatttggaaggaaggatgcatttgtgtgattatgtttgtacaaatattattttgaacttaaaagtaatatgtatttatacaaaactgatcggtcgaatgcaaattaggattcatcgtagcactgctcttttcctgactaaatgctcatatgtttgtttttacatcgccattctgtgagagtgaatatcttcaatttt

SEQ ID NO: 5746 - DNA, 999 bp, Brassica juncea
gggggaacactcttgagtcttgaagaaggtcaacaaacttcgagaataatggcttctctttgtgcttcttctgccatcgccgctatttcttctccaggtttcttgggagggaagaaactgaggctgaacaagaagttgagtgttccagctgtttccaagtcggctgcgtcagtgcgggccgtcgcagctgatccagatagaccaatctggttccctggaagcactcctccagagtggctcaacggtagcctccctggtgacttcggttttgatcctcttggtctttcatctgacccggatagtctaaagtggaacgcacaagcagagctagtccactgccggtgggcgatgctaggcgccgccgggatctttatcccggagtttctgaccaagataggaatcctcaacacgccgtcgtggtacacggcgggagagcaagagtatttcacggacaagaccacactctttgtcgttgagctcatcttaataggatgggccgagggacgtagatgggccgatatcattaagccaggtagcgtcaacactgacccgatcttcccaaacaacaaactgacggggacagacgtcggatacccgggtgggttatggttcgacccgttgggttggggatccggtagcccggctaagatcaaggagctgaggactaaggagataaagaacggaaggttggctatgttggcagtgatgggtgcttggttccaacacatctacactgggactggtcctattgataacctttttgcacatcttgctgatcctggccacgccactatcttcgctgctttcacacccaagtgagacgtcaaaggaggatttggaaggaaggatgcatttgtgtgattatgtttgtacaaatattattttgaacttaaaagtaatatgtatttatacaaaactgatcggtcgaatgcaaattaggattcatcgtagcactgctcttttcctgactaaatgctcatatgtttgtttttacatcgc

SEQ ID NO: 5747 - DNA, 977 bp, Brassica juncea
ctttgtgcttcctctgccatcgccgccatttctgctcctagtttcttgggaggcaagaaactaaggctgaacaagaagttgagtgttccagctggttccaagtcagctgcgactgtgcgcgccgttgcggcggatcccgagagaccaatctggttccctggaagcactcctccagagtggctcgacggtagcctccctggtgacttcggatttgatcctcttggtctttcgtctgacccggatagtctaaaatggaacgtacaagcagagattgtacactgccggtgggcaatgctaggcgccgccgggatttttatcccggagtttctaaccaagatcgggatcctcaacacgccgtcgtggtacaccgccggagagcaagagtatttcacggacaaaaccacactctttgtcgttgagctcatcttaataggatgggccgagggacgtagatgggccgatatcattaagcctggtagcgtcaacactgaccctatcttcccaaacaacaaactgacgggcacagacgttggatacccgggtgggttatggttcgacccgttgggttggggatccggtagcccggctaagatcaaggagttgaggactaaagagatcaagaacggaaggttggctatgttggcagtgatgggtgcttggttccaacatatctacactgggactggtcctattgataacctttttgcacatcttgctgatcctggccatgctactatcttcgctgctttcacccccaagtgagacgtcaagaaaggaggatttgggagggggaatgcgtttgtgtgatcatgtttgtacaaatatggtttttgaacttaaaatatttatgtatttatacaaattgtggtcgaatgtaagttagaattcgccgtaacactggctcttttcctgactaaatgctcatacattgtggttcgtggtctcttctattctttgttggtcaaaaaaaaaaaaaa

SEQ ID NO: 5748 - DNA, 1619 bp, Brassica rapa
cgtggttgatagtagctatgttcagatagagaatctaagatatggtgggacaaaggtgccacgtgttgaagagttgaccaatggggaagctcactgcgttatccatagagataatcagataagcagaatctaattttgtcatcaaacaactttatagttttatacatcattcttcgtctcttcttcttctcccaacactttgagtcttgaagaaaggtcatcatcatcaacgtcgagaataatggcttctctttgtgcttcctctgccatcgccgccatttcttctcctagtttcttgtgtggcaagaagctaaggctgaacaagaagctgagtgttgcagctgtttccaaatcagctgcgtctgtgcgggccgttgcagcggatcccgagagaccaatctggttccctggaagcactcctccagagtggctcgacggtagcctccctggtgacttcggatttgatcctcttggtctttcatctgaccccgatagtctaaaatggaacgtacaagcagagatagttcactgccggtgggcaatgctaggtgccgccggaatttttatcccggagtttctaaccaagatcgggatcctcaacacgccttcgtggtacactgccggagagcaagagtatttcacggacaaaaccacactctttgtcgttgagctcatcttaataggatgggccgagggacgtagatgggccgatatcattaagcccggtagcgtcaacactgacccaatcttcccaaacaacaaactgacgggcacagacgttggatacccgggtgggttatggttcgacccgttgggttggggatccggtagcccggctaagatcaaggagctgaggactaaagagatcaagaacggaaggttggctatgttggcagtgatgggtgcttggttccaacatatctacactgggactggtcctattgataacctttttgcacatcttgctgatcctggccatgccactatcttcgctgctttcacacccaagtgagacgtcaagaaaggaggatttgggagggagaatgcatttgtgtgatcatgtttgtacaaatatggtttttgaacttaaaatattatgtatttatacatattgtggtcgaatgcaaattagggtttcgcggtaacattgcgcttttcctgactaaatgctcatacattgtggttcgtggtctatgagagttaatcttttctattcttttgttggttcatacatctcatgagaatcatacacacttctaagaactgcatgctaattagaacacaccaaacttatcttcaaaatatatagatttggaaaaatatagagaagctgttccatatactaaagaataaagtacctcttgaagaaaaagttccattagccaaattagatggtcttgctgtccgtatgagaaagcgccaacagaatcagatacattatcatcgcctaagcttcttggatttcttatgtttggttccctccacaagaattcataactgcataagaggttgaaacgataactctgttcctggttttgtaattttctagtgtcatacagttgccttcttatcaatacagttgaataacgtgtctctttggagcagcttctcgttcaagg

SEQ ID NO: 5749 - DNA, 1042 bp, Brassica napus
catcatcaacgtcgagaataatggcttctctttgtgcttcctctgccatcgccgccatttcttctcctagtttcttgtgtggcaagaagctaaggctgaacaagaagctgagtgttgcagctgtttccaaatcagctgcgtctgtgcgggccgttgcagcggatcccgagagaccaatctggttccctggaagcactcctccagagtggctcgacggtagcctccctggtgacttcggatttgatcctcttggtctttcatctgaccccgatagtctaaaatggaacgtacaagcagagatagttcactgccggtgggcaatgctaggtgccgccggaatttttatcccggagtttctaaccaagatcgggatcctcaacacgccttcgtggtacactgccggagagcaagagtatttcacggacaaaaccacactctttgtcgttgagctcatcttaataggatgggccgagggacgtagatgggccgatatcattaagcccggtagcgtcaacactgacccaatcttcccaaacaacaaactgacgggcacagacgttggatacccgggtgggttatggttcgacccgttgggttggggatccggtagcccggctaagatcaaggagctgaggactaaagagatcaagaacggaaggttggctatgttggcagtgatgggtgcttggttccaacatatctacactgggactggtcctattgataacctttttgcacatcttgctgatcctggccatgccactatcttcgctgctttcacacccaagtgagacgtcaagaaaggaggatttgggagggagaatgcatttgtgtgatcatgtttgtacaaatatggtttttgaacttaaaatattatgtatttatacatattgtggtcgaatgcaaattagggtttcgcggtaacattgcgcttttcctgactaaatgctcatacattgtggttcgtggtctatgagagttaatcttttctattcagcgtaatgcatgggagacgggaatatggaaaccactgtggtctctg

SEQ ID NO: 5750 - DNA, 1142 bp, Papaver somniferum
gaattcatacattttccaggtgttaatttgcttaacaacaacaaaaatggcatctgtttgcacctcttctgctattgcagctgttgccatctcttccagttctcagaagagtagtggaactactttgggagcaacaaaggcttctttccttgttggacaaaaacttagacaaacaagtaacgctcttgtaaaagcttcaagaagtaccttctccgtctctgctgcagcagctaccgattccgaacggcctctttggttcccaggaagcacccctccagcatggctcgacggcagcctaccaggagactttggatttgatcctcttggactttcatcagacccagagagtttgaagtggaaccaacaagcagaattagttcactgcagatgggcaatgttaggtgctgctggtattttcattccagaatttctaacaaagattggcatcctaaacacaccatcatggtacactgctggtgaacaagaatacttcacagacacaaccactctctttgttatcgaactcgtcctcatcggttgggcagaaggtagaagatgggcagatatccttaaacccggttccgtcaacactgatcccgtcttccctaacaacaagctcaccgggactgatgtcggttaccccggtggactttggtttgacccacttggctggggttctgcttcccctgagaaactcaaggaattgagaactaaggagatcaagaatggaagattggctatgttggcagtcatgggtgcttggtttcaagctcaatacactggtgttggccccattgacaacctctttgctcatcttgctgaccctggtcatgccaccattttccaagcattcaccccacagtaaacaagagattggatcgattgatgaaccgatggcggctgaaatcgaagtgcttatggggcgggaaataattaatctttttaattatgtgaattaaattagattatcaaattgttataatgcatgggttgtgggagtgtactttagacgaggagagtttgtgccaaagtaatgtcttggtctgtaattaaaaatctatgagcattgtgtttacctttctattcatatattcttattaatgatttggttctaatagtaatacatatcatagttctgtaaa

SEQ ID NO: 5751 - DNA, 995 bp, Raphanus sativus
  misc_feature (154)..(154): n is a, c, g, or t
  misc_feature (707)..(707): n is a, c, g, or t
  misc_feature (740)..(740): n is a, c, g, or t
  misc_feature (821)..(821): n is a, c, g, or t
  misc_feature (862)..(862): n is a, c, g, or t
  misc_feature (865)..(865): n is a, c, g, or t
gggatcgtttcttcttcttctcctaacacttaacatttctgagtcttgaagaaggtcaaccagcttcgagaataatggcttctctttgtgcttcttctgccatcaccgctatttcttctccaggtttcttgggagggaagaaactgaggctgancaagaagttgagtgttccagctggttccagatcggctgcgtccgtgcgcgccgccgcagctgatccggatagaccaatctggttccctggaagcactcctccagagtggctagacggtagcctccctggtgacttcgggtttgatcctcttggtctttcgtctgacccggatagtttaaagtggaacgcacaagcagagctagtccactgccggtgggcgatgttaggcgccgccgggatttttatcccggagtttctaaccaagataggaatcctcaacacgccgtcgtggtacacggcaggagagcaagagtacttcaccgacaaaaccacactcttcgtcgttgagctcatcttaataggatgggccgagggacgtagatgggctgatatcattaagccaggtagcgtcaacactgacccaatcttcccaaacaacaaactgacggggacagacgttggatacccgggtggtttatggttcgacccgttgggttggggatccggtagcccggctaagatcaaggagctgaggactaaggagataaagaanggaaggttggctatgttggcagtgatgggtgcntggttccaacatatctacactgggactggtcctattgataacctttttgcacatcttgctgatcctggccacgccactatnttcgctgctttcacacccaagtgagacgtcaaaaaggaagnatnggtttgtgtgatcatgtttgtacaaatatctcttttgaacttagaagcattatgtatttatacaaaactgtggtcgagtgcaaattagggttcgtcgtaacaatgctcctttcctgactaaatgctcata

SEQ ID NO: 5752 - DNA, 1148 bp, Allium cepa
ggggacaacaaagagaagaaaagggaatccttgttctgtattaatggcttctgtgtgtgcttcttcttctgccattgcatccattgccagtaaaaagagtggaagtgcatcaatttctgtatcaaaagcatcctttttaggaggaagcaagaaattcagagcgagcaaatcatcagcaacaagtggcaaaagcctccaagtctcagcagctgcagcagaaaggccactttggtttccaggcagcactcctccagaatggctcgatggcagccttccaggagactttggatttgatcctcttggtcttggatctgacccagaaagcttgaaatggaacgcacaagcagaactagtgcactgcagatgggcgatgctgggagcagcaggcattttcattccagaattccttaccaaaatcgggatactaaacactccttcatggtacacagccggagaacaggagtacttcaccgacaaaactaccctcttcatcgttgaactcatccttatagggtgggccgaaggaagaagatgggctgacattatcaagcccgggtgtgtaaacacagacccaattttccctaacaacaaattaacgggtacagatgtgggttacccaggagggctttggttcgatccattgggttggggttcaggctcacctgaaaagatcaaggagttgaggctcaaggagatcaagaatggtagactggctatgttagcagttatgggtgcttggtttcaagctaattatactggaactggccccattgataacttgttcgctcatcttgctgatcctggtcatgccactatcttcgctgctttcactccaagtgagagaaaaatgtggaacatggattatcagctatggcgaaaattatgtaaaatttggttaggctggtaaatgatgatgtataatatcggcttgtactttgttaattgtctgtgatgaatttggtgactaaaggatgtacaaattgtttgtgagttttgcaagctaaaagaaatgtctggtaagttaggtacgtataaaccttaactaaacctacggtaccgacactaccggtaaacgaaagtagtactaatatgtactaacttaataagtttaatttaacgtttatactatattatttacttttaacctt

SEQ ID NO: 5753 - DNA, 895 bp, Centaurea maculosa
  misc_feature (864)..(864): n is a, c, g, or t
  misc_feature (869)..(869): n is a, c, g, or t
  misc_feature (883)..(883): n is a, c, g, or t
gggatatcatcttgagcccaagtttttcacagaaaaccatggcctccacagcctatgcttcttctgccattgcagctgctgctttctcttctccaagctcccagaagagtggatcaattgttggatcaaccaaggcttcttttcttggtgggaagaaattgagagttagcaagttcagtgcaccaaccggggcgcgatcattcggcacagtctgtgttgcagccgaccctgaccgacctctttggttccctggcagcactcctccagaatggctcgatggcagcctacccggagattttggctttgatcctcttggtctcggatccgaccctgacaccttgaaatggaaccaacaagccgaactagtacattgccgatgggcaatgttgggagcagccgggatcttcatcccggaattcctaaccaaaatcggaatcttaaacactccttcatggtacacggccggcgaacaagaatacttcaccgacaaaaccacacttttcatcgtcgagcttattttcatcggttgggccgaaggaagaagatgggctgacattctcaacccggggtgcgttaacaccgacccaatcttccccaacaacaagctaaccggcacggatgttgggtacccgggtgggctatggttcgacccactcggatggggaagtggttcgcctcaaaagctcaaggaattgaggacaaaggagatcaagaatggaagattggccatgttggccgtgatgggcgcttgggttccaagccatctacactggaacggaccattgacacttttcgcacatctgctgacccggtcacgccacattttgcgcatcaggctaatagcagaagatgctggcatgaaanatggntgacagttttggangatgtgtatata

SEQ ID NO: 5754 - DNA, 930 bp, Brassica juncea
gagtcttgaagaaaaggtcatcatcatcaacgtcgagaataatggcttctctttgtgcttcttctgccatcgctgccatttcttctcctagtttcttgggaggcaagaaactaaggctgaacaagaagttgagtgttccagctgtttccaagtcagctgtgcgggccgttgcagcggatcccgagagaccaatctggttcccaggaagcactcctccagagtggctcgacggtagcctccctggtgacttcggatttgatcctcttggtctttcatctgacccggatagtctaaaatggaacgtacaagcagagatagttcactgccggtgggcaatgctaggcgccgccgggatttttatcccggagtttctaaccaagatcgggatcctcaacacgccgtcatggtacaccgccggagagcaagagtatttcacggacaaaaccacactcttcgtcgttgagctcatcttaatcggatgggccgagggacgtagatgggccgatatcattaagcccggtagcgtcaacaccgaccctatcttcccaaacaacaaactgacgggtacagacgttggatacccgggtgggttatggttcgacccgttgggttggggatccggtagcccggcaaagatcaaggagctgaggaccaaagagatcaagaacggaaggttggctatgttggcagtgatgggtgcttggttccaacacatctacactgggactggtcctattgataacctttttgcacatcttgctgatcctggccacgccactatcttcgctgctttcacacccaagtgagacgtcaagaaaggaggatttgggagggagaatgcgtttgtgtgatcatgtttgtacaaatatggcttttgaacttaaaatattatgtatttatacaaactgtggtcgaatgcaagttagaatt

SEQ ID NO: 5755 - DNA, 999 bp, Flaveria ramosissima
aggaactactgttggatcaacaaaggcttctttcttggtgggaagaagctcaaagttagcaagttgggtgcaccatccggttcacgatcgttcgcaaccgtgtccgccgcggctgatcccgatagacccatttggttcccgggcagcaccccaccagaatggctcgatggcagcctacctggagacttcgggttcgatcctcttggtctaggatctgatcccgagactttgagatggaacgtacaggcggaactagtacactgccgatgggcgatgttaggtgccgccgggatcttcatccccgaattcctgacaaaaatcggaatcctaaacactccgtcgtggtacactgctggtgaacaagaatacttcacagacaaaaccacactcttcatcattgagcttattttcattggttgggcagaaggaagaagatgggctgacatcatcaaacctgggtgcgttaacacggaccccatcttccccaacaacaagctaaccgggaccgatgttggctacccgggcgggctatggtttgacccactcgggtgggggagcggttcacctgcaaagctcaaggagttgaggacaaaagagatcaagaatgggaggttagccatgttggctgttatgggtgcatggttccaagccatctacaccggaaccggacccatcgacaacctgtttgcacaccttgcggacccgggtcacgccaccatttttgccgcattcaagggctaaaacagcattataagggcttttggcaaagtgatgtttgtgtattattagaaactctatcttatgtttactgtagatcaaagttaatggaatgtacaaatacctcttaatttcactcaaaatggtccatatagataaattacataagctagcttgtatgtcataatttcacatattacatcgacgaatccttgttaaatcttgtaacactttaagtacgtttaaaatgaaaatgtacgtttgtgattcttagttttaggt

SEQ ID NO: 5756 - DNA, 1054 bp, Flaveria ramosissima
atgggagttctcctcctaccaactacttcaagccaacgtattactacaacaacaatggcttccactgcttgtgctcttctgccattgcagctgttgctttctcttctccaacttcacagaagagtggttctattgttggatcacaaggcttcttttcttggtgggaagaaactgagagttagcaaggtgggtgcaccctccggttcacgatcgtttggaaccgtgtgcgttgcggctgaccccgatagacccatttggttccccggcagcaccccacccgaatggctcgatggcagcctacctggagacttcggtttcgatcctctcggcctaggatccgatcccgagaccttgagatggaacgtgcaagcggaactcgtgcactgcagatgggcaatgttaggtgcagccgggatcttcatccccgaattcctaacaaaaatcggaatcctgaacaccccttcatggtacaccgcgggtgaacaagaatacttcaccgataaaaccaccctcttcatcgtcgagcttattttcatcggttgggccgaaggaagaagatgggctgatatcatcaaacctgggtgtgttaacactgacccaatcttccccaacaacaagttaactggaactgatgtgggctacccaggtggactatggttcgacccactcgggtggggaaccggctcgcctgcaaagctcaaggagttgaggacaaaagagatcaagaatgggagactggctatgttggctgtgatgggtgcatggttccaagccatatacactggaaccggacccattgacaacctgtttgctcaccttgctgacccgggtcacgccaccatcttcgctgcattcaagggctaaagatattggcaggaaggatttaaagagtttgtgacaagtggtgtttgtgtatcattagaaattgtatgtgtagaaaagttttaatgcaatgtacaaatacctctttgaactccaaagcttgtatgtcatccaatccaactacttcaagtggattttgaaatctaaaagcaagacatgcatatcaactaaa

SEQ ID NO: 5757 - DNA, 1051 bp, Panicum virgatum
cacaagctttcgctgccatggcactcgtctccgcctcctcctcctccaccgccgtcgcggcgctccccaggaatgggcagcgctcgctgtccttcctcggcggcaagacgctgttgaggcaggccgaggcggcgcggccgtcgttcgcggtgcgcgccgcggcggaccccgacaggcccatctggttccccggcagcaccccgccgccgtggctcgacggcagcctccccggcgacttcggctttgatccctggggcctcggatctgacccggagagcttgcggtggaacgtgcaggcggagctggtgcactgccggtgggcgatgctcggcgcggcgggcatcttcatcccggagttcctgaccaagatcggcatcctcaacacgcccttctggtacaccgccggcgagcagcagtacttcaccgacaccaccaccctcttcatcatcgagctcatcctcatcggctgggccgagggccgccgctgggccgacatcatcaagcccgggagcgtcaacaccgaccccatcttccccaacaacaagctcaccggcaccgacgtcgggtaccctggtggcctgtggtttgacccgctcggctggggcagcggctcgccggagaagatcaaggagctgcgcaccaaggagatcaagaacggccgcctcgccatgctcgccgtcatgggcgcctggttccaggccgagtacaccggcaccggccccatcgacaacctcttcgcccacctcgccgaccccggccacgccaccatcttccaggccttcacccccaaatgaggagttggagttagcgatttgagattgcgaccaagcatgcatgggggtggagattgttaggttgatggtcgatcgatgcgacttttttctgtttgtggggcggaagactgtccatgcatgatgattgaatggtttgtggagcgatgcatgcctgttgatcgtgcacttgtactgtgttgtaaccaatgtaaaaatgcaatactcgttagatgctatgctctgtcactgaagcaacgacgacttgatgatttgtgcaa

SEQ ID NO: 5758 - DNA, 1459 bp, Brassica napus
ctcatggttattgttcacaaccgccacaaaagatatgtgctctctttgattgcctcacacgagaagcttttttgtgtttttggtgtttcttgacctgttcttgattggtttcactaggtttagtagaatgttaattacttagttaagcttatgagttatgttaatcttgagtctcaggagagtgatacgtcagcgttggaagctaggaacggtaaagacatccaagggatcccttgggagaagcttaattacagccgagatcaataccgtcactagagattgcaacagtataagaactttgagagcctctttagatccagacaagaccttgacaaggttcgaactatattgttggatccttcttgctctggctctggaaccattatagatcgtctgtgcccaacactttgagtcttgaagaaaggtcatcatcatcaacgtcgagaataatggcttctctttgtgcttcctctgccatcgccgccatttcttctcctagtttcttgtgtggcaagaagctaaggctgaacaagaagctgagtgttgcagctgtttccaaatcagctgcgtctgtgcgggccgttgcagcggatcccgagagaccaatctggttccctggaagcactcctccagagtggctcgacggtagcctccctggtgacttcggatttgatcctcttggtctttcatctgaccccgatagtctaaaatggaacgtacaagcagagatagttcactgccggtgggcaatgctaggtgccgccggtaattttatcccggagtttctaaccaagatcgggatcctcaacacgccttcgtggtacactgccggagagcaagagtatttcacggacaaaaccacactctttgtcgttgagctcatcttaataggatgggccgagggacgtagatgggccgatatcattaagcccggtagcgtcaacactgacccaatcttcccaaacaacaaactgacgggcacagacgttggatacccgggtgggttatggttcgacccgttgggttggggatccggtagccccgctaagatcaaggagctgaggactaaagagatcaagaacggaaggttggctatgttggcagtgatgggtgcttggttccaacatatctacactgggactggtcctattgataacctttttgcacatcttgctgatcctggccatgctactatcttcgctgctttcacacccaagtgagacgtcaagaaaggaggatttgggagggagaatgcgtttgtgtgatcatgtttgtacaaatgtggtttttgaacttaaaaatattatgtatttaagcaaatggttgtcgaatgcaagttagggttcgctgtaaacactgctcttttcctgactaaatgctcatacattgtggttcgtggtatgatcaatctcttttatttttcattggttaatatatctcatgagaatacacttctaac

SEQ ID NO: 5759 - DNA, 1304 bp, Papaver somniferum
agaattcatacattttccaggtgttaatttgcttaacaacaacaaaaatggcgtctgtttgcacttcttctgctattgcagctgttgccatctcttccagttctcagaagagtagtggaactactttgggagcaacaaaggcttctttccttgttggacaaaaatttagacaaacaagtagcgcttttgtaaaagcttcaagaagtaccttctccgtctctgctgcagcagctaccgattccgaacgccctctttggttcccaggaagcacccctccagcatggctcgacggcagcctaccaggagactttggatttgatcctcttggactttcatcagacccagagagtttaaagtggaaccaacaagcagaattagttcactgcagatgggcaatgttaggtgctgctggtattttcattccagaatttctaacaaagattggcatcctaaacacaccatcatggtacactgctggtgagcaagaatacttcacagacacaaccactctctttgttatcgaactcgtcctcatcggttgggcagaaggtagaagatgggcagatatccttaaacccggttccgtcaacactgatcccgtcttccctaacaacaagctcaccgggactgatgtcggttaccccggtggactttggtttgacccacttggctggggttctgcttcccctgagaaactcaaggaattgagaactaaggagatcaagaatggaagattggctatgttggcagtcatgggtgcttggtttcaagctcaatacactggtgttggtcccattgacaacctctttgcccatcttgctgaccctggtcatgccaccattttccaagcattcaccccacaataaacaagagattggatcaaatgatgaaccgatggcggctgaaatcgaagtgcttatgggtaatctttttaattatgtgaattaaattagattatcaaattgttataatgcatgggttgtgggagtgtactttagacgaggagagtttgtgccaaagtaatgtcttggtctgtaattaaaaatctatgagcattgtgtttacctttctattcatattcttgttaatgatttggttctaatggtaatatatcatagttctgtaaacagatcaggcaaactacaaaaatatataaaggtataaacatttgcttaaagcatccacaatgggtgtgctaaaatgatatttatactattttggggaggtagcagtggatatggcacaatgaaacttctcgcaatttagtgaacaaactgcaatcattctttggttcatatggaaat

SEQ ID NO: 5760 - DNA, 999 bp, Brassica juncea
gttctcttcttcttctcctaacactttgagtcttgaagaaaaggtcatcatcatcaacgtcgagaataatggcttctctttgtgcttcttctgccatcgctgccatttcttctcctagtttcttgggaggcaagaaactaaggctgaacaagaagttgagtgttccagctgtttccaagtcagctgtgcgggccgttgcagcggatcccgagagaccaatctggttcccaggaagcactcctccagagtggctcgacggtagcctccctggtgacttcggatttgatcctcttggtctttcatctgacccggatagtctaaaatggaacgtacaagccgagatagttcactgccggtgggcaatgccaggtgccgccggaatttttatcccggagtttctaaccaagatcgggatcctcaacacgccttcgtggtacactgccggagagcaagagtatttcacggacaaaaccacactctttgtcgttgagctcatcttaataggatgggccgagggacgtagatgggccgatatcattaagcccggtagcgtcaacactgacccaatcttcccaaacaacaaactgacgggcacagacgttggatacccgggtgggttatggttcgacccgttgggttggggatccggtagcccggctaagatcaaggagctgaggactaaagagatcaagaacggaaggttggctatgttggcagtgatgggtgcttggttccaacatatctacactgggactggtcctattgataacctttttgcacatcttgctgatcctggccatgctactatcttcgctgctttcacccccaagtgagacgtcaagaaaggaggatttgggagggggaatgcgtttgtgtgatcatgtttgtacaaatatggtttttgaacttaaaatatttatgtatttatacaaattgtggtcgaatgtaagttagagttcgccttgacgctgctcctttcctggctaaatgctcatacaa

SEQ ID NO: 5761 - DNA, 1032 bp, Cichorium intybus
gagtggatcttttgttggatcaacaaaggcttctttccttggtgggaagaacttgagagttagcaagttcactgcaccaaccagggcacgatctgtcggcacagtatgcgttgccgccgaccctgacagacctatttggttccccggcagcacccctccggaatggctcgacggcagcctacccggagacttcgggtttgatcctcttggtctaggatccgacccggagactttgaagtggaacgtgcaagcggaattagtacactgcagatgggcaatgttaggagcagctgggatcttcatcccggagttcctaaccaaaatcggaatcctaaacactccttcatggtacacagccggcgaacaagaatacttcaccgacaaaactacactgttcatagtggagcttattttcatcggctgggcagaaggaagacgatgggctgacatcctcaaacctgggtgtgttaacactgatcccatcttccccaacaacaagctaaccggcacagatgttgggtacccaggtggactatggttcgacccactcggatgggggagcggttcacctgcaaagcttaaggaattgaggacgaaggagatcaagaatgggagattggccatgttggctgtgatgggtgcttggttccaagcaatctacactggaactggacccattgacaacctcttcgctcaccttgctgacccgggtcacgccaccatatttgctgcattcaagggttaaataccaagggattcttgagattatgatcttcaaatgctggagaggaacaatggtggatttaacagtttttggcaagtgatgtgtgtatcattagaaattgtatcttgtctctactgtagaaaagttaatgcaatgtacaaatacctcttgaactcaaaatgatgcatatataagcttgtatgttgatggactatatatgtggcggatccagaaatcccaaataggatgtgcactatcattacaaaatgaaaacgttggttttgctgtaacaaccaaaacaaattcat

SEQ ID NO: 5762 - DNA, 1448 bp, Sorghum bicolor
gcgctccacgtcagcgcgatccggcgtgccagagccaaacgagcagattctcccgcgccgcgtggcacgaggcggccgcgcccgctatcccctcgcggataagccggccccgctccgggctccggcgcgcggccgccgcgagatcccttaaactgccgcgcaccgcccaccacacagctcccaacgctctccacgccacacagctcaatggcactcgtctccgcctcctcgtcctccaccaccgccgtcgcggcgctccccaggaatgggcagcagcgcgcgtcgtcgacgtccttcctcggcggcaagacgctgctgaggcaggccaccgaggcggcccggccgtcgttcgccgtgcgcgccgcggcggaccccgacaggccgatctggttccccggcagcacccctcccccgtggctcgacggcagccttccgggcgacttcggctttgatccctggggcctcggatctgacccggagagcctgcggtggaacgtgcaggcggagctggtgcactgccggtgggcgatgctcggcgcggcgggcatcttcatcccggagttcctgaccaagatcggcatcctcaacacgcccttctggtacaccgccggcgagcagcagtacttcaccgacaccaccaccctcttcatcatcgagctcatcctcatcggctgggccgagggccgccgctgggctgacatcatcaagcccggaagcgtcaacactgaccccatcttccccagcaacaagctcaccggcaccgacgtcgggtaccctggtggcctgtggtttgacccactcggctggggctccggctcgccggagaagatcaaggagctgcgcaccaaggagatcaagaacggacgcctcgccatgctcgccgtcatgggcgcctggttccaggccgagtacaccggcactggccccatcgacaacctcttcgcccacctcgccgaccccggccacgccaccatcttccaggccttcacccctaaatgaggtttagcattattgaggagtgctaccgcacatgcattgttaggttgatggccgatatgaaacttcatttttttgtgggggcggactgcggagtagactgtcaatgatgatggaatgttcgtggtgcgatgcatggtgtacttgtactatgttgtaaaccaatgtaaaaatgggatactcgttagataatatgtcctctcttcactgaatcaatggcttgatgatgatgatgatgtgtgcaacgctaatcgttttgatgatgctttagggcctttttggctccaggggcgaagctagcaataaaaatcaaggttgtgcaccaccaaagcaatacctaaatatttctttgcgatatatggtaaatgttagtcaaattactaatgaaatttgcatataccgtggtgcctgtttaccagggtaatataacatggcgtcgtcctgctcccatt

SEQ ID NO: 5763 - DNA, 2149 bp, Sorghum bicolor
ctttgatttacatcaagcacactctactttaaacgtcttccttttaaagccgaagaaatccgcgtggcatacaacacgcgacacgtgagtgtcacagtgtgctttgccgaaagcagatatgagcagaagcctgcctacctggcaatgcccaatgccgtggccacccctgatttttatcagctcgcagtcgagcgcgctccacgtcagcgcgatccggcgtgccagagccaaacgagcagattctcccgcgccgcgtggcacgaggcggccgcgcccgctatcccctcgcggataagccggccccgctccgggctccggcgcgcggccgccgcgagatcccttaaactgccgcgcaccgcccaccacacagctcccaacgctctccacgccacacagctcaatggcactcgtctccgcctcctcgtcctccaccaccgccgtcgcggcgctccccaggaatgggcagcagcgcgcgtcgtcgacgtccttcctcggcggcaagacgctgctgaggcaggccaccgaggcggcccggccgtcgttcgccgtgcgcgccgcggcggaccccgacaggccgatctggttccccggcagcacccctcccccgtggctcgacggcagccttccgggcgacttcggctttgatccctggggcctcggatctgacccggagagcctgcggtggaacgtgcaggcggagctggtgcactgccggtgggcgatgctcggcgcggcgggcatcttcatcccggagttcctgaccaagatcggcatcctcaacacgcccttctggtacaccgccggcgagcagcagtacttcaccgacaccaccaccctcttcatcatcgagctcatcctcatcggctgggccgagggccgccgctgggctgacatcatcaagcccggaagcgtcaacactgaccccatcttccccagcaacaagctcaccggcaccgacgtcgggtaccctggtggcctgtggtttgacccactcggctggggctccggctcgccggagaagatcaaggagctgcgcaccaaggagatcaagaacggacgcctcgccatgctcgccgtcatgggcgcctggttccaggccgagtacaccggcactggccccatcgacaacctcttcgcccacctcgccgaccccggccacgccaccatcttccaggccttcacccctaaatgaggtttagcattattgaggagtgctaccgcacatgcattgttaggttgatggccgatatgaaacttcatttttttgtgggggcggactgcggagtagactgtcaatgatgatggaatgttcgtggtgcgatgcatggtgtacttgtactatgttgtaaaccaatgtaaaaatgggatactcgttagataatatgtcctctcttcactgaatcaatggcttgatgatgatgatgatgtgtgcaacgctaatcgttttgatgatgctttagggcctttttggctccaggggcgaagctagcaataaaaatcaaggttgtgcaccaccaaagcaatacctaaatatttctttgcgatatatggtaaatgttagtcaaattactaatgaaatttgcatataccgtggtgcctgtttaccagggtaatataacatggcgtcgtcctgctcccattgatatcatcgtgccgcgagtttgattgcgccgtaaatgcacaccgccattttgacaagagttagtgtagaattacacggtgaacgcccaaacttttggcaggcctaagacgcggcagtaaccaaacaagggtacaacgtgccgcctcaggcgtggcgcgctgtggctatgagccagacatgcccttactcggcaaaaggaaaatctcaacccaaaaaccatccacctcaacaagaaaccacatcttgaaactacaccacgaaatacattgatttttcaaatcataaaaaaacagtcagtgcattagaatctctctcccccaatcttgtttcttctcttgagtcttttacctgtatgccattatgaaagatcgaccaaaccaggagacaactaaaaagttgtttcgcaccgctgtgcccaacttcatcttcggctatacctgtgtaccattccatccattttaaagcctaacggcagttaagtagcttggcaatagacttgaatgccct

SEQ ID NO: 5764 - DNA, 994 bp, Triticum aestivum
gcacagccagcgagcgcaccggtgcagcaacgatggcgctggtctcctcctcctccgccgccaccgccgtcgcggcgctccccagtaatgggctggccggcgcccggagctccttcctcggcgctgccggcaaggcggcggcggcgtcgcgcgcgtccttcgccgtgcgcgccgcggcgcccgagaggcccatctggttccccgggagcacccctcccccgtggctcgacggcagccttcccggagacttcggctttgacccctggggtcttggatccgacccggagagcttgcggtggaacgtgcaggcggagctggtgcactgccggtgggcgatgctgggcgcggcgggcatcttcatcccggagctgctgaccaagatcggcatcctcaacacaccgtcgtggtacaccgccggggagcaggagtacttcaccgacaccaccaccctcttcatcgtggagctcatcctcatcggctgggccgagggccgccggtgggcagacatcatcaagcccggctgcgtcaacaccgaccccatcttccccaacaacaagctcaccggcaccgacgtcgggtaccccggtggtctgtggtttgacccgctcggctacggcaccggctcgcccgagaagctcaaggagctgcgcaccaaggagatcaagaacggccgcctcgccatgctcgccgtcatgggcgcgtggttccaggccgagtacaccggcaccggccccatcgacaacctcttcgctcacctcgccgaccccggccacgccaccatcttccgggcctttgcccccaagtaaggaacacggtgggagttagcaactaatccgaggagtgtgctaccacggggaagaagatcgctggtggaacttgatttttttctttcctgggaagtagaccgtggatgatggtatgtaattgtggagcaatgcatgcttgttggatgtgtacttgtaccctggtgttgtagccgatgtaaaaaatgaat

SEQ ID NO: 5765 - DNA, 848 bp, Musa acuminata
actaccaccagtggcagaggcagtggagcttccatcatggcatcgctctgtgcttcctcttctgcagtcgctgcagtcgccaggtctcggaagaacggagctgctgccgttgctgcaaccaaggcatcatttcttggaggaaggaaactgaggcaggggaagcgggcggcacgggcacaaactgcacgccgggagctctcggtgtctgctgccgctgcacctgagaggcctctctggttcccaggcagcacccctccaccatggcttgatggcagccttcctggagattttggcttcgatcctttgggtctcggctctgatcctgagagcctgagatggaaccagcaagcggagatcgtccactgccggtgggcgatgctgggcgctgccggcatcttcatcccggagctgctcaccaagatcggcatcctcaacaccccctcgtggtacaccgccggccagctgcagtacttcacggacaccaccaccctgtttgtgatcgagctcattttgatcgggtgggccgaggggcggaggtgggcggacatcatcaagcccggctgcgtcaacaccgaccccatcttccccaacaacaagctcaccggcaccgacgtcggctaccccggcggcttctggttcgaccccctcggctggggcagtggctcgccggagaaggtgaaggagctgaggaccaaggagatcaagaacgggaggctggcgatgttggccgtgatgggcgcatggttccaagccatctacaccggaacagggcccatcgacaacctcttcgcgcaccttgccgaccccggccatgccacagttttctctgtgagtagattccactggat

SEQ ID NO: 5766 - DNA, 795 bp, Ipomoea batatas
tcatttctttccacacataacacaacaatcacaccctgcattgtacaaaaatctgtcgacatggcatctgcctgtgctgcttcgtccaccattgcggccgctgcatcctcgtccccgagttcccagacaaaggcgtctttcctctcggggagaaagctgagggtgagcaagtactcggcccctgccacgtcgcgatcttttactgtctgtgctacggctgatcccaaccgacccctctggttcccgggcagcacccctcctccatggctcgatggcagcctccctggagactttggttttgatcccctcggtcttgcatctgatcccgagagcttgaaatggaaccagcaggcggagattgtgcactgcagatgggcgatgttgggggctgcgggtattttcatcccggagttcctcacgaagatcgggattctgaacacgccttcgtggtacactgcgggcgagcaagagtacttcactgatacaaccacgctcttcgtcatcgagttgatactcatcggctgggctgagggaaggcggtgggctgacatcatcaagcctggatgcgtgaacacagatcccatcttccccaacaacaagctcaccgggactgacgtaggctatccaggtggcttatggttcgacccactcggctggggatctggttctcctgaaaagatcaaggagttgagaaccagggagatcaagaacggaagattagccatgctggcggttatgggtgcatggttccaacacatctacaccggaacaggacctatggacaacctcttcgct

SEQ ID NO: 5767 - DNA, 771 bp, Ambrosia trifida
ttgcagctgttgccttctcttatccaagttcacagaagatggatcacaaaggttctttcttgtggaagaactaagagttagcaaggtgagtgcaccatccggttcacgatcgtttggaaccgtatgcgcagcggctgacccagatagacccatttggttccctggcagcactccaccagaatggctcgatggcagcctacctggagacttcggttttgatcctcttggcctaggatctgatccggagaccttgagatggaacgtacaagcggaacttgtacactgcagatgggcaatgctgggtgcagccgggattttcatcccagaattcctaacaaaaatcggaatattaaacactccatcatggtacactgctggtgaacaagaatacttcaccgacaaaaccacactcttcatcattgagcttattttcatcggttgggccgaaggaagaagatgggctgacattatcaaacctgggtgcgtcaacactgatcccatcttccccaacaacaagctgactgggacggatgttgggtacccaggtggactatggtttgacccacttgggtggggaactggctcacccgcaaagctcaaggaattgaggacaaaagagatcaagaatggaagactggctatgttggctgtgatgggtgcatggttccaagcgatctacactggaaccggaccattgacaacctgtttgctcaccttgctgacccggttgaattgccactatcttcgctgcattcaagggctaatgcatat

SEQ ID NO: 5768 - DNA, 756 bp, Flaveria ramosissima
tgcagctgttgctttctcctccccaagttacaaaaaagtggatctactgttggatcaacaaaggcttctttcttggtggaagaaactcaagttagcaagttggtgcaccatccggttcacgatcgttcgcaaccgtgtgcgccgcggctgatcccgatagacccatttggttcccgggcagcaccccaccagaatggctcgatggcagcctacctggagacttcgggttcgatcctcttggtctaggatctgatcccgagactttgagatggaacgtacaggcggactagtacattgccgatgggcgatgttaggtgccgccgggatctttatccccgaattcctgacaaaaatcggaatcctaaacactccgtcgtggtacaccgctggtgaacaagaatacttcacagacaaaaccacactcttcatcattaagcttattttcattggttgggctgaaggaagaagatgggctgacatcatcaaacctgggtgcgttaacacggaccccatcttccccaacaacaagctaaccgggaccggatgttggctacccgggcgggctatggtttgaaccactcggtgggggagcggttcacctgcaaagctcaaggagttgaggacaaaagagatcaagaatgggaggttagccatgttggctgtgatgggtgcatggttccaagccatctacaccggaaccggacccatcgacaacctgtttgcacaccttgcggacccgggtcacgccaccatttt

SEQ ID NO: 5769 - DNA, 1136 bp, Triticum aestivum
cgcacgcgcgcgctcgccttccccactacaggcacagccagcgagcgcactggtggtacaacgatggcgctggtctcctcctcctccgccaccgccgtcgcggcgctccccagcaatgggctggccggcgcccggagctccttccttggcgctgccggcaaggcggcggggtcgcgcgcgtcgttcgccgtgcgcgccgcggcgcccgagaggcccatctggttccccgggagcacccctccgccgtggctcgacggcagccttcccggagacttcggctttgacccctggggtcttggatccgacccggagagcttgcggtggaacgtgcaggcggagctggtgcactgccggtgggcgatgctgggcgcggcgggcatcttcatcccggagctcctgaccaagatcggcatcctcaacacgccgtcgtggtacaccgccggggagcaggagtacttcaccgacaccaccaccctcttcatcgtggagctcatcctcatcggctgggccgagggccgccggtgggcagacatcatcaagcccggctgcgtcaacaccgaccccatcttccccaacaacaagctcaccggcaccgacgtcgggtaccccggtggtctgtggtttgacccgctcggctacggcaccggctcgcccgagaagctcaaggagctccgcaccaaggagatcaagaatggccgcctcgccatgctcgccgtcatgggcgcgtggttccaggccgagtacaccggcaccggccccatcgacaatctcttcgctcacctcgccgaccccggccacgccaccatcttccgggccttcgcccccaagtaaggaacacgttgggagttagcaactaatccgaggagtgtgctaccacggggaagaagatcgctggtggaacttgacttttttttccgtggaagtaaaccggatgatggtatgtaattgtggagcaatgcatgcttgttggatgtgtacttgtaccctggtgttgtaaccgatgtaaagaatgaatacccttttgaaccttatgttggcatcgtccacgagtctcgcgacgtcgcccaatggtcctaacgttaatggggtcatacaaagaatactttgagaacaagaaatggtaacactacaagagc

SEQ ID NO: 5770 - DNA, 1239 bp, Triticum aestivum
cgcacgcgcgcgctcgccttccccactacaggcacagccagcgagcgcactggtggtacaacgatggcgctggtctcctcctcctccgccaccgccgtcgcggcgctccccagcaatgggctggccggcgcccggagctccttcctcggcgctgccggcaaggcggcggggtcgcgcgcgtccttcgccgtgcgcgccgcggcgcccgagaggcccatctggttccccgggagcacccctcctccgtggctcgacggcagccttcccggagacttcggctttgacccctggggtcttggatccgacccggagagcttgcggtggaacgtgcaggcggagctggtgcactgccggtgggcgatgctgggcgcggcgggcatcttcatcccggagctcctgaccaagatcggcatcctcaacacgccgtcgtggtacaccgccggggagcaggagtacttcaccgacaccaccaccctcttcatcgtggagctcatcctcatcggctgggccgagggccgccggtgggcagacatcatcaagcccggctgcgtcaacaccgaccccatcttccccaacaacaagctcaccggcaccgacgtcgggtaccccggtggtctgtggtttgacccgctcggctacggcaccggctcgcccgagaagctcaaggagctgcgcaccaaggagatcaagaacggccgcctcgccatgctcgccgtcatgggcgcgtggttccaggccgagtacaccggcaccggccccatcgacaacctcttcgctcacctcgccgaccccggccacgccaccatcttccgggccttcgcccccaagtaaggaacacgttgggagttagcaactaatccgaggagtgtgctaccacggggaagaagatcgctggtggaacttgatttttttttcctgggaagtagaccgtggatgatggtatgtaattgtggagcaatgcatgcttgttggatgtgtacttgtaccctggtgttgtaaccgatgtaaagaatgaatacccttttgaaccttatgttggcatcgtccacgagtctcgcgacgtcgcccaatggtcctaacgttaatggggtcatacaaagaatactttgagaacacgaaatggtaacattacaagagcatctattaccggacttgacaaattcggccccctaaatatctgcggacacacttgggaccaccaagaacagcgtcggacgattcctcatttctcctgccaga

SEQ ID NO: 5771 - DNA, 1102 bp, Glycine max
gtatcacattcacagcctctcttggttgatgacaccaagagacagcacaaagacccttcgtttcaatcccacaacacactcattcctcattcttccactcccgcacaaaaatggcgtctttgcagcaccccacagcttccctccaatccaaacacgtcctaatcccccgaaacactcttacccagaaacccatcctcaacctctcctccctcccgggcaccaccttcacccccctcaagctcaaattcttcagcggcggcgccgtccgccgctccaccggcgcctcgggagccagaatgtcagccaccgcagcctccagctacgcggctgccctggccgacgtggctgccgcgaacaacacgctcgacgcgacaaccgcggacatcgagaaaatcgacgagatattctcggaggcgcaggtgtcggactacttcgccaaccccaccttggccgtggagaagaagcggaagctgatagatgagattgcggaatcttcggggttccagccccacacgagaaacttcctctacatcctcgtggacgcgcagaggatcgacctcatcaacgagatcgcaaaagagttcgaattggtttacaattccttgaccgacacggagctggcggtggtgacgtcggtggtgaagctggagtcgcagcacctggcgcagatcgcgaagcaggttcagaagctcactgggacgaagaacgtgaggattaagacgctacttgaccctagtttggtcgcgggtttcactgtcaggtattccggctccaaattgattgacatgagtgtgagaaagcagcttgaggatattgctgctcagcttgagttgggtgatatctctctcgccgtatgagctttccttccctctctaccttgcgttgctgcgttttctattcggtttcctttcactattatttttggggctaagtataatgtgtatggaatatgaatgaatgaattcgaaaactgtgtacaaccttatataatagcttgctcgcgtttaatattggtttgagctttttctttcttcttccttttcttgatggcaatgagacaccaactatgagcgatcacactttaatttcaaaattttaagag

SEQ ID NO: 5772 - DNA, 1037 bp, Cajanus cajan
ctttgaatcacattcacagcctcttggttaactaacaccaacggaacagaaaagaaaatcaaaagagacaacacaacaaaaacaccctcactttgagttcacaagcgcaacaaatggcgtcgttgcagcacccaacggcttctctccaatccaaacacgccctaatcccccgaaacagcctcgcccagaaacccatcctcaacatctccctccccggcaccaccttcactcctctcaagctcaaattcgcctccttttccttatccgccacccgccgctcccagggcgcctccggggccagaatgtccgccaccgccgcctccagctatgcggctgcccttgcggacgtggcgttctccaacaacaccctcgatgcgaccacctcggacatcgagaaaatcgacgaaatcttcgcggaccccaaggtgtcggactacttcgcggaccccacactggctgtggagcagaagcggaagctggtggacgagattgcagagtcttcagggttccaaccccacaccaggaacttcctctacatcttggtcgatgcccagaggatcgatctcattaacgagatcgccaaggagttcgagttggtctacaacgccttgaccgacaccgagcttgccgtggtcacctccgtggtgaagttggagtcgcagcacttggcgcagattgcgaaacaggttcagaagctcactggggccaaaaacgtcaggattaagaccctccttgaccccgctttggtcgcgggtttcactgtcaggtatgggaattccggctccaagttgattgacatgagcgtcaggaagcagcttgaagacattgctgctcagcttgagttgggtgatatctcactcgctgtatgagttgtaatttctttccatcaatcctttgtgtttctattcaatttcgattactgttacttttttggaggcctatatatgtatcaaatatgaatcgtgaattaatcaatgaatgaatttcaagtgtgtacaaccttataatagcttgtaatgctcctccttataattggg

SEQ ID NO: 5773 - DNA, 1188 bp, Phaseolus coccineus
gctccttaacatcacaaaagaacacaaaaaaaaacgaaacaaaaacaatatcacaacacaatcacattcattcctcactctccgcaaaaaatggcgtccttgcagcatcccacagcttccctccaatccaaacacgtcctaatccccggaaagcccctcgcccagaaacccactcacaccgtctccctgccccgctccaccttctccgccctcaagctcaagctcgccgccgccacccgccgctccaacggcgccgcgggcgcaagaatgtccgccacggcggcctccagctacgcgtcggctctggctgacgtggcgagcgccaacaacactttggacgcgaccacctccgacatcgagaaaatcgacgagctgttctcggacccacgggtgtcggacttcttcgcggaccccacgctggaagtggagaagaagcggcaggtggtggacgagatcgcggagtcctcggggttccaaccccacaccagaaacttcctgtacatcctggtggacgcgcagaggatcgatctcattaatgagatagcgaaggagttcgacctggtgtataacaagttgaccgaaacggagttggcggtggtgacctcggtggtgaagttggagtcccagcacctgacgcaaattgcgaagcaggttcagaagctgactggggccaaaaacgtgaggattaagaccctccttgaccctagtttggtggcgggtttcactgtgaggtacggcaattctggctccaagttgattgacatgagcgtcaggaagcagcttgaagacattgctgctcagcttgagttgagtgatctcacactcgccgtataaccctatcatcttatctttctattccatttcgtttcctattatttttgggctaagtataatgtgtatgtatctatgagatatgatgaacgatttctcaaactctctacaaccttataatactttcctcgcctttatttcttaagcttttttcacgttaattttatctcccaactccactttctgatcacaaatccaatcgcatgcatcattagaccttatccaacaaaccccatgaacgtattgcggaaggaaccataattcaaacattctttcgacctgtatttgaggatttgtttcatcgcaaataagtgcaaataagctgggattagtttattttatgaaaatggtttttac

SEQ ID NO: 5774 - DNA, 1143 bp, Phaseolus coccineus
caatatcacaacacaatcacattcattcctcactctccgcaaaaaatggcgtccttgcagcatcccacagcttccctccaatccaaacacgtcctaatccccggaaagcccctcgcccagaaacccactcacaccgtctccctgccccgctccaccttctccgccctcaagctcaagctcgccgccgccacccgccgctccaacggcgccgcgggcgcaagaatgtccgccacggcggcctccagctacgcgtcggctctggctgacgtggcgagcgccaacaacactttggacgcgaccacctccgacatcgagaaaatcgacgagctgttctcggacccacgggtgtcggacttcttcgcggaccccacgctggaagtggagaagaagcggcaggtggtggacgagatcgcggagtcctcggggttccaaccccacaccagaaacttcctgtacatcctggtggacgcgcagaggatcgatctcattaatgagatagcgaaggagttcgacctggtgtataacaagttgaccgaaacggagttggcggtggtgacctcggtggtgaagttggagtcccagcacctgacgcaaattgcgaagcaggttcagaagctgactggggccaaaaacgtgaggattaagaccctccttgaccctagtttggtggcgggtttcactgtgaggtacggcaattctggctccaagttgattgacatgagcgtcaggaagcagcttgaagacattgctgctcagcttgagttgagtgatctcacactcgccgtataaccctatcatcttatctttctattccatttcgtttcctattatttttgggctaagtataatgtgtatgtatctatgagatatgatgaacgatttctcaaactctctacaaccttataatactttcctcgcctttatttcttaagcttttttcacgttaattttatctcccaactccactttctgatcacaaatccaatcgcatgcatcattagaccttatccaacaaaccccatgaacgtattgcggaaggaaccataattcaaacattctttcgacctgtatttgaggatttgtttcatcgcaaataagtgcaaataagctgggattagtttattttatgaaaatggtttttac

SEQ ID NO: 5775 - DNA, 960 bp, Vigna unguiculata
ccaaaagaaaaagagagatatcacaattcacaacacaatcacgcacattcctcactcaccgcaaaaatggcgtccttgcagcatcccaccgcttcccttcaatccaaacacgttctaatccccggaaagtccctttcccagaaacccgcgctcaccgtctcctttccccgttccactttctccgccctcaagctcaagctcgccgccgccacccgccgctccaacggcgccgcgggcgccagaatgtcggccacggtggcttccagctacgcccaggccctggctgacgtggcgagcggcaacagcacgctggacgccaccgccgccgacatcgagaaaatcagcgagctgttctcggactcgacggtgtcggacttcttcgcggatcccacgctggacgtggagaagaagcggcagctggtggacgatatcgccgagtcctcggcgttccaaccgcacaccagaaacttcctctacatcctggtggacgcgcagaggatcgatctcattaacgagatagcgaaggagttcgaattggtgtataacaagttgaccgacacggagctggcggtggtgacttcggttgtgaagttggagtcccagcacctggcgcaaatcgcgaagcaggttcagaagctgactggggccaaaaacgtgaggatcaagaccctccttgaccctagtttggtggccggtttcactgtgagatacggcaattctggctccaaattgattgacatgagcgtcaggaagcagcttgaggacattgctgctcagcttgagttgagtgatatcacactcgccgtataaccctctctaccttctctatcgtcatatctttttctattccatttcgtttcctattatttttgggctaagtataatgtgtatgtaatctatgagatatgatgaacgatttctcacactctctgcaatcttataatacttacctcgccttta

SEQ ID NO: 5776 - DNA, 1002 bp, Vigna unguiculata
gctccacaccatcacaaaacaaaaaacaaaaccaaaagaaaaagagagatatcacaattcacaacacaatcacgcacattcctcactcaccgcaaaaatggcgtccttgcagcatcccaccgcttcccttcaatccaaacacgttctaatccccggaaagtccctttcccagaaacccgcgctcaccgtctcctttccccgttccactttctccgccctcaagctcaagctcgccgccgccacccgccgctccaacggcgccgcgggcgccagaatgtcggccacggtggcttccagctacgcccaggccctggctgacgtggcgagcggcaacagcacgctggacgccaccgccgccgacatcgagaaaatcagcgagctgttctcggactcgacggtgtcggacttcttcgcggatcccacgctggacgtggagaagaagcggcagctggtggacgatatcgccgagtcctcggcgttccaaccgcacaccagaaacttcctctacatcctggtggacgcgcagaggatcgatctcattaacgagatagcgaaggagttcgaattggtgtataacaagttgaccgacacggagctggcggtggtgacttcggttgtgaagttggagtcccagcacctggcgcaaatcgcgaagcaggttcagaagctgactggggccaaaaacgtgaggatcaagaccctccttgaccctagtttggtggccggtttcactgtgagatacggcaattctggctccaaattgattgacatgagcgtcaggaagcagcttgaggacattgctgctcagcttgagttgagtgatatcacactcgccgtataaccctctctaccttctctatcgtcatatctttttctattccatttcgtttcctattatttttgggctaagtataatgtgtatgtaatctatgagatatgatgaacgatttctcacactctctgcaatcttataatacttacctcgcctttatttcttgaatt

SEQ ID NO: 5777 - DNA, 2201 bp, Glycine max
atgtccatggaagtgcaccaagttgttccaccaccccacaagagcacccttcagaagctccagggtagactcaaggaaactttcttccctgatgatcctctgcgccaattcaagggacaacctcttaagagaaaactgatccttggagcacaatatgtgttccctattcttcaatggggtcctaagtacaacctcaaactcttcaaatctgaccttgtttctggcctcactattgctagcttggccatcccacagggaataagttatgccaagcttgcaagtcttcctccaattgtgggactttattctagttttgttccaccactagtttatgctgttcttggaagctcaaaggaccttgcagttggacctgtttctattgcttctcttgtgatgggatccatgctgaggcaggaagtgtctcccacagcagaccctatcctgtttcttcagctagctttcacttcaacattatttgctggcctctttcaagcttctcttggaatcctaaggctaggcttcataattgattttctatctaaggccattcttattgggttcatggctggtgctgctattattgtgtcactgcaacagctcaagagcctgcttggaatcacacatttcactaatcagatgggtctgattcctgttatgacttctgttttccacaatatacatgagtggtcatggcaaacaatattgatggggatttgtttcctggtgctactgctattagcaagacacgttagcataaagaaaccaaagctattctgggtctcagctggagctcctcttatgtctgtcatcatctctaccctcttggtttttgcaattaaagctcaaaatcatggcatcagtgcgattggaaaattgcaacaaggaataaatcctccatcatggaatatgttgctctttcatggaagtcacctaggcctagttatgaaaacagggcttatcaccgggattttgtccctcactgaaggtattgcagtaggaaggacatttgcagctctcaaaaactacaaagtggatggaaataaggaaatgatggcaattgggtttatgaatgtggttggctccttcacttcctgctatgttacaacaggtgctttctctcgatcagctgttaacaataacgcaggagcaaaaacagctgtgtcgaatgtagtgatgtctgtgacagtcatggtaacactcctttttctcatgccattgtttcaatacacacctaatgtcgtgttgggcgcaatcatagtcacagcagtaattggcctcattgatctccctgctgcttgtaacatttggaagatagacaaattcgatttcgttgtgatgctgactgctttcttaggtgttcttttcatctctgtccagggaggccttgctcttgctgtcgggttatcaactttcaagatactcttgcaaattacgaggccgaaaacagtaatgttggggaagattccaggaacagacatatatagaaatcttgatcaatacaaggaagctgtgagaatacctggatttcttattttaagcattgaggctcccatcaattttgctaacatcacatatctcaacgagagaacgttgcgatggattgaagaagaagaagaagacaacataaaggaacaattaagccttcgattcttagtattggaaatgtcagctgtgagtgctgttgacacaagtggaatctcacttttcaaggagttgaaagcaacactggaaaagaagggtcttgtgttggtcaatcctcttgctgaggtcatagaaaagcttaaaaaagcagatgaagctaatgatttcatacgagcagataaccttttcttaacagttggagaggctgtagcttcactttcatcagcaatgaaaggccaatcatcaaccattacagaagggacacacacaattgtgtcacataattgataaattaagactgcaaaatatataagaaaaggtaaaaaaaaaaagaaaaaagaaatagaagcagcaacaactacaagactagcatagaatttgcctaataccaatcattgtaaaatcctacagtataaacaattaaagtgaaatgtacccttgtgtcatttgtgcttgttcttactggatttgcctcacaggcattgtagtcataacttatatgggaactacttgttgcttgttaattcaatcgttgaagttgatttccaagcacttttcag

SEQ ID NO: 5778 - DNA, 2513 bp, Cajanus cajan
gttgacataggtgagatcttgttttataggcggtcttgcataagagttgattactggggtaggtcatagaggctaacataataaaagggcactattgttcaaagttcaaacctcaagaagctaactaagctacacatacctcaccatttcatatagttctgttcccctcaaatggaggctaatgcttgcactatgcattcccattgcttagaaatgaccatggaagtgcaccaagttgttccaccaccccacaagagtaccctacagaaacttaaggccagactcaaggaaaccttttttcctgatgatcctctgcgccaattcaagggacaacctcttaagagaaagctaatccttggagctcaatatgtgtttcctattcttcaatggggtcctaagtacaaccttaaactctttaaatctgatcttgtttctggtctcactattgctagcttggccatcccacagggaataagttatgctaagcttgcaagtcttcctccaattgtgggactttattctagttttgttcccccacttgtttatgctgttctaggaagctcaaaggacctagcagtaggacctgtttctattgcttctcttgtgttgggatccatgctgagacaagaagtgtctcccacagcagaacctgttctgtttcttcagctagcttttacttcaacgttatttgctggtctctttcaagcttctcttggaatccttaggctaggctttatcattgattttctatctaaggccatccttattggattcatggctggagctgctataattgtctcactgcaacagttaaagagtctgcttggaatcacacatttctcaaatcagatggggctagttcctgtcatgagttctgtttttcacaacatacatgagtggtcatggcaaacaatcttgatggggatttgtttcctgatgctactactattagcgagacacgttagtatcagaaaaccaaaactattctgggtctcagctggagctcctcttgcatctgtcatcatttctactcttctggtttttgcaattaaggctcaaaatcatggcatcagtgtaattggaaaattgcaacaaggaataaatcctccttcatggaatatgttgcttttacatggaagtcacctaggcctagtcatgaaaactgggattatcactggaattttgtccctcactgaaggtattgcagtaggaaggacatttgcagctcttagaaactacaaagttgatggaaataaggaaatgatggcaattggatttatgaatgtggttggctctttcacttcttgctatgttacaacaggtgctttctctcggtcagctgttaataacaatgcaggagcaaaaacagctgtgtcaaatgtagtgatgtctgtgacagtcatggtaacactcctttttctcatgccattgttccaatacacacctaatgtcgtgttgggtgcaattatagtcacagcggtaatcggcctcattgatgtccctgctgcttgtaacatttggaggatagacaaatttgatttccttgtgatgttggttgctttcttgggtgttctttttatctctgtccagggaggccttgctcttgctgtcgggttatcaacttttaagatactcctgcaaattacaaggccgaaaacagtaatgttgggaaagataccaggaacagacatatatagaaatcttcaccaatacaaggaagctgtgagaatacctggttttcttattttaagcatcgaggctcccatcaattttgctaacattacatatctcaatgagagaacattacgatggattgaagaagaggaagacagcataaaggaacaaccaagccttcgatttttaatattggaaatgtcagctgtgagtgccattgacacaagtggaatctcacttttcaaggagttgaaaacaacgctggaaaacaagggtgttgagcttgtgttggtcaatcctctctccgaggtcatagaaaagctgaaaaaggcagatgaagctaatgatttcattcgagtagataatcttttcttgacggttggagaggctgtagcgtcactctcatcagcaatgaagggccaatcatcgaccattacggaagggctacacacaattgtctcatgtaattgataaataaaaactgcagaatatataagcaaaagtaaaaaaacgaaacagaagcagcagcaagacaagcatagaatttgcataaaatcaatcactgtaacatcatatagtttaaacaattaaagtgaaatgtaattttgtcatgtgtggttctgattttcctcgcaagcattgtggtcataacttaaatgggaactacttgttgcttgttaattcaatcgttgaagttgattttcaagcagttttcaactcatctaattcaataaaactacttgcaaagatcatatatttgtaaacatttcttattattgaaggattggaatgtgacttatattgccaatggatgtatcatactaaaaactaaacatttt

SEQ ID NO: 5779 - DNA, 2002 bp, Vigna unguiculata
accctaatgaagtgcagcattctcattgcctagagatgaccatggaactgcaccaggttgttccaccaccccacaagaccactctcaccaaactcaaaaccaggctcaaggaaacctttttccctgatgaccctcttcgtcaattcaagggtcaaccactcaagacaaagctcattcttgcagctcaatatctcttccctattcttcaatggggtcctaagtacaccttcaaactcttcaaatctgatcttgttgctggcctcactattgctagcttggccatccctcagggaatcagttatgctaagcttgcaaatcttcctccgatcgtgggactttattccagctttgttccgccgcttgtttatgctgttcttgggagctcgagggacctagctgtaggacctgtgtcgattgcttctctggtgctgggatcgatgctgagacaggaagtgtctcccacagcagacccggttctgttccttcaactagctttcacttcaacgttttttgctggtctctttcaagcctcacttgggatcctaagactcggtttcataattgattttctgtccaaggccattctgattgggttcatggctggagctgctattattgtctccctgcaacagcttaagagtctgctcggaacctcacatttcactaatcagatgggcctgattcctgtgatgacttctgttttccataatatacacgagtggtcatggcaaacgatactgatggggatttgctttctagtgctactactattagcaagacacgttagcataaaaaagccaaagttattttgggtctcagctggagctcctcttttgtgtgttatcatttccacacttgtagtttttgcaataaaggctcaaaatcatggcattagcgtgattggaaaattgcaacaagggataaatcctccttcatggaacatgctgcgctttcatggaagtcacttaggcctagtcatgaaaacagggcttatcactggcattttgtctctcactgaaggtattgcagtgggaagaacatttgcagctttgaaaaactacaaagtggatggaaacaaggaaatgatggcaattgggtttatgaatgtggttggctcctccacttcctgttacgttacaacaggtgctttctctcggtcagctgttaacaacaacgcaggtgcaaaaacagctgtgtcaaatgtagtgatgtctgtcacagtcatggtgacactcctttttctgatgccattgttccaatacacacccaatgttgtgttgggtgcgatcatagtcactgcagtgattggcctcattgatctccctgctgcttacaacatttggaagatcgacaaattcgatttccttgtcatgttaactgcgttcatgggtgttcttttcatctctgtccaaggaggccttgctcttgctgttgggttatcaactttcaagatattgatgcaaataacaaggccgaaaacagtgatgttgggaaagattccaggaacagacatatacagaaatcttcatcagtacaaggaagctgtgcgagtacctggttttcttattttaagcattgaggctcccatcaattttgctaacataacatatcttaacgagagaacactgcgctgggtggaagaagaggaagacaacataaaagaacaatcaagccttcgattcttgatattggaaatgtctgctgtgagtgccattgatacaagtggaatctcacttttcaaagagttgaaagcaaccttggaaaagaagggtgttgagcttgtgttggtgaatcctctggctgaggtcattgagaagctgaaaaaagttgatgaagcttctgatttcatgcaagcagataaccttttcttgactgttggagaggctgtggcttcactttcaccaacaatgaagggtcaatcaccaacttttcttggaggggcacacacaattgtgtaattgctagatttggaagaggcagaatgtataagccaaagttaaga

SEQ ID NO: 5780 - DNA, 2119 bp, Vigna unguiculata
accctaatgaagtgcagcattctcattgcctagagatgaccatggaactgcaccaggttgttccaccaccccacaagaccactctcaccaaactcaaaaccaggctcaaggaaacctttttccctgatgaccctcttcgtcaattcaagggtcaaccactcaagacaaagctcattcttgcagctcaatatctcttccctattcttcaatggggtcctaagtacaccttcaaactcttcaaatctgatcttgttgctggcctcactattgctagcttggccatccctcagggaatcagttatgctaagcttgcaaatcttcctccgatcgtgggactttattccagctttgttccgccgcttgtttatgctgttcttgggagctcgagggacctagctgtaggacctgtgtcgattgcttctctggtgctgggatcgatgctgagacaggaagtgtctcccacagcagacccggttctgttccttcaactagctttcacttcaacgttttttgctggtctctttcaagcctcacttgggatcctaagactcggtttcataattgattttctgtccaaggccattctgattgggttcatggctggagctgctattattgtctccctgcaacagcttaagagtctgctcggaacctcacatttcactaatcagatgggcctgattcctgtgatgacttctgttttccataatatacacgagtggtcatggcaaacgatactgatggggatttgctttctagtgctactactattagcaagacacgttagcataaaaaagccaaagttattttgggtctcagctggagctcctcttttgtgtgttatcatttccacacttgtagtttttgcaataaaggctcaaaatcatggcattagcgtgattggaaaattgcaacaagggataaatcctccttcatggaacatgctgcgctttcatggaagtcacttaggcctagtcatgaaaacagggcttatcactggcattttgtctctcactgaaggtattgcagtgggaagaacatttgcagctttgaaaaactacaaagtggatggaaacaaggaaatgatggcaattgggtttatgaatgtggttggctcctccacttcctgttacgttacaacaggtgctttctctcggtcagctgttaacaacaacgcaggtgcaaaaacagctgtgtcaaatgtagtgatgtctgtcacagtcatggtgacactcctttttctgatgccattgttccaatacacacccaatgttgtgttgggtgcgatcatagtcactgcagtgattggcctcattgatctccctgctgcttacaacatttggaagatcgacaaattcgatttccttgtcatgttaactgcgttcatgggtgttcttttcatctctgtccaaggaggccttgctcttgctgttgggttatcaactttcaagatattgatgcaaataacaaggccgaaaacagtgatgttgggaaagattccaggaacagacatatacagaaatcttcatcagtacaaggaagctgtgcgagtacctggttttcttattttaagcattgaggctcccatcaattttgctaacataacatatcttaacgagagaacactgcgctgggtggaagaagaggaagacaacataaaagaacaatcaagccttcgattcttgatattggaaatgtctgctgtgagtgccattgatacaagtggaatctcacttttcaaagagttgaaagcaaccttggaaaagaagggtgttgagcttgtgttggtgaatcctctggctgaggtcattgagaagctgaaaaaagttgatgaagcttctgatttcatgcaagcagataaccttttcttgactgttggagaggctgtggcttcactttcaccaacaatgaagggtcaatcaccaacttttcttggaggggcacacacaattgtgtaattgctagatttggaagaggcagaatgtataagccaaagttaagaaaagaaaaaaaaataaaaaatagaagatgtagccacaacaagattttcagagaatttgcgtaaaactggtaattgttaaatatagtttaaacgacaaaattaagatgaatccttgtc

SEQ ID NO: 5781 - DNA, 2287 bp, Phaseolus coccineus
cataaaagccatcattgctcataccataccacataacattcaatatacttctctcttcttttctcttctcttctcttctcttgcaatggatcctaatgctacacagcattctcattgcctagagatggccatggaagtgcaccaagttgttccaccaccccacaagaccaccctgcacaaactcaaggccaggctcaaagaaacctttttccctgatgaccctcttcgccaattcaagggacaaccactcaaaacaaaactcactcttggagctcaatatttcttccctattcttcaatggggtcctaagtacagcctcaaactcttcaagtctgatcttgtttctggcctcactattgctagcttggccatcccacagggaatcagttatgccaagcttgcaaatcttcctccaattgtgggactttattccagttttgttccaccgcttgtttatgctgttcttggaagctcaagggacctagctgtaggacctgtgtctattgcttctcttgtgatgggatcgatgctgagacaggaagtgtctcccacagcagacccagttctgtttcttcaactagcgttttcttcaactttctttgctggtctctttcaagcttcacttggaatcctaaggcttggttttataattgattttctgtctaaggccattctgattgggtttatggctggagcagctattattgtctctctgcagcagcttaagagtctgcttggaatcacagatttcactaatcagatgggcctgattcctgtgatgacttctgtttttcacagtattcatgagtggtcatggcaaacaatactgacggggatttgctttctagtgctactactattagcaagacacgttagcataaaaagaccaaagttattttgggtgtcagctggggctccccttttttgtgtcatcatttccacccttctagtttttgcaattaaggctcaaaatcatggcatcagtgtgattggcaaattgcaacaagggataaatcctccttcatggaatatgttgtgttttcatggaactcacttaggccttgttatgaaaacagggcttattactggcattttgtctctcactgaaggtattgcagtaggaagaacatttgcagctttaaaaaactacaaagtggatggaaacaaggaaatgatggcaattgggtttatgaatatggttggttcctccacttcctgttatgttacaacaggtgctttctctcggtcagctgttaacaacaatgcaggtgcaaaaacagctgtgtcaaatgtagtgatgtctgtgacagtcatggtgacactcctttttctgatgccattgttccaatacacacctaatgttgtgttaggtgcaatcatagtcactgcagtaattggcctcattgatctccctgctgcttataacatttggaagattgacaaattcgatttccttgtgatgttgagtgctttcatgggtgttcttttcatctctgtccaaggaggccttgctcttgctgttgggttatcaactttcaagatactgatgcaaattacaaggccgaaaacagtaatgttggggaagattccaggaacagagatatatagaaatcttcatcagtataaagaagctgtgagagtacctggttttcttattttgagtattgaggctccaatcaattttgctaacatcacatacctcaatgagagaacattacgatggatagaagaagaggaagacaacataaaagaacaatttagccttcgattcttaatactggaaatgtcagctgtgagtgccattgatacaagcggaatctcacttttcaaagagttgaaagcaactttggaaaagaagagtgttgagcttgtgttggtgaatcctctcgccgaggtcattgagaagctgaaaaaagttgatgaagctactgatttcatacaagcagatagccttttcttgacagttggggaggctatagcttcactttcatcaacaatgaaggctcaatcgtcaacctttcatggataaactgtgtaactggtaaattaagacggcagaatatataagccaaagttaagaaaaacaaaatacaaaagatgtagtaacaagaagattttcacagagtttgcgtaaaaccagtcattataaaatcgtagtttaaacaacaaattaagatgaatcgttgtcatttgtgcctttgtttattacttgttgcttattaattcaatagttgaggttgattttcaagcattcaatacattgactcaaaaaaactacttgcgaaaa

SEQ ID NO: 5782 - DNA, 2125 bp, Quercus alba
aaaaaacattccactttctttccaatggaagccaaagctagtaccatgcactctcactgcttggaaatagccatggaagcacacaaggttgtaacaccaccccctatgagcaccttacagaagctgaagatcagactcaaggaaacctttttccctgatgaccctttgcgccaattcaaaggccaaccaacgaagaagaaattaatacttggagctcagtatatctttcctattcttcaatggggtcctaattacagcctcaaactcttcaaatctgacattgttgctggtctcaccattgctagcttagccattccccagggcatcagttatgctaagcttgctaatctgcctcctattgtgggtctatattccagctttgtccctccacttgtgtatgctgttcttgggagttctagggacctagcagtaggacctgtttccattgcttctcttatactaggatccatgcttaggcaagaagtgtctccaagcaatgaccccctcttgtttcttcaactagccttttcttcaaccttctttgctggtctcttccaagcttctttaggattattaaggcttggatttattattgactttctttcgaaagctactcttattggcttcatggctggagctgctatcatagtctctctgcaacagcttaagagcctccttggaatcactaatttcaccaaacaaatgggtttggttcctgttttaagctctgttttccacaacagaaaagagtggtcatggcaaactatagtcatgggattttgcttccttgtcttactattattggcaagacacgtgagcatgaaaaggccaaagctgttctgggtttcagctggagcaccacttgtgtctgtgatcgtctcaactctcctagtctttgcatccaaggctaataatcatggcatcagtgtgattggaaaattacaagaaggattgaacccaccttcatggcacatgttgcacttccatggcagccacctggggctggtaatgaaaaccgggcttgtcactggcattttatccctcactgaaggtattgcagtgggaaggacttttgctgctttaaaggattaccaagtggatggaaataaggagatgatagcaattgggttgatgaatgttgttggctcctctacttcttgctacgttacaacaggtgcattctcaagatcagctgtcaatcacaatgcaggagcaaaaacagcagcctctaacatagtaatgtcagtgacagttatggtgacacttctcctccttatgcctttgttccaatacacaccaaatgttgtactgggtgcaatcatagtctcggcagtagttggtctcattgatatcccagctgcctatcaaatttggaaggttgacaaattcgattttatcgtattgttatgtgcattcttgggtgttattttcatctctgtccaagatggccttgcctttgcggttggactatccattttcaagatcctgctgcaaattacaaggccaaaaatagtgatgttggggaatatacctgggacacacatatatcgaaatctgcaccattacaaggaagctgtaagagtccctggattcctcattttaagcattgaagctcccatcaactttgctaatatcacatatctcaatgaaaggattttgagatggattgaagaatttgaagcagaagaagatagtaaaaaacagtcaagcctccaatttgtgattttggaaatgtcagctgtgagtgctatagacacaagtggagtctctctcttcaaggctttgagaaaagcaatggaaaagaaaggtgttgagcttgtattggtgaatcctctgggtgaggtaatggaaaaactcctgaaggcagatgaagctcaggatttcatgagaccggatagcctttacttgacagttggagaggctatagcttcactctcatcaacaatgaaagatcaatcatcaaccatgtaaaatgaaagggcacatacaaagtattgcttactatgaattacgtgtttgacaagaaaccctgataaaattaatattgcatataaataaagcattatagtttccacatatttaaatggtacatttcatttgcctactggaaaaaaagacacgcgag

SEQ ID NO: 5783 - DNA, 1458 bp, Solanum phureja
  misc_feature (108)..(115): n is a, c, g, or t
gtaaatctctcgtctcggtaactatttaggagaattcaacaaaatggcaactaatgacactgttccgactgtataattggtcggcgggacagacgacggacggcggcnnnnnnnnaccggcgccgccagaggaaattgaccggagataatcagaagccgatagattcgtacaaggcatggctgccaaactgcctttaccaagctgtcccacaatttctaagcatttcagtgctgatcaaacgggatcaagatttaatggagctgtctgccttaggagagctgcacattcattaggcagaatcatgcatttccagctatcttttactaatattatccagccttattctttcagaaatttcaagaggcggtcatggtctataagaagtgctgcagatggcagtggactagattcttctcctacaaccagcggtagcagtggaactcgacttattagggccatagaggctcttctagtcaaactagatgccagaattaaggtgttgagaaaaaacctaccaatgaagttgctgtttttcttagtgggtttctattgtgcaaccgcatttgccactgtaatagggcagacaggtgattgggatattatttcttctggattagctgtggctgtggtagagggcattggagctctcatgtatagatctattcctttaattgatggggtaaggggcatcatcattatgttcaattattggaaaactgggctgactcttggtctattccttgactctttcaagtattaaggcggagatgaggagagaagtgtacagaaatcataatgccattgaaatttcatagtttatcttttgcgtttttgtaggcaaattcatgttatcagagggtaattgatgtctgttgtacagggtctccaatgatacagcatatacgtcacttgtacatgggaggcatccctagtttggtgccacattaataaaatgtatacggaaatatggtttgatctttcagttttatactatcttatttaatcaacatcgtgctcctggatattagcacgatgttaatagagttagataaagcttgtattgattagtgttatacgaataagtttcatcttatgataggaccctttcgtggtaagctttcaattgctctgtttgtacaaatgcttttagaatcaatgacatagagttgaatcttgatggaggtgaggacttgctgtgttcccgctggaatgttaacctatctttagcatgccattctcggaggaactgactctacgtcgagcattaactacaggtcttaatgctcgatatagagcttcgtttattgttatagatcctactgagattagctgaaaattttcgaatgaaagagctttcttaatgttagaatgactagctatagatgaatgttgctagccgcatattggaagttgatgaatgtactactgtctgccttagtgttggttattcttgtgaa

SEQ ID NO: 5784 - DNA, 721 bp, Capsicum annuum
ttatttggcgggagagagtcgactgccggcggtggcttttctcaccggcgccgccgtaggaaattgaccggagaatcagaaagccgatagattccaacaggccatggctgccaaactgcctttaccgagctgtcccacaatttctaagcatttgactgctgatcatactagatcaagatttagtggagctgtctgcctttggagagctgcacattcattaggcagaattttgcatttccagctatcttttactaatattgtccaaccttattcattcagaaatttcaagaggcgggcgtggtctataagaagtgctgcagatggcagcggactagattctaatccttcaaccagcggtagtggtggaactcgacttattagagccattgaggctcttctagccaaactagatgccaggataaaggtgttgaggaaaaatctgccaatgaagttgctgtttttcttagtgggtttctattgcgcaaccgcttttgccactgtaatagggcagacaggtgattgggatattatttctgctggattagctgtggcggtggtggagggtgttggagctctcatgtatagatctattcctttaattgatggagtaaggagcctcatcattatgttcaattattggaaaactgggttgactcttggtctattcctcgactctttcaagtattaaggcggagatgaggagagaagtgtacagaaatca

SEQ ID NO: 5785 - DNA, 775 bp, Capsicum annuum
tcagcatagtagtgtgaaattgatactgttcctacttattattaatttattttggtcgggtagtagtagttcgtacttgtccggtcggttggcttttctcaccggcgccgccgtaggaaattgaccggagaatcagaaagccgatagattccaacaggccatggctgccaaactgcctttaccgagctgtccacaatttctaagcatttgactgctgatcatactagatcaagatttagtggagctgtctgcctttggagagctgcacattcattaggcagaattttgcatttccagctatcttttactaatattgtccaaccttattcattcagaaattcaagaggcgggcgtggtctataagaagtgctgcagatggcagcggactagattctaatccttcaaccagcgtagtggtggaactcgacttattagagccattgaggctcttctagccaaactagatgccaggataaaggtgttgaggaaaaatctgccaatgaagttgctgtttttcttagtgggtttctattgcgcaaccgcttttgccactgtaatagggcagacaggtgattgggatattatttctgctggattagctgtggcggtggtggagggtgttggagctctcatgtatagatctattcctttaattgatggagtaaggagcctcatcattatgttcaattattggaaaactgggttgactcttggtctattcctcgactctttcaagtattaaggcggagatgaggagagaagtgtacagaaatca

SEQ ID NO: 5786 - DNA, 1424 bp, Nicotiana benthamiana
cgctaccgaagcaccagagacactgtttcgactgtaatagtttagtcagcgggaacgagacggccgacggcggctgctctcagcggcgccggggaccaaattgagtggagaatcagaagaccgataccaacaaagtatggccaccaaactgccttttccgtgctttcgaacaacttctaagcatttggttgccgataatactagatcaagacttagtggaactgtttgccttcggagagctgcacattcgctaggcagcatcatgcattttcagctgtccttccttaatattgtacagcgttcttctttcagaaatttcaagaggctggtgtgtataagaagtgctgcggatggcagtggactaaattcttctcctacaaccagcagcagcggtggaactcgacttattagagccatagaagctcttctagtcaaattagatgccagaattaaggtgctgaggaaaaacctaccggtgaagttgctatttttcttagtgggtttctattgtgcaacggcatttgctactgtgatagggcagacaggtgattgggatattatttctgctggattagctgtggctgtggtggagggcatcggagctctcatgtatagagcaattcctttattagatgaggtaaggagcttcatcaccatgatcaattattggaagactgggctgactcttggtcttttcctggactctttcaagtattagagaggagatgaggagagggggtgtgtacagaaatcataatgccattgaaatttcattgtttgttctattggggtggtgtagccacattcattttgtcaaagggtatttatacatcttcttgcaggatgtctgttgtatagtgtccccaatggtatagcatatatgtcacattgtacatgggaggcatctccagtttggtgccactttggtaaaatgtataggaaaagtgatttgattattcagttttaaactgattgttcctcactttgatactttcacaagctgatttaatcaacataatgctctggattgttgctgagcatcggatttttgctcaagcgtgagttatgggttattaggaatgataaggagttgataagacgtatcaattagtgatatacaagcaagttccatttcataggcactttggtacattcctgatctcgtgtttgtccaaatgcttttagaatatatagcatggagttggatcgttgatggaaatgaagagccgtgtttttgttggattgttaaccgacggttagatgccatgcttggaggaaatgattctacttccaatgttttttaaggacacaattacttgtcccaatgctttttaaggacacaattacttttcttcatgcttggtttagtgcttttgtgacaatccggccggtcgtattaagaattaacgcctcgattccctatt

SEQ ID NO: 5787 - DNA, 2026 bp, Solanum phureja
attgtatttatatcaccttctcttcttccttttataccaatctctcttacttttcttctctaactcataaattttcttcttttcaacaaccagaaatggtgagtgtagctactgttgatgcccaaaaagcagaggtattatcttctgtaatttctccgaatcaaaatcaatcttcagaagagctacatgtattcagatcaaaattaccagatatatcaatttccaataacataccactccatgtctacttgttcgaaaggctatcggagtttgaggagcggacttgtcttatagcaggcaacagtggagaaacattcacttttggtgaaacgcatctcatctgccagaaaattgctgctggtttaacgaaggtagggatcaaaaagggagatgttatcatgacttttctacagaactgttcggaatttgtgtttacttttctagcatcttctatgattggagctgttatcactacggctaatccgttctacacgaaatcggaagcgtttaagcagttgaaagcttcgaatgcgaaattaatagttactcaatcgcagtatgtggataaattccgtgatcccgcggaaaatgatccgaaaattggggaagatttttcggtcgttacaattgatgatccgccggagaattgcttgcatttctctgtgctatcggaagctaaagcagaggatatgccaaaaggagttgttatccatcctgacgatcccgtggctcttccgttttcgtcagggaccacggggttgccaaaaggagtgatactgactcataaaagcttgattacaggggtggctcaattagtggatggcgacaacccaaatttttacttgaagcacgacgatgtggtgctatgtgtgcttcctctgtttcatatattcgcgttgaattcagtgcttttagtgtcgttaagagctggagctagtgttctgttgatgcaaaaattcgaaattagtgcgctgttggagctgatacaaaaacaccgtgtctcagtcgctgctgtagttccgcccctggttcttgcattggcgaaaaatccaatggtggattcgttcgatttgagctcgatacggctcgtgatgtccggggctgcgccgctagggaaggagctggaggaagcactccatagaagagtgccccaagccatatttggacagggatatggtatgacagaggcaggaccagtagtaacaatgtgtccagcatttgcaaagcaaccattatcaactaaatccggttcatgtggctctgtggttcgaaatgcggacctcaaggtggttgacccggaaaacggtggctcccttgaccgcaaccaacccggtgaaatttgcattcgtggttcccaaatcatgaaaggttatctgaatgatgatgaggccactgcacggaccatagatgtcgatggatggctccacaccggcgatataggatatgtagatgacgatgatgaaatatacattgtcgatagagtcaaagagctcataaagtttaaaggtttccaggtgccaccagctgagcttgagtctcttctaataagccatccagaaattgcagatgctgctgttgtgccgcaaaaggatggcgctgcaggggaagtcccggttgcatttgtagtccgttcggcccaaggttttgatcttactgaagaagctataaaggaatttatcgccaaacaggtggtattctataaaaaattgcacaaggtgtattttattcacgcgattccgaagtctccatctggaaagatactaaggaaagatttgagagccaaactagccgcgacaccacagtgataatgcactccgtctacgcaaagtccgtaattgtatcgaagatcacttatgctaaaagtctttaacagtattgtatcaaagtcttatatatccaatgactaattctttgaatgttgatttacttcttttttttaaaaaaaattcttcactttttgtgtgaattttctggattctttgaaaggaaaactttcagttttataaattcatgcaccattatttat

SEQ ID NO: 5788 - DNA, 2045 bp, Capsicum annuum
ctctatttcacacacaccctttttcctcttcataaaaaaacatacaattttctatcccaaattacaaaccaaaaaaaaaagaaaagaccaagaaaatggctagtgtagctactgttgaagcccaaaaggcagagatatcatctactgtaattcctccttcaaatcaaaatcaatcatctgaagagctgcatgtatttagatcaagattaccagatatagtcatttctaatgacatcccacttcatgtttacttgtttgaaaagttgtctgagtttcaagaaaggacatgtcttattgctggcaacactggacaaactttcacttttggtgaaactcatttcatctgccagaaaattgctgctggcttaacaaatataggcatcaagaaaggagatgtcatcatgacttttctccagaactgcacggaattcgtgtttacttttctggctgcttctatgattggctctgtcatcactacagctaatccgttctacacaaaatcagaggcctttaagcagttaaaagcctctaatgcaaagttgatcgtcacacaatcacagtacgtggataaattccgcgatcctgttgagaatgatccgaagatcaatgaagattttttggttgtcacaatcgatgatccgccagagaactgtctgcatttctcagtacttgctgaagctaatgcggatgacatgccaaaaggagttgttatccaacctgaggaccccgtggctctcccgttttcgtcagggaccacggggttgccaaaaggcgtgatattaactcacaaaagtttgatcactggtgtggctcaattagtcgatggtgacaaccccaacctttacttgaagcaccaagacgttgtgttgtgcgtgcttcctctgttccacatattcgcgctgaattcggtgcttttggtctctcttagagccggggctagcgtgctgttgatgcaaaaatttgagataggtacgctgctggagctgatacaaaagtatcgagtttcagtcgctgctgtagttccgcccctggttcttgcattggccaaaaatccgatggtggattcgttcgatttgagctcgataaggctcgtgctgtccggggccgcgccgctagggaaagagctggaggaagctctccatcgaagagtcccgcaagccatattcggacagggatatggtatgacagaggcaggaccagtagtaacaatgtgtctatcatttgcaaagcaacctctttcaaccaagtcaggttcatgtgggtctgtggttcgaaatgcggaccttaaggtggtcgaccccgaaaccggtggctcccttgaccgcaaccaacccggtgaaatttgcattcgcggttctcaaatcatgaaaggttatttgaatgatgatgaggctactgcacgaaccattgacgttgatggatggctccacactggcgatataggatatgttgatgacgatgatgaaatatacatcgtcgatagagtcaaagagctcatcaagttcaaaggtttccaggtgccaccagctgagcttgagtcacttctagtaagccatccagatattgcagatgctgctgttgtgccgcaaaaggatgatgctgcaggggaagtgccggttgcatttgtagtccgttcggcccaaggctttgaacttactgaagaagctataaaggaatttattgccaaacaggtggtgttctataagaaattgcacaaggtgtattttattcatgcaattccaaagtctccatctggaaagatactgaggaaagaactgagagccaaactggctgcaactcactcctaattatgcactcttctgtattcaatgactaattatgtgaatgttgttccacttcttcttcttcttcttcattttattttattctctttttgtgtatgtgaagtctctggattctttgaaagtaaaactttctagtttatatattcatgcaccattatttgtcaactctttcatgtacgtcaatttatgtgaactattttcttttttaatttgttggaaaaaaaagaatgttttatttat

SEQ ID NO: 5789 - DNA, 2069 bp, Capsicum annuum
gcacgaggcttatttatttttttcctctatttcacacacaccctttttcctcttcataaaaaaacatacaattttctatcccaaattacaaaccaaaaaaaaaagaaaagaccaagaaaatggctagtgtagctactgttgaagcccaaaaggcagagatatcatctactgtaattcctccttcaaatcaaaatcaatcatctgaagagctgcatgtatttagatcaagattaccagatatagtcatttctaatgacatcccacttcatgtttacttgtttgaaaagttgtctgagtttcaagaaaggacatgtcttattgctggcaacactggacaaactttcacttttggtgaaactcatttcatctgccagaaaattgctgctggcttaacaaatataggcatcaagaaaggagatgtcatcatgacttttctccagaactgcacggaattcgtgtttacttttctggctgcttctatgattggctctgtcatcactacagctaatccgttctacacaaaatcagaggcctttaagcagttaaaagcctctaatgcaaagttgatcgtcacacaatcacagtacgtggataaattccgcgatcctgttgagaatgatccgaagatcaatgaagattttttggttgtcacaatcgatgatccgccagagaactgtctgcatttctcagtacttgctgaagctaatgcggatgacatgccaaaaggagttgttatccaacctgaggaccccgtggctctcccgttttcgtcagggaccacggggttgccaaaaggcgtgatattaactcacaaaagtttgatcactggtgtggctcaattagtcgatggtgacaaccccaacctttacttgaagcaccaagacgttgtgttgtgcgtgcttcctctgttccacatattcgcgctgaattcggtgcttttggtctctcttagagccggggctagcgtgctgttgatgcaaaaatttgagataggtacgctgctggagctgatacaaaagtatcgagtttcagtcgctgctgtagttccgcccctggttcttgcattggccaaaaatccgatggtggattcgttcgatttgagctcgataaggctcgtgctgtccggggccgcgccgctagggaaagagctggaggaagctctccatcgaagagtcccgcaagccatattcggacagggatatggtatgacagaggcaggaccagtagtaacaatgtgtctatcatttgcaaagcaacctctttcaaccaagtcaggttcatgtgggtctgtggttcgaaatgcggaccttaaggtggtcgaccccgaaaccggtggctcccttgaccgcaaccaacccggtgaaatttgcattcgcggttctcaaatcatgaaaggttatttgaatgatgatgaggctactgcacgaaccattgacgttgatggatggctccacactggcgatataggatatgttgatgacgatgatgaaatatacatcgtcgatagagtcaaagagctcatcaagttcaaaggtttccaggtgccaccagctgagcttgagtcacttctagtaagccatccagatattgcagatgctgctgttgtgccgcaaaaggatgatgctgcaggggaagtgccggttgcatttgtagtccgttcggcccaaggctttgaacttactgaagaagctataaaggaatttattgccaaacaggtggtgttctataagaaattgcacaaggtgtattttattcatgcaattccaaagtctccatctggaaagatactgaggaaagaactgagagccaaactggctgcaactcactcctaattatgcactcttctgtattcaatgactaattatgtgaatgttgttccacttcttcttcttcttcttcattttattttattctctttttgtgtatgtgaagtctctggattctttgaaagtaaaactttctagtttatatattcatgcaccattatttgtcaactctttcatgtacgtcaatttatgtgaactattttcttttttaatttgttggaaaaaaaagaatgttttatttat

SEQ ID NO: 5790 - DNA, 2047 bp, Petunia hybrida
tctctctattttcttttctctgtttctcacacacccataagtcataactccagacattttcttttgtacctttttttttttccttttccaatcataaccaagatataggccaaaaaagaaaatgttgagtgttgaagcccagaaggcagagctatcttctccgatacctccttcaaatcaaccttctgaagagttgcatgtttttagatcaagattacctgatatacccattaacaacaccatccctcttcatgtctacttgtttgagaaactctctgagtgtcaagacaggacatgtcttattattggcagcagtgggaaaacatatacttttggtgaaactcatttactttgccaaaaagtagctgctggtttaacaaacattggaatcaagaaaggagatgtgatcatgacattccttcagaattgtgctgaatttgtgtgtacttttattgcagcttctatgattggtgctgttacaactacagctaatccattttaccaaaagcagaggtgtttaagcaattgaaagcttcaaataccaagctgattgtaacacaatctcagtatgtcgataaatttcgtgatcctggagaaaatgatccaatatttggagaagatttttcagttatcacagttgatgatccaccagagaattgcttacatttctctgtactttctgaagcaaatgaagatgatatgccaaagggtgttgttattcaacctgatgatccagtggctttgccattttcatcagggactacagggctacctaaaggtgtggtattaactcacaagagtttaatcacaggggtggctcaagtagttgatggtgacaatccaaatttgtacttaaacatgatgatgtggtgctatgtgtgcttcctttgtttcacatatttgcattgaattcagtccttttagtgtcgttaagagctggggccagtgtgttgttgatgcaaaagtttgagattggtgcacttctggagctgatacagaaacatcgtgtgtcagttgctgctgtggtccacctctggttcttgcgttggcgaaaaatcctacggtagattcgttcgatttgagttcgattaggctcgtgttgtccggggctgcgccactgggaaaggagctggaagaagcacttcatcgaagagttccccaggccatatttggacagggttatggtatgacagaggcaggaccagtagtatcaatgtgcccagcatttgcgaagctgccattttcaaccaaatctggttcatgtggctcagtagttcgaaatgccgacctcaaagtggttgaccctgacaatggtggttcccttggtcgcaaccaacctggcgaaatttgcatccgtggttctcaaatcatgaaaggttatctgcatgatgatgaggccactgcacggaccattgatgtcgatggatggctccataccggcgatataggatatgttgatgacgatgacgaaatctacatcgttgatagagtcaaagaactcataaagttcaaaggctttcaggtgccaccagcagagcttgagtctcttcttgtaagccatccagatattgcagatgctgccgttgtgccgcaaaaggatgatgccgcaggagaagtccctgttgcatttattgtccgatcccccagtggttttgaacttactgaagaagctataaaggattttattgccaaacaggtaattttctataaaagattgcacaaggtgtattttattcattcaattccaaagtctgctgctggaaagatattgaggaaagaactgagagccaaactagcagcgccaccagcttccacccagtgaagacgacctttttgtgcctgcaagggcttaggtccgttttgtgtctgtgtgatgtttattcttatattttttgagacattcccaaaataattttcttgtccaagttgttaatgcactgttatgtgtggattttcatatctaaggactgtgaatgtagctattttttgtcattaaaaaaaaaagaaaagaggaagcaccattgaatggttaaggctattggggttt

SEQ ID NO: 5791 - DNA, 1145 bp, Secale cereale
aaatcatttataagaggcgcggggacgccacgctcccgcattgtctccactcgctccgtccgtcgagaaaccaccaccagcagcgccagcgagaggggaagaggagccgagggccggaggcgatggggctgggcgtgagggcggcgccgttcacgtacgtggcgcacgcgctggccgtggtcgccgccgccatggtgctctactggtgcatccacttccgcggcggcctcgccttcgaagccgccaacaagaacctcatcttcaacgtccatcccgttcttatgttgattggctttattattcttggcagtgaagctataatggtatacaaggtactacctacggtgaaccatgatacaactaagttgatccatctagtgctccatgctattgcgcttgtgcttggcgcggtcgggatatactgtgctttcaagaatcacaatgagactggagttgccaacctttacagtctgcattcttggcttggaataggaacaatttctctatatggtattcagtggatatttggattcttggccttcttcttccctaaggctgcaccaaatgtgaggaagggtgctcttccttggcacatactacttgggatcttcgtttacattttagccctggcaacggcagaacttgggtttctggagaagctcaccttcctccaaagctcaggcctcgacaaatatggaccagagtcatttctggtgaacttcacggcattggttgttgtgctatttggtgcctcggtcgttgtagctgctgttgctccagctcgccttgaagagccacagggttatgctccaatcccggaaaactagtatgtgtgaagtgtactgcatacactgaaattcacaaagtttgctgtcaccatagtgctgcgataccggcatctctccgatttaaaaatgaatgatctgataagaaatggatgatctgataagaaatggtgtgcatcttccttgtgtatatgtaaatacatacgatacaagtacatgttcttccatgtatcatgtataattgaaacatgtatgtaagcagctattttacaaattacatatttgtcttagtataactaaaaaagaaaaaaaaaaactagaaagacgtagaccgaacggacaacgacggagggtatagga

SEQ ID NO: 5792 - DNA, 1257 bp, Brachypodium distachyon
ctttatctttgtaggggaagaggaaatcaacaagagaaaaaaaaaacaaaggaaaaaaaaattacaagaggtgcggggacgccacgctcccgcattgtctccactcgctccttcagtcagtaagccagcagcagcgggagagacacagcgcacgggagaggggaaaaagaacagagggagcgagggaagggaagaagggtcagaggcgatggggctgggcgtgagggcagcgccgttcacttacgtggcgcacgcgcttgccgtggcggcggccgccatggtggtggtctggtgcgtccacttccgcggcggcctcgccttcgaagccagcaacaagaacctcatcttcaacgttcaccctgttcttatgttgattggctatattattcttggcagtgaagctataatggtatacaaggtacttcctacgtggaaccatgatacaaccaagctgatccatctaattctccatggaattgcacttgttcttggtgtggttgggatatactgtgctttcaaatttcacaatgaaagtgggattgccaacctttacagtctgcattcttggcttgggatcggaacaatttgtctatatggtattcagtgggtatttggatttcttgccttcttcttccctggggctgcaccaaatgttaggaggggtgctcttccttggcacattctatttgggatgttcgtttacatcttagccctggctactgcagaacttgggtttctggagaagctcacattcctccaaagttcaggcctcgataaatatggggcagaggcatttttggtgaacttcacggcattggttgttgtgctattcggtgcttctgttgtggtagctgctgttgctccagctcgtcttgaagaaccacagggttatgctccaattccagaaaactagtatatatgaaatggattgcatacatacagaaatttgcaaagtttgatgccaccatagtgccgagatactacgatctcttcaatatacaaatgaataatctgaggaagaatatagttgcgtatcttccttgtgtatatagatacatacaagtacagattgttttctcgtacattacataaaagctggaacttctatgtaagcagtcattttacagatggggtatttctctctacttaatattactctctccgattccacaactttgtactaaatccctgaaacttactattgatcggaggcagtgttagttttcaactctttaacagagtcctgtcacctctgca

SEQ ID NO: 5793 - DNA, 1018 bp, Brachypodium distachyon
gtctccactcgctccttcagtcagtaagccagcagcagcgggagagacacagcgcacgggagaggggaaaaagaacagagggagcgagggaagggaagaagggtcagaggcgatggggctgggcgtgagggcagcgccgttcacttacgtggcgcacgcgcttgccgtggcggcggccgccatggtggtggtctggtgcgtccacttccgcggcggcctcgccttcgaagccagcaacaagaacctcatcttcaacgttcaccctgttcttatgttgattggctatattattcttggcagtgaagctataatggtatacaaggtacttcctacgtggaaccatgatacaaccaagctgatccatctaattctccatggaattgcacttgttcttggtgtggttgggatatactgtgctttcaaatttcacaatgaaagtgggattgccaacctttacagtctgcattcttggcttgggatcggaacaatttgtctatatggtattcagtgggtatttggatttcttgccttcttcttccctggggctgcaccaaatgttaggaggggtgctcttccttggcacattctatttgggatgttcgtttacatcttagccctggctactgcagaacttgggtttctggagaagctcacattcctccaaagttcaggcctcgataaatatggggcagaggcatttttggtgaacttcacggcattggttgttgtgctattcggtgcttctgttgtggtagctgctgttgctccagctcgtcttgaagaaccacagggttatgctccaattccagaaaactagtatatatgaaatggattgcatacatacagaaatttgcaaagtttgatgccaccatagtgccgagatactacgatctcttcaatatacaaatgaataatctgaggaagaatatagttgcgtatcttccttgtgtatatagatacatacaagtacagattgttttctcgtacattacataaaagctggaacttctatgtaagc

SEQ ID NO: 5794 - DNA, 1212 bp, Oryza sativa
tattaattataggaggcgttgggggtgggggacaactacgctccggcattctcttctccactcacccgagacccgccgccggtagcagcggcacggcacagcgcggccgcggcgaagcgaggaggggaaggagacggggcgcgatggggctcggcgtgagggcggcgccgttcacgtacgtggcgcacgcgctggccgtggcggccgccaccatggtgctggtctggtgcatccacttccgcggcggcctcgccttcgaggccacaaacaagaacctcatcttcaacgttcaccctgttcttatgcttattggctatataatcctaggcagtgaagctataatggtatacaaggtccttcctacttggaagcatgatacaactaagctgatccatctaattctccatgcaattgcccttgtattcggtgcggttgggatatactgcgctttcaaatttcacaatgaaagtggaattgccaacctctacagtctgcattcttggcttgggattggaacaatttgtttgtatggtattcagtggatattcgggtttgttgctttcttcttcccccgtgcttcgccaagcgtgaggaagggtgttcttccttggcatatactgtttgggctcttcgtctacattttagccctggccaccgcagaactcggatttcttgagaagctcactttcctccaaagctcagggctcgacaaatatggcgcagaggcatttttggtgaacttcacggctttgattgttgtgctattcggtgcttccgtcgtggttgctgctgtttctcctgctcgcgttgaagaaccgcatgagtatgctccaatccctgaaagttagaacatctgtagtttacaactttacagcatatacaaacacaaccaaagaagtttgttgttgccacagtgagacctggtggctggtgttcatataactccccttgaaacaaagaaagaacatactggacatacaaagaaaggaaatatgcatatttgttgtgtgtgtatttgttatgtggttaatctatattaatatagaaggcgtcggacgtgtcactaccgtccatgccatgttcgtgtaaaggaacatttctagccgtccgagctgatttctctttcgtttcaatccgtgaggggtggcattcctcaaattggccaacaatccttgtgttaatgtgagtaagaaagcatgcgtttgattggag

SEQ ID NO: 5795 - DNA, 1004 bp, Panicum virgatum
cccccctccactcattgcgtcgccgttgccgttggcaagcagcagcatcgcaggaaaggaacaagaggggccagggccgcgaggcgaggagggtgggcaggaaggaagaagagggtcggggagcgatggggctgggcgtgcgggcggcgcccttcacgtacgtggcgcacgcgctggccgtcgcggcggcggtcatggtgctggtctgggccatccacttccgcggagggctcgccatcgaggccaccaacaagaacctcatcttcaacgttcatcctgttcttatgctgattggatatattattatcggcagtgaagctataatggtatacaaggtatttccaacgttgaaacatgacacggctaagcttgtccatctcatcctacatggcatcgcacttgtccttggtgcggttggaatatactttgctttcaaaaatcacaatgaaagtgggattgccaacctttacagtctgcattcttggcttgggatcggaacaattactttgtatggtattcagtggatatttggatttgttacattcttcttccctggtgctgcaccaaacttgaggaggagcctccttccttggcacattctgtttgggctattcgtctacatcttagcactggctaatgcagaactcggctttctggagaagctcacttttctcgagagctcaggcctcgacaaatatggcaccgaggcattcttggtaaacttcacagcattggttgtcgtgttatttggtgcttctgttgtggtagctgctgtagctccggctcgcctggaagaaccacagggttatgctccaatcccagaaaactagtacgaatgatgtgtacagcatatacagtcgacaggattggctgttaccatagggagacaagatattcgtatctctttattaaaataaaaaaggtaccgggaatcgtcacaataagaagataatgcatgttcattgtgtgtgtatatacattctgtgatactcaaaatttcagta

SEQ ID NO: 5796 - DNA, 1191 bp, Setaria italica
gttcgtgccatttataggggacggagcgggggcaccacgctcccgcattcttctccctccactcatcgcgtccccgttgccgttggcacgcagcagcagcgcggggaggccaccgcgtgcagggaacacggaacaaggggccgcgaggaagaggggaaggaagaaaagggtcggggagcgatggcgctgggcgtgcgggcggcgcccttcacgtacgtggcgcacgtgctggccgtcgcggcggcggccatggtgctggtctgggccatccacttccgcggcgggctcgccatcgaggccaccaacaagaacctcatcttcaacgttcatcctgttctcatgctgattggatatattattatcggcagtgaagctataatggtatacaaggcatttccaacgttgaaccatgacacggctaagctgatccatctaattctccatgggattgcgcttgtccttggtgcggttggaatatactttgctttcaaaaatcacaatgaaagtgggatcgccaatctttacagtctgcactcttggattgggatcggaacgattattttatatggtattcagtggatattcggattcgttacattcttcttccctggtgctgcaccaaacttgaggaagagcgtccttccttggcacatactatttgggctctttgtctacatcttagcgctggctaacgcatcactcggctttctggagaagctcactttcctggagagcggaggcctcgacaagtatggtacagaggcattcttggtgaacttcacagcactggttgtcgtgctgtttggtgcttctgtcgtggtagctgctatagctccggctcgcctggaagaaccacagggttatgctccaatcccagaaagttagttcgaatgaagtgtacagaagatacaaatgacaggattgggcattaccatagggatgtgtctcgttattaaaagaagagaaggtactggaattgtcacaataagaagatattgcatcttcattgtgtgtgtatatacattatggtacttcaaactttcagtatattaatatatgcaagactgaatatcctgtttgataaatatactctctctattgttttgctggtctttcttacaaattgtgcttattttggattgtcctggttcagacgcagccattgaaactgcctaacaggaagtgagaaac

SEQ ID NO: 5797 - DNA, 1289 bp, Sorghum bicolor
agaaggggtcgggggtaaaccttacggtcaaatccccatctccacttctccggatccacccagccacgaacaaggacgcctttccggcctcgcagcacgcagcagcttctcatttcttcagccaccaaccaaccacagcacgaaaaggagggaagagaaccgaaacacttctaactcgctccctacctgagacctcagtccctctccctctcataaacgacgacgaggaggccgcacgtactccgcaatatagcttctcagttcacgctctctagtctctcctccaggcctccaccaccggctccagcagcctgagctagtgagctgagcaccgagcacgagctgccagccaccgtacggcccgggcagaagcggatcggaggagcagaagcagagcgagatggggctgggcgtgaaggcgacgccgttcacatacgcggcgcacgcgctggccgcggcggcggcggtgctggtgctggtgtggtgcgtccacttccgcggcggcctcgcgctcgaggcgcagaacaagaacctcatcttcaacgttcaccctgttcttatgctgattggctacattatcctcggcagtgaagccattatgatctacaaggtgtttccaaaactgaaccacgacacagccaagctgacgcacctcatcctccacgccatcgcgaccgtgctcggcgccttcggcatctactgcgcgttcaagtaccacaacgacagcggcatcgccaacctctacagcctgcactcctggctcgggatcggaaccatctctctgtacgccattcagtgggtgttcgggttcgtgaccttcttcttccccggcgcggcgccgagcgtgaggcgcagcgcgctgccctggcacgcgctgttcgggctcttcgtctacgttctggcgctggcgaccgcggagctcgggttcctggagaagctcaccttcctggagagcggggggctcgacaagtacggcgccgaggcgttcctggtcaacttcacggcgctcgtcgtcgtgctcttcggcgcctccgtcgtcgtcgccgcagtcacgccggcgcacgtcgaggaaccgcggggctacgctccaattccgatcaactagagggtataaggagttgctgaaaattcagaagagtgcagcttttgttctgtttgaattaaaccatgacatcaggcgtctggcttaagtctggaaaacgcatccggatctacttcgaagcgaacccgaggtgttcggtctataaatacaacccgatgggtcctctttcctctgcttttccacaaac

SEQ ID NO: 5798 - DNA, 1326 bp, Sorghum bicolor
tggatgagaaggggtcgggggtaaaccttacggtcaaatccccatctccacttctccggatccacccagccacgaacaaggacgcctttccggcctcgcagcacgcagcagcttctcatttcttcagccaccaaccaaccacagcacgaaaaggagggaagagaaccgaaacacttctaactcgctccctacctgagacctcagtccctctccctctcataaacgacgacgaggaggccgcacgtactccgcaatatagcttctcagttcacgctctctagtctctcctccaggcctccaccaccggctccagcagcctgagctagtgagctgagcaccgagcacgagctgccagccaccgtacggcccgggcagaagcggatcggaggagcagaagcagagcgagatggggctgggcgtgaaggcgacgccgttcacatacgcggcgcacgcgctggccgcggcggcggcggtgctggtgctggtgtggtgcgtccacttccgcggcggcctcgcgctcgaggcgcagaacaagaacctcatcttcaacgttcaccctgttcttatgctgattggctacattatcctcggcagtgaagccattatgatctacaaggtgtttccaaaactgaaccacgacacagccaagctgacgcacctcatcctccacgccatcgcgaccgtgctcggcgccttcggcatctactgcgcgttcaagtaccacaacgacagcggcatcgccaacctctacagcctgcactcctggctcgggatcggaaccatctctctgtacgccattcagtgggtgttcgggttcgtgaccttcttcttccccggcgcggcgccgagcgtgaggcgcagcgcgctgccctggcacgcgctgttcgggctcttcgtctacgttctggcgctggcgaccgcggagctcgggttcctggagaagctcaccttcctggagagcggggggctcgacaagtacggcgccgaggcgttcctggtcaacttcacggcgctcgtcgtcgtgctcttcggcgcctccgtcgtcgtcgccgcagtcacgccggcgcacgtcgaggaaccgcggggctacgctccaattccgatcaactagagggtataaggagttgctgaaaattcagaagagtgcagcttttgttctgtttgaattaaaccatgacatcaggcgtctggcttaagtctggaaaacgcatccggatctacttcgaagcgaacccgaggtgttcggtctataaatacaacccgatgggtcctctttcctctgcttttccacaaacgaccccgcgttctgcattacgcacagcggcg

SEQ ID NO: 5799 - DNA, 1072 bp, Saccharum officinarum
agccaccaaccaaccacagcgaaacaacacgaagcaggaggggagagaactgaaacacctctcgctctcgctcacctcagtccctcctctccctctcataaacgacgagcaggccgtacgtactccgcaagcttctcagttcacgctctctagtctctcctccaggctccaccgctccagcagcctgaagctagtgagctgagcacgagctgccaccgtacggccggggcagaagcggatcggatcggaggaggaggagaagaagcagagcgagatggggctgggcgtgaaggcgacgccgttcacgtacgcggcgcacgcgctggccgcggcggcggcggtgctggtgctggtgtggtgcgtccacttccgcggcggcctcgcgctcgaggcgcagaacaagaacctcatcttcaacgttcatcctgttcttatgctgattggctacattatcctcggcagtgaagccattatgatctacaaggtgttcccaaaactgaaccacgacacagccaagctgacgcatctgatcctccatgccatcgcgactgtactcggcgccttcggcatctactgcgcgttcaagtaccacaacgacagcggcatcgccaacctctacagcttgcactcatggctcgggatcggcaccatctctctgtacgccattcagtgggtgttcgggttcgtgaccttcttcttccccggcgcggcgccgagcgtgaggcgcagcgcgctgccctggcacgcgctgttcgggctcttcgtctacgttctggcgctggcgaccgcggagctcgggttcctggagaagctcaccttcctggagagcggggggctcgacaagtacggcgccgaggcgttcctggtcaacttcacggcgctcgtcgtcgtgctgttcggtgcctccgtcgtcgtcgccgcagtcacgccggcgcacgtcgaggaaccgcggggctacgccccaattccggtcagctagaggggagggccgagggcgtcgctgagcattcagaagagtgcagctgtgttctgtttgaaactttaaattgaacccatgacatcaggcgtgtgg

SEQ ID NO: 5800 - DNA, 1178 bp, Panicum virgatum
cctagcatcccaccaaccacagcgaaacagaaggggagggaactagaactcctgttcactctctgtttaaagcacgaggccaccatacgtgctctacacgcttctcaggtctctcaagtctcaactcctgtcgctcgatcgacgagctgtccgtggcgggcggagagcgcgagccgccaccgtacagtccgggagaaggaggcggagggagaggagggaggagagcccgggcgagatggccgcggcctggctgggcgtgaaggcggcgccgttcacgtacgcggcgcacgcgctggcggcggtggcggcggtgctggtgctggtgtggtgcgtccacttccgcggcggcctcgcgctcgaggcccagaacaagaacctcgtcttcaacgttcaccctgtgctgatgctaattggttacattatcctcggcagtgaagccattatgatctacaaggtgttcccaaaactgaaccacgacaccgccaagctgacgcacctgatcctccatgcgattgccactgttcttggcgccttcgggatctactgcgcgttcaagtaccacaacgacagcgggatcgcaaacctctacagccttcactcctggctcgggatcggaaccatctccctgtacggcattcagtgggttttcggattcgtgaccttcttcttccccggcgcggcgccgagcgtgaggcgcagtgcgctgccgtggcacgcgctgctcgggctcttcgtctacgtgctggcgctggtgaccgcggagctcgggttcctggagaagctcaccttcctggagagcgggggggtcgacaagtacggcgccgaggcgttcctggtgaacttcacggcgctcgtcgtcgtgctgttcggcgcctcagtcgtcgtcgccgccgtcacgccggcgcacgttgaggcaccgcagggctacgagtcgattccggtcaactagagaggcgttactgaagggaaagattcagaagagtgccgctgtgttcagtttgaaccatgacatcaggcgtctggcttaagtctggaaaacatccggatttatgtgtaaatctggagtacttgataattggaagcgcatcttttttctttttctttcagtgagataataatttgaacactcttctggtcctcgggtgtactagcaaatgcaataataaccatttccttcc

SEQ ID NO: 5801 - DNA, 1537 bp, Setaria italica
cgggggtaaccttttcggtgaaatccccatctctccacttctccagatccgcccacgaacggagacgccttcccggcctcagcaactgccccccaccaaccacagccaggaaacagaagcggagccctgttctctctgtgtctcccggcccccttctggccttctcataaaggacgaggccgccgtacgtgctccacacgctcctcactcctcaggcctcactcccgtagctcgagctgttcgtggcggacagagagcgtgagccatcaccgcacggcctggaaaggggcagaggaagaagaggaggaggaagaagagcgagatggccagggccgggcttggcgtgaaggcgacgccattcacgtacgcggcgcacgcgctggccgcggtggcggcggtgctggtgctggtgtggtgcgtccacttccgaggcggcctcgcgctcgaggcccccaacaagaacctcatcttcaacgttcaccctgtccttatgctgattggctacattatcctcggcagtgaagccattatgatctacaaggtgttcccaaacctgaaccacgacacagccaagctgacgcacctgatcctccacgccatcgcgactgtcctcggcgccttcgggatctactgcgcgttcaagttccacaacgacagcgggatcgccaatctctacagcctgcactcctggctcgggatcggaaccatctccctctacgggattcagtgggtgttcgggttcgtgaccttcttcttccccggcgcggcgccgagcctgagacgcagcgcgctgccgtggcacgcgctgttcgggctcttcgtctacgtgctggcggtgatgaccgcggagctcgggttcctggagaagctcaccttcctggagagcgggggcctcgacaagtacggcgccgaggcattcctggtgaacttcacggcgctcgtcgtcgtgctgttcggcgcctcggtcgtcgtcgccgccgtcgcgccggcgcacgtcgaggaaccgcagggctacgctccgatccccgtcaactaaagggaacgtttactgaagggaaatattcagaagagtgccgctgtgttcggtttgaagtctgaaccatgccatcaggcttccggcttccggcttcagtctgaaatgacatccggatttatttgtaaatctggagtacttggtatgaacgttcttcttattttctttctttctttctttctttgactgagatgataatttgaacactcttctggtcctcgggtgtagtagcaaatgcaataagacctctctcgttttcatgcactctcgctagaagaaaaaaacgtggacaaaagcatatgggcctggtttagcttcaggttttgacccagagaacttattgggctagtaccagggcgtcacattttgtaggtagccaggctggctgggctggttccaggaccatataattcgaggctggctgagcttggcacgttcaaggaccagaagcttttgtttcgttttcctctcaaaaagaaaagcttctgctccttttgattgctc

SEQ ID NO: 5802 - DNA, 993 bp, Panicum virgatum
cgagctgtccgtggcgggcggagagcgcgagccgccaccgtacggtcgggagagggggcggagggagaggtggaggaggaggagggaggagagcgcgggcgacatggccgcggccgggctgggcgtgaaggcggcgccgttcacgtacgcggcgcacgcgctggccgcggcggcggcggcgctggtgctggtgtggtgcgtccacttccgcggcggcctcgcgctcgaggcccagaacaagaacctcatcttcaacgttcaccctgtgctgatgctgattggatacattatcctcggcagtgaagccattatgatctacaaggtgttcccaaaactgaaccacgacaccgccaagctgacgcacctgatcctccacgccatcgcgactgtgctcggcgccttcgggatctactgcgccttcaagttccacaacgacagtgggatcgccaacctctacagcctgcactcctggctcggcatcgggacgatctccctgtacggcatccagtgggtattcggattcgtgaccttcttcttccccagcgcggcgctgagcgtgaggcgcagcgcactgccgtggcacgcgctgttcgggctcttcgtctacgtgctggcgctggcgaccgcggagctcgggttcctggagaagctcaccttcctggagaccggggggctcgacaagtacggcgccgaggcgttcctggtgaacttcacggcgctcgtcgtcgtgctgttcggcgcctccgtagtcatcgccgccgtcacgccggcgcacgttgaggcaccgcagggctacgagtcgattccggtcaactaaagaggagttactgaagggaaatattcagaagagtgccgctgtgttcagtttgaaccatggcatcagccgactggctaaagtctgaaaaacatccggatttatgtgtaaatctggagtacttgataattggacgcgcattttttttctttttctttcagtgagatgataatttgaac

SEQ ID NO: 5803 - DNA, 1346 bp, Pennisetum glaucum
cgggggtaaccttccagtcaaatcccacatctctccacgtctccagatccgcccaccacgaacagagacgccttcccggcctcagctgaaggcgtgagctgaacttgcttatagcgcctcccccaccaaccacagccaagcagcacggaaacacagggcgagagagagctagccctgttctcatttctgtgtcggcgtcttctgcccccttctcataaaggccgaggccgccgtacgtgctccacacgctcctaactcctctggcggcctctcacccccgtcgctagccgagctgttctgttcgtggcggacagagagcgcgagccgccaacaccaccgtacgaccgggaggagaaggtcaagaagcagaggaggaagaagaagaagagcgagatggccggagccgccgggctgggcgtgaaggcgacgccgttcacgtacgcggcgcacgcgctggccgtgacggcggcggtgctggtgctggtgtggtgcgtccacttccgcggcggcctcgcgctcgaggcccccaacaagaacctcatcttcaacgttcaccctgttcttatgctgattggctacattatcctcggcagtgaagccattatgatctacaaggtgttcccaaacctgaaccacgacacagccaagctgacgcacctgatcctccacgccatcgcgactgtcctcggcgccttcggcatctacttcgcgttcaagttccacaacgacagcgggatcgccaacctctacagcctgcactcctggctcgggatcggaacaatctccctctacgggattcagtgggtgttcggattcgtgaccttcttcttccccggcgcggcgccgagcctgaggcgcagcgcgctgccgtggcacgcgctgttcgggctcttcgtctacgtgctggcgctggtgaccgcggagctcggcttcctggagaagctcaccttcctggagagcgggggcctcgacaagtacggcgccgaggcgttcctggtgaacttcacggccctcgtcgtcgtgctgttcggcgcctcggtcgtcgtcgccgccgtcgcgccggcgcacgtcgaggaaccgcagggatacgccccgatccccgtcaactaaatggagcgatagcgaactaccgaaagggaaaacatttggaagagtgcacgttgtgttcggtttgaagtctgaaccgtcatcaggcctctggcttcagtctggaaggagatcaggatttatgtgtaaatcgagtattgaacgctcttcttattttcttttctttctttgagatgataatttgaacactcttctggtcctgggtcgggtgtgtagcagttagcaacggataaaaaaaa

SEQ ID NO: 5804 - DNA, 1089 bp, Leymus cinereus x Leymus triticoides
caatcctgccgctcacaccccccgaactcatcaaaccctagcgtcaccccatcgagatggacgaccgggacaccacggcggacctgcaggagtgggagctcctcctcgcctcccccaccgccgcggcgcccgggccgtacgccggcggcggggagacggtggaggacgacgccgccggggccatcaagtacgactacttcgaactcggctccgacgccaagtacgccaggagggcgtccctatcggcgggggctgaggaggataaggaggaggtgacggacgaggaggccggcgacgcgagctgggtggagccgcacccgggcgccctcgccttccccgcccgcgaccgcgccgcgctgtggtccgactcgtcgtcggacggggagaggcgtgaggactccgaggcgaccgagccgctggtggagacgccccgggcggcgacggcggccggggcggacgagggggcggtggcgaagggaggtgccgcggcggcggcgcggtggtggaagctgcccgtggaggtgctgcggctgtgggtggctcgcgccgcgaggagcgcgtggtcggtgcccgtcgccgtcgcgctgctcggggtcgccgtgctgggccgccggctgtaccggatgcggcggcagagcaaggccgtggcgcgcgtgcggctcgtccttgacgataagaaggcatctcaattcaaagcccagccgatgttacggcgagctccgatgataaagcctatgcttcctgccaatggagtgaccccatggcctgtgctggggcatctgtgagattgtgagatctgcgacatagaactagaaatacagttggcttgtgagcatactatgcagtcccctgcagatttatatataccctacatgaagtgcgtacttgtggaagaccaatgatgcttaagtgactgactcccctgcatctgggatgtcatttagtacatcttttctgcttgatgtttgtattgaacctatgtgtatatttttcttctgtagcccttttttacctgatgtgcttgaacagtgtggctgtgtatatatgacactaaaagtatccgaatatggttgtagaatggcagtttga

SEQ ID NO: 5805 - DNA, 1047 bp, Hordeum vulgare
ccaagcgctcgcctccaaagcccccaatcctgccgctcacgccccccgaacccgtcaaaccctagcgtcacccccatcgagatggacgcccgggacgccacggcggacctgcaggagtgggagctcctcctcgcctcccccaccgccgctgcgcccgggccgtacgccgtcgccggggagccggtggaggacgacgccgccggggccatcaagcacgactacttcgacctcggctccgacgccaagtacgccaggagggcgtccctgtcgatcggggctgaggaggagggtaaggaggaggggacggacgaggaggccggcgagtcgagctgggtggagccgcacccgggcgccctcgccttccccgcccgcgaccgcgccgcgctctggtccgactcgtcgtccgacggggaaagacgcgaggacgcggaggcgaccgagccgctggtggagactcccctggaagcgccggcggcgggggcggacgagggggcggtggcaaagggaggggccgtggcgcggtggtggaggctccccgtggaggtgctgcggctgtgggcggcgcgcgcggcgaggagcgcgtggtcggtgcccgtcgccgtcgcgctgctcgggatcgccgtgctgggccgccggctgcaccggatgcggcggcagagcaaggccgtggcgcgcgtgcggctcgtccttgacgataagaaggcatctcaattcaaggcccagccgatgttatggcgagctccgatgataaagcctatgcttcctggcaatggagtgaccccatggcctgtgctggggcacctgtgagatgtggaatccgctacatagagctagaaatgcagttggcttgtgagcatactatgcagtcccctgcagatttataccctacctgaagtgcctacttgtggaagacaaaaggatgcttaagtgactcgtttagtactatcttttctgcttgatgcttgtaatgcacccgtgtgtatatttttcttctgtagccctgttttacctgatgtgcttgaacaatgtggctgtgtatatatgaca

SEQ ID NO: 5806 - DNA, 1215 bp, Avena sativa
gggttgcacccgcggaacaaaccacctctccctcacaaccccgcgaatctggctttcccttccccacgcggcacgccacaacacagcgctcaccctgttctccaaaagtcccaatcctttccttccttccttccgctcccacctcccgaacccgaaccctagcgccgcccctcctcgagatggaccgggaggccgcggcggacctgcaggagtgggagctcctcctcgcctcccccacggcgggagccgccgtgccgtacgccgttagcggggaggtggaggacgacgcgggggcgatcaagtacgactacttcgagctcggctccgacgccaagtacaccaggagggcgtccttgtcgatggaggaggaggaggaggtgacggacgaggaggccggcaacgcgggctgggtggagccgcaccccgacgccctcgccttccccgcccgcgaccgcgccgcgctgtggtccgattcgtcgtcggacggggagaggcgcgaggaggccgagccgacccctgccgagccgttggtggagccgccccaggagttggcggcagcggacgagggcgcggtggcaaagggagggccgccggcgccctggtggaagctgccgatggaggtgctgcggctgtgggcggcgcgcgcagcgaggagcgcgtggtccgtgcccgtcgccgtcgcgctgctcgggatcgccgtgctgggccgccgcctgtaccggatgcggcggcagagcaaggccgtggcgcgcgtccggctcgtccttgacgataagaagacgtctcaattcaaggcccaacggatgttacgccgagctccaatgataaagcctttgcttccccccaatggagtgaccccatggcctgtgctggggcacctgtgagttgtgagatctgcgatgtagggctaatacaattgctgggagctacttagcttgtgagcatacgatacattccactcccctacatatttatcgcatacttgaagtgcacatttgtggaagatcgaagaagcttgtgagtcccgctcgtctcggatgtcatttaggactttttacttgatattgtattgtacctgtgtgtatattttccttctgtagccttattttacctgatgtgcttgaacagtgtggctatgtatatatatgacactaaaagtatacagaaatggttgtagaatggcaatttgaaaactgtgctgagcttactttcacc

SEQ ID NO: 5807 - DNA, 3766 bp, Hordeum vulgare
tggggacgacgccgccgcccgcggcaagcaagcggttcgagggttttagacgcgacatccctttttctccgcccgcaaaagagaaagaggggaagacccagagaggaggagcaaggcttccagaaggagaagatcgtcggcgacgagagggagaagggggactcgacctggttcttctccggggagggagagggagagggaagcgagggctggccagttgccgcggcttggggcgaggaggtcaaggtaaaggaggtggccgggttggtgccggctctggtgctcgcctagggtttggaagcttcggctggctcggaggcgccaagtgtaatggccacacagagtgctgttcggttaattggagggggaggggctggtggctggactaaggatttcggagcattcgactctccactgggaaatcttcctggagaagggctggggtttgtggagagtggcagtgggatttatgggggctggggggagtctgtcccaaatcgaagtggaagcgcgcctcctagcatggagggatctcttgctgctcttggtaatcttataggccagaagagtggaaacttcgacgccagtttaggtaacttggacaatgtgattggaagttccacggccgaggagcagttacgtgctgatcctgcatacttcgactattatggttccaaggtgaatttgaacccaaggcttcctcctccactaatctcaagggagagtcgccgcttcatgaaccgagttggcaaggttaaagaatggagagtggtttcccaggatgacagcaataaaggctccttatttatacctcgatctactctatcaactcacaaggaagaacctgaagatgataagtctccaaggttggattcaagttctgcagatgatgaacagatgaatcttgtggattttgtgccagagagctttcagcagaaccccggttctttgtatgacaactcttcttcacatccatcaagtagcagtattggtgatggtgtagctgtccattctaatattgactcatcaaggaatttgccacatgatgttgtcaagccatcagggttgaattcgtggacacctgtacctttggccagtggactgataagtacacatagtagcaatctctcatctacatatgctcccagttcatcatgttctgataataaccctagtgtacaaatttctgagcaacagcaagaaaagcagagcataggcacggagcctggaattgatatgccgatcagtgaggtggttgttactgagcttgatgttgtggactcaagtatgaagaatttgaagttaagtttggatagccagactacgccacaagttaagcagcagtggcagggcaatttcttgcagcagtatgacttctcacctctagtccaaggtgaccatatgccaatgactcctcacggagcacatcttccccatgttccttttgttgacaacttgcctcatactcagctaaaactacccactggtgacatgccgcagcttttacctcaacttggtatgccgacacccttttatacaccaaattcttttggaagcccatattatcagaatttgcatccagccagtgtattggcaactccgtatgtgactggtgggtatgctttgggtggttcaggtttcccacccgttatgactagctattctccccagagttctgctgcgacacctctcgacagccctatgactccaagctttagtggtaggccatctggttttcattcagcagggaattttactgcaggaaccgaacttgttcagccatacaaaatgtacgggcaacttggggttcccatgcagccacccattcccgatccaaacttttttcagttctttcagcatccctcttttccacagtatgccagtggaaatcaatacaatacattggctccaaggggtagtgtttttggaaatgttactgataattttgatccacacaagttatttcctcaagctcaatatccgtctgatcagaggcttcaacttccaaaaactggaatttctaattctcctacaacgctaagaggaggaactgttccaaattatcatggcatatcaccctatgttggagcgccgttgacttatccgacaagcccagtgtttcaggggcaacctttctctggaatttccccctctggccgaaatgatcctgcaaggtttcagccagcctcgagaaatatgactgctgtttctgggtttcaagggcagcgagaaagggagaaatttgatagcccgaaggcatgcactttcctggaagaacttaagtccaacagagcacgtagggttgagctatctgatatcacaggtcgtatagtagatttcagcgctgaccaacatggtagccgtttcatccagcagaagttggaaaactgcactgccgaagagaaggcggccgtgtttgcagaagttcttcctcatgcttcatctttaatgactgatgtgtttgggaattatgtgatccaaaagttttttgaacatggaactcctgagcaaagaagggatcttgctgccaagcttgctggtcatgttgtacctttgagccttcagatgtatggatgccgagtaattcaaaaggctcttgaagttatggaacttgaccagaaaatagatctggtccgcgagcttgatggaaatattatgcgatgtgttcgtgaccaaaatgggaatcatgttatacagaagtgcatagaatgtgttcccacggaacatattggtttcgtagtatctgcttttcggggacaagttgctagcctttcaatgcatccatatggttgccgtgttattcagagagttctggagcattgtggtggtgattcacgaggtcagtgcataatagatgaaatattgcagtccgcttgcatcctcgcacaagaccagtatggcaactatgtcacacagcatgttgtggaaaaaggaaaaagtcatgaaagggctcaaataatcagtaaattggctgggcaggttgtcaccatgagccaaaataaatttgcatcaaatgtgatagagaagtgttttcaacatggagatattgcagaacgagatcttctaatcagagagattgtggagcagactgacggaaacgataccttgctggcaatgatgaaggatcagtacgctaattatgttgttcagaagatacttgaaacatgcaacgatgagcagcgggaacttctggtcagccgtgtaaagggtcacttgcaagcactgaggaagtacacctatggcaaacatatcgcgagccgggtcgagcagctttgcggtgaaggagatgccgagtgcgactcctaggggacgggaggtgcctcaacgctcgcccgattcatcgtcaaggaagaaatcaacgcccgcccaattcataggcaacgaagaaatcataacttggaaccgtggtgcttcaaagtgctaacaaaacttggaactccagcaaggaagattgtacatatgtgactgtaggcagtgtaggaggtgctaggcacaaggtttcttctgtgcgcatcagtgtatctatgttagggtgtgcttgtccacactgtactactgtagttggtagccgtgtgcaaaatatgtatagtagtagtggtttggcttgtgtgtgtgatacatatatgtttttcgaaaaggattgactgcttggtaatgtaattgcttgcttgcttgcttaaatctccagttatgtaataaaacatcgtccattcattggattgactgaagagaaaatggcttgtgatttattacaggttacagagca

SEQ ID NO: 5808 - DNA, 3655 bp, Secale cereale
acgagagggagaaggggggggactcgagctggttcttctccggggagcgagggagagggaagcgaggcctggccagctgccgcggcttggggccgaggcgggagaggggaaggaggaggccgggttggtgctggcgctggtgctcgcctagggtttggaagcttcggctgcctcggaggcgtcaagtgtaatggccacacagagtgctgttcggttaattggagggggaggggctggtggctggactaaggatttcggagcatttgactctccactgggaaatcttccaggagaaggcctggggtttgtggagaatggcagtgggatttatgggggctggggggaatctgtcccaaatcgaagtggaagtgcacctcctagcatggagggatctctggctgctcttggtaatcttataggtcagcggagtggaaacttcgacgccagtttaggtaacttggacaatgtgactggcagttccacggctgaggagcagttacgtgctgatcctgcatactttgactattatggttccaaggtgaatttgaacccaaggcttcctcctccactaatctcaagggagagtcgccgcttcatgaaccgagttggcaaggttaaagaatggagagtggtttcccaagatgacagtaataaaggctccttatttatacctcgatctactctatcaactcacaaggaagaacctgaagacgataagtctccaaggttggattcaagttctgcagatgatgaacagatgaatcttgtggattttgtgccggagagctttcagcagaaccccgattcattgtatagctcttcacatctatcaagtagcagtattggtgatggtgtagctgtccatcctaatattgactcatcaaggaatttgtcacatgatgttgtcaagccgtcagggttgaattcgtggacacctgtacctttggccagtgtactgagaagtacacttagcaacaatctttcatctacatctgttcccagttcatcatgttctgataataaccctagtatacaactttctgagcaacagcaagaaaagcagagcatagacatgaagcctggaaatgatgtgcctgtcagtggggcagttgttactgaacttgatgttgtggactcaagcatgaagaatttgaagttaagtttggatagccagactacaccacaagttaagcagcagtggcagggcaatttcttgcagcagtatggcttctcacctctagtccagggcgagcatatgccaatgactcctcatggagcacatctgccccatgttccttttgttgacaatgtgtctcatactcagctaaaactacccactggtgacatgcagcaacttttacctcaacttggtatgccaacacccttttatgcaccgaattcttttggaagcccatattatcagaatttgcatccagccagtgtattggcaaatccttatgtgactgctgggtatgctttgggtggttcaggtttcccacccgttatgactagctattctccccagagttctgctacgacacctcttgacagccctatgactccaagctttagtggtaggccatctggttttccttcagcagggaatcttactgcaggaaccgagtttgtccagccatataaaatgtatgggcaacttggggttcccatgcagccacccattcccgacccgaacttttttcagttctttcagcatccctcttttccacagtatgctagtggaaatcaatacaatacattggctccaaggggaagtgttttttggaaatgtcgccgataattttgatccacgcaagttatttcctcaagctcaatatccgtctgatcagaggcttcagcttcccaaaactggaatttccagttctcctacaaccctaagaggaggaactgttccaaattatcatggcatttcaccctatgttggagcgccattgacttatccaacaagcccagtgtttcaggggcaacctttctctggaatgtccccctctggtagaaatgattccgcgaggtttcagtccgcctcaagaagtatgactgctgtttctgggtttcaaggacagcgagaaagggagaaatttgatgacccgaaggcatgcactttcctggaagaactgaagtccaacagagcacgtagggttgagctatctgatatcacaggtcgcatagtagatttcagcgctgaccaacatggtagccgtttcatccagcagaaattggaaaactgcactgctgaagagaaggcagctgtgtttgcagaagttcttcctcatgcttcatctttaatgactgatgtgttcgggaattatgtgatccaaaagtttttgaacatggaactcctgagcaaagaagggatcttgccgccaagcttgctggtcatgttgtacctttgagccttcagatgtatggatgccgagtaattcaaaaggctctggaagttatggaacttgaccagaaaatagatctggtccgcgagcttgatggaaatattatgcgatgtgttcgtgaccaaaatggaagtcatgttatacagaagtgcatagagtgtgtcccacggaacatattggttttgtggtatctgcttttcggggtacgaagttgctagcctttcaatgcatccatatggttgccgtgttattcaggtgagttcagactgctcgatatgaatttgctacttgatcctggcacagacattctttctcccttcaacccatatccttctctgcagagagttttggagcattgtggtggtgattcacgaggtcagtgcataatagatgaaatattgcagtccgcttgcatcctcgcacaagaccagtatggcaactatgtcacacagcatgttgtggaaaaaggaaaaagtcatgaaagggctcaaattatcagtaagttggctgggcaggttgtcaccatgagccaaaataaatttgcatcaaatgtgatagagaagtgtttccaacatggagatattgcggaacgggatcttctaatcagagagattgtggaacagactgacggaaatgataccttgctggcaatgatgaaggatcagtatgctaattatgttgttcagaagatacttgaaacatgcaacgatgagcagcgggaactactggtcagccgtgtaaagggtcacttgcaagcactgaggaagtacacctatggcaagcatatcgcgagccgagtcgagcagctttgcggtgaaggagatgtcgagtgcgactcctaggccacgggagcgcctcaacacccgccaaattcatcagcaagaaagaaaccataacttggaaccgcggtacttcaaagtgctaacagaacttggaactccagcaagaaagattgtacatatgtgactttgtttaggcagtgtagggaggtgctaggcacaaggtttattctgtgcgcgccagtgtatctatgttagggtgtgcttatccacactgtactagttggtgtccgtgtgcaaaatatgtatagtggctgtggtttggcttgtatgtgtgatacatgtgtgtatgtcgactgcttggtaatgtaattgcttgcttgtttaaaatctccagttgtgtggtaaacatcgtacattcattggattaaccgaggagaaactggcttgtgctttattgcaaaaaaagtc

SEQ ID NO: 5809 - DNA, 3240 bp, Triticum aestivum
tctgtcccaaatcgaagtggaagcgcacctcctagcatggagggatctctggctgctcttggtaatcttataggtcagcggagtggaaacttcgacaccagtttaggtaacttggacaatgtgactggcagttccacggctgaggagcagttacgtgctgatcctgcatactttgactattatggttccaaggtgaatttgaacccaaggcttcctcctccactaatctcaagggagagtcgccgcttcatgaaccgagttggcaaggttaaagaatggagagtggtttcccaggatgacagcaataaaggctccttatttatgcctcgatctactctatcaactcacaaggaagaacctgaagatgataggtctccaaggttggattcaagttctgcagatgatgaacagatgaatcttgtggattttgtgccggagagcttccagcagaaccccgattcgttgtatgataactcttcacatctatcaagtagcagtattggtgatggtgtagctgtccattctaatattgactcatcaaggaatttgccacatgatgttgtcaagccatcagggttaaattcgtggacacctgtacctttggccagtgtactgagaagtacacttagcaacaatctttcatctacatctgttcccagttcatcatgttctgataataaccctagtgtacaaatttctgagcaacagcaagaaaagcagagcatagacatgaagcctggaaatgatgtgcctgtcagtggggcagttgttactgaacttgatgttgtggactctagcatgaagaatttgaagttaagtttggatagcccgactacgtcacaagttaagcagcagtggcagggcaatttcttgcagcagtatggcttctcacctctagtccaaggcgaccatatggcaatgactcctcatggagcacatctgccccatgttccttttgttgacaacatgtctcatactcagctaaaactacccactggtgacatgcagcaacttttacctcaacttggtatgccaacacccttttatacaccgaattcttttggaagcccatattatcagaatttgcatccagccagtgtattggcaaatccttatgtgacttctgggtatgctttgggtggttcaagtttcccacccgttatgactagttattctccccagagttctgctgcgacacctctcgacagtcctatgactccaagctttagtggtaggccatctggttttccttcagcagggaatcttactgtaggaaccgagtttgttcagccatataaaatgtatgggcaacttggggttcccatgcagccacccattcccgacccgaacttttttcagttctttcagcatccctcttttccacagtatgctagtggaaatcaatacaatacattggctccaaggggtagtgtttttggaaatgttgctgataattttgatccacgtaagttatttcctcaagctcaatatccatctgatcagaggcttcaacttccaaaaactggaatttttaattctcctacaaccctaagaggaggaactgttccaaattatcatggcatttcaccctatgttggagcgccattgacttatccaacaagcccagtgtttcaggggcaacctttctctggaatttccccctctggtagaaatgattctgcgaggtttcagtccgcctcaagaagtatgactgctgtttctgggtttcaagggcagcgagaaagggagaaatttgataacccgaaggcatgcactttcctggaagaactgaagtccaacagagcacgtagggttgagctatctgatatcacaggtcgcatagtagatttcagcgctgaccaacatggtagccgtttcatccagcagaaattggaaaactgcactgctgaagagaaggcagccgtgtttgcagaagttcttcctcatgcttcatctttaatgactgatgtgttcgggaattatgtgatccaaaagttttttgaacatggaactcctgagcaaagaagggatcttgccgccaagcttgctggtcatgttgtacctttgagccttcagatgtatggatgccgagtaattcaaaaggctctggaagttatggaacttgaccagaaaatagatctggtccgcgagcttgatggaaatattatgcgatgtgttcgtgaccaaaatgggaatcatgttatacagaagtgcatagagtgtgtccccacggaacatattggttttgtagtatctgcttttcggggacaagttgctagcctttcaatgcatccatatggttgccgtgttattcagagagttttggagcattgtggtggtgattcacgaggtcagtgcataatagatgaaatattgcagtccgcttgcatcctcgcacaagaccagtatggcaactatgtcacacagcatgttgtggaaaaaggaaaaagtcatgaaagggctcaaattatcagtaagttggctgggcaggttgtcaccatgagccaaaataaatttgcatcaaatgtgatagagaagtgtttccaacatggagatattgcggaacgagatcttctaatcagagagattgtggagcagactgacggaaatgataccttgctggcaatgatgaaggatcagtatgctaattatgttgttcagaagatacttgaaacatgcaacgatgagcagcgggaacttctggtcagccgtgtaaagggtcacttgcaagcactgaggaagtacacctatggcaaacataccgcgagccgagtcgagcagctttgcggtgaaggagatgccgagtgcgactcctaggcattggaggcgcctcaacccccgccaaattcatcagcaaggaagaaagcataacttggaaccgcggtgcttcaaagtgctaacaaaacatggaactccagcaaggaagattgtacatacgtgactttgcttaggcagtgtagggaggtgctaggcacaaggtttattctgtgcgcaccagtgtatctatgttaagagtgtggatatgttagggtgtgcttatccacactgtactagtagttggtagccgtgtgcaaaatatgtatagttccagtggtttggcttgtatgtgtgatacatgtgtgtatcttgactgcttggtaatgtaatggcttggttgcttgcttaaatctccagttgtgtggtaaaacatcatccattcactggattgaatgagaagaaaatggcctgtgatttattgca

SEQ ID NO: 5810 - DNA, 3571 bp, Brachypodium distachyon
atggcagcgacaaagagagggaggaaaaaggcaggagaagagatgggtgtgatcggcgttgttgtcacccggatctgtgacatggtgcacggatctacaacggcttgctgcggcgcttatacttgcatcaattgtaattttgtaatggctacacagagtgctgtccggttaattggggggacaggggctagtagccggagtaaggattttggcgcatatgactcttcactgggcatgggcaatatttcaggagaagggctggggtttgtggataatggcagtggggtttatgggggctggagggagtctggcccaaatcgcagtggaagcgcaccgcctagcatggaaggatctctggctgctcttggtaatcttataggccagcagagtgggaactttgatgccagtttagctaacatagacaatgtgacagacagttctaaatctgaggagcagctacgtgctgatcctgcatactttgactattatggttccaaggtgaacttgaacccgaggcttcctcctccactgatctcgagggagagtcgtcgtttcatgaaccgggttggcaaggttaaagaatggagagtggtttcccaagatgacagcaacaaaggctccttgtttatacctcgatctactctacctactcacagagaagaacctgaggaggataggtctccaaggttggattcaaattccacggatgatgcccagatgaatcttgcagattttgtgccggagagctttcagcagaacatcagttctttgtatgataactcttcttcgcagccatcaagtagcaatattggtgatgctgtagctgtccattctaacaaaaactcaccaaagaatttctcacatgatgtcaagccatcagggttaaattcgtggacccctgtacctgtggccagtggactaagaagtacaattagcaacagtctgtcacctacatcagctaccaattcatcatgttctgataacaacaccggtaggcaaacttctccgcaggaaaagcggggcatagacatgaagcctgtaaataatgctcctggcagtggtgcagttgttactgaacttgataccttggactccaatatgaagaatttgaagttaagtttggatagccatacccctattgcgtcacatgttaagcagcagtggcaggataatttattgctgcagtatggctctgcacctttaatccaaggtgaccatattcaaatgactcctaatggaacacatcttcctcatggtccttttgttgacaacttgtctcaaactcatttaaaattatccaatgctgacatgcagcagtttctaccgcaacctggtatgacagcacccttttatgcaccaaattcttttggaagcccctattacccaaatttgcatccagccagtctattgccaggtccgtttgggactgctggatatgccttgggtggttcagctttgccacctgttatgacaagctattctccccagggttctgttgcaacacctctcgacagccctatcactccaacctttagtggtaggccatctggttttccctccgcagggacagaatttgttcagccatataaaatgtacgggcaacttggagttgccatgcagccaccgattcccgacccaaacttttttcatttctttcagcatccctcttttccacagtatgccggtggaaatcagttcaatacattgggtccaaggggtagtgtttttggaaatgtcgctgataattttgatccacaaaagatatctcctcaagctcaatatccatctgatcagagggttcaacttccaagaaccggaattcccaattctcctacagccagaagaggagcgacttttccaaattatcacagctttccaccctatgttggggcaccattgacttatccaacaagcccggtgtttccagggatttccccctctggtagtagaaatgattctgtgaggtttcaatccccttcaagaaatatgactgctagttctggaattcaagggcagcgagacagagagaaatttgatggcccaaaggcatgctcgttcctggaagaactgaagtccaacagggcacgtagggttgagctatctgatattacaagtcgtatagtggaatacagcgctgaccaacatggtagccgattcatccagcagaagttggagaactgtactgcggaagagaaggcagcggtgtttgcagaagttcttcctcatgctacatcattaatgaccgatgtgtttggcaattatgtgatacaaaagttttttgaacatggaactcctgagcaaaggagggatcttggcactaagcttgtcggtcatgttctacctttgagccttcagatgtatggatgccgagtagttcaaaaggctcttgaagtattggaacttgaccagaaaatagaattagtccttgagcttgatggcaatattatgcgatgtgttcgtgatcaaaatgggaatcatgttatacagaagtgcattgaatgtgtccccacagaacatattggttttgtagtatcttctttccagggacaagttgctagcctttcaatgcacccatatggttgccgtgttattcagagagttttggaacattgcggtggtgattcacaagggcagtgcataatagatgaaatattgcagtctgcttgcgtccttgcacaagatcagtatggcaactatgttacacagcatgttttggagaagggaaaaagtcatgaaagggcccaaattatcagtaaattggctgggcaagttgtcaccatgagccaaaataaatttgcatcgaatgtgatagagaagtgttttcaacatggggattttgcggaacgggatcttctcatcagggagatagtgcagcagactgagggaaatgataccttgctggcaatgatgaaggatcagtatgctaattatgtggttcagaagatacttgaaacatgcaacgatcaacagcgggaacttctggtcagccgtgtcaagggtcatctgcaagcattgaggaagtacacttatggcaaacacatcgcgagccgtgtcgagcagctttgtggtgaaggaggtgcggagtccgactcttagatgactggcaaattctttgcaggagcggtgtgccttgacacctgcccagcgccgtcatcaaggaagaaagcagaacttgtgactccaatgcatctcgaagcgctaaacttcccccttagattgtacataagtgactttctttaagtagtctaggaggtgataggcacaaggctttagcagtgtgcatcatcagtgtatctattgttagggtgtgcttattttacagaatcatcatctaatactgtcctagttgtctagttggtagctgtgtgcaaaaaatatgtctagtggtttggcttggcttgtatgcgatacatatatgtttgactgcttggtaatgtaattgcttgcttgcatcttggctatgtggtaaaatctcgtccattcatgtgagattaaagagaagatgggtctcagaattattgtaagtcacagtaattagttgtaagaaccttgatgcaggagatgttattac

SEQ ID NO: 5811 - DNA, 3485 bp, Brachypodium distachyon
atggcagcgacaaagagagggaggaaaaaggcaggagaagagatgggtgtgatcggcgttgttgtcacccggatctgtgacatggtgcacggatctacaacggcttgctgcggcgcttatacttgcatcaattgtaattttgtaatggctacacagagtgctgtccggttaattggggggacaggggctagtagccggagtaaggattttggcgcatatgactcttcactgggcatgggcaatatttcaggagaagggctggggtttgtggataatggcagtggggtttatgggggctggagggagtctggcccaaatcgcagtggaagcgcaccgcctagcatggaaggatctctggctgctcttggtaatcttataggccagcagagtgggaactttgatgccagtttagctaacatagacaatgtgacagacagttctaaatctgaggagcagctacgtgctgatcctgcatactttgactattatggttccaaggtgaacttgaacccgaggcttcctcctccactgatctcgagggagagtcgtcgtttcatgaaccgggttggcaaggttaaagaatggagagtggtttcccaagatgacagcaacaaaggctccttgtttatacctcgatctactctacctactcacagagaagaacctgaggaggataggtctccaaggttggattcaaattccacggatgatgcccagatgaatcttgcagattttgtgccggagagctttcagcagaacatcagttctttgtatgataactcttcttcgcagccatcaagtagcaatattggtgatgctgtagctgtccattctaacaaaaactcaccaaagaatttctcacatgatgtcaagccatcagggttaaattcgtggacccctgtacctgtggccagtggactaagaagtacaattagcaacagtctgtcacctacatcagctaccaattcatcatgttctgataacaacaccggtaggcaaacttctccgcaggaaaagcggggcatagacatgaagcctgtaaataatgctcctggcagtggtgcagttgttactgaacttgataccttggactccaatatgaagaatttgaagttaagtttggatagccatacccctattgcgtcacatgttaagcagcagtggcaggataatttattgctgcagtatggctctgcacctttaatccaaggtgaccatattcaaatgactcctaatggaacacatcttcctcatggtccttttgttgacaacttgtctcaaactcatttaaaattatccaatgctgacatgcagcagtttctaccgcaacctggtatgacagcacccttttatgcaccaaattcttttggaagcccctattacccaaatttgcatccagccagtctattgccaggtccgtttgggactgctggatatgccttgggtggttcagctttgccacctgttatgacaagctattctccccagggttctgttgcaacacctctcgacagccctatcactccaacctttagtggtaggccatctggttttccctccgcagggacagaatttgttcagccatataaaatgtacgggcaacttggagttgccatgcagccaccgattcccgacccaaacttttttcatttctttcagcatccctcttttccacagtatgccggtggaaatcagttcaatacattgggtccaaggggtagtgtttttggaaatgtcgctgataattttgatccacaaaagatatctcctcaagctcaatatccatctgatcagagggttcaacttccaagaaccggaattcccaattctcctacagccagaagaggagcgacttttccaaattatcacagctttccaccctatgttggggcaccattgacttatccaacaagcccggtgtttccagggatttccccctctggtagtagaaatgattctgtgaggtttcaatccccttcaagaaatatgactgctagttctggaattcaagggcagcgagacagagagaaatttgatggcccaaaggcatgctcgttcctggaagaactgaagtccaacagggcacgtagggttgagctatctgatattacaagtcgtatagtggaatacagcgctgaccaacatggtagccgattcatccagcagaagttggagaactgtactgcggaagagaaggcagcggtgtttgcagaagttcttcctcatgctacatcattaatgaccgatgtgtttggcaattatgtgatacaaaagttttttgaacatggaactcctgagcaaaggagggatcttggcactaagcttgtcggtcatgttctacctttgagccttcagatgtatggatgccgagtagttcaaaaggctcttgaagtattggaacttgaccagaaaatagaattagtccttgagcttgatggcaatattatgcgatgtgttcgtgatcaaaatgggaatcatgttatacagaagtgcattgaatgtgtccccacagaacatattggttttgtagtatcttctttccagggacaagttgctagcctttcaatgcacccatatggttgccgtgttattcagagagttttggaacattgcggtggtgattcacaagggcagtgcataatagatgaaatattgcagtctgcttgcgtccttgcacaagatcagtatggcaactatgttacacagcatgttttggagaagggaaaaagtcatgaaagggcccaaattatcagtaaattggctgggcaagttgtcaccatgagccaaaataaatttgcatcgaatgtgatagagaagtgttttcaacatggggattttgcggaacgggatcttctcatcagggagatagtgcagcagactgagggaaatgataccttgctggcaatgatgaaggatcagtatgctaattatgtggttcagaagatacttgaaacatgcaacgatcaacagcgggaacttctggtcagccgtgtcaagggtcatctgcaagcattgaggaagtacacttatggcaaacacatcgcgagccgtgtcgagcagctttgtggtgaaggaggtgcggagtccgactcttagatgactggcaaattctttgcaggagcggtgtgccttgacacctgcccagcgccgtcatcaaggaagaaagcagaacttgtgactccaatgcatctcgaagcgctaaacttcccccttagattgtacataagtgactttctttaagtagtctaggaggtgataggcacaaggctttagcagtgtgcatcatcagtgtatctattgttagggtgtgcttattttacagaatcatcatctaatactgtcctagttgtctagttggtagctgtgtgcaaaaaatatgtctagtggtttggcttggcttgtatgcgatacatatatgtttgactgcttggtaatgtaattgcttgcttgcatcttggctatgtggtaaaatctcgtccattcat

SEQ ID NO: 5812 - DNA, 821 bp, Secale cereale
ggaggccgcggcggccacggggctccgccccttcgccgcgccgctcggggccgcgacgagggcgggcgcgggctggcggtgcgcgccgggccagcggcggcttgggagaggcgcgcgcgtggtggcgaggctggacggcggcgtggggaagggggtgcccaccaccaactacgtcgtgccgctcgacaaggccaccgggatgacccgcccgctcgtcgagatcctcagggacctcaacaagcgcgtccccgacaagatcatcgaccccgacaccaacaccgtcccctggtaccatgccaacagaatgctgagcttttatgcaccaggttggtgtggtgaagttcgtgatgttatttattccaatagtggaactgtgactgtggtctatcgagtgattctgaaaggaacggatggagaggctttcagagacgccacgggcacagcaaaggtgcacgaggggcgcaacgacgacgctgttgcggctgcggaggaggcagcattcagcaaggcctgcgcgcggtttggtttcggcctgtacctgtaccaccaggatgagatcccatagagggaacagtagcaccgagattcattctgcattggagctggtcataacgtgggcaggcacgcccttggagagttggaaacgcttcgctggtgcttaatgcttgtgcaagagcctgtaaattgttccttctgttacatttttgttgttgttgtcgtcggtgtagcctggcaagattcatccagctagagaaaggaaaagaacatatggaataacgtgctgttacttctctgctgcattctctgcatcatgtagtttt

SEQ ID NO: 5813 - DNA, 997 bp, Secale cereale
gactagacctctgacctctcccccctcccaccgctcgcacgatcgaccaagcacgcaccgcgcattcctcctccgcagagtcaaccccacgcatggaggccgcggcggctatggggctccgccccttcgccgcgacgagggcgggcgcgggcgcaggctggcggtgcgcgccgggccagcggcggctttggcggggggcgcgcgtggtggcgaggctggacgggggcgtggggaagggggtgcccaccaccaactacgtcgtgccgctcgacaaggccaccgggatgacccgcccgctcgtcgagatcctcagggacctcaacaagcgcgtccccgacaagatcatcgaccccgacaccaacaccgtcccctggtaccatgccaacagaatgctgagcttttatgcaccaggttggtgtggtgaagttcgtgatgttatttattccaatagtggaactgtgactgtggtctatcgagtgattctgaaaggaacggatggagaggctttcagagacgccacgggcacagcaaaggtgcacgagggacgtaacgacgacgctgttgcggctgcagaggaggcagcattcagcaaggcctgtgcgcggtttggtttcggcctgtacctgtaccaccaggatgagatcccgtagggggaatggtagcatcgagatccattctgcattggaactggtcataacatgggcaggcacgcccttcgagagttggaaacgcttcgctggtgcttaatgcttgtgcaagaagcctgtaaattgttccttctgttacatttttgttgttgttgttgtcgtcgatgtagcctggcaagattcatccagctagagaaaggaaattaacatatggaataacgtgctgattacttctctgctgcattttccgcctcatgcagtttttctggagattttttgttttgttttgttttgttttctgttgcagcatttctgatctttcaaataggcaatatcactttaccaacaaa

SEQ ID NO: 5814 - DNA, 1048 bp, Secale cereale
accgctcgcacgatcgaccaagcacgcaccgcgcattcctcctccgcagagtcaaccccacgcatggaggccgcggcggctatggggctccgccccttcgccgcgccgctcgggggccgccaggagggcgggatggcggtgcgcgccgggccagcggcttgggcggggtgcgcgcgtggtggcgaggctggacgggggcgtggggaagggggtgcccaccaccaactacgtcgtgccgctcgacaaggccaccgggatgacccgcccgctcgtcgagatcctcagggacctcaacaagcgcgtccccgacaagatcatcgaccccgacaccaacaccgtcccctggtaccatgccaacagaatgctgagcttttatgcaccaggttggtgtggtgaagttcgtgatgttatttattccaatagtggaactgtgactgtggtgtatcgagtgattctgaaaggaacggatggagaggctttcagagacgccacgggcacagcaaaggtgcacgaggggcgcaatgacgatgctgttgcggctgcggaggaggcagcattcagcaaggcctgcgcgcggttcggttttggcttgtacctgtaccaccaggatgagatcccgtagggggaacggttgcatcgagatccattctgcattggagctggtcataacgtgggcaggcacgcccttggagagttggaaacgcttcgctggtgcttaatgcttgtgcaagaagcctgtaaattgttccttctgttacatttttgttgttgttgttgtcgtcggtgtagcctggcaagattcatccagctagagaaaggaaaagaacatatggaataacgtgctgttacttctctgctgcattttccgcctcatgtagtttttctggagatttttttgttttgttttgttttctgttgcagcatttctgatctttcaaataggcaatagcactgtactacagtaccacattgacagaaattgtttactgtttgttgccaatctttgtactccctccgtaaagaaatataagagtgtgttatatcaact

SEQ ID NO: 5815 - DNA, 1203 bp, Hordeum vulgare
ctcgtgccgaattcggcacgagggctggcgcacgggtaggtagccaagccaagccgccgagaccgagctgctcctgctcctgctctcgccgcaaccaaccaaccttccgcttccgcactcgcactcgcacggctggaagcggaacggaacccccggtccttttctactcccctccctcctcctcctcctcctccagaacccaggcctctgacctctcccccctcccaccgctcgcacgtacagcgcgcattcctccgcagggtcaaccccggcggccggccaaccatggaggccgcggcactccgccccttcgccgcgccgctcgggcccgcgaggagggcgggcgtaggctggcggtgcgcgccgggccagcggcggcttgggaggggcgcgcgcgtggtggcgaggctggacgggggcgtggggaagggggtgcccaccaccaactacgtcgtgccgctcgacaaggccaccgggatgacccgcccgctcgtcgagatcctcagggacctcaacaagcgcgtccccgacaagatcatcgaccccgacaccaacaccgtcccatggtaccatgccaacagaatgctgagcttttatgcaccaggttggtgtggtgaagttcgtgatgttatttattccaacagtggaactgtgactgtggtctatcgagtgattctgaaaggaacggatggagaggctttcagagacgcgacgggcacggcaaaggtgcaccagggacgcaacgatgacgctgttgcggctgcagaggaggcagcattcagcaaggcctgtgcgcggtttggtttcggcctgtacctgtaccaccaggatgagatcccatagggtgataggggggacggcacactttgagattcattctgcaatggagctggtcaacgtgggtaggcacacccttggagagttggaaatgctgcgctggtgcttaatgcttgtgcaagaagcatgtaaattgttccttctgttacttcttttttgttgttgttgtcggtgtagccttgcaagattcatccagctagagaaagtaaaagaacatatggaataacgtgatgttacttctgtgctgtattttctgcatcacgtagtttctcaattttgttttgttttctgttgcagcacttatgatcagtagcactgtagtactaaagtaccacgttgacagaaattgtgtactatttgttgctc

SEQ ID NO: 5816 - DNA, 1239 bp, Hordeum vulgare
ggggcatgcccactcgccttggcccttggctggcgcacgggtaggtagccaagccaagccgccgagaccgagctgctcctgctcctgctctcgccgcaaccaaccaaccttccgcttccgcactcgcactcgcacggctggaagcggaacggaacccccggtccttttctactcccctccctcctcctcctcctcctccagaacccaggcctctgacctctcccccctcccaccgctcgcacgtacagcgcgcattcctccgcagggtcaaccccggcggccggccaaccatggaggccgcggcactccgccccttcgccgcgccgctcgggcccgcgaggagggcgggcgtaggctggcggtgcgcgccgggccagcggcggcttgggaggggcgcgcgcgtggtggcgaggctggacgggggcgtggggaagggggtgcccaccaccaactacgtcgtgccgctcgacaaggccaccgggatgacccgcccgctcgtcgagatcctcagggacctcaacaagcgcgtccccgacaagatcatcgaccccgacaccaacaccgtcccatggtaccatgccaacagaatgctgagcttttatgcaccaggttggtgtggtgaagttcgtgatgttatttattccaacagtggaactgtgactgtggtctatcgagtgattctgaaaggaacggatggagaggctttcagagacgcgacgggcacggcaaaggtgcaccagggacgcaacgatgacgctgttgcggctgcagaggaggcagcattcagcaaggcctgtgcgcggtttggtttcggcctgtacctgtaccaccaggatgagatcccatagggtgataggggggacggcacactttgagattcattctgcaatggagctggtcaacgtgggtaggcacacccttggagagttggaaatgctgcgctggtgcttaatgcttgtgcaagaagcatgtaaattgttccttctgttacttcttttttgttgttgttgtcggtgtagccttgcaagattcatccagctagagaaagtaaaagaacatatggaataacgtgatgttacttctgtgctgtattttctgcatcacgtagtttctcaattttgttttgttttctgttgcagcacttatgatcagtagcactgtagtactaaagtaccacgttgacagaaattgtgtactatttgttgctcaaacttttttacatacataaacaaaactttt

SEQ ID NO: 5817 - DNA, 882 bp, Secale cereale
gactctctgacctctccccctcccaccgctcgcacgatcgaccacgcacggagcgcgcattcctcctgcgcagagtcaaccccacgcatggaggccacggggctccgccccttcgccgcgccgctcggggctgcgacgagggcgtgcgcgggctggcggtgcgcgccgggccagcggcggcttgcgcggggggcgcgcgtggtggcgaggctggacggcggcgtggggaagggggtgcccaccaccaactacgtcgtgccgctcgacaaggccaccgggatgacccgcccgctcgtcgagatcctcagggacctcaacaagcgcgtccccgacaagatcatcgaccccgacaccaacaccgtcccctggtaccatgccaacagaatgctgagcttttatgcaccaggttggtgtggtgaagttcgtgatgttatttattccaatagtggaactgtgactgtggtctatcgagtgattctgaaaggaacggatggagaggctttcagagacgccacgggcacagcaaaggtgcacgagggacgtaacgacgacgctgttgtggctgcagaggaggcagcattcagcaaggcctgtgcgcggtttggtttcggcctgtacctgtaccaccaggatgagatcccgtagggggaatggtagcatcgagatccattctgcattggaactggtcataacatgggcaggtacgcccttcgagagttggaaacgcttcgctggtgcttaatgcttgtgcaagaagcctgtaaattgttccttctgttacatttttgttgttgttgttgtcgtcgatgtagcctggcaagattcatccagctagagaaaggaaaagaacatatggaataacgtgctgattacttctctgct

SEQ ID NO: 5818 - DNA, 1277 bp, Brachypodium distachyon
ggctgctctccctccgccccgcgcaagcgcaacccaccatcacgccggcccgtgtccgcttccgctcatcaactggccatttccccggaacggaaggcggaaacccccggcggtccttttctactcccccctttcaatccaacagtctcctcctcttctaatctctccctcctccctgcgaacgcattacgaggtcaaccctccttcctctccccgcgtgcagcggcctagccatggaggccgcggcggcgacgacgacgacggcgctcctcccctccttctcggcgcccgcgaggacgcggagccggacgaacaacgcgctgccgggttggcgcgcgcctccgcggcggggaagggggctgtccatggtggccaggctggacgggggcggcatgggcagaggggtgcccacggccaactacgtggtgccgctcgacaaggccaccgggatgacgcgcccgctcgtggagatcctgcgggacctcaacaagcgcgtccccgacaagatcatcgaccccgacaccaacaccgtaccctggtaccatgccaatagaatgctgagcttttatgcaccaggttggtgtggtgaagtccgtgatgtcatttattccaacaatggaactgtaactgtggtctatcgagtgattctaaaaggaacagatggagaggcattcagagatgccacgggcacagcagctgtacgcgagggccgtagcgacgatgctgttgcggctgcggaggaagcagcgttcagcaaggcctgcgcacggtttggtttcggactgtacctgtaccaccaggatgagattccatagggaggacgacagccttgagattcatcctacagtggagatggttatatcatgggtaggaaccgcccttggacagttggaatgcttcgctttcctgagaaattttcaaaacttgaagcgtgctttccctggcgcatatgcaagaaacctgtaaattgttctagtgctgttatctttgttgttgtcggtgtctccagcaaattcatccattagagaaaagaaacaacatatgaaagatgtcatattattactaagctgctgtaattttctgcctcatgtcggttagtttctggagttgtagcttttgtgttctgttgatgcaattttgctcttactaataatagcagtattctactttactacttcaggaccacattgtcaaaatgagatgaatttgtatgaaacgtttctttctgccgatctttttacataaaactgggtgctatgcgattagttttatgttgc

SEQ ID NO: 5819 - DNA, 1050 bp, Brachypodium distachyon
ccccctttcaatccaacagtctcctcctcttctaatctctccctcctccctgcgaacgcattacgaggtcaaccctccttcctctccccgcgtgcagcggcctagccatggaggccgcggcggcgacgacgacgacggcgctcctcccctccttctcggcgcccgcgaggacgcggagccggacgaacaacgcgctgccgggttggcgcgcgcctccgcggcggggaagggggctgtccatggtggccaggctggacgggggcggcatgggcagaggggtgcccacggccaactacgtggtgccgctcgacaaggccaccgggatgacgcgcccgctcgtggagatcctgcgggacctcaacaagcgcgtccccgacaagatcatcgaccccgacaccaacaccgtaccctggtaccatgccaatagaatgctgagcttttatgcaccaggttggtgtggtgaagtccgtgatgtcatttattccaacaatggaactgtaactgtggtctatcgagtgattctaaaaggaacagatggagaggcattcagagatgccacgggcacagcagctgtacgcgagggccgtagcgacgatgctgttgcggctgcggaggaagcagcgttcagcaaggcctgcgcacggtttggtttcggactgtacctgtaccaccaggatgagattccatagggaggacgacagccttgagattcatcctacagtggagatggttatatcatgggtaggaaccgcccttggacagttggaatgcttcgctttcctgagaaattttcaaaacttgaagcgtgctttccctggcgcatatgcaagaaacctgtaaattgttctagtgctgttatctttgttgttgtcggtgtctccagcaaattcatccattagagaaaagaaacaacatatgaaagatgtcatattattactaagctgctgtaattttctgcctcatgtcggttagtttctggagttgtagcttttgtgttctgttgatgcaattttgctcttactaataatagcagtattctactttactact

SEQ ID NO: 5820 - DNA, 1304 bp, Hordeum vulgare
ccggacgcagccaacagcgctccgctcccccccgaaaaaaagagaacagcaacgggaagaataatcttcccccgtccgcgtgcgatcgacgcggagccgccgcccacctctgccccgaccccatggccttcatgcgcacctcctccaatgcatcctctggcatgggagttgctcctgatatcagggagacattcctggagcttcagatgaagaaggcatttcgctatgttatcttcaagatagaagaaaagcaaaagcaggttgttgtggagaagacaggggctacaactgagagttatgatgatttcctggcttgtctcccagagaacgactgcagatatgcgctttatgattttgactttgttactggggagaatgtgcagaaaagcaagattttcttcattgcctggtcccctgacacatcccgcatccgagccaagatgctgtactccacctccaaggaccgcatcaagcaagagctcgacgggttccactacgagatccaggcaactgacccgaccgaggtggagctcgacgtcctccgtgaccgggcgcactagggcgtatcgatgatcacctgtgggcttcagtcggatgcaaattcatgccatccgtggtaatgctgctgccacagtgttgttaataagacagatatatccaggtttcctgcaaaacgtatcattcggccgttatgcatggctctagctgatgaagtgttgtccgaggtctctactcgtatgatgtcggagcctgtaaacgcaagaaacacctcccaaaaacgcatgtgttgtggtattaatactggtttgctaggcttggattctcctgaatgctctccttggtgtcatgttccgttgcatgacctgacttgttaccatggcttatctctcctgtacttgtatgtccctgaaactcatggtttcttttggcagtttttttgcgaacctttgtacttagggtccaagaacttccagaatgtacaaatggtgaaactcaggcgggaagtctagaacaattctgcgataatcatgaacgaatcgcctttggcttttaaggattggaaacaaagaaagaacgaatcacttatagctcatttccagctttatatgattccccctaccttatcttacaaaaataccccctccatcccataatactataagtaaacgctcttatattatgggatgaagggagtaacaattaaaggttctagtatactttctatagaatagcttctcaaatatacttggttcgactaaagattgaggaaattatttgtaatgtagcataggttcccaaatata

SEQ ID NO: 5821 - DNA, 1416 bp, Hordeum vulgare
aaaccccacccgccagcgaccagcccaacccccgcacccgcacgcgtcgccccgcaccggcgcgtgcgcgtatatgaacgcacgccccgttcagagccctcctcctcctcgccccacaccaacggacgcagccaacagcgctccgctcccccccgaaaaaaagagaacagcaacgggaagaataatcttcccccgtccgcgtgcgatcgacgcggagccgccgcccacctctgccccgaccccatggccttcatgcgcacctcctccaatgcatcctctggcatgggagttgctcctgatatcagggagacattcctggagcttcagatgaagaaggcatttcgctatgttatcttcaagatagaagaaaagcaaaagcaggttgttgtggagaagacaggggctacaactgagagttatgatgatttcctggcttgtctcccagagaacgactgcagatatgcgctttatgattttgactttgttactggggagaatgtgcagaaaagcaagattttcttcattgcctggtcccctgacacatcccgcatccgagccaagatgctgtactccacctccaaggaccgcatcaagcaagagctcgacgggttccactacgagatccaggcaactgacccgaccgaggtggagctcgacgtcctccgtgaccgggcgcactagggcgtatcgatgatcacctgtgggcttcagtcggatgcaaattcatgccatccgtggtaatgctgctgccacagtgttgttaataagacagatatatccaggtttcctgcaaaacgtatcattcggccgttatgcatggctctagctgatgaagtgttgtccgaggtctctactcgtatgatgtcggagcctgtaaacgcaagaaacacctcccaaaaacgcatgtgttgtggtattaatactggtttgctaggcttggattctcctgaatgctctccttggtgtcatgttccgttgcatgacctgacttgttaccatggcttatctctcctgtacttgtatgtccctgaaactcgtggtttcttttggcagtttttttgcgaacctttgtacttagggtccaagaacttccagaatgtacaaatggtgaaactcaggcgggaagtctagaacaattctgcgataatcatgaacgaatcgcctttggcttttaaggattggaaacaaagaaagaacgaatcacttatagctcatttccagctttatatgattccccctaccttatcttacaaaaataccccctccatcccataatactataagtaaacgctcgggatgaagggagtaacaattaaaggttctagtatactttctatagaatagcttctcaaatatacttggttcgactaaagattgaggaaattatttgtaatgtagcataggttcccaaatata

SEQ ID NO: 5822 - DNA, 728 bp, Leymus cinereus x Leymus triticoides
ctccctctgaaaaagagaacagcaacgggaataatctcctttcctcctctgccccctcctcgtctgcgtgcgatcgaagcggaggcgccgcccgtccccctccgctccgaccccatggccttcatgcgcacctcctccaatgcatcctctggcatgggagttgctcctgatatcagggagacattcctggagcttcaaatgaagaaggcgtttcgctatgttatcttcaaaatagaagaaaagcaaaagcaggttgttgtggagaagacaggggctacaactgagagttatgatgatttcctggcttgtctcccagagaatgactgcagatatgccctttatgattttgactttgttactggggagaatgtgcagaaaagcaagattttcttcattgcctggtcccctgacacatcccgcatccgtgctaagatgctgtactccacctccaaggaccgcatcaagcaagaactcgacgggttccactacgagatccaggcaactgacccgaccgaggtggagctcgatgtcctccgcgacagggcgcactagggcggatcagtgatcacctgtgggcttcagtcggatgcaaattcatgctatccgtggtaatgctgttgccgcagtgttgttaataagacggatatatccaggtttcctgtaaaacgtatcattcagccgttatgcatggctctagctgatgaagtgttgtccgaggtctctactcg

SEQ ID NO: 5823 - DNA, 831 bp, Pseudoroegneria spicata
  misc_feature (38)..(38): n is a, c, g, or t
  misc_feature (60)..(60): n is a, c, g, or t
aaaagacgcagccaacagcgctccctctgaaaaaaganaacagcaacgggaataatctcntttcctcctcgtccgcgtgcgatcgacgcggaggcgccgcccgtctccctctgctccgacccgaccccatggccttcatgcgcacctcctccaatgcatcctctggcatgggagttgctcctgatatcagggagacattcctggagcttcagatgaagaaggcgtttcgctatgttatcttcaaaatagaagaaaagcaaaagcaggttgttgtggagaagacaggggctacaactgagagttatgatgatttcctggcttgtctcccagagaatgactgcagatatgccctttatgattttgacttcgttactggggagaatgtgcagaaaagcaagattttcttcattgcctggtcccctgacacatcccgcatccgtgccaagatgctgtactccacctccaaggaccgcatcaagcaagagcttgatgggttccactacgagatccaggcaactgacccgaccgaggtggagctcgatgtcctccgtgaccgggcgcactagggcggatcgatggtcacctgtgggcttcagtcggatgcaaattcatgctgtccgtggtaatgctgttgccgcagtgttgttaataagacggatatatccaggtttcctgtaaaacgtatcattcagccgttatgcatggctctagctgatgaagtgttgtccgaggtctactcgtatgatgtcggagcctgtaaacgcaagaaacaccccaaaaacgcatgtgttgtggtattaatagtactggttgctaggcttggattctcca

SEQ ID NO: 5824 - DNA, 853 bp, Triticum aestivum
cacagcgctccctctgaaaaaaagggaagagaacagcaacgggaataatctcgtctcctttcctcctcaacccgtccgcgtgcgatcgacgcggaggcgccgcccgtccccccctccgacccgacccgaccccatggccttcatgcgcacctcctccaatgcatcctctggcatgggagttgctcctgatatcagggagacattcctggagcttcagatgaagaaggcatttcgctatgtcatcttcaaaatagaagaaaagcaaaagcaggttgttgtggagaagacgggggctacaactgagagttatgatgatttcctggcttgtctcccagaaaacgactgcagatatgccctttatgattttgactttgttactggggagaatgtgcagaaaagcaagattttcttcattgcctggtcccctgacacatcgcgcatccgcgccaagatgctgtactccacctccaaggaccgcatcaagcaagagctcgacgggttccactacgagatccaggcaactgacccgaccgaggtggagctcgatgtcctccgcgaccgggcgcactagggcggatcgatgatcacctgtgggcttcagccggatgcaaatccatgctgtccgtggtaatgctgttgccgcagtgctgttaataagacagatatatccaggtttcctgtaaaacgtaagagtatcattcagctgttatgcatggctctagctgatgaagtgttgtccgaggtctctctactcgtatgatgtcggagcctgtaaacgcaagaaacacccctgaaaaacgcatgtgttgtggtattaatactggtttgctaggcttggattctcctgaatgct

SEQ ID NO: 5825 - DNA, 1158 bp, Triticum aestivum
cagcgctccctctgaaaaaaagggaagagaacagcaacgggaataatctcgtctcctttcctcctcaacccgtccgcgtgcgatcgacgcggaggcgccgcccgtcccctcccctccgccccgacccgaccccatggccttcatgcgcacctcctccaatgcatcctctggcatgggagttgctcctgatatcagggagacattcctggagcttcagatgaagaaggcatttcgctatgtcatcttcaaaatagaagaaaagcaaaagcaggttgttgtggagaagacgggggctacaactgagagttatgatgatttcctggcttgtctcccagaaaacgactgcagatatgccctttatgattttgactttgttactggggagaatgtgcagaaaagcaagattttcttcattgcctggtcccctgacacatcccgcatccgcgccaagatgctgtactccacctccaaggaccgcatcaagcaggagctcgacgggttccactacgagatccaggcaactgacccgaccgaggtggagctcgatgtcctccgcgaccgggcgcactagggcggatcgatgatcacctgtgggcttcagccggatgcaaatccatgctgtccgtggtaatgctgttgccgcagtgctgttaataagacagatatatccaggtttcctgtaaaacgtaagagtatcattcagctgttatgcatggctctagctgatgaagtgttgtccgaggtctctctactcgtatgatgtcggagcctgtaaacgcaagaaacacccctgaaaaacgcatgtgttgtggtattaatactggtttgctaggcttggattctcctgaatgctctctattgtgtcaatgttccgtggcatggcctgacttgttaccatgccttgtctctcctggacttgtatttccctgaaactcatggttctttttggcagtttttttgtgaacttttaccctttgtactttcggtccaagaacttccagaatggtgaaacccaggagggaaatctagaaccattgagcgataatcatgaaagaattgcctttggctttgagggattaaataaaaacaaagaaataaggatgaatttcttctaatttccagctttatatgattccctctgccttatctcttcttaac

SEQ ID NO: 5826 - DNA, 845 bp, Triticum aestivum
acgcagccaacagcgctccctctgaaaaaaaaaagagaacagcaacgggaataatctcctttcctcctcgtccgcgtgcgatcgacgcggaggcgccgcccgtccccctcccctccgctccgacccgaccccatggccttcatgcgcacctcctccaatgcatcctctggcatgggagttgctcctgatatcagggagacattcctggagcttcagatgaagaaggcatttcgctatgttatcttcaaaatcgaagaaaagcaaaaacaggttgttgtggagaagacaggggctacaactgagagttatgatgatttcctggcttgtctcccagaaaaggactgcagatatgccctttatgattttgactttgttactggggagaatgtgcagaaaagcaagattttcttcattgcctggtcccctgacacatcccgcatccgcgccaagatgctgtactccacctccaagaaccgcatcaagcaggagctcgacgggttccactacgagatccaagcaactgacccgaccgaggtggagctcgacgtcctccgtgaccgggcgcactagggcggatcgatgatcacccgtgggcttcagtcggatgcaaattcatgctgtccgtggtaatgctgttgccgcagtgttgttaataagacagatatatccaggtttcctgtaaaacgtaagagtatcattcagctgttatgcatggctctagctgatgaagtgttgtccgaggtctctctactcgtatgatgtcggagcctgtaaacgcaagaaacctccctgaaaaacgcatgtgttgtggtattaatactggtttgctaggcttggattctcct

SEQ ID NO: 5827 - DNA, 875 bp, Secale cereale
ccaacagcgctcccagaaagagcagcccacggcaacgggaataatcctcctctcctcctcgcccgcgtgcgatcgacgcggaggcgccgccgcccccctaccccatggccttcatgcgcacctcctccaatgcatcctctggcatgggagttgctcccgatatcagggacacattcctggagcttcagatgaagaaggcatttcgctatgttatcttcaaaatcgaagaaaagcaaaagcaggttgttgtggagaagacaggggctacaactgagagttatgatgatttcctggcttgtctcccagaaaacgactgcagatatgccctttatgattttgactttgttactggggagaatgtgcagaaaagcaagattttcttcattgcctggtcccctgacacatcccgcatccgtgctaagatgctctactccacctccaaggaccgcatcaagcaagagctcgacgggttccactacgagatccaggcaactgacccgaccgaggtggagctcgatgtcctccgcgaccgggcgcactagggcggatccatgatcacctgcgggcttcagtcggatgcaaatccatgctatccgtggtaatgctgttgtcgcagtgttgttaataagacagatatatcctggtttcgtgtaaaacgtatcattcagccgtccgttatgcatggctctagctgatgaagtgttgtccgaggtctctactcgtatgatgtcggagcctgtaaacgcaagaaacacccccgaaaaacgcatgtgttgtggtattaatactggtttgctaggcttggattctcctgaatgctctccattgtgtcatgttccgtggcagggcctgacttattaccatgccttgtctct

SEQ ID NO: 5828 - DNA, 996 bp, Secale cereale
ccccccctaactccctgtgtgccgttgcagtctacagaagcgagttggtaactcaacgacagagtacgacgtcgggggaccaaccaacccaaaaagacgcccgcagccaacagcgctcccagaaagagcagcccacggcaacgggaataatcctcctctcctcctcgtccgcgtgcgatcgacgcggaggcgccgccgcccccataccccatggccttcatgcgcacctcctccaatgcatcctctggcatgggagttgctcccgatatcagggacacattcctggagcttcagatgaagaaggcatttcgctatgttatcttcaaaatcgaagaaaagcaaaagcaggttgttgtggagaagacaggggctacaactgagagttatgatgatttcctggcttgtctcccagaaaacgactgcagatatgccctttatgattttgactttgttactggggagaatgtgcagaaaagcaagattttcttcattgcctggtcccctgacacatcccgcatccgtgctaagatgctctactccacctccaaggaccgcatcaagcaagagctcgacgggttccactacgagatccaggcaactgacccgaccgaggtggagctcgatgtcctccgcgaccgggcgcactagggcggatccatcatcacctgcgggcttcagtcggatgcaaatccatgctatccgtggtaatgctgttgtcgcagtgttgttaataagacaaatatatcctggtttcgtgtaaaacgtatcattcagccgtccgttatgcatggctctagctgatgaagtgttgtccgaggtctctactcgtatgatgtcggagcctgtaaacgcaagaaacacccccgaaaaacgcatgtgttgtggtattaatactggtttgctaggcttggattctcctgaatgctctccattgtgtcatgttcagtggcagggcctgacttattaccatgccttatctctcctgtacttgtattt

SEQ ID NO: 5829 - DNA, 844 bp, Secale cereale
ggggccacacccaaaagacgcccgcagccaacagcgctcccagaaagagcagcccacggcaacgggaataatcctcctctcctcctcgtccgcgtgcgatcgacgcggaggcgccgccgcccccctaccccatggccttcatgcgcacctcctccaatgcatcctctggcatgggagttgctcccgatatcagggacacattcctggagcttcagatgaagaaggcatttcgctatgttatcttcaaaatcgaagaaaagcaaaagcaggttgttgtggagaagacaggggctacaactgagagttatgatgatttcctggcttgtctcccagagaatgactgcagatatgccctttatgattttgactttgttactggggagaatgtgcagaaaagcaagattttcttcattgcctggtcccctgacacatcccgcatccgtgctaagatgctctactccacctccaaggaccgcatcaagcaagagctcgacgggttccactacgagatccaggcaactgacccgaccgaggtggagctcgatgtcctccgcgaccgggcgcactagggcggatccatgatcacctgctggcttcagtcggatgcaaatccatgctatccgtggtaatgctgttgtcgcagtgttgttaataagacagatatatcctggtttcgtgtaaaacgtatcattcagccgttatgcatggctctagctgatgaagtgttgtccgaggtctactcgtatgatgtcggagcctgtaaacgcaagaaacacccccgaaaaacgcatgtgttgtggtattaatactggtttgctaggcttggattctcctaaatgctctc

SEQ ID NO: 5830 - DNA, 828 bp, Secale cereale
ccacaccccaaaagacgcccgcagccaacagcgctcccagaaagagcagcccacggcaacgggaataatcctcctctcctcctcgcccgcgtgcgatcgacgcggaggcgccgccgcccccctaccccatggccttcatgcgcacctcctccaatgcatcctctggcatgggagttgctcccgatatcagggacacattcctggagcttcagatgaagaaggcatttcgctatgttattttcaaaattgaagaaaagcaaaagcaggttgttgtggagaagacaggggctacaactgagagttatgatgatttcctggcttgtctcccagaaaacgactgcagatatgccctttatgattttgactttgttactggggagaatgtgcagaaaagcaagattttcttcattgcctggtcccctgacacatcccgcatccgtgctaagatgctctactccacctccaaggaccgcatcaagcaagagctcgacgggttccactacgagatccaggcaactgacccgaccgaggtggagctcgatgtcctccgcgaccgggcgcactagggcggatccatcatcacctgctggcttcagtcggatgcaaatccatgctatccgtggtaatgctgttgtcgcagtgttgttaataagacagatatatcctggtttcgtgtaaaacgtatcattcagccgttatgcatggctctagctgatgaagtgttgtccgaggtctctactcgtatgatgtcggagcctgtaaacgcaagaaacacccccgaaaaacgcatgtgttgtggtattaatactggtttgctaggcttggatt

SEQ ID NO: 5831 - DNA, 562 bp, Secale cereale
  misc_feature (49)..(49): n is a, c, g, or t
  misc_feature (54)..(54): n is a, c, g, or t
  misc_feature (153)..(153): n is a, c, g, or t
  misc_feature (264)..(264): n is a, c, g, or t
  misc_feature (267)..(267): n is a, c, g, or t
  misc_feature (459)..(459): n is a, c, g, or t
  misc_feature (510)..(510): n is a, c, g, or t
tcctcctctcctcctcgtccgcgtgcgaatcgacgcggagcgccgccgnccccntaccccatggccttcatgcgcacctcctccaatgcatcctctggcatgggagttgctcccgatatcagggacacattcctggagcttcagatgaagaangcatttcgctatgttatcttcaaaatcgaagaaaagcaaaagcaggttgttgtggagaagacaggggctacaactgagagttatgatgatttcctggcttgtctcccaganaangactgcagatatgccctttatgattttgactttgttactggggagaatgtgcagaaaagcaagattttcttcattgcctggtcccctgacacatcccgcatccgtgctaagatgctctactccacctccaaggaccgcatcaagcaagagctcgacgggttccactacgagatccaggcaactgacccgacngaggtggagctcgatgtcctccgcgaccgggcgcactagggcggatccatnatcacctgcgggcttcagtcggatgcaaatccatgctatccgtggtaatgct

SEQ ID NO: 5832 - DNA, 1055 bp, Brachypodium distachyon
gcccattctgaaatttccacacacaacaaaagacgcggcgctcccggaaaagaagagaaaggaagaaaacacaaacacaggagcggaataatctttttctctccatcgtcctcatccacgtctgcgactgcgtgcgatcgaagcggaggcgcccgccccccctcctctgctccgtcccgatggccttcatgcgcacctcctccaatgcatcctctgggatgggtgttgctcctaatatcagggagacattccttgagctccaaatgaagaaagcatttcgttatgttatcttcaaaatcgaggaaaagcaaaagcaggtcattgtggagaagacaggagctacaactgagagttatgatgattttctggcatctctcccagaaaatgactgcagatatgccctgtatgattttgactttgttactggggagaatgtgcagaaaagcaagattttcttcattgcctggtccccagcaacgtcccgcatccgtgctaagatgctgtactccacctccaaggaccgcatcaagcatgaacttgatgggtttcactacgagatccaggcaaccgacccgactgaggtggagctccaagtcctccgggatagggctcattagtgccgattggtgataatctgtgggcttcagtcggatgcagattcatgctagccgtgatgctgttgccaccactttattgttaataagtatatccatcaaggtttcctgtaaaacgtatcatttagctgtgctccgtggttctctagcagatgaagtgttatctgggatttatctgtgcggtgttctgagcctgtaaactcaggaagtattgtgatattgttactggattgctgggtgagtgggtgtggaatctactaaattgcccccattgtgtcggcataacatgtcgtggcataacttgaccttccactgttcgcagtccacacactgtcttttgctctgtcataccaactcgagatttatggttcttgacagtttgctcgaatgttttactcctttccttcatgtcttgttaggaacaaaagccttgctggaacc

SEQ ID NO: 5833 - DNA, 616 bp, Festuca arundinacea
ggcacgaggaaaacacaccggcagcggaataatcttcttctcttccttcgtcctcgtccgcgtgcgatcgacgcggaggagccgccacccctgctccgagaccccgatggccttcatgcgcacctcctccaatgcatcctctggcatgggggttgctcctgatatcaggcagacattcctggagcttcagatgaagaaggcatttcgctatgttatcttcaaaattgaggagaagcaaaagcaggttattgtagagaagacaggggctacaactgagagttatgatgatttcctggcttctctccctgaaaatgactgcagatatgcgctttatgattttgactttgttactggggagaatgtgcagaaaagcaagattttcttcattgcctggtccccagcaacatcccgcatccgtgccaagatgctgtactccacctccaaggaccgtatcaagcatgagctcgatgggttccactacgagatccaggcaactgacccaactgaggtggagatcgatgttctccgtgagcgggctcactgaagccgatcgatgatgatccacctggtggcttcagtcggatgcaaattcacaattatgtctgtgatactgttg

SEQ ID NO: 5834 - DNA, 940 bp, Avena sativa
gacgccacaccgagaaaacacgcagagaacagaacagagagagagccctccgcaacggaataaatcttttctcctcctcgtccgcgtgcgatcgaaccctgcggaggcgccaccgccgccgccgctccgaccccgatggccttcatgcgcacctcctccaatgcatcctctggcatgggggttgctcctgacatcaggcagacattcctggagcttcagatgaagaaggcatttcgctatgttatcttcaaaatcgaggagaagcaaaagcaggttattgtggagaagacaggggctacaactgagagttatgatgatttcctggcctctctccctgaaaatgactgcagatatgccctttatgactttgactttgttactggggagaatgtgcagaaaagcaagattttcttcattgcctggtccccagcaacatcccgcatccgtgcgaagatgctgtactccacctccaaggaccgcatcaagcatgagctcgacgggttccactatgagatccaggcaactgacccaaccgaggtggagattgatgtcctccgtgagcgggctcactaaagcctaccgatgatatgatcacctggtgacttcagtcggatacagattcatattatctgtggtcctgtcgccaccgcgttgttaataatacagatatccatgtttcctgtaaaacgtgtcatttagctagccgggctgcgtggctctagctgatgaagtgttacccgactagatttcgtatgatgccctgagcctgtcaacgcagaaggcatccccagacgcttgtattgtggtattaaaactgtggattgtcctagttgccctcgttgtgtcagctttgcatatctagcataatcttacaccatcactgaatgcagcatgccatctcatctgaataaaagtaaaaaaaaaaaactaaagagacacg

SEQ ID NO: 5835 - DNA, 951 bp, Avena sativa
cgagaaaacacgcagagaacagaacagaacagaacagagggagccctccgcaacggaataaatcttttctcctcctcgtccgcgtgcgatcgaaccccgcggagccgccgccccgccgccgctgctccgaccccgatggccttcatgcgcacctcctccaatgcatcctctggcatgggggttgctcctgacatcaggcagacattcctggagcttcagatgaagaaggcatttcgctatgttatcttcaaaatcgaggagaagcaaaagcaggttattgtggagaagacaggggctacaactgagagttatgatgatttcctggcttctctccctgaaaatgactgcagatatgccctttatgactttgactttgttactggggagaatgtgcagaaaagcaagattttcttcattgcctggtccccagcaacatcccgcatccgtgcgaagatgctgtactccacctccaaggaccgcatcaagcatgagctcgacgggttccactatgagatccaggcaactgacccaaccgaggtggagattgatgtcctccgcgagcgggctcactaaagcctaccgatgatatgatcacctggtgacttcagtcggatacagattcatattatctgtggtcctgtcgccaccgcgttgttaataatacagatatccatgtttcctgtaaaacgtgtcgtttagctagccgggctgcgtggctctagctgatgaagtgctacccgactagatttcgtatgatgccctgagcctgtcaacgcagaaggcatccccagacgcttgtattgtggtattaaaactgtggattgtcctagttgccctcgttgtgtcagctttgcatatctagcataatcttacaccatcactgaatgcagcatgccatctcatctgatgtactccctccgttacgaaaatataagatgttttaggttagtg

SEQ ID NO: 5836 - DNA, 1445 bp, Oryza sativa
ttccccatttttccattcgaattcctcctcattttattcttccccaaaaagtcaccctttcaaacacttcccaactcatcacgcctctggcaaagggcccacagactcagtcagagccagccaacccgaccccatcccagccgttggattagcccttcaccgccgtccaaaccccacgtctcctcaatccccccacctcctcacccaacccagccactgacaccctgcccccacattacatgaaccccacctgtcagtgacacaaacatcccacacgcgacgtgcaactccccgcctccacaactatatatgaacgcgccccttcctcgcgaatttttcctctccacaccaaaagacgccgcccaactcgcgaaggcggaaaaggaaaaaaagagagaaaaaaaaaggaagaaaaaaaaataaaactcgcgcacagcaaccgaatcatctgcctcctcctcaagtagtctagtcctcctctcttctccggagtctgcgtgcgatcgaagcagaggcgcggcgctcctcctcctcctccggctccgatccccatggcgttcatgcgttcccactccaatgcatcctccggtatgggggttgctcctgacatcagggacacattccttgagcttcagatgaagaaagcatttcgctatgttatcttcaaaatcgaggaaaagcaaaagcaagttgttgtggagaagaccggggcaacaactgagagttatgatgatttcctggcatctctcccagaaaatgactgcagatatgccctctatgattttgactttgttactggggagaatgtgcaaaagagcaagattttcttcatcgcctggtctccatcaacatcccggatccgtgctaagatgctgtactccacctccaaggatcgcatcaagcaagaacttgatggattccactacgagatccaggcaaccgacccaactgaggtagaccttgaggtcctccgggagcgggctcattaaggccctggccctgatgatcgatcacctgcgaatctcaagtcaagacgcaaattcatcctatcagtgatgctcccttgcgatactattgttaataagaaagatatccatgtttcctgtaaaacgtatccccaccatcatcatcatcatcatcgtttagccttgcctgcatgattctagctgcagatggagtgttgtcggagatttacccgtatgaggtctcagagcctgtaaaacgtatgaaacaccctctcccaaactcttatattgtggtattaatatggattactgggtgtggattgtcctacatgttttttgtcgctttgcctctcgttgtctcgtgtcattctggaacattatgctagctggaatcaccttatggccaccaacctgcatgatactgtaattctactgaattggtcagtactcttaagaaacattcgttctcggctttcgagt

SEQ ID NO: 5837 - DNA, 1013 bp, Cenchrus ciliaris
  misc_feature (92)..(92): n is a, c, g, or t
  misc_feature (357)..(357): n is a, c, g, or t
aaagggaaaaccccccgcagcaacagaagcagaagaataatcccttctccttgcttgcgcctcccgtctgcgtgcgatcgacgcagagaggngcgggcgctcaccgccggccacaacctcccggctccgatccgatggccttcatgcgctcccactcaaatgcatcatccggcatgggagttgctcctaacatcagggagacatttgtcgagcttcagatgaagaaggcattccgatatgttatcttcaaaatcgaggaaaagcaaaagcaggtggtagttgagaagactggcgctactactgaaagctatgatgattttttggcctctctcccagaaaatgactgcagatatgctntgtatgattttgactttgtcaccggggagaatgtgcagaaaagcaagatctttttcattgcctggtccccatcgacatcccgcatccgtgcgaagatgctgtactccacctccaaggaccgcatcaagcatgagcttgatggattccactacgagatccaggcaaccgacccaacggaggtggacatcgaggtcctccgggagcgggctcactgaagctggtttacctatgaagggacctgtggagggccatgaaccttcagccagattcaaattcaaattctatcaatcaatgatgctcctgccgtggtattgttaataagttcctgtaagcatgtcatttagttgcgatgcattagctggtgaagcgctatcgaagctctatccatatgagatcttgagcctgtaaacgaagcaacatgtgcaaactcatatattgtggtaatggtactggattgttggttgtggattgttcggaaatgcctggttggtctgaacttgttagcaggttgtaccggtcatttctgaccctttagatcaagtttacacctctgttggtaaatgccattgtgttggaattgggacttattttcagttcatggctttagttttgcatgtacgcctacgtgataatcacagcaaaattgtggtatgtta

SEQ ID NO: 5838 - DNA, 978 bp, Pennisetum glaucum
gccaactcgtcgcataaaaaaaaaaggaaaaggaaaggggagaaaaaaaacccgcagcaacagaagaagaataatcccttctccttgcttgcgcctcccgtctgcgtgactgtgcgcgcgtgcgatcgacgcagagaggcgcgggcgctcaccgccgccgcccaccccccggcggctccgatccgatggccttcatgcggtcccactcaaatgcatcttccggcatgggagttgctcctaacatcagggagacatttgtcgagcttcagatgaagaaggcattccgatatgttatcttcaaaatcgaggaaaagcaaaagcaggtggttgttgagaagacgggcgctactactgaaagctatgatgattttttggcctctctcccagaaaatgactgcagatacgctctgtacgattttgactttgtcactggggagaacgtgcagaaaagcaagatctttttcattgcctggtccccagcaacatcccgcattcgtgcgaagatgctgtactccacctccaaggaccgcatcaagcatgagcttgatgggttccactacgagatccaggcaactgacccaaccgaggtggacatcgaggtcctccgggagcgggctcactgaagctggtttacctatgaagggacctgtggagggccttgaaccttcagccagattcaaattcaaattctatcaacgaatgatgctcccaccgtggtattgttaataagttcctgtaagcgtgtcatttagttgcgatgcaagacttagctggtgaagcactatcgaagctctatccgtatgagatcttgagcctgtaaacgaagcaacatgtgcaaactcatatattgtggtaatgatactggattgttggttggtctgaactttttagcagcttgtactagatcatacctggctctgggtttctgaccctttaggtaacacctctgttggtaaatgctattgtgttggaattggg

SEQ ID NO: 5839 - DNA, 1059 bp, Zea mays
cccaccacaccaaaacccgcatccataaacaagaaaaagaaaagaaaacccccgctgccagcgacagaagaagaaggggtcccttctccttggttgcgttgcgcctccctcctgtctgcgtgcgtgcaatcgacgcagaggcgcgggcgctcgcaccaccacgaccacgacccgatggctttcatgcgctcccgctcaaatgcatcttctggcatgggagttgctcctaacattagggagacattcgtcgagcttcaaatgaagaaggcattccgatatgttatcttcaaaatcgaagagaagcaaaagcaggtggttgtggagaagacaggggctactactgaaagctatgatgactttttggcctctctcccagagaatgactgccgatatgcgctgtatgattttgattttgttactggggagaatgtgcagaaaagcaagattttcttcattgcctggtccccatcgacatcccgcatacgtgctaagatgctgtactccacgtcgaaggaccgcatcaagtacgagcttgacgggttccactacgaaatccaggcgaccgacccatcggaggtggacatcgaggttctccgggagcgggctcactgaagctggttctccttttgaagggacctgtggagggccgtgaaccttcagccagatgcaaattcaattatcaacgatgaagctcccgccgtggtgtttgttaataagttcctgtaagcatatcatttagtcgctatgcatgacactagctgaagcgctatctaagctctattggtatgaggtttggttgccgtgttgccgagcctgtaaacgaagcaagatttgcaaacttgttatattgtggtattgatgatactggattactggctgtgggttgttcgggaatgtctctgcctctctggtctggtgtctggacgtggttgtggcttgctcgggatcgccctggttggtctggtgtctgctgggtctggcccccggacggtcggattgtctgcatctgttagatgtacttgttctaatcaaagcatgttccaagttcctgaccgtaaa

SEQ ID NO: 5840 - DNA, 1119 bp, Sorghum bicolor
acgcgcatctctccggagaatttcgccccaccacccaaaacccgaagcagcccgcatatataaaaaaggaaaaaaataataagaaaaagaaaacccccgcagccagcaaccgaagagaggaggagggggggtctcttctccagttctcctttgcttgcgcctcccgtctgcgtgcgtgcgatcgacgcagaggcgggcgcgggcgctcgcaccaccccgatccgatggccttcatgcgctcccactcaaatgcatcttccggcatgggagttgctcctaacattagggagacatttgtcgagctccaaatgaagaaggcataccgatatgtcatcttcaaaatcgaagagaagcagaagcaggtggttgtggagaagacaggggctactactgaaagctatgatgactttttggcctctctcccagagaatgactgccgatatgctctctatgattttgattttgttactggggagaacgtgcagaaaagcaagattttcttcattgcctggtccccatcgacatcccgcatccgtgctaagatgctgtactccacctcaaaggaccgcatcaagcacgagctcgacgggttccactacgagatccaggcgaccgacccgacagaggtggacattgaggttctccgggagcgggctcactgaagctggttcgcctttgaagggacctgtggagggccgtgaaccttcggtcagatgcaaactctattatgaaatgatgaagctcccaccgtggtatttgttaataagttcctgtaagcatatcatttagtcgcgatgcatgactctagctggtgaagcgttattgaaagctgtatcggtatgaggtttggttgtcgatactgtaaacgaagcaagatttgcaaacttgttatattgtggtattgattatactggattactggctgtggcctgtgggttgttgagaatggcagtttatggttggtctggtgcctggacgtggttgtgggttgttcgagattgcttcggttggtctggtgtctggcccccggttggtctgattgtctgtatctgtttgatatatacttgtgctaatgaaacctggttccaagtttctgaccgtaattacccgttgctggcg

SEQ ID NO: 5841 - DNA, 1219 bp, Sorghum bicolor
accccacatgtcattctctccctggacccacgaagccgtgtacgccacacacgcccacagccacgcacacccacacgaagcggcgcgtccgcgtatatgaacgcgcatctctccggagaatttcgccccaccacccaaaacccgaagcagcccgcatatataaaaaaggaaaaaaataataagaaaaagaaaacccccgcagccagcaaccgaagagaggaggagggggggtctcttctccagttctcctttgcttgcgcctcccgtctgcgtgcgtgcgatcgacgcagaggcgggcgcgggcgctcgcaccaccccgatccgatggccttcatgcgctcccactcaaatgcatcttccggcatgggagttgctcctaacattagggagacatttgtcgagctccaaatgaagaaggcataccgatatgtcatcttcaaaatcgaagagaagcagaagcaggtggttgtggagaagacaggggctactactgaaagctatgatgactttttggcctctctcccagagaatgactgccgatatgctctctatgattttgattttgttactggggagaacgtgcagaaaagcaagattttcttcattgcctggtccccatcgacatcccgcatccgtgctaagatgctgtactccacctcaaaggaccgcatcaagcacgagctcgacgggttccactacgagatccaggcgaccgacccgacagaggtggacattgaggttctccgggagcgggctcactgaagctggttcgcctttgaagggacctgtggagggccgtgaaccttcggtcagatgcaaactctattatgaaatgatgaagctcccaccgtggtatttgttaataagttcctgtaagcatatcatttagtcgcgatgcatgactctagctggtgaagcgttattgaaagctgtatcggtatgaggtttggttgtcgatactgtaaacgaagcaagatttgcaaacttgttatattgtggtattgattatactggattactggctgtggcctgtgggttgttgagaatggcagtttatggttggtctggtgcctggacgtggttgtgggttgttcgagattgcttcggttggtctggtgtctggcccccggttggtctgattgtctgtatctgtttgatatatacttgtgctaatgaaacctggttccaagtttctgaccgtaattacccgttgctggcg

SEQ ID NO: 5842 - DNA, 1171 bp, Saccharum officinarum
aaaagaaaagaaaacccccgcagccagcaacagaaagaagaggagggggtctcttctccagttctccttgcttgcgcctcccgtctgcgtgcgtgcgtgcgatcgacgcagaggtgcgcgcgggcgctcgcaccaccccgatccgatggccttcatgcgctcccactcaaatgcatcttccggcatgggagttgctcctaacattagggagacatttgtcgagctccaaatgaagaaagcattccgatatgtcatcttcaaaatcgaagagaagcaaaagcaggtggttgtggagaagacaggggctactactgaaagctatgatgattttttggcctctctcccagagaatgactgccgatatgcgctctatgattttgattttgttactggggagaacgtgcagaaaagcaagattttcttcattgcctggtccccatcgacatcccgcatccgtgctaagatgctgtactccacctcaaaggaccgcatcaagcacgagctcgacgggttccactatgagatccaggcgaccgacccatcagaggtggacattgaggttctccgggagcgggctcactgaagctggttcgcctttgaagggacctgtggagggccgtgaaccttcggtcagatgcaaatttctattatcaaatgatgaagctcccgccgtggtatttgttaataagttcctgtaagcatatcatttagtcgtgatgcatgactctagcctggtgaagcgttattgaagctgtatcagtcggtatgaggtttggttgtcgagcctgtaaaacgaagcaagattcgcaaacttgttatattgtggtattgatgatactggattactggatgtggcctgtgagattgtctgcgatgagcggatgatggattggtctgggtcttggtgctggaccgtccctgtggagttgctcggggatttgcgtctgatcggcctgggtggtctggcgaccgttttgatctgaatgcactgtattctggtagaatattaacttgatgctaatgaacgcctgcttcccagggtttccctccaaacagggtcttcggacgggcgaaatccaatggtgcaatttttaagcccggggttcctcccggcaattttggaaaataaaaacaaattaatgtggagcacaggcttaaaacaagagggccg

SEQ ID NO: 5843 - DNA, 884 bp, Panicum virgatum
agcgcacagcaactcgcataaataaaaaatagaaaaaagaaaacccccgcagccacagaggaagaataatccattcgccttgcttgcgcctcccgtctgcgtgcgatcgacgcagagaaggcgcgggcgctcaacgccaccgccaccctccggctccgatccgatggccttcatgcgctcgcactcaaatgcatcttccggcatgggagttgctcctaacatcagggagacattcgtcgagcttcagatgaagaaggcattccgatatgttatcttcaaaatcgaggaaaagcaaaagcaggtggttgttgagaagaccggtgctactactgaaagctatgatgactttttggcctccctcccagaaaatgattgcagatacgctctgtatgattttgatttcgtcactggggagaatgtgcagaaaagcaagatatttttcattgcctggtccccatcgacttcccgcattcgtgcaaagatgctgtactccacctccaaggaccgcatcaagcatgagcttgatgggttccactacgagatccaggcaaccgacccatcagaggtggacatcgaagtcctcagggagcgggctcactgaagctggtttacctatgaagggacctgtggagggccttggaacttcagccagattcaaattctatattcaatgatgctcctgccatggtatttgttaataagttcatgtaagcatatgatttagtcgtgatgcgtgactctagctggtgaagcgctatcgaaggtctttctgtatgagatcttgagcctgtaaacgaagcaatttgcaaactcatggtattgtggtaatgatactggttactggaagtactggttgtggattatttggaaataccctggttggt

SEQ ID NO: 5844 - DNA, 894 bp, Panicum virgatum
ctcgcatatataaaaaaaaatagaaaaaggaaaacccccgcagccacagagccagaggaagaataatccattcgccttgcttgggcctcccgtctgcgtgcgatcgacgcagagaggcgcgggcgctcaacgccaccgccaccgccaccctccggctccgatccgatggccttcatgcggtcgcactcaaatgcatcttccggcatgggagttgctcctaacatcagggagacattcgttgagcttcagatgaagaaggcattccgatatgttatcttcaaaattgaggaaaagcaaaagcaggtggttgtcgagaagactggcgctactactgaaagctatgatgactttttggcctccctcccagaaaatgactgcagatacgctctgtatgattttgacttcgtcacgggggagaacgtgcagaaaagcaagatatttttcattgcctggtccccgtcgacttcccgcattcgtgcgaagatgctgtactccacctccaaggaccgcatcaagcatgagctcgatgggttccactacgagatccaagcaaccgacccgtcagaggtggacattgaagtcctcagggagcgggctcactgaagctggtttacctatgaagggacctgtggagggccttggaacttcagccagattcaaattctatattcaaagatgctcctgccatggtatttgttaataagttcatgtaagcatatgatttagtcgtgatgcgtgactctagctggtgaagcgctgtcgaaggtctttctgtatgagatcttgagcctgtaaacgaagcaatttgcaaactcatggtattgtggtaatgatactggttactggaactctggaagtactggttgtggattgtttggaaatgctctggttggt

SEQ ID NO: 5845 - DNA, 858 bp, Brachypodium distachyon
tttgatcttgttctcatgtgtgttcgttctttgcagtccaatgcatcctctgggatgggtgttgctcctaatatcagggagacattccttgagctccaaatgaagaaagcatttcgttatgttatcttcaaaatcgaggaaaagcaaaagcaggtcattgtggagaagacaggagctacaactgagagttatgatgattttctggcatctctcccagaaaatgactgcagatatgccctgtatgattttgactttgttactggggagaatgtgcagaaaagcaagattttcttcattgccaggtccccagcaacgtcccgcatccgtgctaagatgctgtactccacctccaaggaccgcatcaagcatgaacttgatgggtttcactacgagatccaggcaaccgacccgactgaggtggagctccaagtcctccgggatagggctcattagtgccgattggtgataatctgtgggcttcagtcggatgcagattcatgctagccgtgatgctgttgccaccactttattgttaataagtatatccatcaaggtttcctgtaaaacgtatcatttagctgtgctccgtggttctctagcagatgaagtgttatctgggatttatctgtgcggtgttctgagcctgtaaactcaggaagtattgtgatattgttactggattgctgggtgagtgggtgtggaatctactaaattgcccccattgtgtcggcataacatgtcgtggcataacttgaccttccactgttcgcagtccacacactgtcttttgctctgtcataccaactcgagatttatggttcttgacagtttgctcgaatgttttactcctttccttca

SEQ ID NO: 5846 - DNA, 733 bp, Triticum aestivum
ggccttcatgcgctcccactcaaatgcatcttccggcatgggagttgctcctaacattagggagacatttgtcgagctccaaatgaagaaggcataccgatatgtcatcttcaaaatcgaagagaagcagaagcaggtggttgtggagaagacaggggctactactgaaagctatgatgactttttggcctctctcccagagaatgactgccgatatgctctctatgattttgattttgttactggggagaacgtgcagaaaagcaagattttcttcattgcctggtccccatcgacatcccgcatccgtgctaagatgctgtactccacctcaaaggaccgcatcaagcacgagctcgacgggttccactacgagatccaggcgaccgacccgacagaggtggacattgaggttctccgggagcgggctcactgaagctggttcgcctttgaagggacctgtggagggccgtgaaccttcggtcagatgcaaactctattatgaaatgatgaagctcccaccgtggtatttgttaataagttcctgtaagcatatcatttagtcgcgatgcatgactctagctggtgaagcgttattgaaagctgtatcggtatgaggtttggttgtcgatactgtaaacgaagcaagatttgcaaacttgttatattgtggtattgattatactggattactggctgtggcctgtgggttgttgagaaaaaaaaaaaaaaa

SEQ ID NO: 5847 - DNA, 991 bp, Setaria italica
cccagcgagccaactcgcataaaaaagaaaagagaaggaaaggaaaacccccgcagcaacagaagaagaataatcccttctccttgcttgcgcctcccgtctgcgtgcgcgcgtgcgatcgacgcagagaggcgcgggcgctcaccgccgcccaccccccggctccgatccgatggccttcatgcgctcccactcaaatgcatcttccggcatgggagttgctcctaacatcagggagacatttgttgagcttcagatgaagaaggcattccgatatgttatcttcaaaattgaggaaaagcaaaagcaggtggttgtggagaagacgggcgctactactgaaagctatgatgattttttggcctctctcccagaaaatgactgcagatatgctctgtatgatttcgactttgtcactggggagaatgtgcagaaaagcaagatctttttcattgcctggtccccatcgacatcccgcattcgtgcgaagatgctgtacgccacctccaaggaccgcatgaagcatgagcttgatgggttccactacgagatccaggcaaccgacccaaccgagatggacatcgaggtcctccgggagcgggctcactgaagctggtttacctatgaagggacctgtggagggccttgaaccttcagccagattcaaattctatcatcaatgatgctcctgccgtggtattgttaataagttcctgtaagcatatcatttagtcgtgatgcatgactctagctggtgaaacgctatcgaagctctatccgtatgagatcttgagcctgtaacgaagcaacatgtgcaaactcatatattgtggtaatgatactggattgatggttgtggattgttcggaaatgcccttgttggtctgaacttgttaccgacttgtgctgatcacacctggttctgggtttctgacccttcagggcaaattgttagtaaatgccattgtgatggaattgggacttgtttttc

SEQ ID NO: 5848 - DNA, 858 bp, Zea mays
cagccaacaggacagtaggggctcccttctccagttctccttgcttgcgtcttcccggtcccgtctgcgtgcgtgcgatcgacgcagaggcgcgggcgctcgcaccaagccgatccgatggccttcatgcgctcccgctcaaatgcatcttctggcatgggagttgctcctaacattagggagacgtttgtcgagctccaaatgaagaagacattccgatatgttatcttcaaaatcgaagaaaagcaaaagcaggtagttgtggagaagacaggggccactactgaaagctatgatgattttctggcctctctcccagagaatgactgccgatatgcgctgtatgattttgattttgtcaccggggagaatgtgcagaaaagcaagattttcttcattgcctggtccccgtcgacatcccgcatccgtgccaagatgctttactccacctcgaaggaccgcatcaagtatgagctcgacgggttccactacgagatccaggcgaccgacccatccgaggcggacattgaggttctgcgggagcgggctcactgaagctggttcgccttcgaagaagggacctgtggagggctgtgaaccttttggtcagatgcaaattctattaccaatgatgaaagctcccgccttggtatttgttattaagttcctgtaagcatgtcgtttaggcgcgatgcgtgactctagctggtgaagcgttatcaaagctgtatctgtaagagttttggttgtcgagcctgtaaacgaagcaaggtttgcgaacttgttatattgtggtattgatggtactggattactggctgtgggttgctgggaatgcctctgttggtctggtatgtg

SEQ ID NO: 5849 - DNA, 572 bp, Eragrostis curvula
  misc_feature (106)..(106): n is a, c, g, or t
  misc_feature (116)..(116): n is a, c, g, or t
  misc_feature (155)..(155): n is a, c, g, or t
  misc_feature (158)..(158): n is a, c, g, or t
  misc_feature (170)..(170): n is a, c, g, or t
  misc_feature (173)..(173): n is a, c, g, or t
  misc_feature (317)..(317): n is a, c, g, or t
  misc_feature (362)..(362): n is a, c, g, or t
  misc_feature (396)..(397): n is a, c, g, or t
  misc_feature (411)..(411): n is a, c, g, or t
  misc_feature (413)..(413): n is a, c, g, or t
  misc_feature (420)..(420): n is a, c, g, or t
agggagagaataatctctcctcctcgcgtctcgtcttcctcttgcttgcgccccccggctgcgtgcgatcgaagcggaggcgcgcgcgcgcgagcgggcggacgcngactcctccnaccccgatggccttcatgcgcacccactccaatgcctcntcnggcatgggagtngcncctaacatcagggacacattccacgagcttcagatgaagaaggctttccgttatgttatcttcaaaattgaggaaaaacaaaagcaagtggttgtggagaagactggggctactactgaaagctatgatgactttttggcctgnctcccagaaaatgactgcagatatgccatctatgattttgacttngttactggggagaatgtgcagaaaagcaagattnncttcattgcctggncnccatcgncatcccggattcgtgctaagatgctgtactccacctccaaggaccgcatcaagcaggaacttgatgggtttcactacaagatccaggccaccgacccatcagaggtggaccttgaagtgctccgggagcgggctcactgaggctgattgccc

SEQ ID NO: 5850 - DNA, 859 bp, Zea mays
gaaataacactgcacaattctatgcagtcaaatgcatcttccagcatgggagttgctcttaaaattagagagacgtttgtcgagctccaaatgaagaaggcattccgatatgttatcttcaaaatcgaagaaaagcaaaagcaggtagttgtggagaagacgggggcgactactaaaaactatgatgattttctggcctctctcctggagaatgactgccgatatgcgttgtatgattttgattttgttactagggagaatgtgcagaaaagtaagattttcttcattgcctggtccccgtcgacatcccgcatccgtgctaagatgctctactcgacctcgaaggaccgcatcaagtatgagctcgacgggttccactacgagatccaggcgaccgacccatccgaggcggacattgaggttctgcgggagcgggctcactgaagctggttcgccttcgaagaagaagggacctgtggagggccatgaaccttttggttagatgcaaatcctattaccaatgatgaaagctcccaccttggtatttgttattaagtttctgtaagcatgtcgtttaggcgcgacacgtgactctagctggtgaagcgttatcaaagctgtatctgtatgagctttggttgtcgagcctataaacgaagcaaggtttgcgtacttgttatattatggtattgatggtactggattactggctgtgggttgctgggaatgcctctgttggtctggtatgtgggcgtggttgttgttcgaccaggaatgggccctgttggtttggacgtccgaatctgtggatagactggtgttaatcaaacgaatgctattgtgatgctggagactggtt

SEQ ID NO: 5851 - DNA, 567 bp, Hordeum vulgare
cagtcatcagcgctctactgccctccgaaaaatagagaacagctaccggatgaatgatcttcccccgtccgagagcgatcgacgcggaaccgccgtccacactatgccccgaccccatggcctttatgcgcacctgctccaatgcatcctgtggcatgggagttgctcctgatatcagggagacattcctggagcttcatatgaacaacgcatttccgtatgttatcttcaagatagaagaaaaggataggctggttgttgtggagaagacaggggctacaactgagagccgtgaggatttcctggcttgtctcccagagaacgactgcagatatgcgcatgatgattttgactatgatactgggcagaatgtgcagaaaagcaagatgttcttcattgactggtcccctgacacatccggcatccgagccaacatgctggactacacctacaaggaccggatcaagcaagagctgaacgggttccactacgagatccaggcaactgacccgaccgaagtggagctcgacatgcttcgtgaccgggcgcactatggcgtgtcgatgt

SEQ ID NO: 5852 - DNA, 884 bp, Zea mays
ataacactgcacaattctatgcagtcaaatgcatcttccggcatgggagttgctcctaacattagggagacgtttgtcgagctccaaatgaagaagacattccgatatgttatcttcaaaatcgaagaaaagcaaaagcaggtagttgtggagaagatggggcgactactgaaagctatgatgattttctggcctctctgccggagaatgactgccgatatgcgctatatgattttgattttattactagggagaatgtgcagaaaagtaagattttcttcattgcctggcccccaacaccgtcgacatcccacatccgtgctaagatgttgtactcgacctcgaaggaccgtatcaagtatgagctcgacaggttccactacgagatccaggcgaccgacccatccgaggtggacattgaggttctgtgggagcgggctcactgaagttggttcgcctttgaagaagaagggacctatctatggagggtcgtgaaccttttggtcagatgcaaatcctattaccaatgatgaaagctcccaccttggtatttattattaagttcctgtaagcatgtcgtttacgcgcgacacgtgactctagctagtgaagcgttatcaaagctgtatctgtaagagttttggttgtcgagcctgtaaacgaagcaaggtttgcgaacttgttatattgtggtattgatggtactggattactggttgtgggttgctgggaatgcctctattggtctggtatgtgggcgtggttgtggttcgaccggaaatgggccctgttggtttggacgtccgaatctgtggatagactggtgttaatcaaacgaatgctattgtgatgctggagactggtttggagtaagctttgtccgt

SEQ ID NO: 5853 - DNA, 1375 bp, Secale cereale
gcgcgcgccagacctaggtttcggacgttgtccgccttttgcttgtgggtaacatttttagcggaggataataaacaccagcgaacccagcccgccgtttggatatttcgccgttgccttctgttctgcctgcctcccaagaatggctctccccctcgttcgcctcctcctcccctcgctccccgcgtgccagccgccgctccgccaccccgagtactccgccccacctcgccacagccacgtctccttcgctgtctccgctgccgctcgctcctccggccaccgcttggcgttcgctgtctgtgctgctagcgcctcggtcgccccgacgcctgcggaaacggaggcggatgcggaggatgagcagcccgtggggccaaagacgcggcttatcgcgatgaacatcccgtgggatttcacgcccgacgatattcgcgttcttttcgagaagcaaggcaccgtcgtcgacgtggagctttcgatgcacagttccaaaaaaaacagaggattggcatttgtaaccatgggttcagaagaggaggctctttcagcactcaagaatctcaatttgtctactttgaacgatagaacgattaaggtggactttgcaaaacctaaaaagaagcaacctattgtgccgtcagctcctgttgataaaaatgttgtgtttgtggggaatttaacgtggagagtgagatcccgccatcttcgggagttatttgcctcaaccccaggtgtcgaatcagttgaagttatctttcataccaccacaccaaggcgatctgctggttatgcatttgtttccttttcctcaaaagaggaggcagaggctgctatttctaccttcaacggcaaggaattgatgggacgatccattaacgtgatgttcaaagaagacactcccaaaaagaacagatcttctgattcagaggaagagaagttggaggaggcagaatcatctgaggagagtgatagctaagaatggattgttgtgagaagcgcagaaagaagttcagtgagctgcgcaggactatactgctctttttccaggttaccaagctcctggttgatttcactcgtcccataactcttgaattgtcaaatactgtgtttctaagttctcttgatatggatgacatctggaggttagcttgatgctagagtacatgaaatctgtgagctgttgaaatctgagttaatttattgtaggatataagtgtcaatgatgaatttgagtgcaacctgctgacgaatctgactatatttttctttcttctgtaatgaaatgtattgtactgtaacattttttggccgcttctgtaatggccatgtgtaatttaacaaaaaaaaaaaaaactagaagactcgcaacgga

SEQ ID NO: 5854 - DNA, 1308 bp, Hordeum vulgare
tttcgccgttgccttgtcttctgcctgcctcgcaacaatggctctccccctcgttcgcctcctcctcccctcgctccccgcgtgccagccgccgctccgccaccccgagtactccgccccacctcgccacagccacatctcctttgctgtccccgctgccgcccgctcctccggccaccgcttggcgttctctgtctgcgctgctagcgcctcggtcgccccggcgtctgtggaaaccgaggcggatgcggaggatgaggagcccgtggggccgaagacgcggcttatcgcgatgaacatcccgtgggatgtcacgcccgacgacattcgcgtccttttcgagaagcaaggcaccgtcgtcgacgtggagctttcgatgcacagttccaaaaaaaacagaggattggcatttgtaaccatgggttcagaagaggaggctctttcagcactcaagaatctcaatttgtctactttgaacgatagaacgattaaggtggactttgcaaaacctaaaaagaagcaacctgctgtgccatcagctcctgtggagaaaaatgttgtgtttgtggggaatttaacatggagagtgagatcccgtcatcttcgggagttatttgcctcaaccccaggtgtccaatcagttgaagttatctttcataccaccacaccaaggcgatctgctggttatggatttgtttccttttcctcaaaagaggaggcagaggctgctatttctaccttcaatggcaaggaattgatgggacgatccattaacgtgatgttcaaagaggacactcccaaaaagaacaaatcttctgattcagaggaagggaagttggaagaggcagaatcatctgaagacagtgatagctaagaatcgattgttgtgagaaccacagaaagaaattcaatgagttgatctgcaggactataatgctctcttccaggttaccaagctcctggttgatttcactcgcgtcccataactcttgaattgtcaaatactgtgttctgtaagccccccctgaaatggatgacattgggagtgttagcttgatgctagagtacatgaaatctgtgagctgttgaaatctgagttaatttattgtagaatataagtgttaatgattaatttgagagcaacctgctgacgaatttgactatttttttcttctgtaatgaaagttgttgtaatattttttggccgcttctgtagtgtatcatttgtatttcaggatcaggctaccaatttagcctcattaggtacccatccctgctaatgaagttcacataagaacactgaaatac

SEQ ID NO: 5855 - DNA, 1108 bp, Pseudoroegneria spicata
  misc_feature (29)..(32): n is a, c, g, or t
  misc_feature (544)..(544): n is a, c, g, or t
  misc_feature (1089)..(1091): n is a, c, g, or t
cctcgccacagccacgtctccttcgctgnnnncgctgccgcccgctcctccggccaccgcttggcgttcgctgtctgcactgctagcgcctcggtcgccccggcgcctgcggaaacggaggcggatgcggaggatgagcagcccgtggggccgaagacgcggcttatcgcgatgaacatcccgtgggatttcacgcccgacgacattcgcgttcttttcgagaagcaaggcaccgtcgtcgacgtggagctttcgatgcacagttccaaaaaaaacagaggattggcatttgtaaccatgggttcagaagaggaggctctttcagcactcaagaatctcaatttgtctattttgaatgatagaacgattaaggtggactttgcaaaacctaaaaagaagcaacctattgtgccgtcagctcctgtggagaaaaatgttgtgtttgtggggaatttaacgtggagagtgagatcccgccatcttcgggagttatttgcctcaaccccaggtgtccaatcagttgaagttatctttcataccaccncaccaaggcgatctgctggttatgcatttgtttccttttcctcgaaagaggaggcagaggctgctatttctaccttcaatggcaaggaattgatgggacgatccattaacgtgatgttcaaagaagacactcccaaaaagaacaaattttttgattcagaggaagagaagttggaggaggcagaatcatctgaggagagtgatagctaagaatggattgttgtgagaaccacagaaagaagttcaatgagctgcaggactataatgctctttttccaggttaccaagctcctggttgatttcactcgtcccataactcttgaattgtcaaatactgtgttctgtaagttctcctcttgacatggatgacatttggaggttagcttgatgctagagtacatgaaatctgtgagctgttgaaatttgagttaatttattgtagaatataagtgttaatgatgaatttgagtgcaacctgctgacgaatctgactatttttttccttctgtaatgaaatttattgtactgtaacattttttggccgannntgtaatggccatgtgta

SEQ ID NO: 5856 - DNA, 984 bp, Festuca arundinacea
  misc_feature (446)..(446): n is a, c, g, or t
  misc_feature (471)..(471): n is a, c, g, or t
  misc_feature (496)..(496): n is a, c, g, or t
  misc_feature (604)..(605): n is a, c, g, or t
  misc_feature (635)..(635): n is a, c, g, or t
ggcacgaggcttctctgttctgcctgcctccccaacaatggctctccccctcgttcgcctcctcctcccctcgctccccgcgtgccagccgccgctccgccttcccgagcactccgctcctcctcgccacggccacgtctccctcgctctctccaccgccgcccgctgctccgtccaccgcgcggcgttcgctgtctgtgcttctagcgcctcggtcgccccagcgccggcgcctgcggagacagaggcggaggacgagcagcccacggggccgaagacgcggctcatcgcgatgaacatcccttgggacttcacgcccgacgacatgcgggctctcttcgagaagcaaggcaccgttgtcgacgtggagctttcgatgtacagctccaaaaagaacagaggattggcatttataaccatgggttccgaagaggaggctatctcancactcaacaatctcaatttgtctantttaaacgacagaacaattaaggtngactttgcaaaacctaaaaagaagcaacctattgtgccgtcagctcccgtggaaaaaaatgttgtatttgtgggaaatttaatgtggagagtgagatcccgtcatctnngggagttatttgcctcaactccaggtgtcnaatcagttgaagttatcttccataccaccactccaaggcgatcagctggttatgcatttgtttccttttcctcgaaagaggaggcagaggctgctattgctacctttaatggccaggaactgatgggacgatccatcaatgtgatgttcaaagaagacaccaccaaaaagagtaaatcttctgcttcagaggaagagaagttggaggtagaatcatctgaggagagtgacagctaagaagaattgttctgagaaccacagaatgaagtttaatgagttcatcttgtaggaccatgatgctctttttcacgttggcaagctcctggtcgatttcactcgttcagcaactc

SEQ ID NO: 5857 - DNA, 1296 bp, Avena sativa
gcactgcgctccacctcgccacggccacgtatccttcgctctctccaccgccccccgctcctccggccaccgcgcggcgttcgctgtctgtgcttctagcgcttcggtcgccccggcgccggcgcctgcggagacagaggcggaggcggaggatgagcagcccactgggccgaagacgcggctcatcgcgatgaacatcccgtgggacttcacgccggacgacatgcgcgctctcttcgagaagcaaggcaccgtcgtcgacgtggagctttcgatgtacagttccaaaaagaacagaggattggcatttataaccatgggttcagaagaggaggctctttcagcactcaacaatctcaatttgtctactttgaacgatagaacaattaaggtggacttcgcaaaacctaaaaagaagcaacctagtgtaccttcagctcccgtggaaaaaaatgttgtgttcgtgggaaatttaatgtggagagtgagatcacgtcatcttcgggagttatttgcctcaactccaggtgtccaatcagttgaagttatcttccataccaccacgcctaggcgatctgctggttatgcatttgtttccttttcctcgaaagaggaggcagaggctgctattgctacctttaatggccaggaattgatgggacgatcaattaacgtgatgttcaaagaagacaatgccaaaaagaacaaatcttctgcttcagaagaagagacattggaggtagagtcatctgaggacagtgatagctaagaatagattgttctgagcaccgcagagagaagtttaatgagttcatctacagctacaggactacagtgctctttttcaggttaccaatctcctggtcgattccacttgttcagcaactcttgagtcttcaaatactgcgttttgtaagttctccacctgatctggatgacatttggaggttatcttgatgctaggaatacagaaagtccgtgagcggtcgacatccgagttaatttagaatacaagtgttaatgaaagcgcaacctgctgacggatgtgaccatatttattgtccttctgcaatgaaatatgtttagacatgtagcagttttggcggggttttctttatggataaaaatgagcatatcctcatccaccacctgctaagttaatgtggcacatgcacttccaaatttcatgaccagaccgattataaggtagttggtgcaaccttgaacatgcttgttgacttgttaacgtttgagaaagatcactggtatatctcgtcttttttttcttcaaaaaaa

SEQ ID NO: 5858 - DNA, 4755 bp, Hordeum vulgare
caaatatccagtcttgcttgggaaccttccctcgctccagccagagatcctccccgggcggggatccccgtcgtccggccccggcgcggcggcctctcccgtccgcgtctcccacgcgttttcttgcttccggcgagggaggggaggggaggggaggggataaggcgggggcagcgcgcctggatgagctgcttctcctgcttcggcccggccctcgaggcggaggccggcaagccggggcccgatgccaaggacgcgcgaggcaaggacggcgccgccccggatcgcgccggatcagataaattgaaactgcagggtgggtcagaccctaagaatactcatctaaccatccctagggatgggaatagccaaaacattgcggcacagattttcacttttcgtgagcttgctgccgccactaagaacttcagacaagattgcatgctgggtgagggaggtttcggacgtgtatataaaggtcgcctcgagaatggccaggctgttgctgtgaagcaacttgatcgtaacggtctccaaggaaatagagaattccttgttgaggtcctcatgctcagtctcttgcatcacactaaccttgtcaatctaattggttattgtgctgatggtgaccaacgcctccttgtttatgagtttatgccactgggctcattagaagatcacttgcatgatgtgccacctgagaaggaacctcttgactggaacacacggatgaagatagctgcgggtgcagccaagggcttagagcatcttcatgacaaggctagccctcctgttatttaccgggatttcaagtcatcaaacattcttcttggtgaagggtttcacccgaagctgtccgactttggccttgcaaaacttggtccagttggtgacaagactcatgtttcaacacgtgtaatgggaacatacggatactgtgccccggaatatgcaatgactgggcagctcacagtgaaatcggatgtctatagcttcggcgtcgttttccttgaactgatcacagggcgtaaagcaatcgacaacaccaaaccccagggggagcaaaacctggtggcatgggcccgtccactcttcaaggatcgcaggaaatttcctaagatggctgacccaatgcttcaaggccggttccccatgaggggcctgtatcaggctttagctgttgctgctatgtgcttgcaagagcaagccacaactcgtcctcatataggagatgttgtcactgctctctcatatctagcgtctcagacatatgatccaaatgccccaactcaacatactcggagcaattcatcgacgcctagggccaggaatatgggtgggcggaacagcgaacagcgcaatggacgctcaccaaaccatcattctcccaggacatcaaagcatggtggggaggttagccggactagttctaatggcggtgattctggtcggagatcaggattggatgacatggacatggcaggatcacaggcaggtagtccagctcagacaggaaggaagagagacaccccaaggactgctgacaggcaccgcgccgtcgtggacgctaaaatgtggggggagaactccagagagcggaagcgaccgaacggccatggtagcttcgatagtacaaatgagtaaagtggacggctctctttcacggcgtcgctctagcagggggtcgacgagtttgctcatcagcaccagacgggccaggtttaggaacacggtgtttgttccagttctgtcccgttgtctgtgaataaaggcttttcgtgccatcagcactgcctcacggttgctttatctgtaagttgttgcagttgacatgccttctccgggcggcgtccattccttgcgaatgtgattgtgtcatgcgctcatgtcctttagagttcaggagcctacatagatgcagctggaaatgtagggaaggggattggaagaccgtcgaagccgcagagctgagtctgtcgggccctttctcttttatctgcagttacacaatgtcgacaagtatgctccgctgcaccttgtgttctggaactgattgtgcaaccgtgccgggcagtttcttctgatggatgcgacttctcaggtttggttggggataggatagagattacccatgtttcgttcgtacagctcctattgtttttgtgtcgagtcgcgggatggtcatttatttgtattagctttgacgcacttcttctgcttgtatcttattagtgcgaacatggtttagcatgcagcaaaagtatcaggttattcagaatttcagagcccatatattattgttctcattttgttcctagaagtggaaaccatgttgttcatgtatatactgctatttttgtcagtcatgcacccatcttgcaaatcagctcaaaacattttcaaaccgatctcatttgattgtgggagtgacagacaatgaatatcatggaaggaaacctcagtcaggggtgacaggtgagcaaagaaaacagaagtactccctccgtcctacaatataaaagcatttttgacagtatagtagtgtcaaaaacgctcttatattatgggatggatggactattttgtactggaaaatgcttcacattaccaaacgaacatttacagagcatcttccagtccagcgtggtggtgttatcccatctctgaatgcagaaacaatgaagcagagaggggagtgacaggctgcgtgcgtggtgctactatgataatacataacttctttacatgggtttcactgggcgctgaagcagagaggggagtgacaggctgcggtggtggtgttatcccatctctgaatgcagaaacaatgaagcagagaggggagtgacaggctgcgtgcgtggtgctactatgataatacataacttctttacatgggtttcactgggcgctgtgtcttcttcgctcgtccgacagaccgggctgctgttgctgcagcttcgacaagacgacgtttccatggaggtccatcttgtaccgcagctcggcgtagtccataacgatcctgcagctgctccaggcctccgcgtgcatgctcacgcccaggtaggttatgtggtcttgaatgctgttgccgctcacagatctggagaaggcgaaccatgtcaagcaagagcaagaaccttgttaacaaagagcagaaatcatgcagtgcgacagaggcagaattcacaggacatggtggtggagggagagagggagggacctgctgcatgcagggtcttctccggagtcgtcgcagatcttctcaaccgtgtataccaggctcccgagcccgacattgtggacccatacctgaaggaaggagaggaacagcatggcattatgcagtggaacctgatggaatgggtatacaggggaaggttggattcccagatagaatggcactatgtgtaagtatttttcaagccattatctatttgcatgtagtgagtatgaatgaacaggtgtaaattggtgtcaacgcaagtggagataacaagcatgccacagagtggagcatacctctcttggaaagtgatggtaggtcttctgcgggaagaacgagaagtacggtggcaggtgagggacgatatcatttgcgtgagtaactcgaatggcatgaggcaagtatctcttgaagtaagaagcaaaagcagcattgccgacgcgaggttgcccaaatgtcatcagctttacatcatctaacccgtagttcacctaaaacagaacaaacattccccgattagctgtggaagtcaaaccatcaggaaagaagtggcaaataactaactgctcagacatttagaagtatgcatagactgaaaacaatcatcgggtaaagtatgcaacaggtccatataactcgcaatgagaaaatttagcaggttgagttggggaaacctattttctatgcaatataatgtaacaggggaagctcaatgttaatgtatttaagaccagggcaggtcagtactcacaacaagatcaagtgcacaaaatgaagccatagctgcccccattgaatgccctgtgaccatgattggaacatctccatgcaatttccgagtcttctgaataccgctgacaattccatcgcgtatggttgtgttgtgataagcagagtaaaatcctcggtgtacctacacgaatcaagcattactacagattttggttcgacacaattgcattaactatatgttttagcaaaatgctcaccatcgcttctggcatgccagggtaatcaagatcaagttgtttccatagcaagtcctctatccagttctggatgctgataaattggaggatgaatatggttgaggagttataaaggatattgacagccttttaaatgactattacatgcatatggagaaaaatatgcaaactaaaggaacaaacaggtcaaggtttataaattcttacacaagagtgaaatcgaaataaataaaatctgcctcttcctagtgataaacatctgaatcaaaacataaattattatttttacaaccatagaaaacaaggtgcacactagttacctgttttcttgagttcctctaaacacaacgatgacagcattaatatcactggcaaaaccaacatatgcctgcttgttcataatgaaaaaaaaaatgatcaacctaggcacttagcaggcggtagaaatatagagataaacagactgaaggcaagtagggatgaacctctaagcagttctccacatctacgatgatgtccatcatctcaaacccctgg

SEQ ID NO: 5859 - DNA, 2137 bp, Hordeum vulgare
tgcttctcctgcttcggcccggcccttgaggcggaggccggcaagcgcggggcccgatgccaaggacgcgcgaggcaaggacggcgccgccccggatcgcgccggatcagataaattgaaactgcagggtgggtcagaccctaagaatactcatctaaccatccctagggatgggaatagccaaaacattgcggcacagattttcacttttcgtgagcttgctgccgccactaagaacttcagacaagattgcatgctgggtgagggaggtttcggacgtgtatataaaggtcgcctcgagaatggccaggctgttgctgtgaagcaacttgatcgtaacggtctccaaggaaatagagaattccttgttgaggtcctcatgctcagtctcttgcatcacactaaccttgtcaatctaattggttattgtgctgatggtgaccaacgcctccttgtttatgagtttatgccactgggctcattagaagatcacttgcatgatgtgccacctgagaaggaacctcttgactggaacacacggatgaagatagctgcgggtgcagccaagggcttagagcatcttcatgacaaggctagccctcctgttatttaccgggatttcaagtcatcaaacattcttcttggtgaagggtttcacccgaagctgtccgactttggccttgcaaaacttggtccagttggtgacaagactcatgtttcaacacgtgtaatgggaacatacggatactgtgccccggaatatgcaatgactgggcagctcacagtgaaatcggatgtctatagcttcggcgtcgttttccttgaactgatcacagggcgcaaagcaatcgacaacaccaaaccccagggggagcaaaacctggtggcatgggcccgtccactcttcaaggatcgcaggaaatttcctaagatggctgacccaatgcttcaaggccggttccccatgaggggcctgtatcaggctttagctgttgctgctatgtgcttgcaagagcaagccacaactcgtcctcatataggagatgttgtcactgctctctcatacctagcgtctcagacatatgatccaaatgccccaactcaacatactcggagcaattcatcgacgcctagggccaggaatatgggtgggcggaacagcgaacagcgcaatggacgctcgccaaaccatcattctcccaggacatcaaagcatggtggggaggttagccggactagttctaatggcggtgattctggtcggagatcaggattggatgacatggacatggcaggatcacaggcaggtagtccagctcagacaggaaggaagagagacaccccaaggactgctgacaggcaccgcgccgtcgtggacgctaaaatgtggggggagaactccagagagcggaagcgaccgaacggccatggtagcttcgatagtacaaatgagtaaagtggacggctctctttcacggcgtcgctctagcagggggtcgacgagtttgctcatcagcaccagacgggccaggtttaggaacacggtgtttgttccagttctgtcccgttgtctgtgaataaaggcttttcgtgccatcagcactgcctcacggttgctttatctgtaagttgttgcagttgacatgccttctccgggcggcgtccattcctcgcgaatgtgattgtgtcatgcgctcatgtcctttagagttcaggagcctacatagatgcagctggaaatgtagggaaggggattggaagaccgtcgaagccgcagagctgagtctgtcgggccctttctcttttatctgcagttacacaatgtcgacaagtatgctccgctgcaccttgtgttctggaactgattgtgcaaccgtgccgggcagtttcttctgatggatgcgatttctcaggtttggttggggataggatagagattacccatgtttcgttcgtacagctcctattgtttttgtgtcgagtcgcgggatggtcatttatttgtattagctttgacgcacttcttctgcttgtatcttattagtgcgaacatggtttagcatgcagcaaaagtatcaggttattcagaatttcagagcccatatattattgttctcattttgttcctagaagtgga

SEQ ID NO: 5860 - DNA, 6259 bp, Oryza sativa
taaaagaggaggtggcaggcaggagaggaaagtggatgtgcccccaaagatcccctcccctctcctctcttcttcactctgccccagagctgacttttgcttcttactcctactactactacttgtctttctctttgcaccctagcctcatgttcttcttcttcctcctctcctcctccttgtagcttccacccccaccccactccctcccacccccgccgcccgcttaaaagtccgattttggggaggttcgtgcgctcagatcggggagggggtccaacaccccatttcgtcttgctgcggcggggagggtggtgaagcgaaagtttggattttttttttttggggggaaggttctgcttggatgagctgcttcctgtgcttcggatcggcccaggagggggaggccaagaagcccggggctgactccaaggacgcgcgcaaggacggctccgcggatcgcggggtgtccagggtcggatcagataaatcgagatcacatggtggattagactctaagaaggacgttgtcatccaaagagatgggaacaaccaaaatattgctgcacagacgttcacttttcgtgagcttgctgccgccaccaagaacttcagacaagattgcctattgggagagggaggttttggccgtgtatataaaggacgcctggagactgggcaggctgttgctgtgaagcaacttgatcgcaatggtcttcaaggaaatagagaattcctggttgaggtcctcatgctcagtcttctacatcacactaacctggtcaatctaattggctattgtgctgatggtgaccagcgccttcttgtctatgagtttatgccattgggatcactggaagaccatttgcatgatttgccacctgataaggaacctcttgactggaacacacggatgaagatagctgcaggtgcagccaagggcttagaatacctacatgacaaggcgagcccgccagttatttatcgtgacttcaaatcatcaaacattcttcttggtgaaggatttcaccccaagctgtctgattttggtcttgcaaaacttggtccagttggtgacaagacccatgtttcaacacgtgtgatgggaacttatggctactgtgccccagaatatgcaatgactgggcagctcacagtgaaatccgatgtctatagctttggtgttgttttcctcgaactgattacagggcgcaaagcaattgacaacacaaagccacagggggagcaaaacctagtggcatgggctcgtccactattcaaggaccgcaggaagttccctaaaatggctgatccaatgctccaaggtcgcttccctatgaggggtctgtatcaggctttagctgttgctgccatgtgtttacaagagcaagctaccactcgccctcatataggagatgttgtcactgcactctcatatctagcttctcagacatatgatccaaatgcccctgttcaacatagcaggagcaattcgtcaactcctagggccagaaatctagctgggtggaatgaagatcgacgcagtgtgcgctcgccaaatcatcattctccagatctgaggagggaagctgccaggtcatcaagagcagaggttagcaggactagttctaccggtgattctggccggagatcaggattggatgatttagacatgacagggtcgcagatgggtagtccagctcaaacaggaagaaaaagagagactccaaggactgctgatagacagcgtgctattgcagaggccaaaacgtggggggagaattctcgagaacggaagcatccgaatggtcatggcagctttgatagtacaaatgagtaaatcggagggtttttgtttcagaaatcagtctacggaggatgaatctgctcatctacacgaaacggatccaatcaagtaacattgcattggttccacacggttctttatctgtgaataagacccttgttcttccccggccatcagtgccactccatggtcactatgtcattgctatttgacatgtcttagatctcccggcgtccattccttgtgaatgtgattgtgtcatgtgtctttagagttcggctccgttcgggagccgataaaattcagctggaaaggtaggcaacagaagagaggaacctgatgaatgccttttcttggttacctgatcgccatgctcatgctcagcaccacctgtgttacgaatgttacagcatttcaggtttggctacctgaggacgtgaagttacttccgatgagaattcaggtttggagataggacacattacctgtgtttcgtacagttttttcttttcttttcttttcttttgagttgcctgagcacttatttatttgtattagcttactgtacctctcatgtatcttagcgtgaacgttgttcgacatgcagcaagaggtttttatctgtatcaagctatttcagagccaatgtgttgtacatgtaatattttgcagtagtagtcaatcatgtgttcatcttgcaaagccaaatgagctgtatcaaaccaaatctgattggtgtggcagtgctcttcgcattgttgctatctgcagaagctatctgatgcttagctgctactctctcctttccatattataagatgtttggattttattcttggtcaaatttcttcaagtttgaccaagtaaaacgtctgataaataatatgaaacggaggtagtactgtaatgcaacaacgcaagtacttgtgaactgaacaatgcttcacattaccaaaccacatttacagcaagcatctcccaatcctcttctgacgcatgaacaattttgacacatatgagcatcagagagaggaacacacgtgtagtagtactgtacaataatataacacatctaagctaccattatactaaatctgttccattttgaatcattggtcactgtgttctaggtcacctgacaaacccagatgctttgacaagacgatgttgccattgatgtccatccggtaacgcagcttgctgtagtccatgacgatcctgcaggagctccatgcctcggcgtgcatgctgacgccgagatagtatatgtggtcttgcacgctgctcccactcacagacctgaaaggtgaaagtggcgtcaaagaaagagagagatcatgaagagctcatcaggttcagggtcaccaaaaggagaggagatgatgaggtgtggttcaccccccatctgcttgtgtttgtgcatatggagaagaagaagaagaggggtagtacctgcagcacgatgggtcttcaccagaatcatcacagatctgctctaccgagtacactaggcttcctagtccgacgttatgaacccatacctgaagaaaaagagcatcttttttagataaaaaaaagaggatttttattgaactcggtcgattacgtcaaggtgatagaaccatattgaaaaggagcactcagcactgcatcatgcattgggaaattatggaaatgcaagatgagtaagattgcatgtgtactgtctgtaagcaattgatctcgtcagaaaatgcatatatggttcaaggtattgagtttcaggtaagcatattagacaggtagagtgtatcgtacctctcttgggaaatgatggtaggtcttctgtgggaagaatgagaagtatggtggcaggtgaggcacgatatcatgaccatgggtaactcggattgcgtgaggcaagtatttcttgaaaaaggaagcaaaagcagcattgccaatccgaggctgcccaaatgtcattagcttcacaccatctagcccatagttcacctaaaagaaaacagaattcctgtttagctgtagaggcaaaacctggaggtaagtaagcaggggcggaaccacgcctggggcaacttgggctggagccccaggcgtgggaaaaaatttaacggtcttatacctgaaaattcaacagatattttgatccttccatgtctcagccctacgcgtatactccagcctgggacttagatcgattctatccctcactaccattacttggaggcctattttaattgccgaactctctagtccatactactactatacttctttggaccggcaaaggaggcatgtatcccaacaattctacaaacaaaacctcattctatgatagcattaggtgatacatttgctaaatatgcctatctgtaggaacacctcgtgctctatcctacgaggtcgagaatatataatagcccacctaacgtactccctctattttataatataacaaatttttagttacgaatctggacaagtgttgaatccagacaattctatgttagattcgtaactaaaaattgctatattttgaaaacagagatattatataggaattttgggtagctttaggctgagttcttaagtgagtttgggctgaaaaaatgtcttatttatcatgtgcatgttttttgaattactaaatagtgtttctcatacaaaagttttcaatatagaagtttctctaaatatataaataaatatatattttaagtttataatagtcaatacttaatcaatcatacactaataagctttcttgtttctcgtaccgctaaaaatatcattctaacatcggaaatgaccatagcttagtatttagttttgagccctaggcttcgagaaatcctggctccgccactgtaagtaaggaatggaaacctacaaaccgaccatagatgtagattgctactacataactgaaaattagtactaggctggcaaaggaaagatgaaagatcggctccaagaagataaaaaggctcgacagcttcgcagactatttgtccatttgaccagaatataaagtattatcatggaagaaggtgtttccaaattccaacaaaataaaacacttctctcttttatgtgaagtcagatgtggagaataaaatgtttataatttattgcacaaaactaagcagagaaacaatatgtggtgtaattttctaaacagaaagtgatataggagctaaaagtgaacactattgaattcagttaagatgcagtactcacaacaagatcaagtgcacaaaacgaagccatagctccacccattgaatgccctgttaccatgatcggaacatctccaaacaattttcgagtcttctgaataccgctgacaactccatctcgcattgttgtgttatgataagcagaataaaatcctcggtgtacctatggtgaggtggagcacaaaatgaatttggtctgccaatgttgcaactcataatgctgaagctaacattgctcaccattgcttcaggcataccagggtagtcaagatcaagttgtttccatagcaagtcctctatccagttctgaatgctgcgaaattgaaggatcagtacagattaaagtaagtactttattaaattaagagagtacctagaatagaggtcaagtactttataaatgtgaagtatgcacacatgaaaccaaaatacacaacagaatacccttataagtaatagaacgatcaaaatcaaaaagaaatttcagtaagcaagcaaaacgaaacagacgataattacctgttctcttgagttcctctaaatacaactactatagcattgatatcacttgcaaaacctacatatgcctgcacatttgttaaaatattatcaacatacaagatgctactagagacatgaagataagtgttatgatgtacacaggcagaaacgaacctgcaagcagttctccacatctacgatgatatccatcatttcaaacccctgggcatccaacaaatttacttcaatcatccgtgccaagaattgcaggaagttgcccaaaagtcaaacaaaatcatgtcatggcaaacagaaagtataccagtgataaaggattacctcaatcaggtcaccacatctagcacatgtccatgtaaacaattgtgtcaggtcagcagtatagatctgcaggacatcctctatgttaaactccaaaatattagaaaacgtgttgcaaacggttgatccatattgaaggatgatctaacattcaggaataacttagataaagaaaaaggtgaatgaacatacagctgaagcatattccacaagtgtcttggcaagctttgggttatatatggtggtagagggatggcgttgaatgacctgaatttcttttttcaccaaatgtaaaagaaccagcatcagccttttaaaaaggaaaacaatgaacatctagcgaagcaacattcaacatgctggatacatgtag

SEQ ID NO: 5861 - DNA, 2257 bp, Setaria italica
atggccgtccttggccgcgcgttcacgtggcagcgcgccaaatcgccgatgcacccgtggagccgccccgcgcctccagttcttttatctcgccgcaggagaggaagcggacgaagccggcgacagcgaccccgcacggcattcccgttccgtggaaatatcggcgtggcccagccaggagctcgagatggcgtcgtcgtttcctccgcggcgccaacgcttcaaaagccccgcaaaccttcccccccccccccccccccccccccgttcgttccttggtggcgcgtcttcttcccggggggtggtgctcggatgagctgcttcgtgtgcttcggatcggcccaggatggggaggccaagaagcaagtcgccgacgccaaggacccgcgcaaggacgggccgccggatcgcggggtggccagggtcggatcagataaatctagatcacagggtggatcagactctaaggatataattatccatagggatgggaacagtcaaaatattgcagcacagactttcacttttcgtgaacttgctgctgccacgaagaatttcaggcaagattgcctattaggggaaggaggttttggccgtgtatataaaggacgtttggagaatgggcaggctgttgctgtgaagcaacttgatcgtaatggtctccaaggaaatagggaatttctggttgaggttctcatgctcagtctcttacatcacactaacctggtcaatctaattggctattgtgctgacggtgaccaacgccttcttgtttatgagtttatgccattggggtcactagaagatcatctgcatgatctgccaaaagataaagaagctcttgattggaacacacggatgaagatagccgctggtgctgctaagggcttagagtaccttcacgacaaagccagccctcctgttatttacagggatttcaagtcgtcaaacattcttcttggagaaggatttcatccaaagctatctgattttggccttgcaaaacttggtccggttggtgacaagacacacgtttcaacacgtgtgatgggtacatatggctactgtgccccggaatatgcaatgactgggcagctcacagttaagtccgatgtgtatagcttcggtgttgtgttccttgaactgatcacagggcgcaaagcaattgacaacagcaagccccagggggagcaaaacctagtggcatgggctcgtccactgttcaaggaccgaaggaaatttcctaaaatggctgatcctaagcttcagggccgcttccccatgaggggtctatatcaggccctagctgttgctgccatgtgtttgcaagagcaagctgccacacgccctcatatcggggatgtcgtcactgccctctcatatcttgcttctcaggcatatgacccaaatgcccctgttcaacacagccggagcaattcatctacccccagggccagaaaccctgcagggtggaacgacgaccagcgcagtgtgcggtcaccaaatcatcattctccagacctgcggaggagagacgctgccagggcatcaaagtatggagcagaggttagccgaactagctctactggcggttctggtcggcggtcaggattggatgagatggatatgacaggttcacaaatgggtagtccagctcaaactggaaggagaagagaaactccaagggctgctgctgacaggcagcgtgctatcgcggaggccaaaatgtggggggaatattcgagagagcgatcaaatggccatggtagcttcgatagcacaaatgagtaaagccgacaggtttctttccaggcatcacttcagaagaggggtgagttcgagttcacccaccatcaccaaaagggatccggtctcggatacatgtcaacggttccgctcggtcccattatctgtgaataaggcgtttcttgctcttttctgcatcctcctggcgtccattcgttgcgaatgtgattgtgttacatgcttgggtggagcagaggagcctgtaggattcagttgaagagggtagaattgagaagagagggtgcacagagtcgcatttgacgagtgcgttttttgcggttaaatgatataagcatatgcatgctcgatttcttctatgttgtgaatgtataactcggtgtcaggcttggctgcctgagcttctttgtgaattccggtttggatatgtataacaggctatgatgtttagtacagctgtttttccccccctggatcccttctcctttcattc

SEQ ID NO: 5862 - DNA, 2248 bp, Panicum virgatum
gacttttgctccgacccccctccctctctctctaccacgcttgtttgccttcgctttgccccccagcctcatgttcttcctctccttcgtgtagcttccatcccactcccaccgccgcccccccgctcgagccgaatccccaattggggcccaggcccccctcccgccggcttcaaaatccggttctggggaggcttgctgccgcagatcggggatacgctccctgttcattcggtccgccggtgtccgcgtcccccgtccttcctaggtgctgtcttcttccgggggtggtgcttggatgagctgcttcgtgtgcttcgaatcggcccacgatggggaggccgacaagcccgccgccgccgacgccaaggactcgcgcaaggacgggccgccggatcgcggggtggtcagggtcggatcagataaatctagatcacagggtggatcagactctaagaaggacatcattatccatagagatgggaacagtcaaaatattgcagcacagactttcacttttcgtgaacttgctgctgccacaaagaacttcaggcaagattgcttattaggggagggaggttttggccgtgtatataaaggacgtttggagaatgggcaggctgttgctgtgaagcaacttgatcgtaatggtcttcaaggaaatagggaatttctggttgaggttctcatgctcagtctcttacatcacactaacctggtcaatctaattggctactgtgctgacggtgaccaacgccttcttgtttacgagtttatgccattggggtcactagaagatcatctgcatgatctgccaccagataaagaagctcttgattggaacacacggatgaagatagccgcaggtgctgccaagggcttagagtaccttcacgacaaggcaagccctcctgttatttacagggatttcaagtcgtcaaacattcttcttggagaaggatttcacccaaagctatcggactttggccttgcaaaactaggtccagttggtgacaagacacatgtttcaacacgtgtgatgggtacatatggctactgtgccccagaatatgcaatgactgggcagctcacagttaagtccgatgtttatagctttggtgttgtgttccttgaactcatcacagggcgcaaagcaattgacaataccaggccccagggggagcaaaacctagtggcatgggctcgtccactgtttaaggaccgcaggaagttccctaaaatggctgatccaatgcttcagggccgcttccccatgaggggtctatatcaagcattagctgttgctgccatgtgtttgcaagagcaaggtaccacacgccctcatataggggatgttgtcactgccctctcatatcttgcttctcaggcatatgacccaaatgcccctgttcaacacagtcggagcaattcatctacccccagggccagaaatcctgctgggtggaatgatgaccaacgcaacatgcgctccccaaaccgccactctccagacctgcggaggagagaagctgccagggcatcaaagtatggagcagaggttagcaggactagctctactggcgattccggtcgacgatcgggattggatgacttggacatgacaggttcacaagtgggtagtccagctcaaactggaaggagaagagaaactcctagggccgctgacaggcagtgtgctattgcggaggccaaaatgtggggggaatattcaagagagcgatcaaatggtcatggcagctttgacagcacaaatgagtaaaacctgcaggttttgttttaggcatcacttcagcagaggggtgagttgagttcactcatcagcaccaaaggggatcctgtctcggtcccggatacattgtcatcggtcccattgtctgtgaataaggcttttcttgctctttcatgcatcctcctggcgtccgttccttgcgaatgtgatcgtgttatatgcttcggtggagctgaggaccctgtaggattcagttggagagggtagatttgaggggggggggggggcacagagtcgcaccggacgagtgcctttttttgcggttatatcatataagcacgcatgctcatcaatttcttctatgttgtgaatgtataactcggtgtcaagtttcgctgcctgagaaggccgtgaagcttgtttgtgaattcttgtttggatatgtgggacaggctacggtgtctagtacagctgttttttccccttcagggttctgcc

SEQ ID NO: 5863 - DNA, 2262 bp, Zea mays
gtccctctccctccagggcgccgcgcctccctccctttccctaatcccccgctaccgcggcgcttccccctcccccgctccctccacaattaggccagtagcccgcttgcagctgcggcgtcggtcgggaagaggccttgctccagtcccgcagatcgggggaggcgctcccccccgcccccgcctcgtcagctcggccgcttccccgccgccggtccctcccggaggcgccagcgtcgccgatgagctgcttcgtctgcttcgggtcggcggcgcacgacggggagtccaggaagccccccgccgcgggcgccggcaaagacgtcccgccggatcgcgcggtggtccgcgtcggatcagacaaatcaagatcacagggtggaccagaatctaagaaggacctgattatacatagggatgggaatagtcaaaatattgcagcacatactttcacttttcgtgaacttgctgcagccactaagaatttcaggcaagattgccttttaggggagggaggttttggtcgtgtatataaaggacgcttggagaatggacaggctgttgctgtgaagcaacttgatcgtaatggcctccaaggaaatagggaatttctggttgaggttctcatgctcagtctcttacatcacactaacctggtcaatctaattggctactgtgctgacggtgaccaacgccttcttgtttatgagtttatgccattggggtcactagaagatcatctgcatgatctgccaccagataaagaacctctagactggaacacacggatgaagatagctgcaggtgcagctaagggcttagagtaccttcacgacaagacgagtcctcctgttatttaccgggattttaagtcgtcaaacattcttcttggagaaggatttcatccgaagctatcagactttggccttgcaaaacttggcccggttggtgacaagacccatgtttcaacacgtgtgatgggtacatatggctactgtgccccagaatatgcaatgactgggcagctcacagttaaatccgatgtgtatagctttggagtcgtgttccttgaacttatcacagggcgcaaagcaattgacaacaccaagacccaaggggagcaaaacctagtggcatgggctcgtccactgttcaaggaccgcaggaaattccctaaaatggctgatccaatgcttcagggccgcttccctatgaggggtctatatcaggccttagctgttgctgccatgtgcttgcaagagcaagctgctacacgccctcacatcggggatgttgtcactgctctctcatatctcgcttctcaggcttatgacccaaacgcccctgttcaacacagccggagcaacgcatctacccccaggtccagaaaccctgctgcatggaacggtgatcagcgcagtgtgcgctcgcctaatcatcaccattctccagacccgcggcggagggaccctgccagggcatccaagtatggagcagaggttagcaggactagctctgccagcgattctggccggcggtcaggtctggatgacatggacccgaccgggtcgcaagtgggaagcccagctcaaaccggaagaagaagagaagctccaagggccaccgacagacagcgcgctgtcggagaggccaggatgtggggggagaactcaagggagcgaacgaatggccatggtagcttcgacagcacgcatgagtgaagccgtcaggttccactccaggcatcatttcagacgaacgatgggtttgagcccactcatcggcaccggtcggatctgatcttgggacatggcgtggtgccgcccggtccgggtgtctgtgaataaggctctctctcttgccctcatgtggcgaatgcaattctcctcatgtccatcccttccgaaggcgatgcttccggcgacggggagcctgaggagcctcctgtaggattcagtcagaggtagacaggtcagtgaagaaaaaggatgcgcggagtcacattggcgagtgtgtgtttttggtggctagagctgagtattttcagctgcatgtatccttttttgtgtatgggtaagagcaaccgtgtcaggtttggctacctgagagacctttgaagctagccagctgctgttgctgctgcttctgcttcttcctccccccttttgggagttcagagctggaatgtaggtaggataggcgatgatgttgagtacagcaactgttttacacccttccatgttgaacagtatacatatatat

SEQ ID NO: 5864 - DNA, 2490 bp, Brachypodium distachyon
ctaccacgagctgacttttgggcgtcggacctcggacatcctgttctctctcctgtcccgttctttccatacttctctccctgtctctccccccaaattcacccgacccaccgcttccaaatcccatccaatccctctacatcctccaaagatcggatttcgggaaggcctccgcccccagatcggggagggatccccgtttgctctggtgggccggtctccgccgtccttttcttgatatttttctccgagggaggttcttggatggggtgcctcccgtgcttcgggtcaggcggcaagggggaggccaagaagggccgcgctggggcgcgcaaggacgttccaccggatcggcgcggcaccctggccggatcagataaatcaaaaccgcaaggtggattggattctaagaaggatgcagtcatcccaagggagggtaacaatcaacatattgcagcacacactttcacttttcgtgagcttgctgctgctactaagaacttcagacaggattgccttttaggcgagggtggttttggacgcgtatataaagggcgtttggacaattcgcaggttgttgcagttaagcaacttgatcgcaatggccttcaaggaaacagagagtttttggttgaggtccttatgctcagtctgctgcaccatgataacctggttaacctaattggatactgtgctgatggggatcaacgtcttcttgtatatgaatacatgccattgggatcacttgaggatcatttgcacgatattccacctgaaaaggaacctcttgactggaatacacgtatgaagattgctgctggtgcagccaagggactagaatacttgcatgacaaggcaagtcctcctgttatttaccgggatttcaagtcgtcaaacattcttctaggcgaggggtttcatccaaagttatctgactttggtctggcaaaacttggccctgttggtgataagactcatgtttcaacacgtgttatgggaacatatggctattgtgccccagagtatgcaatgacaggacagcttacagttaaatctgatgtgtatagctttggtgttgtgttccttgagctgattactggccgcaaagcaattgacaacaccaaaccgcacggagaacaaaacttagtggcctgggctcgtcctctgttcaaagaccgccggaaatttccgaaaatggctgatccgtcgctccagggccgctttcccatgaggggcctgtatcaagctttagccgttgctgcaatgtgtttgcaagagcaagctgccacccgtccttttataggagatgtggtcactgccctttcatatcttgcttctcaggcatatgatccaaatgcgcccactcaacataatcggagcaatgcatctacccccagagccagagaccgtggtagtgggaacagtgaccagcggcgtatcaactcgccaaatcaccattccccagatgtgaggaggcgagaagctacaacaacatcaaagtatgaagcagaggttagcaggaatagttctggtggtggttctggtcgacggtcggccttggatgatggggatgcaacaggttcacaagtgggtagtcccgctcatgcaggaaggaggagggaagcttcaaggacctctgacaggcagcgtgctattgcagaggccaagacatggggggagaattcaagagagaggaagtggccaaacgctcggggcagcttcgatagtacaaatgagtagaactctggagcaaaaagtcagagtcaccattctagaaaagatttgagttgcttgccagtaccaaacaggtcgcaatttaggaacacggggtcaggtcataatttaggaatatggggttcgatcttggttccgtggtctatgtgaatagaacatttcttctttcctgtcctgcccattaccactgcttcataggttctctcttccatacaacattatcaccataatcaccatcgacacgcctatttgtggtgtccgttcctcatgaatgtgatcatgcaattgcgattatatcatcatgacgacaaacaccatttgtctggaaagttaaaatgtggagtaaactattctaaagacgaggagcacatgatgttatcgagggtatcttctgttgctgttacaagttgcatgcatgatggatcatgggtatcagcggcttgatgtgatgatttttctttccttaagggtttgtaccgaggtgttttacctgtgtttcatacatatttcatgtcacattttggtgttgagttgtcagaacacatcctttgctttatcccttctagcaagccgttatgccccttccagttgagcagtgcattcttaattttgagttgtatgctcaaatgttcttcctgttctctgtttttgagctttcttccagtttatgttatacttgtaaaccaattgcgcatgaagaacaaaaacagttgattcttttgcaagtgcatctcaactaatatttttctcatgaaa

SEQ ID NO: 5865 - DNA, 2428 bp, Brachypodium distachyon
ggacatcctgttctctctcctgtcccgttctttccatacttctctccctgtctctccccccaaattcacccgacccaccgcttccaaatcccatccaatccctctacatcctccaaagatcggatttcgggaaggcctccgcccccagatcggggagggatccccgtttgctctggtgggccggtctccgccgtccttttcttgatatttttctccgagggaggttcttggatggggtgcctcccgtgcttcgggtcaggcggcaagggggaggccaagaagggccgcgctggggcgcgcaaggacgttccaccggatcggcgcggcaccctggccggatcagataaatcaaaaccgcaaggtggattggattctaagaaggatgcagtcatcccaagggagggtaacaatcaacatattgcagcacacactttcacttttcgtgagcttgctgctgctactaagaacttcagacaggattgccttttaggcgagggtggttttggacgcgtatataaagggcgtttggacaattcgcaggttgttgcagttaagcaacttgatcgcaatggccttcaaggaaacagagagtttttggttgaggtccttatgctcagtctgctgcaccatgataacctggttaacctaattggatactgtgctgatggggatcaacgtcttcttgtatatgaatacatgccattgggatcacttgaggatcatttgcacgatattccacctgaaaaggaacctcttgactggaatacacgtatgaagattgctgctggtgcagccaagggactagaatacttgcatgacaaggcaagtcctcctgttatttaccgggatttcaagtcgtcaaacattcttctaggcgaggggtttcatccaaagttatctgactttggtctggcaaaacttggccctgttggtgataagactcatgtttcaacacgtgttatgggaacatatggctattgtgccccagagtatgcaatgacaggacagcttacagttaaatctgatgtgtatagctttggtgttgtgttccttgagctgattactggccgcaaagcaattgacaacaccaaaccgcacggagaacaaaacttagtggcctgggctcgtcctctgttcaaagaccgccggaaatttccgaaaatggctgatccgtcgctccagggccgctttcccatgaggggcctgtatcaagctttagccgttgctgcaatgtgtttgcaagagcaagctgccacccgtccttttataggagatgtggtcactgccctttcatatcttgcttctcaggcatatgatccaaatgcgcccactcaacataatcggagcaatgcatctacccccagagccagagaccgtggtagtgggaacagtgaccagcggcgtatcaactcgccaaatcaccattccccagatgtgaggaggcgagaagctacaacaacatcaaagtatgaagcagaggttagcaggaatagttctggtggtggttctggtcgacggtcggccttggatgatggggatgcaacaggttcacaagtgggtagtcccgctcatgcaggaaggaggagggaagcttcaaggacctctgacaggcagcgtgctattgcagaggccaagacatggggggagaattcaagagagaggaagtggccaaacgctcggggcagcttcgatagtacaaatgagtagaactctggagcaaaaagtcagagtcaccattctagaaaagatttgagttgcttgccagtaccaaacaggtcgcaatttaggaacacggggtcaggtcataatttaggaatatggggttcgatcttggttccgtggtctatgtgaatagaacatttcttctttcctgtcctgcccattaccactgcttcataggttctctcttccatacaacattatcaccataatcaccatcgacacgcctatttgtggtgtccgttcctcatgaatgtgatcatgcaattgcgattatatcatcatgacgacaaacaccatttgtctggaaagttaaaatgtggagtaaactattctaaagacgaggagcacatgatgttatcgagggtatcttctgttgctgttacaagttgcatgcatgatggatcatgggtatcagcggcttgatgtgatgatttttctttccttaagggtttgtaccgaggtgttttacctgtgtttcatacatatttcatgtcacattttggtgttgagttgtcagaacacatcctttgctttatcccttctagcaagccgttatgccccttccagttgagcagtgcattcttaattttgagttgtatgctcaaatgttcttcctgttctctgtttttgagctttcttccagtttatgttatacttgtaaaccaattgcgcatgaagaacaaaaacagttgattcttttgcaagt

SEQ ID NO: 5866 - DNA, 2506 bp, Triticum aestivum
ccatgagctgacttttgccctcggacctcggacatcctgttctctctcctcgctttctctctcttgcccgttctcccaatagttctgtccctgtccctcccccaaattccccgacccaccgctcccaaatcccatccaaatccctccacatcctccaaggatcggattttcggagggcctccgcccccagatcggggagggatccccgtttcctctggtgggtcggtccccgccgtccttttcttgatctttttcctggaggggaggttcttggatggggtgcctgccgtgcttcgggtcgagcggcaagggggagcctgccaagaagggcggcgcgcggaaggacgttccgtcggatcgccgcgccacgggggtcggatcagataaaccaaaaccacaaggtttattggattctaagaaggatacagttatcccaagggagggaaacaatcaacatattgcagcacacacattcacttttcgtgagcttgctgctgccactaagaacttcagacaggattgcctattgggcgagggaggtttcggccgtgtatatagaggacgtttggacaatggacaggctgttgcagttaagcaacttgatcgcaatggacttcaaggcaacagagagtttctggttgaggtccttatgctcagtctattgcaccacgataacttggtaaacctaattggatactgtgctgatggggatcaacgtcttcttgtatatgaatatatgccgctaggatcacttgaggatcatttgcacgacattccacctgaaaaggaacctcttgactggaatacacggatgaagattgctgctggtgctgccaagggattagaatacttgcatgacaaggcaagtcctcctgttatttaccgggatttcaagtcgtcaaacattcttcttggcgaagagtttcatccaaagctatctgactttggccttgcaaaacttggccctgttggtgataagacccatgtttcaacacgtgttatgggaacttatggctactgtgccccagagtatgcaatgactggacagcttacagttaaatctgatgtgtatagctttggtgttgtgttccttgaactgattactggtcgtaaagcaattgacaacaccaaaccacatggagagcaaaacctagtggcgtgggctcgtcctctgttcaaagaccgcagaaaatttccaaaaatggctgatccggcacttcagggccgctttcctatgaggggtctgtatcaagctttagccgttgctgcaatgtgtttgcaagagcaagctgccactcggcctttcataggagatgtggtcactgctctttcatatcttgcttctcaggcgtatgatccaaatgcacccactcaacatagtcggagcaatgcatctacccccagagccagagaccgtggtagtgtgaacggcgaccagcggcgtatccggtcgccaaatcaccattctccagatctgaggagaaaagaagccacaacaacatcgaagtatgaagccgaggttagcaggaatagttctggtggtggttctggtagacgatcaggcttggatgatagggatgtgacaggttcacaacagggtagtcctgctcaggcaggaaagaggagggaaacttcaaggacctctgagaggcagcgtgctattgcagaggctaagacatggggtgagaattctagagagaggaaatggccaaatgctcggggcagcttcgatagtacaaatgaatagaactctggagcagaaggtctgagtcatcattctagaaagaggatgagtcgcaagccagtaccaagcaggggacagtttagggacatggggttcgatttcggttccatgtttaatgtgaatagagctttccttttctttcccggccatgaccactgcttcatagtttctctcttccccacaaatatcaccaccgcaatcaccatcgacacgcctattcgtggcgtccgttcctcgtgaatgtgatcatgcagatgtgccttcatcatcatatggcacgaacgacatctggctggaaagttagtaagcaaaggggagaactgttctgtggacatgatccaatcaaatgagcctcttctgttgcctgcatgcatgatgggtatcacagttgttccgagcgtagagctttattgtgaagtctgagtaccgagggatgtgatgatttttctttcctcgagggtttgtaccgagggttttacccgtgttccatacgtctgtattgtgacatttttgtttgtatcgagttgtcagaacacatcctttgatttatctcttctggcaaagccgttgtgccccttccatctaagctgtgcaaaatatttaggaagcttgttagctatatgctcaaatttattttttgtttcctgtttctgagctttctgtccatagcagataagcccagggttgttttttggtccaactttgctcaaactaattatatttgtcgatggaacatttttttttcccacaccaaaaaaaaaa

SEQ ID NO: 5867 - DNA, 2474 bp, Triticum aestivum
ctcactcctcagtcggccatgagctgacttttgccctcggacctcagacatcctgttctctctcctcgctttctctctcttgcccgttctcccaatagttctgtccctgtccctccccccaaattccccgacccaccgctcccaaatcccatccaaatccctccacatcctccaaagatcggattttcagagggcctccgcccccagatcggggagggatccccgtttcctctggtgggtcggtccccgccgtccttttcttgatctttttcctggaggggaggttcttggatggggtgcctgccgtgcttcgggtcgagcggcaagggggagcctgccaagaagggcggcgcgcggaaggacgttccgtcggatcgccgcgccactggggtcggatcagataaaccaaaaccacaaggtttattggactcgaaggatgcagttatcccaagggagggaaacaatcaacatattgcagcacacacattcacttttcgtgagcttgctgctgccactaagaacttcagacaggattgcctattgggcgagggaggtttcggccgtgtatatagaggacgtttggacaatggacaggctgttgcagttaagcaacttgatcgcaatggacttcaaggcaacagagagtttctggttgaggtccttatgctcagtctattgcaccacgataacttggtaaacctaattggatactgtgctgatggggatcaacgtcttcttgtatatgaatatatgccgctaggatcacttgaggatcatttgcacgacattccacctgaaaaggaacctcttgactggaatacacggatgaagattgctgctggtgctgccaagggattagaatacttgcatgacaaggcaagtcctcctgttatttaccgggatttcaagtcgtcaaacattcttcttggcgaagagtttcatccaaagctatctgactttggccttgcaaaacttggccctgtcggtgataaaacccatgtttcaactcgtgttatgggaacttatggctactgtgccccagagtatgcaatgactggacagcttacagttaaatctgatgtgtatagctttggtgttgtgttccttgaactgattactggtcgtaaagcaattgacaacaccaaaccacatggagagcaaaacctagtggcgtgggctcgtcctctgttcaaagaccgcagaaaatttccaaaaatggctgatccggcacttcagggccgctttcctatgaggggtctgtatcaagctttagccgttgctgcaatgtgtttgcaagagcaagctgccactcggcctttcataggagatgtggtcactgctctttcatatcttgcttctcaggcgtatgatccaaatgcacccactcaacatagtcggagcaatgcatctacccccagagccagagaccgtggtagtgtgaacggcgaccagcggcgtatccggtcgccaaatcaccattctccagatctgaggagaaaagaagccacaacaacatcgaagtatgaagccgaggttagcaggaatagttctggtggtggttctggtagacgatcaggcttggatgatagggatgtgacaggttcacaacagggtagtcctgctcaggcaggaaagaggagggaaacttcaaggacctctgagaggcagcgtgctattgcagaggctaagacatggggtgagaattctagagagaggaaatggccgaatgctcggggcagcttcgatagtacaaatgagtagaactctggagcagaaggtctgagtcatcattctagaaagaggatgagtcgcaagccagtaccaagcaggggacagtttagggacatggggttcgatttcggttccatgtttaatgtgaatagagctttccttttctttcccggccatcaccgctgcttcatagtttctctcttccacacaaatatcaccactgcaatcaccatcgacacgcctattcctggcgtccgttcctcgtgaatgtgatcatgcagatgtgccttcatcatcatggcatgaacgacatctggctggaaagttagtaagcaaaggggagaactgttctgaggaggacacgatccaatcaaatgagcctcttctgttgcctgcatgcatgacgggtatcacagttgttccgagcgtagagctttattgtgaagtctgagtaccgagggatgtgatgatttttctttcctcgagggtttgtaccgaggggttttacccatgttccatacgtctgtattgtgacatttttgtttgtattgagttgtcagaacacatcctttgatttatctcttctggcaaagccgttgtgccccttccatctaagctgtgcaaaatatttaggaagcttgttagctatatgctcaaatttatttttgtttcctgtttctgagctttctgtccatagcagataagcccagggttgttttctggtccaactttgctcaaactaa

SEQ ID NO: 5868 - DNA, 2528 bp, Secale cereale
gactccgacacgagacgcggaccaacgcccagcacacgacacgccccccgccccgccgcgaaccagccggaggaacccgccggagcccggccgagcgcgcggcctaatggcgctcgcgctctccacgctccccttcgccccctccaccccggcgtccgcctcgttccgcccccgcggggcccacttcgccccctcccccgccggcaggagcgtcggcgtcggcctccccctcgcgtgcgcggcgccgcggaagaaccgcgggcggaggcggcgcggcgggggcctggtggtgttcgcggcggccgactactacgcgacgctcggcgtgccgcgctccgcgaccatcaaggacatcaaggccgcctaccggaagctcgcgcgccagtatcatcctgatgttaataaggaacctggagcaaccgacaagttcaaagagataagctcagcctatgaggttctgtcagatgataagaagagggcgttgtatgaccaatatggtgaagctggggttaagagtgcggttgggggcaacgctggagcttatacatcgaatccatttgatctttttgagacgttcttcggagcaagcatgggtggtggtggtggtggcttttctggtatggaccagagcgcatttaggacacgcagaaggagcactgctgctcagggtgaagacatcagatatgatgtgattctagggttctcagaggcaatatttggaacagaaaaagatatcatattatcccatttggagacttgtgatgcctgtagcggttctggttcaaaggttggctcaaaggcaaaaatatgctccacatgtggtgggcgagggcaagtaatgcgaaccgagcagacaccatttggtctcttctcccaggtttctatttgccccacttgtgtaggagagggcgaggtcatttcagagtattgcaggaaatgctctggagaggggcgcgttcgtgtcagaaaagagatcaaagtaaaaatccctccaggagttagtaaaggtagcactcttcgtgtacgtggtgaaggtgatgcaggaccaaaaggagggcctcctggagatctttttgtttgccttgatgtagaggagccatctgatattaaaagggatggtatcaacttgtattcaactgtgtcgataagctacgttgaagctattttgggtacagttgagaaggtcagaactgttgagggaactagtgaacttcgaatacctccaggcacccaacctggtgatgtattggtcctagcgaagcaaggtgttccatcgttgaataggccatctatacgcggtgatcatctattcactgttaaggtctctatacccaaacgtataagtgggcgagaaaaggagttacttgaggaacttgcatcgttgaaaaatggtggttttgcccgtgcacctgtgaagccaaaacctgtacataaagagaatggaagccgtgctgctccagaagtatcagatcaacctgatgatggggaggttgactggttgaagaaactttctgattttgctggatccattgtcaacggggcatccaagtggctgaaggacaacctgtagcctgtaaatatttattgcacgacgcattctcttcaacaccagccatggtgttatccaatctgcaattcttcaattcatcgggattcgacgagctgttgcatcttttacgggctgtgaagtggcaacggagaggtttagtgtcaactaattttattgacgcggttcttattttgttttgagatacacttgtaaagcatgaattttgctgtagttgcactcttatttcctagagcatgtaacagtcgtcgagtcacgtccgctgatatcaagcttgatgaagcttacatcctttgtaaatacatatatttttccagtagagcatcaattggtacatcaggctatgcaagtgaatatccttctcgtcgctacaaattcagaataaacaggcatctgcatcgtcaagtgcaattttttttgcaatagaacacaagatattattctgttcttgcttacaagtcgtgttgagttgcaaaatgaaattaaataaaggcacatgatattatctgaacttgaaaggacgtacaagccctagtcctgtgtggaatattgtctgaactttgaagggtgtacaagcccagccctagtcctgtgtggaagtggagctgagcttgagcaagatgaggacggcggccgccatgggcaaggacaccatgagcagcgcctccacgatgttgggccgcgtgatgtcggggagcagcacgctgccgtacttcacggccgccgcgccgccgacggacccgagccccagcgtgaggaggtagccggagtcatcctgcgggattcgccccttgctctccggctccgcctcggcgccgctggtgtcgcgggacacgcgagcgcggccgccggcgcgtctcctcgccgagcgccggcagctcacgcggaagccgcgccctggcgaggctgcgccggggccggagacggtggcccgggatggcgcggccaccgcgcacgcgca

SEQ ID NO: 5869 - DNA, 2376 bp, Secale cereale
gcaggagcgtcggcgtcggcctccccctcgcgtgcgcggcgccgcggaagaaccgcgggcggaggcggcgcggcgggggcctggtggtgttcgcggcggccgactactacgcgacgctcggcgtgccccgctccgcgaccatcaaggacatcaaggccgcctaccggaagctcgcgcgccagtatcatcctgatgttaataaggaacctggagcaaccgacaagttcaaagagataagctcagcctatgaggttctgtcagatgataagaagagggcgttgtatgaccaatatggtgaagctggggttaagagtgcggttgggggcaacgctggagcttatacatcgaatccatttgatctttttgagacgttcttcggagcaagcatgggtggtggtggtggtggcttttctggtatggaccagagtgcatttaggacacgcagaaggagcactgctgctcagggtgaagacatcagatatgatgtgattctagggttctcagaggcaatatttggaacagaaaaagatatcatattatcccatttggagacttgtgatgcctgtagcggttctggttcaaaggttggctcaaaggcaaaaatatgctccacatgtggtgggcgagggcaagtaatgcgaaccgagcagacaccatttggtctcttctcccaggtttctatttgccccacttgtgtaggagagggcgaggtcatttcagagtattgcaggaaatgctctggagaggggcgtgttcgtgtcagaaaagagatcaaagtaaaaatccctccaggagttagtaaaggtagcactcttcgtgtacgtggtgaaggtgatgcaggaccaaaaggagggcctcctggagatctttttgtttgccttgatgtagaggagccatccgatattaaaagggatggtatcaacttgtattcaactgtgtcgataagctatgttgaagctattttgggtacagttgagaaggttagaactgttgagggaactagtgaacttcgaatacctccaggcacccaacctggtgatgtattggtcctagcgaagcaaggtgttccgtcgttgaataggccatctatacgcggtgatcatctattcactgttaaggtctctatacccaaacgtataagtgggcgagaaaaggagttacttgaggaacttgcatcgttgaaaaatggtggttttgcccgtgcacctgtgaagccaaaacctgtacataaagagaatggaagccgtgctgctccagaagtatcagatcaacctgatgatggggaggttgactggttgaagaaactttctgattttgctggatccattgtcaacggggcatccaagtggctgaaggacaacctgtagcctgtaaatatttattgcacgacgcattctcttcaacaccagccatggtgttatccaatctgcaattcttcaattcatcgggattcgacgagctgttgcatcttttacgggctgtgaagtggcaacggagaggtttagtgtcaactaattttattgacgcggtttttattttgttttgagatacccttgtaaagcatgaattttgctgtagtcgcactcttatttcctagagcatgcaacagtcgtcgagtcacggccgctgatatcaagctcgatgaagcttacatcctttgtaaatacatatatttttccagtagagcatcaattggtacatcaggctatgcaagtgaatatccttctcgtcgctacaaattcagaataaacaggcatctgcatcgtcaagtgcaatttttttttccaatagaacacaagatattattctgttcttgcttacaagtcgtgttgagttgcaaaatgaaattaaatgaaggcacatgatattatctgaacttgaaaggatgtacaagccctagtcctgtgtggaatgttgtctgaactttgaagggtgtacaagccctagtcctgtgtggaagtggagctgagcttgagcaagatgaggacggcggccgccatgggcaaggacaccatgagcagcgcctccacgatgttgggccgcgtgatgtcggggagcagcacgctgccgtacttcacggccgccgcgccgccgacggacccgagccccagcgtcaggaggtagccggagtcatcctgcgggattcgccccttgctgtccggctccgcctcggcgccgctggtgtcgcgggacacgcgagcgcggccgccggcgcgtctcctcgccgagcgccggcagctcacgcggaagccgcgccctggcgaggctgcgccggggccggagacggtggcccgggatggcgcggccaccgcgcacgcgcacgcacccgcacccgccatccacacgagcagggcgcgacaggaagcagagacagtc

SEQ ID NO: 5870 - DNA, 3958 bp, Brachypodium distachyon
acagccggggcccatcccattcacacatcgtcccttcccctgccatcgcagctgcacagctgtcttgcctcctgcgctcaggcgagacgcggaccaacgcccagcacacgcgcccgcgcccgcgggacaagcagggttctagaagggtgccgaccctcggggagaggcgctaatggcgctcgcgttctccacggtcccgttcgcgccctccaatccggcgccttcctcccgctctgccgccgccgccgctctccgccctcacggggtccacttcgccgccgccggtaggagcggcggcttagggatcccgctcgcctgcgcggcgccgagaaatcgtaggcagcggcgcggtgtccgcctggtggtgtgggcgtcggctgactactacgcaacgctgggcgtgcagcgctccgcgaacatcaaggacatcaaggccgcgtaccggaagctcgcgcgccagtatcatcctgatgtcaataaagaacctggcgcaactgacaagttcaaagagataagctcagcatatgaggtgctatcagatgagaagaaaagggcgttgtatgatcaatacggtgaagctggagttaagagtgcggttggaggatctgcgggagcttatacgagtaatccatttgatctgtttgagacattctttggagcaaacatgggtggcttttctggcatggaccagaatgcatttaggacacgcaggaggagcactactgttcagggtgaagacatcagatatgacgtgaacctggggttttcggaggcaatatttggaacagagaaagatatcatattatcccatttggagacttgtgatacttgtagtggttctggttcaaaggctggctcaaagacaagaatatgttccacatgtggtgggcgagggcaagtaatgcgaactgagcaaacaccatttggtctattctcccaggtttctatttgccccacttgcgcaggtgagggtgaggtcatttcagagtattgcaggaaatgctctggagaggggcgtgttcgtgtcagaaaggagatcaaagtaaaaattcctcctggagttagtaaaggtagcactctccgtgtacgcggtgaaggtgatgcaggaccaaaaggagggcctcctggagatctttttgtttgccttgacatagaagagccatcagatattaaaagggatggtatcaacttgtattcaactgtgtcgataagctacattgaagctattttgggtactgttgaaaaggtcagaactgttgatggaactagtgaacttcgaatacctccaggcacccaacctggtgatgtagtggtcctagcgaaacaaggtgtcccgtcgttgaataggccatctatacgtggtgatcatctattcactattaaggtcaatatacccaaacgtgtaagtggacgcgaaagggagttacttgaggagcttgcatcgttgactaatggtggttttgcccgtgcacctgtgaagccaaagcctatacatcaagagagtggaagcagtgttgctcaagaacaatcggatcaacctgctgaaggggagggtgactggtttcagaaacttacagattttgctggatccattgccagtggggcagccaagtggctgaaagacaacctgtagcctgtaaatatttactgcagaatgcattatcttcaacatcctggtgtcgaatctgcaaatcttcaattcatccgagatgttgcacgtgttttgttggagaggttcaacttttataggctgcaaagcggcagacggagagtttgagttctgttaactaattttattgacaccaattctatttttggcattccttgtaaagcatgagttttgcggtagttgcagtcattcccgggagcatgtaataggtctcggagccatggccgctgatattaaggactgaagctacaaccactgtaaatacatatatttttgctgtaagacatcttgatacaccaggcattggtttgttcgttaacctgaattcaaaatagacgggcaccctgtcgtaaagcttacaacagttcaatatctcagatgcatttttatttctcaacaaaaggaagcttccgtctcctgtcctccgtttgctgaggcataggccattgtcacaagtgcgttgctcgcactctattattttctgaatcgagcatattttgccctcatcttacaaggtacgagtaaaaaatggaacttaataaagacacaacatatcatccgaagcttacacaagacctcctgattctcatcctattcctccgtgtcgctcccactgagcttgagcaagatgaggacggcggctactacaggcagggacaccatgagcagcgcctgcacgatgttgggccgtgtgatgtcagggagcagcacgcttccgtactttatagccgccgcgccgccgacggatccgaggcccagtttccatagataactggagtcatcctggttataaatataacacatgaaaaggggaatcgattcagaaacaaagcaatcttcgcatgcatgaaccaagaatccactggtgggagtacagggagactgatgagtggatgacattagccgaaagccttcagttggtgcgtaccatggaagcatgaaaactatattcagttttgaatgaaatgtaggaggatgtgcgaatcggtagtgttctcgtggcactgaagtggagcttagggaatggctgctgaagactttgagcagaacattcgccgcttcagctatctatgctcgcttaatctagatttcgagcttggagaagcggatggatttgactgacctgcggggtttgccgctccttgcccggctccgcccccttggcggggctgcgggagcaacgagcgcgaccgatgctcctcgtcccacggggctcccgccggcagctcacgcgggagcgcggcggagcaacgccggaactggaggtggccgtcgcggaaggcgacgaggcaaccgcgatcgccatgggaacaacagatgagcttcacccacgcgtgcgcgccggtcttccgcgttatccagaaccgagacgcctcttctgatctcgcgggaagaaggggaaattccactttactcccctcgggcgaaattattctctcgaatcgagcggaccggagccgtccgtgaattcgaacccttataagggcatttccgcaagaaaagccaaccgcaacaaatcgaaggctctcttctcgcggtcgcgattcgcgaaggctcaggcggtctttctctcttcctctcctccggctgctgctaaggcatttggcatctgagctcaacagcaagcaaatggcaggtggcagggttgcacatgctaccctcaaggggccgagcgtggtgaaggagatcttcatcggattgaccctagggctggttgccggcggtatgtggaagatgcatcactggaacgagcagaggaagactcgatccttctacgacatgctggaaaaggggcagatcagcgtcgtcgtcaaggagtagttttgccatgctgaatccgaagttctgtatctaaagtcttctgttgttcccttttttgtcagtaatttccagtactctactctccgggcagcatgacaaagtgattgttgtggagattgtgacgaaaataagcaccaccatttgaaaaaattgtatcttgttgaatttgatctgtccttgttctttgacatctgaaatatgtccatttcatatctgtcatgaacaaactcaggggatttggatgtcttcttgctgacattaatattaatttagatttccttcggcgagtccgcgagtgagctcacccttttgattcaatgtttgctattattactatcatcatgcatgcatggatcaaagcagcataattctgaatataatgtttattttcttgcggggacagtataatgttcctttgacatattgaaggtgacaagacaggacgaaacagagctgcttcagaaggtg

SEQ ID NO: 5871 - DNA, 1905 bp, Brachypodium distachyon
gcgctaatggcgctcgcgttctccacggtcccgttcgcgccctccaatccggcgccttcctcccgctctgccgccgccgccgctctccgccctcacggggtccacttcgccgccgccggtaggagcggcggcttagggatcccgctcgcctgcgcggcgccgagaaatcgtaggcagcggcgcggtgtccgcctggtggtgtgggcgtcggctgactactacgcaacgctgggcgtgcagcgctccgcgaacatcaaggacatcaaggccgcgtaccggaagctcgcgcgccagtatcatcctgatgtcaataaagaacctggcgcaactgacaagttcaaagagataagctcagcatatgaggtgctatcagatgagaagaaaagggcgttgtatgatcaatacggtgaagctggagttaagagtgcggttggaggatctgcgggagcttatacgagtaatccatttgatctgtttgagacattctttggagcaaacatgggtggcttttctggcatggaccagaatgcatttaggacacgcaggaggagcactactgttcagggtgaagacatcagatatgacgtgaacctggggttttcggaggcaatatttggaacagagaaagatatcatattatcccatttggagacttgtgatacttgtagtggttctggttcaaaggctggctcaaagacaagaatatgttccacatgtggtgggcgagggcaagtaatgcgaactgagcaaacaccatttggtctattctcccaggtttctatttgccccacttgcgcaggtgagggtgaggtcatttcagagtattgcaggaaatgctctggagaggggcgtgttcgtgtcagaaaggagatcaaagtaaaaattcctcctggagttagtaaaggtagcactctccgtgtacgcggtgaaggtgatgcaggaccaaaaggagggcctcctggagatctttttgtttgccttgacatagaagagccatcagatattaaaagggatggtatcaacttgtattcaactgtgtcgataagctacattgaagctattttgggtactgttgaaaaggtcagaactgttgatggaactagtgaacttcgaatacctccaggcacccaacctggtgatgtagtggtcctagcgaaacaaggtgtcccgtcgttgaataggccatctatacgtggtgatcatctattcactattaaggtcaatatacccaaacgtgtaagtggacgcgaaagggagttacttgaggagcttgcatcgttgactaatggtggttttgcccgtgcacctgtgaagccaaagcctatacatcaagagagtggaagcagtgttgctcaagaacaatcggatcaacctgctgaaggggagggtgactggtttcagaaacttacagattttgctggatccattgccagtggggcagccaagtggctgaaagacaacctgtagcctgtaaatatttactgcagaatgcattatcttcaacatcctggtgtcgaatctgcaaatcttcaattcatccgagatgttgcacgtgttttgttggagaggttcaacttttataggctgcaaagcggcagacggagagtttgagttctgttaactaattttattgacaccaattctatttttggcattccttgtaaagcatgagttttgcggtagttgcagtcattcccgggagcatgtaataggtctcggagccatggccgctgatattaaggactgaagctacaaccactgtaaatacatatatttttgctgtaagacatcttgatacaccaggcattggtttgttcgttaacctgaattcaaaatagacgggcaccctgtcgtaaagcttacaacagttcaatatctcagatgcatttttatttctcaacaaaa

SEQ ID NO: 5872 - DNA, 5002 bp, Oryza sativa
agttggggcccaatctctgctcacacatcgtcccctctccccatcccaaaccgcagctctgtcttccccaaacgacgcggaccgtataaaactccgccgcgacgccgagcacgcgcgccggctctagaagcttctagaaggcgcagctgcagcgctggctaatggcgttcgcgacctccacgctcccattcgcgccatccaacccctcgccgtcctcccgctccgccgcagcggctttctctccccgcggcggggtccacttcgccgccgctaggagcggcctcccgctcgcgtgcgccgcgccgaggcaccgagggaggcctcctccgaggaggcgccgcggagggtgcctggtggtgtgggcgtccgccgactactacgccacgctcggcgtgccgcgctccgcgagcaacaaggacatcaaggccgcctaccggaagcttgcgcgccagtaccatcctgatgtcaataaggaacctggagcaaccgataagttcaaagagataagtgcagcatatgaggtgctatcagatgaaaagaagagggcgctgtatgatcaatatggtgaagctggggttaggagtgcggttggaggctcagctggagcttacacaagtaatccttttgatctatttgagacattctttggagcaagcatgggtggcttttctggtatggaccagggaacatttaggacacgcaggaggagcactgctgttcagggggaagacatcagatatgatgtgaatctggggttctcagaggcaatatttggaacagaaaaggatattatattatctcatttggagacatgcgatgcatgtgctggttctggatcaaagattgggtcgaaaatgagaatatgctccacatgtggtggtcgagggcaagtaatgagaactgagcagacaccatttggtctgttctcccaggtttcaatttgccccacctgtgcaggagagggtgaagtcatttcagagtattgcaagaaatgtgctggagaggggcgtgttcgtgttagaaaggagatcaaagtaaaaattcctccaggtgttagcaaaggtagtactcttcgtgtacgtggtgaaggtgatgcgggaccaaaaggaggacctcctggagatctttttgtttgccttgatatagaggagccagcagatattaaaagggatggtatcaacttgtattcaactgtttcagtaagctacattgaagctattctgggcactgttaaaaaggtcagaactgttgatggaaatagtgaacttagaatacctccaggtacccaacctggtgatgtagtggttctagcaaagcaaggtgttccatcattgaataaaccatctgttcgtggtgatcatctattcactattaaggtcactatacccaaacgtataagcggacgagaaaaggagctacttgaggaactggcttctttgagcaatggtggttttgctggtgcacctgtgaagccaaaatccatacgccaagagaatgaaactactgttgcccaagaaaattcggatcaacctgatgaaggggagggtgactggttgaagaaacttcaagattttgcaggatccattgctaatggtgctgccaagtggctaaaagacaacctttagcctgtaaatagttaccgcggaatgcatttatattaatcgctgttatggtgtagtccaatctgctattcttcaattcattggatcccacgagctgttgcatttgttttggagaggctcaaagttctcaggctgtgaagtggcaacgaagaggctgaatctgttaattaattccatcggcaacgttcttattttggtatgcttgtaaagtggcatgattttttatgtagttgcagttatcattccctagagcatgtgatggttttacgtcacttgctgctgatactgaattcagtaaagataatgcactgtaaatatatatttcatgcagtagagcatcttgaaatctcaggtatgtactctgtgggtaagcaaccgtgaggtgtgtcgttctgaactagagatatttaaatccagaacaagagcacccatattcagaaggttgtgttgagacttgatcaccagcttgatccataacaagagcactcaaaacagaggaacctggatgtaccatgttacatgtaccacccaagaactagagagaaaaaaccgtgacatgtagtatcacacttgaatttagttcaagcataatctgtaaacaaagtttgaaattcgagggcagcctatgattctgagaagaactagtttcgattaattccatacaagagtactcaaggcccagccgccgaggcttcaaattccatcatacaagaaaattcatcatcatctggaaagttgtaagctagtcagtcatctctcgagctgactttgagcaagaggaggacagcaacagccacaggaatggacaccattaacaaggctaccacgatgttcggccttgtgatgtcaggtaacaggatgctcccgtacttgatagccgctgcgccgccaaccgatccaaggcccaatttccaaaggtagctcgagtcatcctatgatgcaacacacccaaaagacgaatggtttgattcagcgtaggagaactatgaagagattttttggtggaaaacataaaagactcgcagattagtctgtaagtaaaatatagccatttgaaaaaaaaaatccctttgtgttctttttgcaaaacaacacacgggtgaagctgtgaacggctatggcaattgttcgcggtggattagatgcctcctggaggccaaactgagaaatgaagaaatatttgtcccaatgggctatctatctatctatctatctatctatctatctatctatctatctatctatctatctataactgagaaaaggtgaggaatggtggagagcgtgtgcgagcagtctatctatgtatcagtatcgctgacctcgattcgccccgagtccgcctccgcgtcgacgtcggcggatttaccggagaagcgagcggccacgccacggcggcggcgctcgcgccactgctgctggaagctgcggcgtggcggcgggtttgagttggtcttgccggttagggacggggcggccaccgagagcgcgcaggcaatcgccatcgaccgccgctctcccgcgcagctcaaccaaccaccgagagctcgcgttctgtgcacgttatccagaaccgagcgaacgcatatgcgtctctagtccttaccactaccaacgagatgtgctggaatttgtacaccatttcgtcaaatcaaaccgtgcattttttttttgccaaaacccatgtaaaattttaagcaacaaacatacaatactggatccttcaaaagtaggacatagatttgcacagcatttgtcaaaactcagaattgctagaaggttacagaacatgaacggctctatggtgtagagagagagagcgcattcacccaactcttcaactgaacctttctcgtactactaataatgagctactagtatgacaaacggcaaaatggtgcacaggcattccaagaatcatttgaaactagaagtagcttttccgcttccgccctgtgtatttggtgtccgcgggcacctcccgtcctcgccttctcagctgctcctttttgttcaagagccaagccttgcccttgccgttcttcttcgtcttctgcctcttctttggcctatttctttcatatatgccgacctgcataccaaaaatataagcattcatctaagccggtcgaacatcaaaagggagggaaaaaaaccccaatattaggtcctataaaatagagtaagaaccaagtatgaaatagatgatccttgagtccttgactaagcacaaccatttagctagtacctcctccaagacaacagcatttctataactactgaacatctaaggtaaaactgaataataagttagtaaaacaccacaggaacaatgcaacttgcaagcagagattggtagaaagattttgtacacacacacacacacacacaaaaagcaacggtatcacaacttatgtgatgtaaaggcgacaatataacaatatcaaggggaagctctggacaaagaatgcaatatactgccatccgttgaagcagtaagtagttcccttgaaacatgaaacatagcacaatgcaatgcatgaacaagcttgtaaagcatgggcttactgtttgggctccatcttcatcaccacttccatcatcgctctcatcatcatcactacacatggcaccatcttgacctttacccttcggaagcgatgaatttagagaaggtggtccacaagtgaggacaaggtaggatttctttgcttttgaactgtaagaaagaaggcatgcccataattgtatatcagtaacgaaattcgtagcattgttcgtacgctaatatggcattgttgtgaggtaataaaatactaacctgtgaggccagtcaacaaccactccacctgcaaatccagcacgcatggcagcagtcacgatcatttcactctgcttcacattatcagcataaaattgcaaaacggctcttgctccccttgctaggcatctatataatgatccaaagaaagccctgaaaattatgcacatatgaaagttatgaactggttgcaagcaacctaagaggctaagagaaacaataaatacacactttaaccgcaatcttgggttgtgacaagacttgtcagcattgcataaccactgcacaaacaaaacacacagttgagaggacaaattaaaagtgcagatttgagatcaacatggtcagtttgttgcagtaacataacagctcaaacattacctgaactgctgaaatactgattgctccatcaataactccaggccgcaagcctaaaccctggaacaggattgaatataaataaatacacatgcagcaccttaaagctagacaagttgtggtgaagcaactgtgaagaagttgctgtatttgtgttaaccaaaggatggtgagattgtgc

SEQ ID NO: 5873 - DNA, 1413 bp, Avena sativa
cagacgagacgcggaccaacgccgagcacacgcgccgcccagcttctagaaggcgccgagcgcacgccctcggcgagcggcgctaatggcgctcgcgctctccactccgttcgcgccctccaacccggcgccctcctcccgcggtgccgccgccgctttccctccgcgtggggtccacttcgctgccgccggtaggacaggcggcgtcggcctcccgctcacgtgcgcggcgccgcgaaaccgcgggcgtaggcggcgcggagggggcttggtcgtgttggcggccgccgactactacacgacgctgggcgtgcagcgctccgcggatatcaaggccatcaaggccgcgtaccggaagctcgcgcgccagtatcaccctgatgtcaataaggaccctggagcaaccgacaagtttaaagagataagctcagcctatgaggtgctgtcagacgataagaagagggcgttgtatgaccagtatggtgaagctggggttaagagtgcggttgggggttctgctggagcttatacaactaatccattcgatctgtttgagacattcttcggagcaaacatgggtggtggtggtggcttttctggtatggaccagagcgcatttaggacacgcagaaggagcacagctacgcagggtgaagatatcagatatgatgtgactctggggttctcagaggcaatatttggaacagaaaaagatataatattatcacatttggagacttgtgatacctgtagtggttctggttcaaaggttggctcaaagacaagaatatgctccacttgtggtgggcgagggcaagtaatgcgaactgagcaaacaccatttggtctcttctctcaggtttctatttgccccacttgtacaggagagggtgaggtcatttcagagtattgcagaaaatgctcaggagagggacgtgttcgtgtcagaaaggagatcaaagtaaaaatccctccaggagttagtaaaggtagtactcttcgtgtacgtggtgaaggtgatgcaggacctaaaggagggcctcctggagatctttttgtttgccttgatgtagaggagccatctgatattaaaagggatggtatcaatttgtattcaactgtgtcgataagctacattgaagctattttgggtactgttgaaaaggtcagaactgttgatggaactagcgaacttcgaatacctccaggcacccaacctggtgatgtagtggtcctagcgaagcaaggtgttccgtcattgaataggccatctatacgcggggatcatctattcactattaaggtttctataccaaaacgtataagtgggcgcgaaaaggagttacttgaggaacttgcgtcattgaccaatggtggttttccttcgtgcgcctgtgaagccaaaacctatac

SEQ ID NO: 5874 - DNA, 1856 bp, Setaria italica
ccgtgcgctcaggcgtccacaccaccgagcagccgcagccgcagccaaacctctgcgagctcgctaatggcgttcgcgctgtccacgctgccgttcgtgccctctaatccctcgccatcctcccgcgcccccgctgacgccgcgttccctcctcgtcgggtccacttctctgccgccgtccggagcggcggcggcgacctcccgcttgcctgtgctgcgccgcggcatcgcgggcgggctccaaggcggcgccgcggagggagattgttggtctgggcgtcggccgactactacgcgacactgggcgtgccgcgctctgcgaccaacaaggacatcaaggccgcctaccggaagcttgcgcgccagtaccatcctgatgtcaacaaggagcctggagcaactgaaaaatttaaagagataagcgcagcatatgagatattgtcagatgaacagaagagggcattatatgaccaatatggtgaagctggggttaagagtgcggttggaggctcgggtggagcttacacaactaatccatttgatctctttgagacattctttggagcaagcatgggtggcttttctggcatggaccagagcacatttaggacacgcaggcgaagcactgctgttcagggtgaagacatcagatatgatgtcattctgggcttcacagaggcgatatttggaacagagaaagacattatattatctcatttggaaacatgtgatacatgtggtggctctggatcgagggctggctccaagatgagaatatgttccacatgtggtgggcgagggcaagtaatgcgaaccgagcaaaccccatttggtctgttctcccaggtttctatttgccccgcttgtgctggagagggtgaagtcatttccgagtattgcaggaaatgttctggagaggggcgtattcgtgtcaggaaggagatcaaagtaaaaatccctccaggagtgagtaagggtagcactcttcgtgtacgtggggaaggtgatgcaggaccaaaaggtgggcctccaggagatctttatgtttgcctcgatatagaggagccatcagatatcaaaagggatggtataaacttgtattcaactgtctcagtaagctacattgaagctattttgggcaccactaagaaggtcagaactgttgatggaaccagtgaacttcgaatacctccaggtacccaacctggtgatgtaattgtcttagcaaagcaaggcgttccatcattgaataagccatctatacgtggtgatcatctattcactgttactgtcacaatacccaaacgtataagtgggcgggaaaaggaattacttgaggaacttgcatctttgagtggtggtggttttgctcgaacagccgccaagccgaagccggccaagccaaaacccgttcatgaagagaaagaagttggcacaagtcaagaagatgcaggtaaatccaatgaaggagagggtgggtggttgaagaaacttacagatttcgcagggtccattgccaatggcgctgcgaagtggctgaatgacaacctgtaggctgtaaatatttactatagtccaatctgcaatttttcgattcattccgatccctacatccattttgttggagagcgtagagattctcaggctggaactgagggcatgagacgtgtcaactaatatagtcggcgcaataatatgtttctcccttgtaaaggaatgatttttatgtagttgcagttattccaattctccaagtgcatgtagcagcctgaagttgcgtgatgctgatctgaaacccagagattcgcaatgttgtaaatatatgtttaattcctgaagtagggtttcatgaaacc

SEQ ID NO: 5875 - DNA, 2057 bp, Sorghum bicolor
atgacaggtgggcccatactgttccatccaacgtgtcttctcctttccatccctagaactaccctccgctcgcgcgacgcggaccatgcatctcgattatctcccgagccgaccagcgaccagcggcgccagaacccagaaggttcgctcatggcgctcacgtccatgctcccgttcgcgccctcgaacacctcgctatcctactcctcccgcgcctcaaccgccgccgcgttcgctcctcgtggggcccacttcgccgcgtacggaaggagcggcggcggtggcgcccaatcactggcgtgcgccgcgcctcgccgctgcggacgggctccgcggcggcgccgcggagggggcctggtggtctgggcgtcggccgactactacgcgacgctgggcgtgccacgcgccgcgagtaacaaggacatcaaggccgcgtaccggaagctcgcgcgccagtaccatcctgatgtcaataaggagcctggagcaaccgaaaagtttaaagagataagtgcagcgtatgaggtgctgtcagatgaaaagaagagggcgttgtatgaccaatatggtgaagctggggttaagagtgcagttggaggccccggtggagcttacacaactaatccatttgatctgtttgagacattctttggagcaagcatgggtggcttttctggcatggaccagagctcgtttaggacaagcaggcgaaacactgctgttcagggtgaagacatcagatatgatgtgattctggggttcacagaggcgatatttggaacagagaaagatattatattatctcatttggaaacatgcgatacatgtggtggttctggatcaaaggctggttccaagatgagaatatgttccacatgtggtgggcgagggcaagtaatgcgaactgaacaaacaccatttggtctgttctctcaggtttctatttgccccacttgcgcaggagagggcgaagtcatttcagagtattgcaggaaatgttccggagagggtcgtatccgtgtcagaaaggagatcaaagtaaaaatccctccaggagtgagcaaaggcagtactcttcgtgtacgtggggaaggtgatgcaggaccaaaaggtgggcctcctggagatctctttgtttgccttgatatagaggaaccatcagatatcaggagggatggtataaacttgtattcaactgtgtcaataagctatcttgaagctattttgggcaccgttaagggggtcagaactgttgatggaaccagtgaccttcgaatacctccaggtacccaacctggtgatgtaattgtcttagcgaagcaaggagttccatcattgaataagccatctatacgtggtgatcatttgttcactgttaaagttgcaatacccaagcgcataagtgggcgtgaaagggaattacttgaggaacttgcatctttgagtaatggtggctttgctcgaacagacgccaagccaaaacctgcccagccaaaacgcgtacatcaagagaaagaagtaggtgctagtcaagaagatacagacaaatctaaagaagcagagggtgactggttgaagaaacttacagattttgctgggtccattgttaatggtgctgcaaagtggctgaatgacaacctgtaggcgtgtaaatatttactgcaggattctagattgtcttcaactaccatgttgctgtagcccaatctgcaattcttagattcattggggtccccacgagcttgtacattcgttgtgttgagagcttcaagattttcgggctgtgagtggcaaccgcgggagtgagaattgtgaactaatattgtcggcgcattgatccctttatcattcttgcaaagcaattatttttatgtagagttatttcgtttggcaagtgcatgcagcagtcggaagttgtgggatgctgatctcaaaccccgagactagacaacactgtaaatatgttccattcctgattctgtacttgaggttttggattaatcatttttttttgaaagtcagattaagcaaattcaatatcaacggacaatcttttt

SEQ ID NO: 5876 - DNA, 1942 bp, Zea mays
ccgtgtcttcttccttccatccctaaaaactgccctccgctcgcgcgacacggaccatgcatcccgattactatctgccgagccgaccagcggcaccagaacccacaaggttcactcatggcgcccacgtccatgctcccgttcgcgccctccaatacgtcgctgccctattcctcccgcgccacaactgccgccgcgttcgctcctcgtgggctccaccacgccgcggccggaaggagcggcggcggccaacggctcgcgtgcgctgcgcctcggcgccgccgcggagggggtcttgtggtcagggcgtcggccgactactacgcgacgctgggcgtgccgcgcgccgccagtaacagagacatcaaggccgcgtaccggaagctcgcgcgccagtatcatcctgatgtcaataaggagcctggagcgactgaaaagtttaaagagataagtgcagcatatgaggtgctgtcagatgaaaagaagagggcgttgtatgaccaatatggtgaagctggtgttaagagtgcagttggaggctccggtggagcttacacaaccaatccatttgatctgtttgagacattttttggagcaagcatgggtggtttttctggcatggaccagagcgcgtttaggacaagcaggcgaagcactgctatacagggtgaagacatcagatatgatgtgattctggggttcacagaggcgatatttggaacagagaaagatattatattatctcatttggaaacatgtgatacatgtggtggttctggatcaaaggctggctccaagatgagaatatgttccacatgtggtgggcgagggcaagtaatgcgaactgagcaaacaccatttggtctgttctcccaggtttctatttgccccacttgtgcaggagagggcgaagtcatttcagagtattgcaggaaatgttctggagaggggcgtatccgtgtcagaaaggagatcaaagtaaaaatccctccaggagtgagcaaaggcagtactcttcgtgtacgtggggaaggtgatgctggaccaaaaggtgggcctcctggagatctctttgtttgccttgatatagaggagccatcagatatcaagagggatggtataaacttgtattcaactgtgtcaataagctatcttgaagctattttgggcactgttatgcaagtcagaactgttgatggaaccagtgaccttcgaatacctccaggtatccaacctggtgatgtaattgtcttagcgaagcaaggagttccatcattgaataagccgtctatacgtggtgatcatctcttcactgttaaagtcgcaataccgaagcgcataagtgggcgtgaaagagaattacttgaggaacttgcatctttgagtaatggtcgctttgcacgaacagacactaagccaaaacctgcccagccaaaagccatacatcaagagaaagaagttggtgctattcaagaagatacaagcaaatctaaagaagcagagggtgactggttgaagaaacttacagattttgctgggtccattgttaatggcgctgcgaagtggctgaacgacaacctgtaggctgtaaatatttactgcaggatagaagattgtcttacatggtgctgtagtccaatcaaaatttttagattcattgggggtccccacgagctcgtatattcgttttattggagagctgcaagattttcaggctgagtggcaaccgagggagtgaaagttgtcaactaatatcgtcgcggcgttggtcccttgtcattcttgccaagcattattttatgtagttggagtccttttcagtctggcaagcggcgtagaagtctgaagctgtgggatgttgatcccaaaccccgggactagacaaacactgtacttgaggttttggattaatcaaattcaccgatatcgaattgcaaactta

SEQ ID NO: 5877 - DNA, 1963 bp, Panicum virgatum
  misc_feature (109)..(109): n is a, c, g, or t
  misc_feature (180)..(181): n is a, c, g, or t
  misc_feature (206)..(206): n is a, c, g, or t
  misc_feature (221)..(221): n is a, c, g, or t
  misc_feature (225)..(225): n is a, c, g, or t
  misc_feature (300)..(300): n is a, c, g, or t
  misc_feature (325)..(326): n is a, c, g, or t
  misc_feature (475)..(475): n is a, c, g, or t
  misc_feature (516)..(516): n is a, c, g, or t
  misc_feature (537)..(537): n is a, c, g, or t
  misc_feature (600)..(600): n is a, c, g, or t
  misc_feature (684)..(684): n is a, c, g, or t
  misc_feature (693)..(693): n is a, c, g, or t
  misc_feature (696)..(696): n is a, c, g, or t
  misc_feature (895)..(895): n is a, c, g, or t
  misc_feature (1046)..(1046): n is a, c, g, or t
  misc_feature (1068)..(1068): n is a, c, g, or t
  misc_feature (1257)..(1257): n is a, c, g, or t
  misc_feature (1299)..(1299): n is a, c, g, or t
  misc_feature (1319)..(1319): n is a, c, g, or t
  misc_feature (1439)..(1439): n is a, c, g, or t
  misc_feature (1463)..(1463): n is a, c, g, or t
  misc_feature (1494)..(1494): n is a, c, g, or t
  misc_feature (1527)..(1527): n is a, c, g, or t
  misc_feature (1585)..(1585): n is a, c, g, or t
  misc_feature (1677)..(1677): n is a, c, g, or t
  misc_feature (1685)..(1685): n is a, c, g, or t
  misc_feature (1693)..(1693): n is a, c, g, or t
  misc_feature (1710)..(1710): n is a, c, g, or t
  misc_feature (1713)..(1713): n is a, c, g, or t
  misc_feature (1718)..(1718): n is a, c, g, or t
  misc_feature (1808)..(1808): n is a, c, g, or t
  misc_feature (1824)..(1824): n is a, c, g, or t
  misc_feature (1841)..(1841): n is a, c, g, or t
  misc_feature (1858)..(1858): n is a, c, g, or t
  misc_feature (1860)..(1860): n is a, c, g, or t
  misc_feature (1928)..(1928): n is a, c, g, or t
  misc_feature (1931)..(1934): n is a, c, g, or t
  misc_feature (1936)..(1937): n is a, c, g, or t
  misc_feature (1940)..(1940): n is a, c, g, or t
  misc_feature (1944)..(1944): n is a, c, g, or t
  misc_feature (1946)..(1946): n is a, c, g, or t
ccgtagccgtgcgctcaggccgggaccaacatcgagcagccgcagccgcagccgcgccaaacctccgcgagctcgctaatggcgctcgcactgtccacgctcccgctcntgccctccaatccctctccatcctccggcgccacccctgccgccgccgcgttccctcctcgtcgggtccanntcgctgccgccggtaggagcggcgncggcgtcctcccgcncgcntgtgccgcgccgcggcatcgcgggcgggttccgaggcggcgccgtggagggagcctggtggtctgggcgtcggcngactactacgcgacactgggcgtgnngcgctctgcgaccaacaaggacatcaaggccgcctaccggaagcttgcgcgccagtaccatcctgatgtgaataaggagcctggagcaactgaaaagtttaaagagataagtgcagcatacgaggtgttgtcagatgaaaagaagaggncattatatgaccaatatggtgaagctggggttaagagtgcngttggaggctcgggtggagcntacacaactaatccattcgatctgtttgagacattctttggagcaagcatgggtggcttttcnggcatggaccagagcacatttaggacacgcaggcgaggcactgctgttcagggtgaagacatcagatatgatgtgattctgggnttcacagangcnatatttggaacagagaaagacattatattatcgcatttggaaacatgtgatacatgtggtggttctggatcaaaggctggctccaagctgagaatatgttccacatgtggtgggcgaggacaagtaatgcgaactgagcaaacaccatttggtctattctcccaggtttctatttgccccacttgtgctggagagggcnaagtcatttcagagtattgcagaaaatgttctggagaggggcgtattcgtgtcaggaaggagatcaaagtgaagatccctccaggagtgagtaaaggtagcactcttcgtgtacgtggggaaggtgatgcaggaccaaaaggtgggccacnaggagatctttatgtttgcctngatatagaggagccatcagatatcaaaagggatggtataaacttgtattcaactctgtcgataagctaccttgaagctattttgggcaccactaagatggtcagaactgtggatggaaccagtgaacttcgaatacctccaggtacccaacctggtgatgtaattgtcttggcaaagcaaggtgttccntcactgaataagccatctatacgtggtgatcatctattcacngttacggtcacaatacctanacgtataagtgggcgcgaaagggagttacttgaggaacttgcatctttgagtgatggtggttttgctcgaacagccgccaagccgaaacccgccaagccaaaacacgtacatgaaggganagaagttggcacaagtcaagaagntacagataaatccaatgaaggagaggatgantggttgaagaaacttacagattttgcagggtcngttgtcaatggtgctgcgaagtggctgaaagacaacctgtaggctgtaaatatttacnatagtccgatctgcaatttttcaattcatcggggttcccacgagctcttacattcattttgttggagggcttaaagattttcaggctggcanccgagagngtgagacntgtcaactaatatagtnganacatngatatgttctgtcttggaaaggaatgattattacgatgtagttgcagttatttcaattttccaagcacatgtagatgtagcagcctgaanttgcgggatgctgatntgaaacccagagattcngcaatgttgtaaatatntntttaattccccctgaagtagggttgcatgaaatctcaggttctgtacttgaggttttaagttaataanttnnnnannaanatangntaataaaattcaggacc

SEQ ID NO: 5878 - DNA, 2238 bp, Triticum aestivum
cacagagctcctccaaaaagaactcttgttcccatcgcatctcggcggcttcctaccccctcctcgccccgatctaactcgccggcggccatgtcgcagccggctgccgccgccgttgcggcgcagccgcaggggcaggccccggctgggcggcagggaggcggcctgggccagagcctcgccggcatcgtgcggatggccgtgttctggtacttcgcgtccaagttcttcggccccaagcgcgcccccacggagccgggcttgctcatgtccaacctctttcagaagggagagccaatggatatgtggatgtatttatcggagaatgataaatttagcgactttggtaatgaggatgcactcatctggcatgaaacaaacataccatatgcagtctggacacctaccagtaccagaacacacacactgacatactatccaacggaggctctcaagcacaatggctctttgtatgctcatgtttatttttcccgttcgggttaccctgtggaccctaccgatcctgaatatgagcaaaaatctgcatttggaaggacacatcctattgtggcatacttgcggaaatcaaaagctggtcataagaagagcttgcttggagattcggatgagtccgaggaaaagctaccccctaaggagaacaaagagtccgaagacaaagaggagggcccagttgaatatatttcttattggaaaccaaatgtgacaataaatcttgttgatgacttcacacggtatccccaaaacaacattcctccaaatgttgctccatatttgaatgtggatccaactacaaacagctactatccaactgtattcttcaatgaattttggctgttgagggacaaattgacagcactcaacgagactgtgaaggaactgaccttgaaccttgaagttagtcctatcagcatgaccaagtggcaattatttctacagattgagcagtctttccaagttcatcgtagttacggaagtatgcttgaaggcgaggctgatgagctcaagagggttttccttgaaggaaatccatatctactgggattgaccatgattgtatctctgttccactctctgttcgatttcctggctttcaagaatgatatccagttctggaataaaaacaagtccatggaaggtctttcagcgaaatctgttgttctgaacttcatttgtcagctgattatatttctgtacctgcttgacaatgatacatcatggatgattcttgctagctctggagttggtgtgtgcattgaattttggaagataggaaaagcgatgcatgttgagattgacagaagtggaaagattcccatgttgagattccgggatcgtgagtcatatgcacagaataagactaaggagtacgatgcgcttgcaatgaagtatcttacgtatgtccttctagtccttatggctggttttgctatctattcactcaagtatgataaacacaagagctggtactcgtggatactctcttccctcacaagttgtgtttacatgtttggtttcattatgatgtgcccacaattatttatcaactacaagctgaagtccgttgctcacatgccatggagacaaatgacctacaagttcctcaacactataattgatgatctgtttgcatttgtgattaagatgccgtggttgcatcgtctctcggttttcagagatgatgttatcttcttgatatacctctaccagaggtgggtatacccagttgacaagaagcgtgtcaacgagtttggctttggaggggaagacgaacccgcagcaccccaaactttggaaggagcagcggctgcccaacagatcgaggccaaggctgagacgagcacggaggacaagaagacaaagtgagcctccgcaagcttcaatcgacacagacacatctcggcagcactggccgttttggccaccgggcacaaattttctgtgtgccaaattcgacgctgaactcatcttcacgcgttgctgaccattaaaagaaggatatgtaacaggttcagattgggcgcgtggacacaatacacatagtcttgttgccattaccgtttatttgattttggtttgttttttatgcttagcaacagcaatttctagatggatcttcaggattcttgttgatgtataagtttgcctgcagaaaaacctcacacaaaagaaaacgtaaccgaacgtgacgtcgaaccgctcggtacctggacacgtacg

SEQ ID NO: 5879 - DNA, 2365 bp, Hordeum vulgare
ccccccccccctcctcgccccgatccaacttgccggcggccatgtcgcagccggctgccgccgccgtcgcggcgcagccgcaggggcaggccacggctgggaggcagggaggcggcctgggccagagcctcgccggcatcgtgcggatggccgtggtctggtacttcgcgtccaagttcttcggccccaagcgcgcccccacggagccggggttgctcatgtccaacctctttcagaagggagagccaatggatatgtggatgtatttatcggagaatgataaatttagcgactttggtaatgaggatgcactcatctggcatgaaacaaacataccatatgcagtctgggcgcctaccagtacccgaacacacacattgacatactatccaactgaggctctcaagcacaatggctctttgtatgctcatgtttatttctctcgttcgggttaccctgtggaccctactgatcctgaatatgagcaaaaatctgcatttggaaggacacatcctattgtggcatacttgcggaaatcaaaagctggtcataagaagagcttgcttggagattcagatgagtctgaggaaaagctacctcctaaggagaacaaagaatccgacgacaaagaggagggcccagttgaatatattgcttattggaaaccaaatgtgacaataaatcttgttgatgacttcacacggtatccccaaaacaacattcctccaaatgttgctccatttttgaatgtggatccaactacaaacagctactatccaactgtattcttcaatgaattttggctgttgagggacaaattgacagcactcaacgagactgtgaaggagctgaccttgaaccttgaagttagtcctattagcatgaccaagtggcaattatttctacagattgagcagtctttccaagttcatcgtagttatggaagtatgcttgaaggcgaggctgatgagctcaagagggttttccttgaagggaatccatatctactgggcttgaccatgattgtatctctgttccactctctgttcgatttcctggctttcaagaatgatatccagttctggaataagaacaagtccatggaaggtctttcagcgaaatctgttgttctgaacttcatttgtcagctgattatatttctgtacctgcttgacaatgatacatcatggatgattcttgctagctctggagttggtgtgtgcattgaattttggaagataggaaaagcgatgcatgttgagattgatagaagtggaaagattcccatgttgagattccgggaccgtgagtcatacgcacagaataagactaaggagtatgatgcgcttgcaatgaagtaccttacctatgtccttctgttccttatggctggctttgctatctattcactcaagtatgaaaaacacaagagctggtactcgtggatactctcttccctcacaagttgtgtttacatgtttggttttattatgatgtgcccacaattatttatcaactacaagctgaagtccgttgctcatatgccatggagacaaatgacctacaagttccttaacactataattgatgatctgtttgcatttgtgattaagatgccatggttgcatcgtctctcggttttcagagatgatgttatcttcttgatatacctctaccagaggtgggtgtacccagttgacaagaagcgtgtcaatgaattcggtttcggaggggaagacgaaccggcagcaccccaaactgtggaaggagcagcggcagcccaacagatcgaggccaaggctgagacgagcacagaggacaagaagacaaagtgagcctaaacacatgcatctagccagcactggctgtttgggccaccgggcacaaattttccgtgtgccgaattcgacgctggacacaacagcttcacgcgttgctgactgttaaaagaaagaaggatgtaacaggttcagattgggcgcgttgacacaatacagtcttgttgccattactgtttatttgtttgggtttgtttttctatgcttagcaacagcgatttctagatggaccttgaggatgttgatgtataagttttgcctgctggaaaaatatcattcacgccagtgcctagttggttttgccatggcatgctttttggccgtagtgcggtcgccattattcagatttggtgtcttgtacagggtacaggaggccgagggaatgtccctggacctgtgtgcagtgacaagtgacacgacatggagttgactgcagctgaggacaaggcgtatcgctgatggtgtggattgatgagaagagggcgagctgatagatccgtgtggatgaggtactccctcctagatgt

SEQ ID NO: 5880 - DNA, 2010 bp, Secale cereale
cggcatcgtgcggatggcggtgttctggtacttcgcgtccaagttcttcggccccaagcgcgcccccacggagccgggcttgctcatgtccaacctctttcagaagggagagccaatggatatgtggatgtatttatcggagaatgataaatttagcgactttggtaatgaggatgcactcatctggcatgaaacgaacataccatatgcagtctgggcgcctaccagtaccagaacacacacactgacatactatccaacggaggctctcaagcacaatggctctttgtatgctcatgtttatttttcccgttcgggttaccctgtggaccctaccgatcctgaatacgaggaaaaatctgcatttggaaggacacatcctattgtggcatacttgcggaaatcaaaagctggtcataagaagagcttgcttggagattcggatgagtctgaggaaaagctaccacctaaggagaacaaagagtccgaagacaaagaggagggcccagttgaatatatttcttattggaaaccaaatgtgacaataaatcttgttgatgacttcacacggtatccccaaaacaacattcctccaaatgttgctccttatttgaatgtggatccaactacaaacagctactatccaactgtattcttcaatgaattttggctgttgagggacaaattgacagcactcaacgagactgtgaaggaactgaccttgaaccttgaagttagtcctatcagcatgaccaagtggcaattgtttctacagattgagcagtctttccaagttcatcgtagttacggaagtatgcttgaaggcgaggctgatgagctcaagagggttttccttgaaggaaatccatatctactgggattgaccatgattgtatctctgttccactctctatttgatttcctggctttcaagaatgatatccagttctggaataaaaacaagtccatggaaggtctttcagcgaaatctgttgttctgaacttcatttgtcagctgattatatttctgtacctgcttgacaatgatacatcatggatgattcttgctagctctggagttggtgtgtgcattgaattttggaagataggaaaagcgatgcatgttgagattgacagaagtggaaagattcccatgttgagattccgggatcgtgagtcatacgcacagaataagaccaaggagtacgatgcgcttgcaatgaagtatcttacgtatgtccttctagtccttatggctggttttgctatgtattcactcaagtatgataaacacaagagctggtactcgtggatactctcttccctcacaagttgtgtttacatgtttggttttattatgatgtgcccacaattatttatcaactacaagctgaagtccgttgctcatatgccatggagacaaatgacctacaagttcctcaacactataattgatgatctgtttgcatttgtgattaagatgccatggttgcatcgtctctcagttttcagagatgatgttatcttcttgatatacctctaccagaggtgggtatacccagttgacaagaagcgtgtcaacgagtttggcttcggaggggaagacgaaccagcagcgccccaaactttggaaggagcaacggctgcccaacagatcgaggcggaggctgagacgagcacggaggacaagaagacaaagtgagccctccgtaagcttcaaccaacgcagacacatctcggcagcactggccgttttggccaccgggcacaaattttctgtgtgccaaattcgacgctgaactcagcttcacgcgttgctgaccattaaaagaaggatgtaacaggttcagattgggcgcgtggacacaatacacatagtcttgttgccattaccgtttattttattttggtttgtttttttaatgcttagcaacagcattttctagatggatcttcaggatgcttgttcctacatgttgatgtataagttttgcctgctggaagaaaaaa

SEQ ID NO: 5881 - DNA, 2419 bp, Brachypodium distachyon
taagtaacaatagctgtccctatcggcaaaagaaacctataaattatcgtgaaacaacccccgcttaaatccccaaagcatcaatcacagagagctcctccaaaaaaaactcgtgttcctttcgcatctcggctcttctacccctcctccttactccgatccaacttgccggcggccatgtcgcagccggcggttgccgccgttgcggcgcagccgcaggggcaggctccggcggcgcgaggtggcctggggcagagcctcgccggcatcgttcggatggcggtcttctggtacttcgcgtccaagttcttcgggccgaagcgcgcccccacggagccggggatgctcatgtccaacctcttccagaagggagagccgatggatatgtggatgtatttgtctgagaacgataaattcaacgacttcagtaatgaagatgcgctcatctggcatgaggcaaacatcccatatgcagtctgggggcccaccagtaccagaacacgctcactgacataccatccttcggaggctcttaaacacaatggctctctgtatgctcatgtttactttgcccgttcgggttaccctgtggaccctactgatccggaatatgagcagaagtctgcctttggaaggacacatcctattgtggctttcttgcggaaatcaaaagctggtactaagaagagcttgcttggaaattcgaacgagtctgaggaacaaccaacacctaaggagaacaaagatgctgaagacaaagacgagggcccagtcgaatttattgcttactggaaaccaaatgtgacaataaaccttgtggatgacttcacacggtatccacacaataacattcctcctaatgttgctccatatttgaatgtggatccaactacaagcagctactatcccactgtattcttcaacgaattttggctactgagggataaattgatagcactcaatgagactgtggaggacctgaccttaaaccttgaagttggtcctattagtatgaccaagtggcaattgtatctacagattgagcagtctttccaagttcatcgtagctatggaagtatgcttgaaggcgaagctgatgaactcaagagggttttccttgaagggaatccatatcttctgggactgaccatgattgtttctctcttccattctctgtttgatttcttggctttcaagaatgatatccagttttggaataagaacaagtccatggaaggtctatcagcaaaatccgtggttctgaacttcatatgtcagctggttatttttctgtacctgcttgacaatgatacttcatggatgatccttgctagctctggaattggtgtctgcattgaattttggaagattggaaaagcgatgcatgttgagattgacagaagtggaaggattcccatgttgaggttccgggatcgtgaatcatatgcacagaataagacaaaggagtatgatgcaattgcaatgaagtaccttacctatgtccttctcttccttatggtcggtttcgctatctattcactcaaatacgacaaacacaagagctggtactcatggatactgtcttccctcacaagttgtgtgtacatgtttggttttatcatgatgtgcccacaactattcatcaactacaagctgcagtccgtcgctcatatgccatggagacaaatgacctacaagttcctgaacactataatcgatgacctttttgcatttgtgattaaaatgccattgttgcatcgtctctcagtcttcagagatgatattatctttttgatatacctctaccagaggtgggtatacccagttgacaaaaagcgtgtcaatgagtttggattcggaggggaagacgagccaccaaccgcccagacattggaaggaactgattcagctgctgctgcagcccaacagattgaggctgagacaagcacggaagacaagaagacgaagtgatcttccatcagtctcattcaatcacatcttggcagcaccgtcgtttctgccaaccgggcacaaacttttggtgtgccaaattggacgctggacttgcttggcatgttcgtgaccataaaaaaaagatgtaacatgttttgagtgggcacgttgacacacacatacacacatagccttcttgcctatctatttttcagtttgtttctaactcttatgactgcaattgctagatggaccttaaggatgcttgtttctacatgtttttttgtactactagttttgcattgcctggggaaaaagatgtatcgcaccagtgactagttgatattgtcatgacatgcttttcgccacacaatcccctttggaaccgtgtttcatcaccaccaaggtgcagaaaatttggaacgtataaaatgtcgctggtgaagtactgggggcgaagtccagg

SEQ ID NO: 5882 - DNA, 2212 bp, Brachypodium distachyon
tgttcctttcgcatctcggctcttctacccctcctccttactccgatccaacttgccggcggccatgtcgcagccggcggttgccgccgttgcggcgcagccgcaggggcaggctccggcggcgcgaggtggcctggggcagagcctcgccggcatcgttcggatggcggtcttctggtacttcgcgtccaagttcttcgggccgaagcgcgcccccacggagccggggatgctcatgtccaacctcttccagaagggagagccgatggatatgtggatgtatttgtctgagaacgataaattcaacgacttcagtaatgaagatgcgctcatctggcatgaggcaaacatcccatatgcagtctgggggcccaccagtaccagaacacgctcactgacataccatccttcggaggctcttaaacacaatggctctctgtatgctcatgtttactttgcccgttcgggttaccctgtggaccctactgatccggaatatgagcagaagtctgcctttggaaggacacatcctattgtggctttcttgcggaaatcaaaagctggtactaagaagagcttgcttggaaattcgaacgagtctgaggaacaaccaacacctaaggagaacaaagatgctgaagacaaagacgagggcccagtcgaatttattgcttactggaaaccaaatgtgacaataaaccttgtggatgacttcacacggtatccacacaataacattcctcctaatgttgctccatatttgaatgtggatccaactacaagcagctactatcccactgtattcttcaacgaattttggctactgagggataaattgatagcactcaatgagactgtggaggacctgaccttaaaccttgaagttggtcctattagtatgaccaagtggcaattgtatctacagattgagcagtctttccaagttcatcgtagctatggaagtatgcttgaaggcgaagctgatgaactcaagagggttttccttgaagggaatccatatcttctgggactgaccatgattgtttctctcttccattctctgtttgatttcttggctttcaagaatgatatccagttttggaataagaacaagtccatggaaggtctatcagcaaaatccgtggttctgaacttcatatgtcagctggttatttttctgtacctgcttgacaatgatacttcatggatgatccttgctagctctggaattggtgtctgcattgaattttggaagattggaaaagcgatgcatgttgagattgacagaagtggaaggattcccatgttgaggttccgggatcgtgaatcatatgcacagaataagacaaaggagtatgatgcaattgcaatgaagtaccttacctatgtccttctcttccttatggtcggtttcgctatctattcactcaaatacgacaaacacaagagctggtactcatggatactgtcttccctcacaagttgtgtgtacatgtttggttttatcatgatgtgcccacaactattcatcaactacaagctgcagtccgtcgctcatatgccatggagacaaatgacctacaagttcctgaacactataatcgatgacctttttgcatttgtgattaaaatgccattgttgcatcgtctctcagtcttcagagatgatattatctttttgatatacctctaccagaggtgggtatacccagttgacaaaaagcgtgtcaatgagtttggattcggaggggaagacgagccaccaaccgcccagacattggaaggaactgattcagctgctgctgcagcccaacagattgaggctgagacaagcacggaagacaagaagacgaagtgatcttccatcagtctcattcaatcacatcttggcagcaccgtcgtttctgccaaccgggcacaaacttttggtgtgccaaattggacgctggacttgcttggcatgttcgtgaccataaaaaaaagatgtaacatgttttgagtgggcacgttgacacacacatacacacatagccttcttgcctatctatttttcagtttgtttctaactcttatgactgcaattgctagatggaccttaaggatgcttgtttctacatgtttttttgtactactagttttgcattgcctggggaaaaagatgtatcgcaccagtgactagttgatattgtcatgacatgcttttcgccacaca

SEQ ID NO: 5883 - DNA, 2213 bp, Saccharum officinarum
cgaaaaacctcgtctacattcacatctaggcgcccctcctcctcgctccgatccagctcgccggcggccatgtcgcagccggcggcgacggtggccgcggcggcgcagccgcagggtcgcggccccgcggggcgccagggcggcggcggcggcctggggcagagcatcgccggcatcgtgcggatggcggtgttctggtacttcgcggccaagttcttcgggcccaagcgcccacccgcggaccccgggatgctcatgtccaacctcttccagaagggcgagccaatggatatgtggatgtatttgtcagagaacgagaagttcaacgattttgctaatgaggatgcacttatttggcatgaggcaaacataccatatgcagtctggggacctaccagtactagaacacgatcattaacatactatccttcagaggctctcaagcataatggctctttgtatgctcatgtttactttgcccgctcgggttaccctgtggaccctacagatccagaatatgagcagaaatctgcatttgggaggacacatcctgttgtggcattcttgccaaaatcaaaagctggtaaaaagaagagcttgcttggagattcagaagagcctgaagagcaagcaccacctaaggagaataaagaatttgaggataaagatgagggtccgactgaatatatatcttattggaaaccaaatgtaacaataaatcttgttgaagacttcacacggtatcccaacaataatgtacctcccaacgtcgctccatatctgaatgtggatccagctacgggcgattattatcctacagtatttttcaacgagttttggctactgagggataaattaatagcgcttaatgagactgtggaggaattgcctttaaaccttgaagttggtcctattagcatgaccaagtggcaattgtttttacagattgagcagtccttccaggttcatcgtagttatggaagtatgcttgaaggcgaggctgatgaactcaagagggttttccttgaaggaaatccttatcttcttggattgactatggtcgtttctctgttacactctctgtttgatttcctggccttcaaaaatgatatccagttctggaacaagaacaaatccatggaaggtctatcggcaaaatctgtggttctgaattttgtgtgtcaactagttgttttcctgtaccttcttgacaatgacacttcatggatgatccttgccagctctggaattggtgtgtgcattgaattttggaagatcggaaaggcgatgcatattgaggtcgatagaagtggaaaaattcccatgttgagattccgagaccgtgaatcatatgcacagaataagaccaaagagtacgatgccattgcaatgaagtaccttacctatgtccttttcctccttgttattggtttctctatctattcacttaagtatgaaaagcacaagagctggtactcatggatactttcttccatgacaagttgtgtgtacatgtttggtttcattatgatgtgcccccaattatttatcaactacaagctgaagtctgttgctcatatgccatggagacaaatgacctacaagttcctcaacactataattgatgacctttttgcgtttgtcattaaaatgccaatgcttcatcgtctctcagttttcagagatgatgttatcttcttgatatacctctaccagaggtggaaatatccggttgacaagaagcgtgtcaatgagtttggcttcggaggcgaggacgaaccggcagcccaggaggctctggaaggaagcgattcagcggcagcagcagcccagccaacggaggatgaggccgagacaagtacggaggacaagaaaaccaagtgatctccaatctttggatcatccaaatatagcacacctctcagcaacacctgccttcccagcgggcgtgaaatttctttgctgaactggatgctggactcttgcggtgttgccttactgagatgctgaccataagataagatgtgtaacaggggacacaatagtctttgcctagggcagcgggcgaacaggcacactatcacaattacatttccagtttgtcttttagcagccattactaggctatatgcttgtttgattggtttttgtacaattttgtgcattttcttaaaatacataattggttgttcgtaaagaacgcaagggtctat

SEQ ID NO: 5884 - DNA, 2643 bp, Oryza sativa
cggcatcatcagctatcatatcaccatctcaccccccctcaaaaattctccaaaattacaattcggtccaaccaacgaaccgaatctcccagaacaacacagacccatcccccctccacgtgcaggaccttgacatgattcagtaacaacccaggtcctatctgcaaaatagccctataaatttaatcgtagaacaacctctcttaaatcccaaagccttcgcaccaaaaaaaaaaaaggtgaaaaaaaaaagccttcgcatctagcgccgcctctctccacctccctcgtttcgatctagctcgccggcggcgatgtcgcagccggcggcggtggccgctggggcggcggcggggcagcagccgcagggccgggcgcaggcggcgaggcaggcgggcggcggactggggcagaccatcgccgggatcgtgcggatggccgtgttctggtacttcgccgccaagttcttcggcccgaagcggcccccggcggagccgggcatgctcatgtccaacctcttccagaagggagagccgctggatatgtggatgtatttatcagaaaatgagaaattcaatgacttcagtaatgaggatgcactcgtctggcatgaggcaaacataccatatgcagtctggggacctaccagtacgagaacgcacacattgacatactatccttctgaggctatcaagaacaatggttctttgtatgctcatgtttattttgcccgctcgggttaccctgtggatcctactgatcctgaatatgagcaaagttctgcatttggcaggacacaccctgttgtggcttacttgcgaaaaccaaaagatggtaaaaagaagagcttgctgggagattcaagtgaatctaatgaacaaccaccacctaaggagaataaagattctgtagacaaagatgagggcccagttgaatatatttcttattggaaaccaaatgtaacaataaatcttgttgacgacttcacacggtatccacacaataatgttccacccaatgttgctccatatttgaatgttgatccatcttcaaacaactactacccaactgtattcttcaatgagttttggctactgagagataaattgatagcactcaatgagactgtggaggaactgcctttgaaccttgaagttggtcctattagcatgaccaagtggcaaatatttcttcagatggagcagtccttccaagttcatcgcagttatggaagtatgcttgaaggggaggctgatgagctcaagagagttttccttgaaggaaatccatactttttgggattgaccatgattgtttctctgttccactctctgtttgattttctggctttcaaaaatgatattcagttctggaataagaacaagtccatggaaggtctatcagcaaaatccgtggttctgaactttgtatgccagctgattattttcctctacctgctcgacaatgagacttcatggatgatccttggtagctctggaattggtgtttgcattgaattttggaagattggaaaagcaatgcatgttgagatcgatagaagtggaaagattcccatgttgaggttccgggaccgtgaatcatatgcacagaataagacaaaggagtatgacgcaattgcaatgaagtatcttacatatgtacttctcttccttgtgttctgtttctccatctattcccttaagtatgagaaacacaagagctggtactcatggatactctcttctctcacaagttgtgtgtacatgtttggtttcatcatgatgtgcccacaactattcatcaactacaagctgaagtctgttgctcatatgccatggaggcaaatgacctacaagttcctcaacaccataattgatgaccttttcgcatttgtgatcaaaatgccgatgctgcatcgtctctcagttttcagagatgatgttatcttcttgatatacctctaccagagatgggtgtacccagttgacaagaagcgtgtcaacgagtacggcttcggtggggaagacgagccacaagctccccagacattggaagggagcgatctagcagctgcatcccagcaagccggggctgaggcggaggccgagacgagcacggaggacaagaagacgaagtgagcccctcctgctctgcacctccagatcatccaaccacagaacacatctcggctgccaccgggcgtaaattttctgtgccgagcttggaacgctggactcgcctcacccgtcgctgaatgctgctgaccataagagattgtagtaacaggctttgagtgggcgcatcgacgaacacacatacacttgcccaatctatggacgggcaacatcgtcaaacattatcgccactatttcccagtttgtcttaatctttttttaggtaacaacaaccaccaccattaccagatgtcgataacgatgcactagacgcgtattttattggtttatgtataagttttgcattggctgaaaaaaaagtgttcgtttattgatccgtcatctgacattttgttaaatgtactaatgtagtcattttttgaacggctagatttctcgcggccttgataagcctaatcttagccttgctggccttttataaacctaatcttggccttgctgacatcgg

SEQ ID NO: 5885 - DNA, 2381 bp, Zea mays
aaaaccgcccccggttaaaaattccgaacgcatcacgcaatcgagaaaaacacaaaccgaaaaacctcctctacagtcccatctaggcgcccctcctcggctccgatccagtttcgccggcggccatgtcgcagccggcggcgacggtggccgcggcggcgcagccgcagggtcgcggccccgcggggcgccagggcggcctggggcagagcatcgcaggcatcgtgcggatggcggtgttctggtactttgcgtccaagttcttcgggcccaagcgcccacccgcggaccccgggatgctcatgtccaacctcttccagaagggcgagccaatggatatgtggatgtatttgtcagagaacgagaagttcaacgattttgctaatgaggatgcacttatttggcacgaggcaaacataccatatgcagtctggggacctaccagtactagaacacggtcattaacgtactatccgtcagaggctctcaagcataatggctctttgtatgctcatgtttacttcgcccgttcgggttatcctgtggaccctacagatccagaatatgagcagaaatcttcgtttgggaggacccatcctgttgtggcattcttgccaaaatcaaaagctggtaaaaagaagagcttgcttggagattcagaagagcctgaagagaaagcaccgcgcaataaggagaataaagaatctgaggataaagatgagggtccgactgaatatatatcttattggaaaccaaatgtaacaataaatcttgttgaagatttcacacggtatcccaacaataatgtacctcccattgttgctccatatctgaatgtggatccagttacgggcgattattatcctacagtattcttcaatgagttttggctattgaaggataaattaatagcgctcaacgagactgtggaggaattgcccttaaaccttgaagttggtcctattagcatgaccaagtggcaattatttttacagattgagcagtccttccaggttcatcgtagttatggaagtatgcttgaaggcgaggctgatgaactcaagagggtttttcttgaaggaaatccttatcttcttggattgactatggtcgtttctctattacactccctgtttgattttctggccttcaaaaatgatatccagttctggaacaagaacaagtccatggaaggtctatcggcaaaatctgtggttctgaattttgtgtgtcaactagttgttttcctgtaccttcttgacaatgacacttcatggatgatccttgctagctctggagttggtgtgtgcattgaattttggaagattggaaaggcaatgcatattgaggttgatagaagtggaaaaattcccatgttgaggttccgagaccgtgaatcatatgcacagaataagactaaagagtacgatgccattgcaatgaagtaccttacctatgtacttttcctccttgtggtcggtttctctatctattcacttaagtatgaaaagcacaagagctggtactcatggatactttcttctatgacaagctgtgtgtacatgtttggtttcattatgatgtgcccccaattgtttatcaactacaagctgaagtccgttgctcatatgccatggagacaaatgacctacaagttcctcaacactataatcgatgacctttttgcatttgtcatcaaaatgccaatgcttcatcgtctctcagttttcagagatgatgttatcttcttgatatacctctatcagaggtggaagtatccggtcgacaagaagcgtgtcaacgagtttggcttcgggggcgaggacgaaccggcagcccaggaggctgtggaaggaagtgattcagctgcagcaccccaactaacggaggccgggtccgagacgagtacggaggacaagaaaaccaagtgatctccaatcttttgatcatccaaatacaagcatacatctctgcaacacctgccttcccagccggcgtgaaatttctttgctgaaactggatgctggactcttgcggtcttgtcttaccgagacgtgctgaccataagataaggcgtgtaacaagggacacgatagtcttttgtctagagcagcgggcgaacaggcacacactgtcacaattacgtttccagttcgtcttttagcagccattactagttgatatgcttgtttgattggtttgtgtacaaattttgtgcatttttcttaaaacacacaattggcggctcgtagtttcatcgtgatgtgttttccctaatattagtgttgcaacgagtgtccactagtgagtgcacacaacggtgcggttctaaactgttcctcacaagaaacaattgaatccctgccaagagaagtagagaa

SEQ ID NO: 5886 - DNA, 2221 bp, Panicum virgatum
gagcccagttaaaagttcccgaagcatcccgcgatcgaaaaaaaaaaaacagaacccaaaaacctcgtctatattcgcatctcggcgcccccctcctcctcgctccgatccagctcgccggcggcgatgtcgcagccggcggcggcggtggccgcggcggagcagccgcaggggcgcggccccgcggggcggcagggcggcggcctggggcagagtatcgccggcatcgtgcggatggcggtgttctggtacttcgcggccaagttcttcggcccaaagcgccctcccgcggaaccggggatgctcatgtccaacctcttccagaagggcgagccaatggatatgtggatgtatttgtccgagaatgagaagttcaatgattttgctaacgaggacgcacttatttggcatgaagcaaacataccatatgcagtctggggacctaccagtaccagaacacgatcattaacatactatccttcagaggctctcaagcataatggctctttgtatgctcatgtttactttgcccgctcgggttaccctgtggaccctacagatcctgaatatgaacaaaaatctgcatttgggaggacacattctgtcgtggcattcttgccaaaatcaaaagctggtaaaaagaagagcttgcttggagattcagaacaacctgaagagcaagcaccagcgaaggagaataaagaacctgagggtaaagatgagggtccggctgaatatatatcttattggaaaccaaatgtaacaataaatcttgttgatgacttcacacggtatccccacaataatgtccctcccattgttgctccatatttgaatgtggatccagctacaggcgactattaccccacagtattcttcaatgagttttggctactgagggataaactaatagcgctcaacgagactgtggaagaactgcccttaaacctcgaagttggtcctattagcatgaccaaatggcaattgtttttacagattgagcagtccttccaggttcatcgtagttatggaagtatgctcgaaggcgaggctgatgaacttaagagggttttccttgaaggaaatccttatcttcttggattgaccatggttgtttctctgttacactctctgtttgatttcttggccttcaaaaacgatattcagttctggaacaagaacaagtccatggaaggtctatcggcaaaatctgtgattctgaattttgtgtgtcaactaattgttttcctgtaccttcttgacaatgacacttcatggatgatccttgctagctctggcattggagtgtgcattgaattttggaagattggaaaggcaatgcatattgagatcgatagaagtggaaagattcccatgttgaggtttcgagaccgagattcatatgcacagaataagaccaaggagtatgatgcgcttgcaatgaagtaccttacctatgtcctttttctccttgtgattggtttctctatctactcactgaagtatgaaaagcacaagagctggtactcatggatactttcttctatgacaagttgtgtgtacatgtttggtttcattatgatgtgcccccaactatttatcaactacaaactgcagtctgtcgctcatatgccatggagacaaatgacctacaagttcctcaacaccataatagacgatcttttcgcatttgttattaaaatgccaatgcttcatcgtctctcagttttcagagatgatgtcatcttcttgatatacctctaccagaggtggaaatatccggttgacaagaagcgtgtcaacgagtttggcttcggaggtgaggacgaacccgcagcccgggagaccttggaaggaaacgattcatcagctgccgcccagctaacgggggctgaggctgaggcagagacgagcacggaggacaagaagaccaagtgattaccacacccaccatcacccagaagatagcacacctctcagcagcaccggccttgtttcttccagcgggcgcgaacatttctttgctgaactggacgctggactagccttgctgagacgctgaccataagatgtgtaacagggtgaacagtcacacactataaccgttaccgatttcagtttgttcttagcaaccgttactaggcgatatgcttgtttgattggtttttgtataacttttgcatttgcttggagtaggagtaccatctgtagttttgccctc

SEQ ID NO: 5887 - DNA, 2508 bp, Sorghum bicolor
tgcacacaactaattacacaataactcacgcccttatctgcaaaaaggcaatataaagtaacgcaaaaccgcctccggttaaaaataccgaaagcatcacgcgatcgagagaaaaacacaaaccgaaaaacctcgtctacattcacatctaggcggcccctcctcctcgctccgatccagctcgccggcggccatgtcgcagccggcggcgacggtggccgcggcggcgcagccgcagggtcgcggccccgcggggcgccagggcggcggcggcggcctggggcagaacatcgccggcatcgtgcggatggcggtgttctggtacttcgcggccaagttcttcgggcccaagcgcccacccgcggaccccgggatgctcatgtccaacctcttccagaagggcgagccaatggatatgtggatgtatttgtcagagaacgagaagttcaacgattttgctaatgaggatgcacttatttggcatgagtccaacataccatatgcagtctggggacctaccagtactagaacacgatcattaacatactatccttcagagactctcaagcataatggctctttgtatgctcatgtttactttgcccgctcgggttaccctgtggaccctacagatccagaatatgagcagaaatctgcatttgggaggacacatcctgttgtggcattcttgccgaaatcaaaagctggtaaaaagaagagcttgcttggagattcagaagagcttgaagagcaagcaccacctaaggagaataaagaatttgaggataaagatgagggtcctactgaatatatatcttattggaaaccaaatgtaacaataaatcttgttgaagacttcacacgatatcccaacaataatgtacctcccaacgttgctccatatctgaatgtggatccagctacgggcgattattatcctacagtattcttcaatgagttttggctactgagggataaattaatagcgcttaatgagactgtggaggaattgcctttaaaccttgaagttggtcctattagcatgaccaagtggcagttgtttttacagattgagcagtccttccaggttcatcgtagttatggaagtatgcttgaaggcgaggctgatgaactcaagagggttttccttgaaggaaatccttatcttcttggattgactatggttgtttctctattacattctctgtttgatttcctggccttcaaaaatgatatccagttctggaacaagaacaagtccatggaaggtttatcggcaaaatctgtggttctgaattttgtgtgtcaactagttgttttcctgtaccttcttgacaatgacacttcatggatgatccttgctagctctggaattggtgtgtgcattgaattttggaaaatcggaaaggcgatgcatattgaggtcgatagaagtggaaaaattcccatgttgaggttccgagaccgcgaatcatatgcacagaataagaccaaagagtacgatgccattgcaatgaagtaccttacctatgttcttttcctacttgtgatcggtttctctatctattcacttaagtatgaaaagcacaagagctggtactcatggatactttcttccatgacaagttgtgtgtacatgtttggtttcattatgatgtgcccccaattatttatcaactacaagctgaagtctgttgctcatatgccatggagacaaatgacctacaagttcctcaacactataattgatgacctttttgcatttgtcattaaaatgccaatgcttcatcgtctctcagttttcagagatgatgttatcttcttgatatacctctatcagaggtggaaatatccggttgacaagaagcgtgtcaatgagtttggcttcggaggcgaggacgaaccggcagcccagggggctctggaaggaagtgcagcccagccaacggaggctgaggccgaggacaagaaaaccaagtgatctccaatctttggatcatccaaatatagcacacctctcagcaacacctgccctcccagctggcatgaaatttctttgctgaactgaatgctggactcttgcggtcttgccttactgagatgctgaccataagataagatgtgtaacaggggacacaatagtctttgcctagggcagcgggcgaacagacacactatcacaattacgtttccagtttgtcttttagcagccattactaggtgatatgcttggttgattggtttttgtacaattttgtgcattttattaaaaaaatacataattggttgttcgtagtttcataatgacatgctttgctctaataatgttgcaacgagtccactagtgagtgcactggtgccgttacctcacaagaaacagttggatctctgccgaaccaaaatttgattcattgttagcttgaggagaatcattttaggtgaagccgctgtacatggaatatcagaaacctagttatctgttttgaactagaggaaacatttctctct

SEQ ID NO: 5888 - DNA, 2748 bp, Sorghum bicolor
ctgccatattggtacgtctaacattttggttcctaaacaggacagcaacatgcctcgttgcgcaaatcccagctgcagtatcctttcatcgctaagacacccagaagtcctcaacaattacgtctagatccaaatcacaaagccaaacggcaaaggccggcaacacaacagggactctgcacacaactaattacacaataactcacgcccttatctgcaaaaaggcaatataaagtaacgcaaaaccgcctccggttaaaaataccgaaagcatcacgcgatcgagagaaaaacacaaaccgaaaaacctcgtctacattcacatctaggcggcccctcctcctcgctccgatccagctcgccggcggccatgtcgcagccggcggcgacggtggccgcggcggcgcagccgcagggtcgcggccccgcggggcgccagggcggcggcggcggcctggggcagaacatcgccggcatcgtgcggatggcggtgttctggtacttcgcggccaagttcttcgggcccaagcgcccacccgcggaccccgggatgctcatgtccaacctcttccagaagggcgagccaatggatatgtggatgtatttgtcagagaacgagaagttcaacgattttgctaatgaggatgcacttatttggcatgagtccaacataccatatgcagtctggggacctaccagtactagaacacgatcattaacatactatccttcagagactctcaagcataatggctctttgtatgctcatgtttactttgcccgctcgggttaccctgtggaccctacagatccagaatatgagcagaaatctgcatttgggaggacacatcctgttgtggcattcttgccgaaatcaaaagctggtaaaaagaagagcttgcttggagattcagaagagcttgaagagcaagcaccacctaaggagaataaagaatttgaggataaagatgagggtcctactgaatatatatcttattggaaaccaaatgtaacaataaatcttgttgaagacttcacacgatatcccaacaataatgtacctcccaacgttgctccatatctgaatgtggatccagctacgggcgattattatcctacagtattcttcaatgagttttggctactgagggataaattaatagcgcttaatgagactgtggaggaattgcctttaaaccttgaagttggtcctattagcatgaccaagtggcagttgtttttacagattgagcagtccttccaggttcatcgtagttatggaagtatgcttgaaggcgaggctgatgaactcaagagggttttccttgaaggaaatccttatcttcttggattgactatggttgtttctctattacattctctgtttgatttcctggccttcaaaaatgatatccagttctggaacaagaacaagtccatggaaggtttatcggcaaaatctgtggttctgaattttgtgtgtcaactagttgttttcctgtaccttcttgacaatgacacttcatggatgatccttgctagctctggaattggtgtgtgcattgaattttggaaaatcggaaaggcgatgcatattgaggtcgatagaagtggaaaaattcccatgttgaggttccgagaccgcgaatcatatgcacagaataagaccaaagagtacgatgccattgcaatgaagtaccttacctatgttcttttcctacttgtgatcggtttctctatctattcacttaagtatgaaaagcacaagagctggtactcatggatactttcttccatgacaagttgtgtgtacatgtttggtttcattatgatgtgcccccaattatttatcaactacaagctgaagtctgttgctcatatgccatggagacaaatgacctacaagttcctcaacactataattgatgacctttttgcatttgtcattaaaatgccaatgcttcatcgtctctcagttttcagagatgatgttatcttcttgatatacctctatcagaggtggaaatatccggttgacaagaagcgtgtcaatgagtttggcttcggaggcgaggacgaaccggcagcccagggggctctggaaggaagtgcagcccagccaacggaggctgaggccgaggacaagaaaaccaagtgatctccaatctttggatcatccaaatatagcacacctctcagcaacacctgccctcccagctggcatgaaatttctttgctgaactgaatgctggactcttgcggtcttgccttactgagatgctgaccataagataagatgtgtaacaggggacacaatagtctttgcctagggcagcgggcgaacagacacactatcacaattacgtttccagtttgtcttttagcagccattactaggtgatatgcttggttgattggtttttgtacaattttgtgcattttattaaaaaaatacataattggttgttcgtagtttcataatgacatgctttgctctaataatgttgcaacgagtccactagtgagtgcactggtgccgttacctcacaagaaacagttggatctctgccgaaccaaaatttgattcattgttagcttgaggagaatcattttaggtgaagccgctgtacatggaatatcagaaacctagttatctgttttgaactagaggaaacatttctctctgttttgaacctgaactagaaagaaaaacatttctctgtttcgaactaggaaggagaatcaccc

SEQ ID NO: 5889 - DNA, 2334 bp, Setaria italica
taattacaactcaactcaagcccttatctgcaaataacaccataaagtaacccaaaactgtcccagttaaaaatccccgaagactcacgcgatcgaaaaaaacagaacccaaaaacctcgtctacattcgcatctcgccgcccctcctcctcgctccgatccagctcgccggcggcgatgtcgcagccggcggcagaggtggccgcggcggcgcagccgcaggggcgcggccccgcggggcggcagggcggcggcctggggcagagcatcaccggcatcgtgcggatggcggtgttctggtacttcgcggccaagttcttcgggccaaagcgccctccggcggaaccggggatgctcatgtccaacctcttccagaagggcgagccaatggatatgtggatgtatttgtcagagaacgagaagttcaatgattttgctaatgaggacgcacttatttggcacgaagcaaacatgccatatgcagtctggggacctaccagtaccagaacacgatcgttaacatactatccttcagaggctctcaagcgtaatggctctttgtatgctcatgtttactttgcccgctcgggttaccctgtggaccctacagatgctgaatatgagcagaaatctgcatttgggaggacacatcctgttgtgacattcttgccaaaatcaaaagctggtaaaaagaagagcttgcttggagattcagaaaaacctgaagaggaagcaccacctaaggagaataaagaatctgaggataaagatgagggtccggccgaatatatatcttattggaaaccaaatgtaacaataaatcttgttgaggacttcacacggtatccccacaataatgtccctcccattgttgctccatatttgaatgtcgatccagctacaggcaactattatcctactgtattcttcaatgagttttggctactgagggataaattaatagcgcttaacgagactgtggaggaactgcccttaaaccttgaagttggtcctatgagcatgaccaagtggcaattatttttacagattgagcaatccttccaggttcatcgtagttatggaagtatgctcgaaggcgaggctgatgaactcaagagggttttcctcgaaggaaatccttatcttcttggattgaccatggttgtttctctgttacactctctgtttgatttcctggccttcaaaaatgatattcagttctggaacaagaacaagtccatggaaggtctatcggcaaaatccgtgattctgaattttgtgtgtcaactaattgtgttcctgtaccttcttgacaatgacacatcatggatgatccttgctagctctggaattggagtgtgcattgaattttggaagattggaaaggcaatgcacattgagatcgatagaagcggaaagattcccatgttgaggtttagggaccgtgaatcatatgcgcagaataagaccaaggagtacgatgcgcttgcaatgaagtaccttacctatgtccttttcctccttgtggttggtttctcgatctattcgctaaagtatgaaaagcacaagagctggtactcgtggatactttcttctatgacaagttgtgtgtacatgtttggtttcattatgatgtgcccccaactattcatcaactacaaactgaagtccgtcgctcatatgccatggagacaaatgacctacaagttcctcaacaccataatagatgaccttttcgcatttgtgattaaaatgccaatgcttcatcgtctctcagttttcagagatgatgttatcttcttgatatacgtgtaccagaggtggaaatatccagttgacaagaagcgtgtcaacgagtttggcttcggaggcgaggatgaacctgctgcccaggaggctttggaaggaagtgattcatcagccgcggcccagctaacggaggccaagactgaagctgaggccgagacgagcacagaggacaagaagaccaagtgatgtccacaccttccatcatccaaaagatagcacacctctcagcaacaccggccttgtttctcccagtggacttctcccggcggacgtgaaattttctttgctgaatcggacgctggacttgccttgctgagattctgactataagatgtgtaacggggaacacaaacacattagtcctgtctagggcagcgggcgaacaaacacaccatcttacgttttaagtttgtttctagcaaccattactaggtgatatgcttgtttgatcggtttttgtacaagattttgcatctgcttgagagcatcatcagttgctcgtagtgccgtgatatgctttgccta

SEQ ID NO: 5890 - DNA, 2074 bp, Pennisetum glaucum
ggcggctgaggtggccgcggcggcgcagccgcagggtcgcggccccgcggcgcggcagggcggcggcggcggcctgggacagagcatcgccggcatcgtgcggatggcggtgttctggtacttcgcggccaagttcttcgggccaaagcgccctcctgcggaaccggggatgctcatgtccaacctcttccagaagggcgagccaatggatatgtggatgtatttgtcagagaatgagaagttcaatgattttgctaatgaggatgcacttatttggcacgaagcaaacatgccatatgcagtctgggggcctaccagtaccagaacacgatctttaacatactatccttcagaggctctcaagcataatggctctttgtatgctcatgtttactttgcgcgttcgggttaccctgtggacccttcagatcctgaatatgagcagaaatctgcatttgcgaggacacatccggttgtgacatttctgccaaaatcaaaagctggtaaaaagaagagcttgcttggagattcagaaaaacctgaagaggaagcaccacctaaggagaataaagaatctgaggataaagacgagggtccggctgaatatatatcttattggaaaccaaatgtaacaataaatctcgttgaggacttcacacggtatccccacaataatgtccctgccattgttgccccatatttgaatgtggattcagatacaggaaactattatcctactgtattcttcaatgagttttggctattgagggataaattaatagcgcttaacgagactgtggaggaactgcccttaaaccttgaagttggtcctattagcatgaccaagtggcaattatatttacagattgagcaatccttccaggttcatcgtagttatggaagtatgcttgaaggcgagactgacgaactcaagagggttttcctcgaaggaaatccttatcttcttggattgaccatggttgtttctctgttacactctctgtttgatttcctggccttcaaaaatgatattcaattctggaacaagaacaagtccatggaaggtctatcggcaaaatcagtgattctcaattttgtgtgtcagctaattgttttcctgtaccttcttgacaatgacacgtcatggatgatccttgctagctctggaatcggagtgtgcattgaattttggaagattggaaaggcaatgcacattgagatcgatagaagtggaaagatacccatgttgaggtttagggaccgtgaatcatatgcgcagaataagaccaaggagtacgatgcgcttgcaatgaagtaccttacctatgtccttttcctcctcatgattggtttctcgatctattcgctaaagtatgaaaagcacaagagctggtactcatggatactttcttctatgacaagttgtgtgtacatgtttggtttcattatgatgtgcccccaactattcatcaactacaaactgcagtctgtcgctcatatgccatggagacaaatgacctacaagttcctcaacaccataatagacgaccttttcgcatttgtgattaaaatgccaatgcttcatcgtctctcagttttcagagatgatgttatcttcttgatatacctgtaccagaggtggaaatacccagttgacaagaagcgtatcaacgagttcggctttggaggtgaggacgaacctgctgcccaggaggctttggaaggaagtggttcagcagccgctgcccagcaaatggaggccaaggcagaggctgagacaagcacagaggacaagaagaccaagtaatctccacaccttccatcgtccaagatagtgaaattccaaactggacgctggacttgccttgctgagatgctgaccataaagatgtgtagcaagggacacacaatagtcctgtctagggcagcgagcgaacggacacaccgtcaccattacgttttaaagtttgattctagcaaccattactaggccatatgattggttttgtacaagtttttgcatttgcttgagatacattatcagttgctccgtagtgcagtgatatgctttgcc

SEQ ID NO: 5891 - DNA, 2423 bp, Zea mays
acccgccattgccactggttatgagaaacaatctaaactctggagcagagctgctccacccagagttttagagtagagctgctctggggtggagcagagccatgccaaacacacccttaaatacggaataactcacgcccttacctgtaataaaatccaatataaagtaatgcaaaaccgtccccggttaaaaaccccgaaagcgccacgcgaccgagaaaaaacgcaactgaaaaacctcgtctacattcgcatctaggcgcccctccacctcgttccgatccagctcgccggcgcccggcggccatgtcgcagcccacggcggcggtggccgcggaggcgcagccgcagggtcgcggcctcgcggggcgccagggcggcggtggcggccttgggcagagcatctctggcatcgtgcggatggcggtgttctggtacttcgcggccaagttcttcgggcccaagcgcccgcccgcggaccccgggattctcatgtccaacctcttccagaagggcgagccaatggatatgtggatgtatttatcagagagtgacaagttcaacgattttgctaatgaggacgcacttatttggcatgaggcaaacataccatatgcagtatggggacctaccagtactagaacacggtcattaacatactacccttcagaggctctcaagcataatggatctttgtatgctcatgtttactttgcccgctcgggttaccctgtggacccaacagatcctgaatatgagcagaaatctgcatttgggaggacgcaccctgttgtggcattcttgccaaaatcaaaagctggtaaaaagaagagcttgcttggggattcagaagagcctgaagagcaagcaccacctaaggagaataaagaacttgaggataaagatgagggtccgactgaatatttatcttattggaaaccaaatgtaacagtaaatcttgttgaagacttcacacggtatcccaacaataatgtacctgccatcgttgcttcatatctgaatgtggatccagctacaggcgattattatcctacagtattcttcaacgagttttggcttttgagggataaattaatagcgctcaatgagtctgtgaaggaattgcccttaaaccttgaagttggtcctattagcatgaccaagtggcagttttttttacagattgagcagtccttccaggttcatcgtagttatggaagtatgcttgaaggcgaggctgatgaactcaagagggttttccttgaaggaaatccttatcttcttggattgactatgattgtttctctattacactctctgtttgatttcctggccttcaaaaatgatattcagttctggaacaagaacaagtccatggaaggtctatcggcaaaatctgtggttctgaattttgtgtgtcaactaattgttttcctgtaccttcttgacaatgacacttcatggatgatccttgctagctctggaattggtgtttgcattgagttttggaagatcggaaaagcgatgcatattgaagtcgatagaagtggaaaaattcccatgttgaggttccgagatcgtgaatcatatgcacagaataagaccaaagagtacgatgctattgcaatgaagtacctcacctatgtcctcttcctccttgtgatcggtttctctatctattcactaaagtatgaaaagcacaagagctggtactcatggatactttcttctatgacaagttgtgtgtacatgtttggtttcatcatgatgtgcccccaattatttatcaactacaagctgaagtctgttgctcatatgccatggagacaaatgacctacaagttcctcaacactataattgatgacctttttgcattcgtcattaaaatgccaatgcttcatcgtctctcggttttcagagatgatgttatcttcttgatatacgtctaccagaggtggaaatatccggtcgacaagaagcgtgtcaacgagtttggcttcggaggcgaggaggaacccgcagcccaggagactttggaaggaagtgatccagcagctgcagcagcagcagccgagccaacggaggacaagaaaaccaagtgatctccaatcgttcgatcatccaaatgtagcacgccactcagcagcacctgccctcccacagcgggtgtgaaatttttcgctgaactggatgctggactcttgcggtcttgccttactgagacactgacgataagataagttgtgtgtgtaacaggggatacaatagtgtttctagggcagcgggcgaacaggcacactatcgcaattacgtttctacagccattactaggcgatatgcttgtttatattgcttttttgtacaattttgtgcatcatttttcaaaatacataacggcgattcttagcttcctaataatgtt

SEQ ID NO: 5892 - DNA, 1950 bp, Hordeum vulgare
ggggccgccgggcgcggggccgctgcggccggcgcactcctcggcgtcctcggcgctctccgacgcctccaactcctcctcggcctcctcgctctcgctcaagcgggcgcgcacgccgcggaagcgcctcaaccagacctacaacgaggcggccgcgctgctcgcctccatgtacccctccgtcttccccgccggggacagggcgccgccgtcgccgaggctcctcggcctcgcctccgcgctcgccgacgacccctcccgcgccgacctcctcccgcccttccccgtcctcggcaacgccgcctgcctcctccgcgacgccgcgccgatgcagtcgcccacgccgcggagccccgtgctcgccagggcctgcccgtcgccggcggccgtcagcagcgccttcaccgagttccgcgactccgcgccgtccccggggacccccgacggcgccgccggcgcggacgggcccggggagctcgactttgaggatgatgacgacagcttcgacgcagactccttcctcctcggcggcgccgatgagggcgcggcggccgaggggatcgacggcatcatgggcaaactcagtatggaaaacggcagcgatgcttcgactatcaaccgcgtcctctccagctccggcatagacccctacatcagaaacctcatggtgctcgggctcgggttccggcgctcacggtctaacatcaagcaggcactgaagcggcaggacgatgacagcgaatggtggatgtgccctgccatcccattgaaggacattatgccagtgcctcctccatcaatggcgccgccgccgcccccggtggagaagaaaaagaagaagactaagaagaaggcgttgaaggacatagctgccggaccatgcattacatgtcttaaggaggaaattcctgaccctgcttatggggatgatgggatttttggactgaaggcgcccaagacagggttgggcctgagcctcaacaccgaggaggtgctcaaggcgtggtatgacagaggctctgtgttcgctgacggcaacatacctgatgcgtcatccgctgactggctggctaaactttcagatattgaactgtttctagagaatggtgctgccggtgctatcagggaaggcagcgtacagaaattgaagcacaagcagaagcagtgcacgcccctcctctcaaataagactcggtaccaagcacggaaggtgcacgccgagtctcgccctcgggtcaaggcaagcaccagaactcattcccgagctttaggcctcccaagtagtgtagtctattgaagtctcaacccaaacgccaagttttaggcctcccaagtagtgtagtctattgaagtttgaaaaagagcttctgaaggtcctcatgctcatctttggttcttgcaggggaggtttgtcagccaggcggctcttctgcagaaagccggcgagaaagaggcctaggggaggacaatcttgcttgctcccatgaacattttgtcttgggattcaatttcactccccgtagaagtgaagcagatgacggcttcttgtcttttttcttttctgcacttctgtgatcatgtagagagggttaggggttgcctgtagagtagcttctgaggctgctggttagtttcctagttcagatgctgctgaggcaaagaaggccgtaagccaaaaaacatggtaacaatggtacagtgtcgtggcaatgaccaaagttcttctgctactttgctcccgtcttatgctctgaaccctctgaagaaactggcacttggtgctcctaaaatgttctgccacagctctgaagttttgtacaaaaatggatctgcaaaatttgttggacattaggggagcatttgattcgcaaggttctaaagtacatgaattgaaagaaagaaaaactaggattagaatgtcatgtatgaatccttcctaggattggaaaa

SEQ ID NO: 5893 - DNA, 676 bp, Hordeum vulgare
cggcgacgccatgaagcacctcctgctcccctccccgctccctctcctcctccacggccccgcctccaaacccctcctcctccacgtccgccaccgccaccgccacgccccaagcgccgcacccgacggcaactccggcgacacctccacggccgcgtccgagccgcctcccacgaatacccagcccagccggccaccctccacgcctccgtccaccaactccggcaccaccagcgtcaagacccgcctccgttccaggaaccaggcccgccgcgtccaggacccgtacctgcccccggtggaggtgaagatgatgaggggcaagggcaaggcgaacgcttccgcggcgccgaggagggagaaggagaagcggaagaagacgtgggacgagatgagcctcggcgagaaggcctacgagctgtacgtcggggagaagggcgccctcttctggctcaacaagttcgcctacgcctccatcttcatcatggccggcgcctggatcctgttccgcttcgtcgggcccgccaccggcctctaccagctcgacgcgccgccgctggcgcccacggacgtcctgcgcggctcctagtgagagccagtgcctaggtttcttgatagatagcgcggcgggtaaggtaagggatggacggccggaaaagaagatcgatgaataatt

SEQ ID NO: 5894 - DNA, 1366 bp, Hordeum vulgare
cgggtaatattcccaacaggattgctacttgggtacacaaatacagaattttccttttcgttcccatggcggtttaattcgagccattggattctccatcggaccgtcgacggggggcgcagttgatcatccccgcccctagtatccccagccacccaaacctcatcatcaaaccgacgccaagaaaaccagacaccgtccggcgacgccatgaagcacctcctgctcccctccccgctccctctcctcctccacggccccgcctccaaacccctcctcctccacgtccgccaccgccaccgccacgccccaagcgccgcacccgacggcaactccggcgacacctccacggccgcgtccgagccgcctcccacgaatacccagcccagccggccaccctccacgcctccgtccaccaactccggcaccaccagcgtcaagacccgcctccgttccaggaaccaggcccgccgcgtccaggacccgtacctgcccccggtggaggtgaagatgatgaggggcaagggcaaggcgaacgcttccgcggcgccgaggagggagaaggagaagcggaagaagacgtgggacgagatgagcctcggcgagaaggcctacgagctgtacgtcggggagaagggcgccctcttctggctcaacaagttcgcatacgcctccatcttcatcatggccggcgcctggatcctgttccgcttcgtcgggcccgccaccggcctctaccagctcgacgcgccgccgctggcgcccacggacgtcctgcgcggctcctagtgagagccagtgcctaggtttcttgatagatagcgcggcgggtaaggtaagggatggacggccgggaaagaagatcgatgaataattgttgcttacaacggcttccatgggatgcttgtatctggttattacgaaattatcgtagaagaatgattatacttccctgggtaatattggagctaaagttttcaccctgaattcctgaacaatcttacacaccattcaactctgtttcgttaatgggatttttgttggcatgtaaaattcgatgttaatcgactcaggcaactgaatccgacgcaacgatctgaagttgaagaccatgatgtcaacaacaaatcagcaagcaaacaaaaattcctaacaaactcatgtcagtgatcaactcatcataacacacatgtacaaattctgaacttctccacaacacaacaacacagtgatctccctactgagtagtgactgatcagctcatcgatcagttcggcaattcagatggatcaccagttgatctacacaaacagtcagctggcagttaggaggttaggattcagcaatcgatgagccgatcaggacg

SEQ ID NO: 5895 - DNA, 585 bp, Leymus cinereus x Leymus triticoides
cacggccccgcctccaagcccctcctcctccacgtccgccagcgccaccgctacggcccaagcgccgcacccgatggcaactccggcgacacctccacggccgcgtccgagctgcctcccacggacacccagcccagcccgccaccctccgcacctccgtccgccaactcgagcaccaccagcgtcaagacccgcctccggtccaggaaccaggcccgccgcgtccaggaggcgtacctgcccccggtggaggtgaagattatgaggggcaagggcaaggcgaatgcttccgccgcggcgcaggcgccgaggagagagaaggagcgacggaagaagaagtgggacgagatgagcctcggcgagaaggcctatgagctgtacgtcggggagaagggtgccctcttctggctcaacaagttcgcctacgcctccatcttcatcatggccggcgcgtggatcttgttccgcttcgtggggcccgccaccgggctctaccagctcgacgcgccgccgctggcgcccacggacgtcctgcgcggctcctagtgagagcgagcacctaggtttcttgatatatagcgcggc

SEQ ID NO: 5896 - DNA, 776 bp, Secale cereale
tattgaagtcggagaggagaggaaagcagacaggtgcccgccgcccgccgcccgccgggaagactcgctccgccgcccgcccgcccgcccgccggagatggcgatgaccgtggaagtgctcgctggacttgcctgtatgttctccacgagcgttcttttgcaaatcctggcatgtgctttgtacaacaattggtggcctatgctagcagcactcatgtatatcattgtgccaatgccatgcctgttctttggtgatggatccacacggttcttgagtagcggagagggtggagcgtggatgaaagccgcaaagttcctgaccggcatgtctgccatgggaagcctcgcaatcccggccatcctgaggcacgctggcctgatcgagacgggggccatgttcatcgagttcacgtccttcttcatcctcgtgtgcacggtgctgtgcttccacagggctacactggacgaggagtggtaaaacgtgcaaagaccacaaggagtgcccaggagaagaatcgtctgttaggatgtggaaaagaaatccctttggtgggtggaagctaacgcggaagcgtgtacaaaaagatgcatgtctcaaacgcttgactactgtatttatgtattgttagccacgttcccgggattcggtaatctagctggtgacgccatctgtcttatgttaaccttctccatgtcgatgtcgtcctcgtatgacccgtgctgaaccgacagtgtaaagcatattgatctggtgtgtttataatagacgcagtttt

SEQ ID NO: 5897 - DNA, 900 bp, Secale cereale
gttattggagtcggagaggagaggaaagcagacaggtgcacgccgcccgccgggaagactcgctccgccgcccgcccgcccgccggagatggcgatgaccgtggaagtgctcgctggacttgcctgtatgttctccacgagcgttcttttgcaaatcctggcatgtgctttgtacaacaattggtggcctatgctggcagcactcatgtatatcattgtgccaatgccatgcctgttcttcggtgatggatccacacggttcttgagtagcggagagggtggagcgtggatgaaagcagcaaagttcctgaccggcatgtctgccatgggaagccttgcaatcccagccatcctgaggcatgctggcctgatcgagacgggggccatgttcatcgagttcacctccttcttcatcctcgtgtgcacggtgctgtgcttccacagggctaccctggacgaggagtggtaaaggctcgcgcaggaccgcaaggagtgcccgagagaagaatcgtctgttaggatgtggaaaagaaatccctttggtgggtggaagctaacgcggaactgtgtacaaaaagatgcatgtctcaaacgcatgactactgtatatgtattgttagccacgttcccgggattcggtaatctagctggtgacgccatctgtcttatgttaaccttcttcatgtcgatgtcgtcctcgtatgacccgtgctgaaccgacagtgtaaagcatatgatctggtgtgttgataatagacgctaagtttttaaactaaaaaaaaaaaacaaaaaaaaaacaaaaaaaaacaaaaaaacaaaaaaacaaaacaacaacacacacacacacacacacacacacacacacacacgacgacgagtacgagagagagtacagcacag

SEQ ID NO: 5898 - DNA, 778 bp, Secale cereale
tattggagtcggagaggagaggaaagcagacaggtgcacgccgcccgccgggaagactcgctccgccgcccgcccgcccgcccgcccgcccgccggagatggcgatgaccgtggaagtgctcgctggacttgcctgtatgttctccacgagcgttcttttgcaaatcctggcatgtgctttgtacaacaattggtggcctatgctagcagcactcatgtatatcattgtgccaatgccatgcctgttcttcggcgatggatccacacggttcttgagtagcggagagggtggagcgtggatgaaagccgcaaagttcctgaccggcatgtctgccatgggaagcctcgcaatcccggcgatcctgaggcacgctggcctgatcgagacgggggccatgttcattgagttcacctccttcttcatcctcgtgtgcacggtgctgtgcttccacagggctacactggacgaggagtggtagatgcgcaaagaccacagggagggccctagagaagaacgcctgttacgatgtggaaaagaaattcctttggtgggtgggagctaacgcggaagcgtgtacaaaaagatgcatgtctcaaacgcttgactactgtatttatgtattgttagccacgttcccgggattcggtaatctagctggtgacgccatctgtcttatgttaaccttctcgatgtcgatgtcgtcctcgtatgacccgtgctgaaccgacagtgtaaagcatattgatctggtgtgtttataatagacgctagtttttt

SEQ ID NO: 5899 - DNA, 920 bp, Hordeum vulgare
gggagttattggagtccgagtcagagaggagaggagaggaaagcaggaggaggagacgacaggcaggcgctcgccggaccgccgggaagacaaggctcgctccgccggagatggcgatgaccgtggaagtgctcgctggacttgcgtgtatgttctccacgagcgttcttttgcaaatcctggcatgtgctttgtacaacaactggtggcctatgttagcagcactcatgtatatcattgtgccaatgccatgcctgttctttggcgacggatccacacggttcttgagtagcggagagggtggagcatggatgaaagcagcaaagttcctgaccggcatgtctgccatgggaagcctcgcaatcccggcgatcctgaggcacgctggcctgatcgagacgggggccatgttcatcgagttcacctccttcttcatcctcgtgtgcacggtgctgtgcttccacagggccaccctggacgaggagtggtaaaggctcgcgcaaaaccacaaggagtgccctagagaagaacgtctgttaggatgtcgaaagaaatcccttggtgggagggagctaacgtggaactgtgtacaaagaagcgcgcatcaagcgcttgaccactgtatttatgtatacgcgtacccgagataatctagttggtaatccgcgttgaaccggtcgtgtaaagcatatgatctggcgcagttgatagacgcaaagctgtcttttctatggttggtttgccacttgtgcattcagaatctgcacttgcagcatggtacaaactattggatggaatgaagtgacaaggttttgtttggatgttgcaagtgaagccgacgttgctcagttatgtgcgccctaattctttggttgtttgtgtgtgatggtgtcatctttagagaacatatttttggtgcg

SEQ ID NO: 5900 - DNA, 1080 bp, Hordeum vulgare
tcggtcggtgagaggagttattggagtccgagtcagagaggagaggagaggaaagcaggaggaggagacgacaggcaggcgctcgccggaccgccgggaagacaaggctcgctccgccggagatggcgatgaccgtggaagtgctcgctggacttgcgtgtatgttctccacgagcgttcttttgcaaatcctggcatgtgctttgtacaacaactggtggcctatgttagcagcactcatgtatatcattgtgccaatgccatgcctgttctttggcgacggatccacacggttcttgagtagcggagagggtggagcatggatgaaagcagcaaagttcctgaccggcatgtctgccatgggaagcctcgcaatcccggcgatcctgaggcacgctggcctgatcgagacgggggccatgttcatcgagttcacctccttcttcatcctcgtgtgcacggtgctgtgcttccacagggccaccctggacgaggagtggtaaaggctcgcgcaaaaccacaaggagtgccctagagaagaacgtctgttaggatgtcgaaagaaatcccttggtgggagggagctaacgtggaactgtgtacaaagaagcgcgcatcaagcgcttgaccactgtatttatgtatacgcgtacccgagataatctagttggtaatccgcgttgaaccggtcgtgtaaagcatatgatctggcgcagttgatagacgcaaagctgtcttttctatggttggtttgccacttgtgcattcagaatctgcacttgcagcatggtacaaactattggatggaatgaagcgacaaggttttgtttggatgttgcactggaagcgaaagttgctcagttatgtgtgccgtaattctttggttgtttgtgtgtggtcgtgtgatctttagagaacatatttttggtgtgatatctggagagcatttttgtgtgtgatctctagataacatattttaattgttgtgtgtggtctctagaggacttgatagatgcaatggtctcttggatccgttgcccaactcctcaaaacctagaaaaacttgtgagatgtgcttct

SEQ ID NO: 5901 - DNA, 804 bp, Pseudoroegneria spicata
  misc_feature (324)..(324): n is a, c, g, or t
  misc_feature (509)..(509): n is a, c, g, or t
  misc_feature (645)..(645): n is a, c, g, or t
  misc_feature (754)..(754): n is a, c, g, or t
gaggagttattggagtcagagaggagaggaaagcaggaggagacgacaggtgctcgcccgcccgcctgccgggaagactcgctcgccggagatggcgatgaccgtggaagtgctcgctggacttgcgtgtatgttctccacgagcgttcttttgcaaatcctggcatgtgctttgtacaacaactggtggcctatgttagcagcactcatgtatatcattgtgccaatgccatgcctgttcttcggagatggatccacacggttcttgagtagtggagagggtggagcgtggatgaaagccgcaaagttcctaaccggcatgtntgccatgggaagcctcgccatcccggcgatcctgaggcacgctggcctgatcgagacgggggccatgttcatcgagttcacgtccttcttcatcctcgtgtgcacagtgctgtgcttccacagggccaccctggatgaggagtggtaaaggcgcaaagaccacaaggagtgcccgagagaacgtntgctaggatatatgtcagaagaaatcccttggtgagagggagctaacgcggaactgtgtacaaaaagatgcatgtttcaaacgtatgactgctgtattttgtgtattgtcatacacgtacctgagattcggtaatntagttggtaatccgcactgaaccggtcgtgtaaagcatattatctggcgcagttgatagacgcagtcagtctttccttggttggtttgccacttgtgcattcaagaatntgcacttgcagcatggtacaaactaaagttgctcagttatgtgtgcccta

SEQ ID NO: 5902 - DNA, 718 bp, Avena sativa
ccgccggagatggcgatgaccgtggaagtgcttgctggacttgcgtgtatgttctccacgagcattctcttgcaaatcctggcatgtgctttgtacaacaactggtggcctatgttagcagcgctcatgtacatcattgtgcccatgccatgcctgttcttcggtgacgggtccacacggttcttgagcagcggagagggcggagcgtggatcaacgcggcgaagtttctgacaggcgcgtccgccatgggcagcctggccatccccgcgatccttaggcacgccggcctgatcgagacgggtgccatgttcatcgagttcacgtccttcttcatcctcgtgtgcaccgtgctctgcttccacagggccaccctggacgacgagtggtaaaagcaagccacgagacgcgaggagagtccgtttctaaggggtgtcgcctcctcgccgtctctcttgacgacgccggatagaaagaaaggattccctctgtgtgggtgggttgctaacgtggctacatggaactgtgtacaaaggaagcacgcctggagtgcacggctgctgtatttgtgtgttattattatacacgtactcgagatgggtggtctagtggcgtgatgccgacatgccgttgttttcgtttaaccccttcccttgtcgttgccgtgccgaatcacgccggcctgtaggacatgtgactcggcactgttgtttatatgag

SEQ ID NO: 5903 - DNA, 785 bp, Avena sativa
gctcgccgggaagattcgcgccgccgccgcaattccccccgtccgccggagatggcgatgaccgtggaagtgctcgctggacttgcgtgtatgttctccacgagcattctcttgcaaatcctggcatgcgctttgtacaacaactggtggcctatgttagcagcgctgatgtacatcattgtgcccatgccatgcctgttctttggtgacgggtccacacggttcttgagcagcggagagggcggagcgtggatcaacgccgcgaagttcctgactggcgcgtccgccatgggcagcctggccatccccgcgatcctgaggcacgccggcctgatcgagacgggtgccatgttcatcgagttcacgtccttcttcatcctcgtgtgcaccgtgctctgcttccacagggccaccctggacgacgagtggtaaaagcaagccacgagacgcgaggagagtccgttactagggtgtcgcctcctcgccgtctctcttgacgacgccggatagaaagaaagaattccctctgtgtgggtgggttgctaacgtggctacatggaactgtgtacaaaggaagcacgcctggagtgcacggctgctgtatttgtgtgttattatttatacacgtactactcgagatgggtggtctagtggcgtgatgccgacatgccgttgttttcgtttaacctcttcccttgtcaagaatcacgccggcctgtaggacatgtgactcggcactgttgtttatatgagcagtttggctgcaatctgcaatggtgaacaaa

SEQ ID NO: 5904 - DNA, 950 bp, Brachypodium distachyon
gcagtgccgtattgacgccgctcggtttggctcgagtcggtcggaaagagtcagactcggagcggaaaggaggagacgacgaaaggaaaggtgctcgctcggtcgccggggagattctcgccgccgccggagatggcgatgaccgtggaagtgctcgctggacttgcgtgtatgttctccacgagcattctcttgcaaatcttggcatgtgctttgtacaacaattggtggcctatgttagcagcactcatgtatatcctcgttccaatgccatgcctattctttggtgatggatccacacggttcttgactactggagagggtggagcgtggatcaatgctgcaaagtttctgaccggagcgtctgccatgggcagcctcgctatcccagcgatcctgaggcatgctggcctgatcgagaccggggccatgttcatcgagttcacgtccttcttcattcttgtgtgcacggtgatgtgcttccacagggctaccctggacgaagattggtgaaaggtgcaagacagccaaggagtacccaagaagaagagcagtgctggtgtcgcttcgccttctctcttgacacctgaaaagaattcccttggtgggagctaacatggaactgtgtacaaagaagcatgtttcaagtgcatgactactatatggagtataaatgtagttaagatcctgcagtcaagtggcaatgccattattttacttccacttcttcatgtcaagtttttctgtgtgttatccatggcgaactgccgttgtaaaacatgacctggtgcactgattgacaccgtttttattaggttggttgtcacttctatatattttctggattcatatttgcatttgcactttggtggtgaagtctttgtgctccgacattgacatatttagattcttctaagataagctaattggaatttagttctgggtcaaaa

SEQ ID NO: 5905 - DNA, 862 bp, Brachypodium distachyon
gacgccgctcggtttggctcgagtcggtcggaaagagtcagactcggagcggaaaggaggagacgacgaaaggaaaggtgctcgctcggtcgccggggagattctcgccgccgccggagatggcgatgaccgtggaagtgctcgctggacttgcgtgtatgttctccacgagcattctcttgcaaatcttggcatgtgctttgtacaacaattggtggcctatgttagcagcactcatgtatatcctcgttccaatgccatgcctattctttggtgatggatccacacggttcttgactactggagagggtggagcgtggatcaatgctgcaaagtttctgaccggagcgtctgccatgggcagcctcgctatcccagcgatcctgaggcatgctggcctgatcgagaccggggccatgttcatcgagttcacgtccttcttcattcttgtgtgcacggtgatgtgcttccacagggctaccctggacgaagattggtgaaaggtgcaagacagccaaggagtacccaagaagaagagcagtgctggtgtcgcttcgccttctctcttgacacctgaaaagaattcccttggtgggagctaacatggaactgtgtacaaagaagcatgtttcaagtgcatgactactatatggagtataaatgtagttaagatcctgcagtcaagtggcaatgccattattttacttccacttcttcatgtcaagtttttctgtgtgttatccatggcgaactgccgttgtaaaacatgacctggtgcactgattgacaccgtttttattaggttggttgtcacttctatatattttctggattcatatttgcatttgcactttggtggtga

SEQ ID NO: 5906 - DNA, 883 bp, Sorghum bicolor
gggacgaaaggaaaaaaaaaaaaaaggtctcgagtctcccctgtcccctccctccctacgctcgctgtagaggaaaggcgaagatggcgatgaccgtcgaagtgcttgctggactcgcgttcatgttctccacgagtattctgctgcagatactggcatgtgctttgtacaacaactggtggcccatgttagcagctctcatgtatgtccttgtaccaatgccatgcctgttttttggtggtggatccacacacttcttgactagcagagaaggtggagggtggatgaatgctgcaaaattcctgactggtgcgtccgccatgggaagccttgctattccagcaattctgaggcatgctggcctaatcgaaacgggggcaatgttcatcgagttcacgtccttcttcatccttgtatgcacggtgctgtgcttccatagggctaccctggatgaagactggtaaatgcgcatgcacggaaccccctaaacctgaagattagccattctgtggccacttttctccatgctaagaaaactcctgacatggatctgtatgtacaaagaagcaaatttcgagcttacgtagctgatgttttatgtatacacttgttaagattctgtagtcatgtggcaatgcagattgcgttacgatcactctgataatttattgtcgtcgaatgttctgtggtgaaggaaccatccgtgtaaaacatgaccgagagcagataccctacttggctacttatgtcgtgggctttgcgttaacctattatggatgaagtgatgaactgatgattggatcttgatggcgatattttgtttgtatttggagtgtcgatttgaaaagtaaaagactcaattgtgaagcaagcctcaaattac

SEQ ID NO: 5907 - DNA, 710 bp, Saccharum officinarum
ctcgagtctcccctgtcccctcctcccccaacgctctcgctgtagaggaaaggcgaagatggcgatgaccgtcgaagtgctcgctggactcgcgttcatgttctccacgagtattctactgcagatactggcatgcgctttgtacaacaactggtggcccatgttagcagctctcatgtacgtccttgtaccaatgccatgcctgttttttggtggtggatccacacatttcttgactagcagagaaggtggagggtggatgaatgcagcaaaattcctgactggtgcgtccgccatgggaagcctcgctattccagcaattctgaggcatgctggcctaatcgagactggggctatgttcatcgagttcacgtccttcttcatccttgtatgcacagtgctgtgcttccatagggctaccctggatgaagactggtaaatgcacatgcacggacgaccccctgaacttgaagaatagccaatctgtggccgcttctctccatgctaagaaaaattcctgttggaagctaacatggatctgtagaaagaagcgtatttcgagcgtacgaagctgatgttttatgtagacacttgtgaagaatctgtagtcatgtggcaatgcagatgttattaccttcaccttgactttgtcgtaacatgttctatggtgaaggacggaatcatccgtgtaaaacatgaccaggacaccc

SEQ ID NO: 5908 - DNA, 779 bp, Pennisetum glaucum
ggggggacgggagcacacgagtctttttcttcttcttcagagagagaggaagcgaagcaggtgaggaaaggcggagcagcagcccgacatggcgatgaccgtcgaagtcctcgctggacttgcgtttatgttctccacgagtattctgctgcagatactggcatgtgctttgtacaacaactggtggcccatgttagcagctctcatgtatgtcctcgtgccaatgccatgcctgtttttcggcggtggatccacacacttcttgacaagcagagaaggcggggggtggattaatgctgcgaaattcctgaccggcgcgtctgccatgggaagccttgcgatcccagccatcctgcggcacgccggcctaatcgagaccggcgccatgttcatcgagttcacgtccttcttcatcctcgtatgcacggtgctgtgcttccacagggctaccctagacgaagattggtaggtgcgcgcgcgcgcggaccctgaagaagaatagtggccgctttgatcgcgcccgtcactcccatgctgagcaggaggaaaatcatgttgttggaagctagcatggatctgtacaaaagaagccaattcgaaccgtaacgtgtcaatgcagtcgttactacgttcactttgacgtagccgtggccatgttgcatggtgaaggaacccatctgtgcagtgtgaagcttgaccaagagccacgggcaccctacttgtttgggtggttgcccgcatcgcgttattaacatagtatttatccatccaatggaacc

SEQ ID NO: 5909 - DNA, 955 bp, Panicum virgatum
ggccgccgccgaagtgatcacttggtaccctaccctaacggcgcccaaagcaaagcaaagcaaaaaaaaaaaaagagaaggggagacccttacaggtgggcctcccaccttaagtaggacccgcttgtctgtctccacggaacgggaagagtctccggtctccgcacgagtcggtcacaaacagaagaagagaagaggtgaggaaaggcgaagcttctcctcgcaacgatggcgatgaccgtcgaagtgctggctgggctcgcttttatgttctcgacgagcattctgctgcaaatactggcatgtgctttgtacaacaactggtggcccatgttagcagctctcatgtatgtccttgtaccgatgccatgcctgttttttggtggtggatccacacactttttgacaagcagagaaggtggagggtggattaatgctgcaaaattcctgactggtgcatctgccatgggaagcctcgcgatcccagctattctgaggcacgcaggcctaattgaaactggtgccatgttcatcgagttcacgtccttcttcatccttgtatgcacggtgctgtgcttccatagggctaccctagatgaagattggtaaatgtgcatgcacggacccctgaagaatagcaattctgtggccgcttctctccatgctaagcagaagaatttctgttggaagttaacaattagcatggatatgtacaaagaagtgtatttgaaacccctggctgatgtttcatataggcactctttaagatctgtggtgacgtggcaaggcagatgttatttcgatcacttgacatcgtagtcgcatgtttctgtgaaggaacccaatctgtgcaaaacatgagcaagagcctgtacacggtacaccattcttctttgctggccgctacattgcctcaacatgttattcagtgaagtgatggaaacttgatgctgat

SEQ ID NO: 5910 - DNA, 697 bp, Cynodon dactylon
ggggggggggcgaggagaggaacttgcatcgtctgcctaccaaggatcaaggatggcgatgaccgtcgaagtactcgctggactcgcgtttatgttctcaacgagcattctactgcagatactggcatgtgctttgtacaacaactggtggcccatgttagcagctctcatgtatgtcctcgtcccaatgccgtgtctgttctttggcggtggatctacgcagttcttgactagcagagatggtggagggtggattaatgctgcaaaatttctgactggtgcgtccgccatggggagcctcgccattccagcaattttaaggcatgctggcctaatcgagactggtgccatgttcatcgagttcacatccttcttcattcttgtatgcacagtgttgtgcttccatagggctaccctggatgaagactggtaaacgcgcatgaagccatgaagtgtcatgaatagcctttctctagtgggttctccccacgctaaaagcatgactgttggaagctaacatggacctgtacagagaactgtgtggccaacgttttatctagatttctcaggactatttcacctgatttgtcaagatatttttcacatattctgtggggaatcggcagtgtattacatgagatcttataacatttacgttggttggctgctatgttgcatcaatcaacttgataacaac

SEQ ID NO: 5911 - DNA, 974 bp, Zea mays
gggacgaatattatctcaaaaaaaagtcttgagtcccccctctccttccccttcccaacgctctcgctgcagaggaaaggcgaagatggcgatgaccgtcgaagtgcttgctgcactcgcgttcatgttttccacgagtattctactgcagatactggcatgcgctttgtacaacaactggtggcccatgttagcagctctcatgtacgtccttgtaccaatgccatgcctgttttttggtggtggatccacacacttcttgaccagcagagaaggtggagggtggattaatgctgcaaaattcttgactggtgcgtcggccatgggaagccttgctattccagcaattctgaggcacgctggcttaatcgagaccggggccatgttcatcgagttcacgtccttcttcatccttgtatgcacagtgctgtgcttccatagggcgactctggatgaagactggtaaatgcgcatttcaccgtcaccctgaaccctagcggttcttggctgcttctgtccatgctaagaaaaattcctgttggaagctaacatggatctgtacaaagaagcgtatttcgagcgtagccgtagctgatgtcttatgtagacacttgtgaagattatgtggtcatgtggcaatgcagatgttattaccttcactttgactttgtcgtcacatgttctatggtgaaggaaggaatcatccgtgtaaaccatggtcagggcacgccctacttggctcctaattctatcgcaggctttggggttaacctattatgaatggaataataggatcttgatgaccgaaagaaaagggagagctaattagtcacatggctcggccgatgtatttttttttcatatttgcattcatgaatctgtctaggatattacatattgtggtctgaatctttataaatcacttgttttgcggtctgaatctttataaatttctacctgtgctcctggttcta

SEQ ID NO: 5912 - DNA, 834 bp, Panicum virgatum
agtcgtcacaaacacaaggggagagagagacagaggtgaggaaaggcgaagctcctcctcctcctcgcccacgacgatggcgatgaccgtcgaagtgctggctggactcgcatttatgttctccacgagcattctgctgcaaatactggcatgtgctttgtacaacaactggtggcctatgttagcagctctcatgtatgtccttataccaatgccatgcctgttttttggtggtggatccacacactttttgacaagcagagaaggtggagggtggattaatgctgcaaaattcctgactggtgcatctgccatgggaagcctcgctatcccagctattctgaggcacgcgggcctaattgagaccggtgccatgtttatcgagttcacatccttcttcatccttgtatgcacggtcctgtgcttccatagggctaccctagatgaagattggtaaatgtgcatgcacggaccccagaagaatagcaattctgtggccgcctctctccatgctaagcagaaaaattccagttggaagttaacaattagcatggatctgtacaaagaagtgtatttgaatcccctcgctgatgttttatataggcactgtttaagatctgtggtgatgtggcaaggcagatgttatttcgatcactttgtcatcgtagtcgcatgtttctgtggcgaaggaacccaatctgtgcaaaacatgtgcaagagcctgtacacgatacaccatagtacttctttgggtggccgctacattgccttaacatgttattcaatgaagtggtggaaacttgatgctgatatttgtttgattctgaactgttg

SEQ ID NO: 5913 - DNA, 1348 bp, Oryza sativa
acctcgagagtgaggaggcagttgtagccgaggtcgaggcgctccagattcacgaagctgctcaggcacgacacctacacaaaaaccaacacagcacagcaccgcacaacacaaggatgagaaaacatggcaggaaaaaaaacaccaatcgacgaggcagaggctacacagcaccgacgtcggagagggcgcggtgggagaggttgagcgacgtggcgagcgtcccggcggatcccgcctcgcgcttcgcctgctccaccgtgagccgcgccatctcctcctcctccggccgccgccgttgaggagggcgaagcgaagcaagcgctcgttgcggcggcaggcgagctgagctctcaagtctcaaagacttcaagagagaaaaataccctaacctaacaagggcgatatgcagctgacatgtggggcccactgtcagcctccacggagtatttctctctcttctcgttagagaggggggtaaagcgcaagagactcgcaacgcaggtcagagcggaaggggagaagaaggaggtgctcctctcgagtttggagaaaatttcccccgcagaggcctccgcttgctcgcggagatggcgatgaccgtcgaagtgctcgctggacttgcatttatgttctcaacaagtattcttttgcaaatactggcttgtgctctgtacaataattggtggcctatgttagcagctcttatgtatgtccttgtaccgatgccatgcctattcttcggtggtggatctacccagttcttgactagcagagatggtggagggtggttcaatgctgcaaaattcctgactggtgcatctgccatgggaagcattgcaatcccagcaattctgaggcacgctggcctaattgagactggagccatgttcatcgagttcacgtccttcttcatccttgtatgcacagtgatgtgcttccatagagctacgctggatgaagattggtaaaaggctcgaggcacatggacacaagaaggtaaatctgtttcatggtttgcttctcagcacgtacaagagaaattccttagtggacactaacatggacatgtgtacaaagaagcaaatatttgagttggcgtgactgtctgtataaatgctcaaagatttgctgatctagcgacaatgccaatgttctatgtgcacttttcatgtgaatactcctcacatgatctatgggcaacctgtcagccatccgtgtgaaatgcgatcaaacgagcaggcaggcgccctgtttaattcccttgattggttctttgcattttgaagcatttggccaccgtgcggcagctcgtctcctgctgcatctctccaccgtttcgcttctc

SEQ ID NO: 5914 - DNA, 1507 bp, Setaria italica
cgagaggaagcaaagcagagcaggtgaggaaaggcgaagcttctcctcgccaacatggcgatgaccgtcgaaggtgggtgtgcttcttcctcccctaaatttcaaccggttatgcgagttcctcttcgcttgagatccgattcgtgtgtggaatcgtggggattgggtgggtgcttgtggttttctgcggattagggcttgggagatcccaattagactacgggtgctgctctttaaggtatggattgtgagttgtgtatctcttgttagtccaggttctctgcagcgccaagcaaccctggatgcttactgcgatcgaggttggtgtatgtgtaaatttttgatttggatcagtggaaattaattggtcagattagtcttagacaaagcgatttagttgctcggccagttcagttccctgaaaatccggggtctaattagatcgtccaagtattgatcctgttgtaccaggtcttgtgtgttgccactacaagtagtcgttgtttgggagttagattcgtgaaactcattgcacgaaatgtagtttggttatagtgttctcatcgttttctagtagtctgttatagttggttatagttttccataatatttttaggctctagtgctctgattagcttacatatatatcagacattcagactggcagctatttttgttgttcaaatagcttcaaggttctaatttcaatgactaactctacgtgctatttttcttcctgtcctccgtacttttgtgctggatgatgctgttcacttactcttggtgtttctcgtgacagtcctcgctggacttgcctttatgttttccacaagcattctgctgcagatactggcatgtgctttgtacaacaactggtggcccatgttagcagctctcatgtatgtcctcgtaccaatgccatgcctgtttttcggtggtggatccacacacttcttgacaagcagagaaggcggggggtggattaatgctgcaaaattcctgactggtgcgtctgccatgggaagccttgccatcccagctattctgaggcacgctggcctaatcgagactggtgccatgttcattgagttcacgtccttcttcatccttgtatgcacagtgatgtgcttccacagggctaccctagatgaagattggtaaatgcgcatgcacggaccccttaagaatagtgattctgtggccgcttgacggcttctctccatgctgagcagaaaaattcctgttggaagctaacatggatctgtacaaagaagccaatttgaacctcttggctgatgttttatatagaaactcttaagatctgtggtcacgtgtcgatgcatatgttactacgttcacttgacatcgcggtggcatgttctatggtgaaggaaccatctgtgtaaagcatgaccaagagtacggacaccctacttctttggttggctgccacattgcgttaacatattatccaatggaacctaatgccaacatctgtttgattctg

SEQ ID NO: 5915 - DNA, 553 bp, Musa acuminata
gcctcagcttcggccttttggtggagaaaagatggcgatgaccgtcgaagtgcttgctggccttgcttttatgttctcggctagcatcttattgcaaattctggcatgtgctttatacaacaattggtggcctatgttatcagcgctcatgtatgtgctattgccgatgccatgtctgttctttggagatggttcaacacgtttcctgactagcagggaaggagggggctggattaatgctgctaagttcttgactggggcatcagctgtggggagcatagcaattccagcaatcctgaggcatgcccacctaattgagacaggagccatgttaatagaattcacatctttcttcatccttgtttgcactgttctttgtttccatcgtgttagtcttgatgaagacttctaaatctgtacttgagtccaatgacagaaaaacactagaaccatgttccatgtatcagtgactcaggtcgacaatgtacccaatttttagcagccagagagcctgttcaaaacttcatcatcaaattatcatggtgtttgcatc

SEQ ID NO: 5916 - DNA, 759 bp, Musa acuminata
atgtatacggtggcatacagagaggtacttgcggtcgcacacgtctccgacccaaacccaaccctgctgcgctttatttcgatcattcgccttagcttcggcccttcggtggagagaaaagatggcgatgaccgtcgaaggcttgctggccttgcttttatgttctcggctagcatcttattgcaaattctggcatgcgctttatacaacaattggtggcctatgttatcagcactcatgtatgtggtattgccgatgccatgtctgttctttggagatggttcaacacgtttcctgactagcagggaaggagggggctggattaatgctgctaagttcttgactggggcatcagctgtggggagcatcgcaattccagcaatcctgaggcatgcccacctaattgagacaggagccatgttaatagaattcacatctttcttcatccttgtttgcactgttctttgtttccatcgtgttagtcttgatgaagacttctaaatctgtacttgagtccaatgacagaaaaacactagaaccatgttccatgtatcagtgactcaggtcgacaatgtacccaatttttagcagccagagagcctgttcaaaacttcatcatcaaattatcatggtgattgcatcaactaagctacaagttttatgcatgtttcagcagagaaaatggcaagtgatgatacttatggtttgtagtctggtggtgtgcttgtgttataggttcatcatccatctaagatcctc

SEQ ID NO: 5917 - DNA, 536 bp, Allium cepa
aaccaaacagtaaataaatatcagattgtactgctactttgcccccgagtttttggtttggcttcggagatggcgatgacagtagaagtgcttgctggtctggcttttatgttttcatctagcatcctacttcaaatcttggcttgtgcattgtacaacaattggtggccaatgttatcagctctgatgtatgttgtggttcctatgccatgtctattctttggtgatggatccacccgtttcttgaccagtaatgagggtggtggattcatgaatgctgctaaatttttgacgggtgcatctgctgtaggaagcattgctattcctataattctcagacatgcaggcttgattgaaaccggagctatgttaatagaattcacctcttttttcattttagtggttactgttctttgcttccataaagtaagcttagatgaagatttttaggttcattcttgattgtaaaatatagaaaaaagagttgacaatggtccatgtattcaatgtacaggtgcatgcttacatgtattcta

SEQ ID NO: 5918 - DNA, 969 bp, Sesamum indicum
caccattgacgatctaaaaagctttcttgatgagctctctttcaatctccactcgcaatccctaaataatttcagtgcggagtcttgaatttgttcttcttttacatcccttgcagcagaagattcgtgttgttattgttgtagcgatctcaatcaaattaactggaaagttctgaagttcgacagcaatctccaaactattgaatttctctcttcaaacaaaatcctcatagttgcagaaatggcaatgaccattgaagttcttgcaggacttgctttcatgttttcagctagcatcctgctccaaatcttggcttgtgcaatatacaacaactggtggccgatgctatcagctctaatgtatgtactggtgccaatgccttgtctgttttttggcggtgggtccactcagttcctaaccagtcgagatggtggggggtggatggatgctgctaagtttttaactggagcatctgctgtcggaagtgtggctattccaattattctgaggcatgcaggcttaattgggactggagctatgttcattgagttcacatctttcttcattttcgtctgcacagtcctttgctttcatcgtgctagtcttgatgacgagtggtaacatcttcatgagtgcattaagtgatacttactgtaaatcccataccagtcaaatgttggattagctgacgctacgggaagaaatatttagcaagaaagtactggaaagggtgaaaaagcagggataatactttccaccatgtacagataaattcttggtggtctgagttcggtaaggtcgtgaccagttcatgtaaaactttcaacctggattaattgctccggagaccaagggaaggcgagtttgggtgctcaatggtgtacaatttgaaataatttatttgtatgatggctccttgattcattaatttcatgttaattactagggttaattttacctatacctcc

SEQ ID NO: 5919 - DNA, 668 bp, Elaeis guineensis
cgaggaaatggcgatgaccgtcgaagtgcttgctggacttgcttttatgttttctgctagcattctgcttcaaatcctggcatgtgctttatacaacaattggtggcctatgttatcagctctcatgtatgtgctggtgcccatgccctgtttgttctttggaggtggttccacaagtttcttgaccagcagggagggtgggggctggattaatgcagcaaaattcttgacgggtgcatccgctgttggaagtattgctattccagcaatcctgaggcatgccaacatgatcgagacaggagccatgttcatagagttcgtctcctttttcattctcatctgtacggttctttgtttccaccgagttagcctcgatgaagactggtaggaagctgccggtgaggatcgaccaaagaaacggaagggacatgtaacccatgtattgcttgtgtacagttattgcatatattttctctcggtggaaagaggtaatggcattgcacccttcatgtatttcactgggacaaatgaaccgatttttgaagaaccggagtagctggtttgagctcgtcatgtaacatcagtattagattccgatatactatgtgacaattttagcaggcaatatcacaactttggtcccctcacgcaccaaaaaaaaaaaaaaa

SEQ ID NO: 5920 - DNA, 605 bp, Triticum aestivum
ggagatggcgatgaccgtggaagtgctcgctggacttgcgtgtatgttctccccgagcgttcttttcccaatcctggcctgtgctttgtccccccactggtggcctatgttagcgcccctcatgtatatccttgtgcccatcccctgccttttctttggcgccggatccccccggttcttgagtagcggagagggtggagcctggatgaaaccccccaattttttgaccggcatttctgccctgggaagcctccccctcccggcgatcctgaggccccctggcctgatcgagacgggggccattttcatcgagttcccctcctttttcatcctggtgtgcccggttctgtgcttcccccgggctaccctggacgaggagtggtaaaggctcgcgccaggcccccaggagtgcccgagagaagaacccctgttaggatttggaaaagaaatcccttggtgggagggagctaacgtggaactgtgtaccaagaagcgtgcttccagcgcttgactactgtatttatgtatacgcgtacccgagattcggtaatttagttggtaatctttgctgaaccggtcgtttgaagcatatattattcggcccc

SEQ ID NO: 5921 - DNA, 563 bp, Papaver somniferum
aaaacagtacattagtttcctctaagcttccttcctcatcgtcttcacttcggttgtaaaatttctcttcggtttcacgcaatctagaacaagaaatatggctatgtcggtcgaagtgcttgcagggctggctttcatgttctcagctagcattttgttgcaaattctggcctgtgcaatttacagcaactggtggccgatgttggcagcgctcatgtacgtgatggtacctatgccttgtttatttttggtggtggatccactgcattcttaaccagccgtgatggtggaggctggatggatgctgcaaagttcttgacaggagcatccgcagtaggaagcatcgccattcctgcaatccttaggcatgctggtctgatcgaaacaggagctatgttcattgagttcacttctttcttcattcttgtttgcactatcatgtgttttcatcgtgctagtcttgaagatgaatggtgatggatttatattggaaaatagaacaaaatataacagagtattattgtatgattttctgccagtggattcaaatgtaaaatttaaga

SEQ ID NO: 5922 - DNA, 764 bp, Ocimum basilicum
tttctgatgtgccatctttcaactcccattctcaaaaccctagcaaattccggcatgtaattttcgtcttcgcttgaattgcttgctgccgaagaaattatactttcattgactaagcactaagcaggcaaattgacttgaagatcttgaagtccgacctgtgatcttaagtactagcagaaatggcaatgacaattgaagttcttgcaggacttgcattcatgttttcatccagcatcctgctccagatcttggcttgtgcaatatacaacaactggtggccaatgctatcagctctgatgtatgttctagtgccaatgccctgccttttctttggtggcggatccactcagttccttatgagtcgagatggtgggggttggatcgatgctgctaagtttttaactggtgcatctgctgtgggaagtatggccattcccatcattctgaggcatgcgggcttgatagggagtggagcaatgtttattgaatttacatcttttttcatattcgtctgcaccgtcctctgctttcatcgtgccaacctcgacgatgagtggtaacgttctttgtgatcaaacagaaatttggccagtttcaagcagtccatgttgtttgagttgacaagaaaggtgaaaaaggaactgaagatgaagatatcctaacatgtacatataactagaggggtttattgctgattgtttttttttgagttgggtgactgaagcacaaattagttgctgatcctagtcataatctgatat

SEQ ID NO: 5923 - DNA, 737 bp, Solanum melongena
aagaatcagattttggatcagcgatcaacaattttttcttcctattttgcaccttcaaaattaaccataaatggcgatgaccattgaagtgcttgcggggcttgctttcatgttctcttccagcatcttgttacagatcctggcgtgtgctctatacaataactggtggccaatgttatcagctcttatgtatgttgtggttcccatgccatgcatgttctttggtggtggatcgacacagttcctaataagtcgagatggagggggctggatggatgctgctaaattcttaacaggggcatcagctgtgggaagcatagccatccccattattctcagacatgcagatcttatccagacaggagcaatgttcatcgaattcgtgtcattcttcatatttgtctgcacagtcttgtgtttccatcgcgccaatcttgatgacgagtggtaatatcaaaatcgaggtgttgccctttgcgttcgtcggctgtaattatgttgcctggttttgacaaacaagaaaaaaatgccaacaaaaggtagctgaaaaggaaggaaacaatgctagaaatgaactagaaattttatgtatcaatgtgtatagctttgtcaaatgtcagatttcttgatgtttgaaccttttgctgatggaacaaagatcatctttttatgttactatttgcacagatagttgctaacagatcataaatactcaattctgtggatgtttcttttcg

SEQ ID NO: 5924 - DNA, 984 bp, Plantago ovata
gccgggggaaaccggaatcgataataatgaaacgtagcaactagcaaagtcttggtgcggaaattcaacgaacacacctgacctggtggcaatcggcgatcttctctgctcaaatccgtctttaatttttcactggaacaaacatcagccataaacctctcaaactctcgcaaaacacagtctaatataattgggaatttgcgaagctagagaaaggggtacttaatagcttgaagttctttatttaagcaaaattcttatactttgctgagatggctatgacggttgaagttcttgcaggacttgctttcatgttttcatccagcattcttctccagatattggcttgtgcaatatatagcaactggtggccaatgttgtcagctcttatgtacgttatggtgcccatgccttgtctcttttttggtggtgggtccactcagttcctaatcagtcgagatggtgggggttggatggatgctgctaagttcttaacaggggcatctgcagttgggagcatagccattcccgttattctacatcatgcaggcttgattgggactggtgctatgctcatcgagttcacatctttcttcatattcatttgcacggttctttgttttcatcgtgccactcttgatgacgaatggtaaattctcagtggatgtttatgtaaaactgcatcagaatgcttgcacgaatttttcaagaggaaagttggtccaaatggagaggaaaaaaaaagaaggtataaatgacatgtacatctaacttcttttcaactattgtaagtttgtatatccattattggctattttagaatcaggttagttcaacacaaagatgttcacttagtttcatgtagtgatttttgctactccggagtactatgtaataatttcggaagctgattttatttatgccttgaccttaactccccactgccactgagcatgaatatattaagtatggttgacacttggc

SEQ ID NO: 5925 - DNA, 879 bp, Triphysaria pusilla
ggacccctaagtgtctgattaccctttttccctttcaaattcaagggatgagagtgtataattattgataactatgataaaagaatatttgtgagcaaagtccctctttctttcactttcaatattcattttgcgaaattgcagattttgtcttgcttttctcgcttgtgcgcgagttaattctctattattggtaaaatacattaatatcagctcaagcttgtcttcagtctccagttcttcagtttgtttctcaagtacctgcttgaatggcaatgacagttgaagttctcgcaggacttgccttcatgttttcagccagtatcctgctccaaatcttggcttgtgcaatatacagcaactggtggccaatgctatcagctcttatgtatgtcctggtgccgatgccttgtctcttttttggtggtgggtccactcagttcctattaagtcgagatggtggggggtggatggatgcggctaagtttttaacaggcgcatccgctgttggaagtttggccataccgataattctaaagcatgcgggcttaattgggactggagctatgttaatcgaattcacatctttcttcatatttgtctgcacggtcctttgctttcatcatgctagtcttgacgacgagtggtaatgtttagactagctgacattagttacttaagaaaagctggcttgaaatattggaataggatatgatatcccaacacgtacagttttgtatttgtaaaacttggaaccttgatgattagtagttgtaagttgtaacacttgatcaagcaagcaagctcccaagtccaaaagggtgtatttactaaatttttttacttcattactatcatgttaatttgtggcaaaaaaaa

SEQ ID NO: 5926 - DNA, 434 bp, Vinca minor
gaaatggcgatgactatagaagtgcttgcagggcttgccttcatgttttcagcaagtattctgttacaaattctggcttgtgcgatatataataattggtggccgatgttatcagctctcatgtatgttatagtacccatgccatgtttgttctttggtggtggttccactcaattcttaattagtcgtgatggtggaggatggatagatgctgccaagttcatgacaggggcgtcggcagtggggagcatagccattccaatcattcttaggcatgcagatttgataggaacaggcgctatgttcattgagtttacgtccttcttcatctttgtctgcactgttctgtgttttcatcgtgctagtcttgatgatgagtggtgatggcgtagcgtgtatacggctggggttcaactgtacaaaaagattagcag

SEQ ID NO: 5927 - DNA, 539 bp, Persea americana
cccctttctccttcctcgttcgaatcgcagaaatgtctatgacgattgaagtactggctggactcgctttcatgttttctgccagcattctcttgcaaattctggcttgtgctctatacaacaactggtggccaatgttatcagctctcatgtacgtgctggttccgatgccttgtttattctttggtggtggttccactcagtttttaacctagcagggatggtgggggcgtggatcgaagctgcaaagttcttgactggtgcttctgctgttgggagcattgccattcctgcaattctgaggcatgcacatctgattgagacgccagccatgcttattgaattcacatccttctttattcttgtttgcaccgttttgtgtttccatcgtgttagccttgaagaagattggtaaagccaaggagtatcttatttcatttgcatgtacagtaaatccagccattgaactgtaagcaccttatttgaaaatccattgacaagaagaaacaaaaaaagagagggatatttagtagtccata

SEQ ID NO: 5928 - DNA, 3036 bp, Hordeum vulgare
ccgacccccacccccgtccacgaaccaacggaggcggcatctccaccgccggcggcgagcaatccggctagggtttccgcggccccgtcgagcgacccacccgatgggaccgggcgcgccgtccccggaggacgccgcgggcggggagccggaggcgtggtacgggagcatccagtacctcgtcaacatctcggcggtgggcgccgcctcctgcgtgctcctcttcctcctcgtcaagctccgcttcgaccaccgccgcatcccggggccctccgcgctcgccgccaagctgctcgccgtctaccacgccacggcgccgcagatcgcgctccactgcggcgccgacgccgcccagttcctcctcttcgagcgcgcctccttcctcgtcctcgccgccgtctccgccgccgccttctccgccgcgctcccgctcaacctgctcgccggggacgccgccatcgccgaccagttcgccgccaccaccatctcccacatccccagggcctccccgctgctctggctccacctcctcctcaccgccgccgtcgtcgccatcgcgcacctcggcatctcccggatggaggacgccctccgcatcacccgcttccgcgacggcaacggcaaccccagcgaccccaactccagctccgtcgccgtcttcaccatcatgatccagggcatccccaggacgctcgccgccgacaagaccccgctcaaggactacttcgagcacaagtaccccggcaaggtctaccgcgtcattgtgcccttcgacctctgcacgctggagtacctcgccgaccagtgggggaaggttcggaacaagatctcctggctggaggcaaggatggacgcccgcagcctgtttgacgagtttgtgcaggatgaatcagggcacttggaagcgcattggcttgtcaggagatgcaaagagctgtgggcaatggccgcgcagaggttcgggtttactgatgatgagaggctaaggaagctgcagacaagtaaactcgtgattgggagcaggctttcggattacaaggaaggccgtgcgcctggtgctggcatagctttcgttgtgttcaaggatgtgtacacggcaaacaaggctgttagggatttccggatggaaaggaagaagacacccattggcaggttcttcccagtgatggagctccagcttgagaggagccgatggaaagtggagagggcgccaccggcatcagatatctactggaatcatcttgggatgaacaagacctcactagccttgcgccggattgctgtcaacacctgcctcatcgtaatgctcctgttctttagttcacccttgtcaatactcagtggaatgcaaaacgcagcacggatcatcaatgtggaggctatggataatgccaaatcatggattgtttggcttcaaggctcaagctggttctggacaataatctttcagtttctacccaatgtcctcatcttcgtgagcatgtatattatcatcccatcagtactgtcgtacttttccaagtttgagttccatctgacagtgtcgggagagcagagagctgcattgcttaagatggtttgcttcttccttgttaatctcatcttgttgcgtgcgctggtggaatcgtcgcttgaaagttggattcttagcatgggacggtgctacttagatagtgctgattgcaagcagattgaacattacctgagcccatcattcttatcgagatcatcactttcttccctggcgttcttaatcacatgcacctttctgggaatatcttttgatctgttggctccaatcccttggataaagcatatactgaagaaattcagaaagaatgacatggtccagttggtccctgaagaaaatgaggagtacagatctatgaacaatgacgaagaaacaaatggtctgatatcgcctctaatgtctgagagagaagacagtgacattctgaatggtttcgaggggcatgatctttccatgtacccaataaaccggagcttccacatgccaaagcagaaattcgactttgcacaatactacgcgtttgacatcacaatattcgcgctcacgatgatctactcattgttcgctccgcttgtggttcctgtcggtgcagtatactttggctaccgttatcttgtggacaagtacaatttcctgttcgtgtacagagtcagaggatttcctgcaggcaatgatgggaagctgatggatagggtgctgtgcatcatgcaattctgtgttatcttctttcttgctgctatgttgctcttcttcgcagtccagggcgattccatgaagctgcaggctatatgtactcttgggctgttagtgttctataagttgctgccttctggaagtgatcgcttccaggcgtccttgttagaagggatgcagacagttaatagctttgtagacggtccaacggattatgaagttttttcacaacctgacctggattggaatctgtatcaatcctgaagaaaactcaagctatccttgttaatagagacacagacagttaaatagctttgtagacagtccaatggattatgaagttttttcacaacctgacctggattggaatctgcatcaatcctgaaggaaaagctcaagcccagccatccttgttaatagagacacagacaattaaatagctttatagacggcccaacggattatgaagtttttttcacaacctgacctggactggaagaaaaactcaaggtcaatacacacctgtttcatgacatagacaactagtatcgctggagcttctctcattgtacaactctcagttgtttctgtagtctgtacagcattgtaggataactccttttttctatgtggagctattgtgtttcatcaaatgacatacacgtcaattccgatcatgaaaccatgagctgttatgcggggatgccgtgaaaagatatctgatgttatcctattcctacctgattagttcaccatgttcttttttccttcaattgcggccatctaacgcgatctagacatttattcttccc

SEQ ID NO: 5929 - DNA, 2971 bp, Oryza sativa
accgagaaaaagacgaggcgtgtccccaccttccagcgtcagatcccgacgctggtgtgcggcagcgcgcaccgcgacacgtcacgtctcgcccccgacctcgcgtgatctagccccacccccaccccgccacgccacgccacgaaccgcggtgaaccggggcatctcgtcggcatatttcgcggcccgaacctagggtttcgtcacgtccccgtcccccggcgatggggccgaccgcgccgccgccggacgccggcggcggggagccggaggcgtggtacggcagcatccagtacctggtcaacatctccgcggtgggggccgcctcctgcgtgctcctcttcctcctcgtcaagctccgcttcgaccaccgccgcatcccggggccctccgcgctcgccgccaagctcctcgccgtctaccacgccaccgcgccgcagatcgcgctccactgcggggccgacgccgcccagttcctcctcttcgagcgcgcctccttcctcgtgctcgccgccgtggccgccgccgccgtcgccgccgccctcccgctcaacctcctcgccggggacgccgccatcgccgaccagttcgccgccaccaccatctcccacatccccaagtcatccccgctcctctggctccatctcctcctcaccgccgccgtcgtcgccatcgcccatctcggcatctcccgcatggaggacgcccttcgcatcacccgcttccgcgacggcaacggcaaccccagcgaccccaactccagctcggttgccgtcttcaccatcatgatccagggcattcccaagacgctcgccgcagacaagaccccgctcaaggattactttgagcacaagtaccctggaaaggtgtaccgggtcatcgtgcccttcgatctctgcacgctggagtatctagctgaggagtgggggaaggtgcggaacaggatttcttggctggaggcaaggatggatgcccgcaacctatttgatgaatttgctcagggtggaagacattcagaagagcattggattgtgaggagatgcaaagagctgtgggtgatgacagcagagaggttcgggtttactgacgaggaaatgctaaggaggttgcagacaaagaaacttgtcctcggtagcaggttatcggattataaggatgggcgtgctcccggtgctggcatagcctttgtggtttttaaggacgtgtatacagcaaacaaggctgtgagagatttccggatggaaaggaagaagacaccaatagggaggttcttcccggtgatggagctccagcttgagagaagccgttggactgtggaaagggcaccaccggcatcagatatctactggaaccatctagggctgagcaagacctcactaggattgcggcgtattgcagtcaacacctgcctcattctgatgctcttgttcttcagttcaccattggcaataattagtgggatgcaaagtgcagcgcggatcatcaatgtggaggctatggataacgccaaatcatggcttgtctggctccaaagctctagctggttctggaccattatctttcagtttcttcccaacgtcctcatttttgtgagcatgtatattatcatcccatcagtgctgtcttacttctccaagtttgagtgtcatctgacagtgtcgggagagcagagggctgcattgttgaagatggtttgcttcttccttgttaatctcattctactgcgtgcgctggtggaatcatcgcttgaaagttggatactcagtatgggccggtgctacctagacagtgttgattgcaagcagattgaacaatacttaagcccctcttttttgtcaagatcttcactctcctccctggcattcttgatcacatgcacctttctaggaatatcctttgatctgttggctccaatcccttggataaagcatgtaatgaagaaatttagaaagaatgatatggtccagttggtccctgaagaaaatgaggactaccaactgatgcatgatggcgaagaaacaaataatttgagagcgcctctaatgtctgagagagaagacagtggcattctgaatggtattgaggagcatgatctttcattgtacccgataaacaggagcttccatatgccaaagcagacatttgactttgcacaatactatgcatttgacattacaatattcgcgctcacaatgatctactcactgtttgctcctctgacagttcctgtcggcgcagtatactttggctaccgataccttgtggacaagtacaatttcctgtttatctacagagttagagggtttcctgcaggcaatgatgggaagctgatggacatggtgatctgcatcatgcaattctgcgttattttcttccttgttgcaatgttactattctttgcagtccaaggtgatcctatgaagctacaggcaatatgtactcttagtttgttagtcttttataaattgctgccctctagaagtgatcgcttccagccatccttgttggaagggatgcagacagttaatagctttgtagatggtccaacagattatgaagttttttcacaacctgacctggattggagcctgtatcaatcctgaagaaaatttcaaggtcaatacacacttgtttagttatttcttatctctttcacctgagcttttcattgtaccactcttgaccttttgtacagttacataggtaactcttttggcttctagctgaatttgtttgttggaaatgaaaagcacgcactgtttagatcattaaagctgtgtatctaaaattctatgagaagaaaatacttaacattatcctacacgaacggcattttctgtttgggccttttgtgattgcatccatccttttgcaaatgcccctgtaccaacaaatgtgtcgaggcatgcctgatttatccttcttgtcattcatgagttcaaaattgccagctactgtcaaactagaagag

SEQ ID NO: 5930 - DNA, 3059 bp, Sorghum bicolor
ccgccgcatatactatgctagaaaaaaaaaatacttcttctccgcctccgcgtccccaccttcagcgtcacgcacctccatgggcagcgcatggggacacggctcgtccacggcaccccctcccctgatctagccagccgcaccccgatcggttgcccgtgccgcgcgcccccacgcgaccccgaccaggaccacgatccgcggcaaggcctcatcggcgaacggaatatttcgcggccgagctcctgctcccccggaatctagggttcgcctccccccgccccgcgtcgccctcgatgggcccggccgcgcagccgccggacgccggcggcggcggggacccggaggcgtggtacggcagcatccagtacctcatcaacatctccgccgtgggcgccgcctcctgcgtcctcctcttcctcctcgtcaagctccgcttcgaccaccgccgcatcccggggccctccgcgctcgccgccaagctcctcgccgtctaccacgccaccgcggcgcagatcgcgctccactgcggcgccgacgccgcccagttcctcctcttcgagcgcgcctccttcctcatcctcgcagccgtcgccgccgccgccgtcgccgcggcgctcccgctcaacctcctcgcgggggacgccaccgtcgtcgaccagttcgccgccaccaccatctcgcacatccccaagtcgtccccgctcctctggctccacctcctcctcaccgccgccgtcgtcgccatcgcgcacctcggcatctcccgcatggaggacgcgctacgcatcacgcgcttccgcgacggcaacggcaaccccagcgaccccaactccagctccgtcgccgtcttcaccataatgatccagggcatccccaagacgctggccgcggacaagaccccgctcaaggactacttcgaccacaagtatcctggcaaggtttaccgtgccatcgtgccatttgatctctgcacgctggagtatctcgtcgaccaattggggaaggtccgcaacaagatctcttggctggaggcaaggttgggcgcccgtgacctgtttgatgacattgtgcacaacgacgaagcagttcggtcagaggagcattggtttgtgcgaagatgcaaagagctatgggcaatggcaggggagaggctagggttcactgatgaggagagattgaggaagttgcagactaagaaacttgtgcttgcaagcaggctatctgattataaggaagggcgcgcccctggcgctggtgtagcttttgtggtgtttaaggatgtctacaccgcaaacaaggctgtaagggatttcaagatggagaggaagaagaccccaattggcaggtttttcccagtgatggagctccagctcgagagaagtcgatggaaagtggagagagcaccaccggcatcagatatctactggaatcatctaggtcttagcaagatatcttcgcggctgaggaggattgcagtcaacacctgcctaattttgatgctcttgttcttcagttcacccttggcaatcatcagcgggatgcaaaacgcggcacggatcatcaatgtggaggctatggatcatgccaagtcatggcttgcccggcttgaaggttcaagctggttctggaccataatctttcagtttcttcccaatgttctcatctttgtgagcatgtatatcatcatcccatcggtattgtcgtacttctccaagtttgaatgccatctgacagtgtcaggggagcagagggctgcattgctgaagatggtttgcttcttccttgtcaatctcatcctattgcgtgctctggtggaatcatcacttgaaagttggattcttagcatggggcggtgttacttggatggtccagactgcaagcagattgaacgctatttaagcccatcctttttatcaagatcatcgctttcttccctggcattcctgatcacatgtacctttctgggaatatcttttgatctgttggcaccaatcccttggataaagcatataatgaagaaatttagaaagaatgatatgatacagttggtccctgaagagaatgaggactacctacccatgcagaatggtgaagaaactaataatttgacagcgcctctaatgcctgagagagaagacagtggccttttggatagtattgaagggcacgatctttccctgtacccactaaacaggagcttccacatgccaaagcagaaatttgactttgcacagtactatgcttttgacattactatatttgccctcacaatgatctactccctgtttgctccgctcgtggttcctgtgggcgcgacatactttggctaccgttatcttgtggacaagtacaacttcttgttcgtttacagagttagagggtttcctgctggcaatgatgggaagctgatggacagagtgctgtgcatcatgcaattctgtgtgatcttcttccttgctgcaatgctgctcttctttgctgttcagggtgattcaatgaagctacaggctatatgtactcttgggatgttagtgttctataagttgcttccttctagaagtgatcgcttccagccatctttgttagaagggatgcagacagtgaatagctttgtagatggtcccacggattatgaagttttttcacaacctgacctggattggaatctgtatcaatcctgaagatcaatacacacttttgttcattacaacatctttcatgacttgaaatacctgatcgcgaccctggtgtatcaaagtcattcattcttcttgtacagctatgtagattaacttttatctccttagatgtatttgttttgtcggatatgacaagcagatacagttttgatgatgaacatggtctatcaaaaacttactttaaattatacatgatgtagtcatttcatttcttttttgttaataatcgaaggtcctataaccagaaaaagttgtcatatttatgcatccttgtgtttagatttcctattataattgatggtgactagaagagataatttatatggttgagatgagaagcaaaatttgctactggaa

SEQ ID NO: 5931 - DNA, 2874 bp, Setaria italica
ctccacccgacgcggtgttcccaccttcagcgtcacgcacctcgacgggcagcgcacggcgacacggctcgttcaccgcccccgtcccgtcccgtgatctagccagccgggacccgatccgccacccgttccgcacgcaccccccacgaccagggccacgagcggcggcaaggcatctcatcggcgaacggaatatttcgcggtcggactccgtctccaccggaatctagggtttgccaccccggcgtcgcccccgatggtcccggccgcggcgccgccggacgccggcgggggtggggacccggaggcgtggtacggtagcatccagtacctcatcaacatctccgccgtgggggccgcctcctgcgtgctcctgttcctcctcgtcaagctccgcttcgaccaccgccgcatcccggggccatccgcgctcgccgccaagctcctcgccgtctaccacgccacagcgccgcagatcgcgctccactgcggcgccgacgccgcccagttcctcctcttcgagcgcgcctccttccttatcctcgccgccgtcgccggtgcggccgtcgtggcggccctcccgctcaacctccttgcgggggacgccgccatcatcgaccaattcgccaccacgaccatctcgcacatccccaagtcttcaccgctcctctggctccacctcctcctcaccgccgccgtcgtcgccatcgcccacctcggcatctcccggatggaggacgcgctccgcatcacacgcttccgcgacggcaacggcaaccccagcgaccccaattccagctccgtggccgtcttcaccataatgatccagggcatccccaagacgttggctgcagacaggaccccgctcaaggactacttcgagcacaagtaccctggcaaagtttaccgtgttatcgtgccatttgatctctgcacgttggaatacctcgtccaggaattgggtaaggtccggaacaaaatctcttggctggaggcaaagttgggcgctcgtgacctgtttgatgactttgcacacgccgaagcagctcaatcagaggagcatcggtttgtgagaaggtgcaaagagctgtgggtgatggcatcggagaggctaggttttactgatgaggaaaggttgaggaaattgcagactaagaaacttgtgcttggaagcaagctatcggattataaggaagggcgtgcccctggcgctggcgtagcttttgtggtgtttaaggatgtctacaccgcaaacaaggctgtaagggattttaagcttgagaggaagaagaccccgatcggcaggtttttccctgtgatggagctccagctcgagagaagtcggtggaaggtggagagagcaccgccggcttcagatatttactggaatcatctaggtcttagcaagatgtcttcgagattgaggaggattgcagttaacacctgcctacttttaatgctattgttcttcagttcacccttggcaatcatcagcgggatgcaaagcgcggcacggatcatcaatgtggaggctatggatcatgccaaatcatggcttgcctggcttgaaggctcaagctggttctggaccataatctttcagtttcttcccaatgttctcatctttgtgagcatgtatatcatcatcccatctgtgttgtcatacttttccaagtttgagtgccatctgacggtgtcaggggagcagagggctgcattgctcaagatggtttgcttcttccttgttaatctgatcctgttgcgtgccctggtggaatcgtcacttgaaagttggatccttagcatggggcgatgctacttggatggtccagattgcaagcagatcgaacactacttaagcccgtcatttttatcaagatcatcactttcatccctggcattcttgatcacgtgtacctttctgggaatatcttttgatctgttggcaccaatcccttggataaagcatataatgaagaaatttagaaagaatgacatggtccagttggtccctgaagaaaatgaggactatctaatgatgcagaatggtgaagaaagtaataatttgacagcacctctgatgcctgagcgagaagacagtggccttctggatagtatcgaggggcatgatctttctctatacccattaaacaggagcttccacatgccaaagcagaaatttgactttgcacagtactatgcttttgacattacaatatttgcactcacaatgatctactccctgtttgctccgctcgtggttcctgtgggtgcagcatactttggctaccgatatcttgtggacaagtacaatttcttgtttgtgtacagagttagaggatttccagcagggaatgatgggaagctgatggacagagtgctgtgcatcatgcaattctgtgtgatcttcttccttgctgcaatgctgctcttctttgccgttcagggtgattccatgaagctacaggctatatgtactcttgggatgctagtgttctataagctgctgccttctagaagtgatagcttccagccatctttgttagaagggatgcagacagttaatagctttgtagatggtcccacggattatgaagttttttcacaacctgacctggattggaatatgtatcaatcctgaagaaaaaactcaagatcaatacactcttttgttttattacagtgacatcttttatcacttgatgatgtccctagtgtaccacagtcgctcattcttactgtacagctatgtagattatctgtctttttctttgtcagaggtgacaggcacatgcaattttgatcatgaacctggtctatctaaacatacttcaaattattctacacgatgcggtcatcttgattcttttaggg

SEQ ID NO: 5932 - DNA, 2884 bp, Triticum aestivum
cgccgccgtctccgccgccgccttcgccgcggccctgccgctcaacctgctcgccggggacgccgccatcgccgaccagttcgccgccaccaccatctcccacatccccagggcctccccgctgctctggctccacctcctcctcaccgccgccgtcgtcgccatcgcgcacctcggcatctcccgcatggaggacgccctccgcatcacccgcttccgcgacggcaacggcaaccccagcgaccccaactccagctccgtcgccgtcttcaccatcatgatccagggcatccccagggcgctcgccgccgacaaggcccccctcaaggagtacttcgagcacaagtaccccggcaaggtgtaccgcgtcattgtgcccttcgacctctgcacgctcgagtacctcgccgacgagtgggggaaggtccggaacaagatctcctggctggaggcgaagatggacgcccgcagcctgtttgacgagtttgtgcaggatgaatcagggcagttggaagcccactggcttgtcaggagatgcaaagagctgtgggcaatggcggcgcagaggtttgggtttactgatgatgagaggctaaggaagctgcagacaaggaaactcgtgattgggagcaggctgtcggattacaaggaagggcgtgcgcctggtgctggcatagctttcgttgtgttcaaggatgtgtacacggcaaacaaggctgtgagggatttccgaatggaaaggaagaagacacccattggtaggttcttcccggtgatggagctccagcttgagaggagccgatggagagtggagagggcgccaccggcatcagatatctactggaatcatcttgggatgaacaagacctcactagccttgcggcggatcgcggtcaacacctgcctcattgtaatgctcctgttcttcagttcgcccttgtcaatactcagtggaatgcaaaacgcagcacggatcatcaatgtggaggctatggataatgccaaatcatggattgtttggcttcaaggctcaagctggttctggacaataatctttcagtttctacccaatgtcctcatcttcgtgagcatgtatattatcatcccttcagtactgtcatacttctccaagtttgagttccatctgacagtgtcgggggagcaaagagctgcattgctgaagatggtttgcttcttccttgttaatctcattttgttgcgtgcgctggtggaatcgtcgcttgaaagttggattcttagcatgggacggtgctacttagatagtgctgattgcaagcagattgaacattacctgagcccatcattcttgtcgagatcctcactttcttccctggcgttcttaatcacatgcacctttctgggaatatcttttgatctgttggctccaatcccttggataaagcatatactgaagaaattcagaaagaatgatatggtccagttagtccctgaagaaaatgaggagtacagatctatgaacaatgatgaagaaacaaatgggctgatatcgcctctaatgtctgagagagaagacagtgacattctgaatggtttcgagggacatgatctttccatgtacccaataaaccggagcttccacatgccaaagcagaaatttgactttgcacaatactacgcgtttgacatcacaatattcgcgctcacgatgatctactcactgttcgctccgcttgttgttcctgtcggtgcagtgtactttggctaccgttaccttgtggacaagtacaatttcctgttcgtatacagagtcagaggatttcctgcaggcaatgatgggaagctgatggatagggtgctgtgcatcatgcaattctgtgttatcttctttcttgctgctatgttgctcttcttcgcagtccagggtgattccatgaagcttcaggctatatgtactcttgggctgttagtgttctataagttgctgccgtctggaagtgaccgcttccagccgtccttgttagaagggatgcaaacagttaatagctttgtagacggtccaacggattatgaagttttttcacaacctgacctggattggaatctgtatcaatcctgaagaaaactcaagccatccttgttaatagagacacagacagttaatagctttgtagacggtccaacggattatggagttttttcacatcctgacctggattggaatctgtatcaaccctgaaggaaaaattcaagccatccttgttaatagagatgcagacagttaaatagctttgtagacggttcaacggattatgaagtttttccgcaacctggcctggattggaatctgtatcaatcttgaagcactcaaggtcaatcaatacacacttgtttcctgacatagacatctagtaaccggagcttctcattgtacgactctcagttgtttctgtacagtaatctaggataactcctttttctctagctggaactgttgtgttggaacttggaaatgacatagacttcgatttggaccacgaaagcatgagctgccatttggaaatcccatgagagaatatctggtgtcatcctattcctacactattagagttcaccatcttgagatttttttttccctttaattgcgtccatctaacgcaaaggcccaaccgcagcagatgtatcagtgcatgccacatttattctttccatctcttctgtgttagaatgtcccaactataagagaattattgttatgttcaggatttaagaaaattttaatgctgagagtaccttatgcactgtggagttttgacagtcttaactatgcggtaactcctgaagttttgatgtagcttcacaaacatcagtaccatgagcatatatgccatatttatatcttgat

SEQ ID NO: 5933 - DNA, 3674 bp, Brachypodium distachyon
gtccccacctcgcagagacagaaatcacgaagcgggtaaaggtaagcgcacggcgacacggcgagcccacctcgccccgtcgggatctaagccaagccccaccccgtccacgaacctcggcggcaaggcatctcgtcggcgaattcccctgccaacaaacaaaaaaatctagggtttcgcccccgtggttcccgatggtcccggccgcgtcggcgccggacgccggcggcggcggcggggagccggaggcctggtacggcagcatccagtacctgatcaacatctcggccgtgggcgcctcctcctgcgtgctcctcttcctcctcgtcaagctccgcttcgaccaccgccgcatcccggggccctccgcgctcgccgccaagctgctcgccgtctaccacgccacggccccgcagatcgcgctccactgcggcgccgacgccgcgcagttcctcctcttcgagcgggcctccttcctcgtcctcgccgcggtctccgccgccgccgtcgccgccgccctgccgctcaacctcttcgccggggacgccgccatcgccgaccagttcgccgccaccaccatctcccacatccccaagtcctccccgctcctctggctccacctcctcctcgccgccgccgtcgtcgccatcgcgcacctcggcatctcccggatggaggacgcgctccgcatcacccgcttccgcgacggcaacggcaaccccagtgaccctaattccagctccgttgccgtcttcaccatcatgatccagggcatccccaggacgctggcggctgacaagacccctctcaaggattacttcgagcacaagtaccctgggaaggtgtaccgtgtcgttgtgccctttgacctctgcaccttggagtatcttgccgatgagtgggggaaggtccggaacaagatctcttggctggaggcaaggatggacgcccgcaacctgtttgatgaatttgttcaggatggatcagggcaggccgaagcacattggtttgtcaggagatgcaaagagctgcgggcaatggcagcggagaggtttgggtttactgatgatgaaaggttaaggaggttgcagaccaataaacttgtgcttgggagcaggttgtcggattacaaggaagggcgtgcacctggtgctggcatagctttcgttgtgtttaaggatgtttacacggcaaacaaggctgtgagggatttccggatggaaaggaagaagacaccgattggtaggttcttcccagtgatggagctccagcttgagaggagcagatggaaagtagagagggcgccacctgcatcagatatctactggaatcatcttgggatgagcaaggcctcactagctctgcgtcggattgcggtcaacacatgcctcgtcgtaatgctcttgttctttagttcgcccttggcaatactcagtgggatgcaaagtgcagctcggataatcaatgtggaggctatggatagtgccaaatcatggatagtttggcttcagggctcaagctggttctggacaataatctttcagtttcttcccaatgtcctcatctttgttagcatgtatattatcattccatccgtattgtcatacttttccaagtttgagttccatctgacagtgtcaggggaacagagagctgctctgctgaagatggtttgcttcttccttgttaatctcattttgttgcgtgcactggtggaatcttcgcttgaaagttggatacttagcatggggcggtgctacttagatggtgctgattgcaagcagatagaacagtacttaagtccatcattcttgtcaaggtcttcgctttcatccttggcgttcttaattacaagcacctttctggggatatcttttgatctgttggctccaatcccttggataaagcatatactgaagaaatttagaaagaatgatatggtccagttggtccctgaagaaaatgaggactaccaatatattcagaatggtgaagaaacaaatggtttgataacccctctaatgtctgagagagaagacagtgacattctgaatactatcgaggggcatgatcttttgctgtaccctataaaccggagcttccacatgccaaagcagaaatttgactttgcacaatactacgcgtttgacatcacaatatttgcactcacgatgatctactcactgtttgctccgcttgtggttcctgttggtgcagtatactttggctaccgttatctcgtggacaagtacaatttcctgttcgtgtacagagttcgaggatttcctgcaggcaatgatgggaagctgatggacagggtgctgtgcatcatgcaattttgtgttatcttcttccttgctgcaatgttgctcttctttgcagtccaggatcttttgtacaaggactacaattttgaccaaaagttttctttatcgacaactagcaatactggtttgggtctcacggccactggcgtgaagatcgatgaactcttcattggtgacatacagacacaacatagaagtggtagaacaactgttgatgtcaaaatagattctgattcaatagtgtcaaccacagtcactgttaatgaagtgatctctggtttgaactccaaattaagcttcagggttcctgatcaaatgtcagggaagcttgatttgcaataccttcatgatcgattcgcactgaattcaaccattggtttgacgtcagcacctttggttgagttggcagcaactgtaggcacaaatgaacttgctgtgggtgccgaggttgggtttgacagtacttcagcttctgttaccaagtacaactcagggatcagctataacaaacatgatatatctgctgccttactgttggctgataaaggcgagactttgaaagcttcttatattcacttgttcagcccaaccagtgctgtggcagttgaggcaacacacaggttgaaaacaaaagagaattacttcaccattgggagctctcatgctcttgattcttccacactgctgaagacaagatttagcaacaatgggaaagctgggcttctctgccagcatgaatggaggcccaagtcctttgtgactctctctgcggaatatgaccccaaattggttagttccccttcaagatttggtgtggccatagctctgaagccttgattagctggatgacctcctgtacaacagcgccaatgttaagtaatcatatatacgttggagcgacttgccaaagctccgatgattttaaccccttttggcctgggaaacattgcctaggtgttgtaatcagttttgcagaatgccccgattattccactatgcattatcagtccaagaattggaaatatacagaggtttgtaacggcactatagctttactcttcccgaaatgatagtctgggtgcacacctccaaaatagtgccgttttacaccatgacaaacatgatacggttcagctgcctgaggagtggcagattgtcatattttgtttgtttggcagtactccctccgtttctaaatttttgtcattgttttagttcaaatttataaaaaaaatgacaagaatttaggaacggagggagtagcagggagcaactgagaatccaaaatattgtcgttttaaacctgcattatctgccaagctaatcttggtaactggagattgctta

SEQ ID NO: 5934 - DNA, 945 bp, Setaria italica
cgggggcaagcagcgcttggggcgcgagcggcgccgtcgttggagcagacggcttggctaggggaggggcacgagcggtgcggcggcttcagaggaggctttttggaatcacgatttttgaagaactgtctgctgtatagcaaaattaggttcctgatcacattatggaccagcaacctcaaagtgatgctgattttcttgagccatcagtactattagacgagacacattaccaggagggctacaaaaatggttatcatgatggcctatcatcagggaaggaagagggcaggcaggttggtttaaagatgggtttccaggtcggtgaagagctgggtttctatcagggttgtctggatgtgtgggcctccgcaactcgcattgatcagaacgtgttctcagctagggtcaggaagaacattgagcaactagctgcactggtgagcagctatccgctgtctgatccggagaatgaacaagttcaagatgtgatggagaagataaggctgaaattcagggttatcactgcaaccttaggggcgaagttggagtatgaaggtcgcccggcatcatcgaaacaggacgttgaggatctgtgagggcgatagaaattttggtctctctgtctttgtcatcttgagttctccaaatcctgtcttcagctcgttggtatcatgaagaatttggcgtgaggaaacaattgttgaagcatgaatcagtaatacaattttagctgtcttcagctttgtccatgatcagtctctaagatttcaccagagatccacaagtacttgcttaattgtggaatatttccctttcacaagtcaaaaacatcccttataaataggttcaagccttccttacctctttttttaagagcatcttgttatcctatgttacggactactccctctgttccaaattgaagttctttttagattttct

SEQ ID NO: 5935 - DNA, 945 bp, Pennisetum glaucum
ggcggcggcggcaggcagcgcctggggggtggcgcgacgctgtcgttggagggagcggcttggcccagggaggggaggagcgcgagcggcgcggcggcttcagaggctttttagaatcacgatttttgaagaactgtctgctgattatggacaagcaacctcaaagtgatgctgactttcttgagccatcagtactattagatgagacacattaccaggagggctacaaaaatggttatcatgatggcttgtcatcagggaaggaagagggcagacaggttggcttaaaaatgggtttccaggttggtgaagagctgggtttctatcagggctgtctagatgtgtgggcctctgcaattcgcattgatcagaacgcgttctcagctagggtcaggaagaacattgagcaactagctgcactggtgagcagctatccgctgtctgatccggagaatgaacaagttcaagatgtgatggagaagataaggctgaaatttagggttatcactgcaagcttaggggcaaggttggagtatgaaggtcgcccggcatcatcgaaacaggacgttgaggatctgtgaggaagatagaaactttggtctgtctttgtcatcttgagttctccaaatactgtcttcagctcgttggcatcatgaagaatttggtgtggtcaacaattgttgaagcatgaatcagtaatacaattttagctgtattcggtgttgtcttacctgctttctccgacatgttgtccacgatcagtctctaagatttcaccaaagattcacaagtgcttgcttaattgtggaatatttccctttcacaagtcaaaagcatccttataaataggttcaatagatttcattaccctttttctaagagcatcttgttatcttatattatggactactcagtttacaaattgaagtcatgttgacttaatcc

SEQ ID NO: 5936 - DNA, 1072 bp, Brachypodium distachyon
gttatcctctttcccatggacagtccggtgaaacaagggtgttgttccatcttccgtttggagcagcctgcggctgtcgcttgggaactggaagatttcttggaattttacatatttttgggaaactgcatattgctcaacaatttagactttagttcgtatcatggatcaacaacccaaagatgatgttgattttcttgaaccatcgatactgttagatgagacacactatcaagagggttataaaaatggttatgatgatggcttggtatctggaaaggaagagggaaggcaggttggtttaaagatgggtttccaggtaggtgaagaactgggattctatcagggttgtttggatgtgtggatgtcagtaattcgccttgaggaaggtgcattctcagctcgggtcaggaagaacatggagcagctagctgtactgctgagcaaatatcctttgtctgatccagagaatgagcaagtgcaagacatgatggagaagataaggctgaaattcagggttatcacggcaagtttaggagcaaaaatggagtatgaaggtcgccccacatcatctaagcaggacgttgaggatctgtagcttatgtagtagtatggataggtcccttgtagattatgaaatctgaattaccactttgaaattgatatgtggtgccaatatgttttgctttcattttggatctgtgatgccttatgctactccctccggccggaattgcttgtcactaatttagtacaactatgtactaaatctaggacaagtaatatgggttggagggagtactaaagatctgcatgaaattatgctgccaccaggataaccgaggaaacctggaccactgtatctaagatctattcgacatgaggggattttggagtaatgttgtttcttagcctcagtcctctctcatcatttgtagttgtgccttcactgttaccttttcacttgagatttgaggttatctggttgatatacttgttgtgaaaagatgttttattctgtatatactacacaaggagctcttattatgacatatttcagctctaagaagta

SEQ ID NO: 5937 - DNA, 923 bp, Setaria italica
cggcggcaagcagcgcttgggcgcgagcggcgccgtcgttggagcggacggcttggccaggggaggggcacgagcggtgcggcggcttcagaggccttttggaatcacgatttttgaagaactatctgctgtatagcaaaattaggttcctgatcacattatggaccagcaacctcaaagtgatgctgattttcttgagccatcagtactattagatgagacacattaccaggagggctacaaaaatggttatcatgatggcctgtcatcagggaaggaagagggcagacaggttggtttaaagatgggtttccaggtcggtgaagagctgggtttctatcagggctgtctggatgtgtgggcctccgcagctcgcattgatcagaacgtgttctcagctagggtcaggaagaacattgagcaactagctgcactggtgagcagctatccgctgtatgatccggagaatgaacaagttcaagatgtgatggagaagataaggctgaaattcagggttatcactgcaacattaggggcgaagttggagtatgaaggtcgcccggcatcatcgaaacaggacgttgaggatctgtgagggcgatagaaattttggtctctctgtctttgtcatcttcagttctccaaatcctatcttcagctcgttgatatcatgaagaatttggtgtgaggcaacaattgtcgaagcatgaatcagtaatacaattttagctgtcttcagctttgtcttacctgctttctccgatatgttgtccatgatcagtctctaagatttcaccagagatccacaagtacttagttaattgtggaatatttccctttcacaagtcaaaagcatcccttataaataggttcaatagccttccttacccttttttttaggaacatcttgttatcctatatta

SEQ ID NO: 5938 - DNA, 924 bp, Saccharum officinarum
ctcagccagacgcccgccgccgcccgcaagccgcacgccgcccgtttgccgacgtccccccgcgcgcggcgagctccaccaccttccggcggtatttcggcggcgagtcagccgctttctggaatcacatttcttgagaactgtctgttgcatagctaaactaggctcttgttcgtattatggatcaggaacctaagattgaggctgattttcttgacccaacattactcttagatgagacacattaccaggaggggtataaaaatggctataatgatggtttggcatctggaaaggaggagggaaggcaggttggtttaaagacgggtttccaagtcggtgaagaactgggtttcattcagggctgtctggatgtgtggacgtccgcaattctcattgatcagaacgccttctcagctcgcgtcaggaagaatattgagcaactagctgcactggtgagcagctatccgctgtctgatccagagaatgaacaaattcaggacgtgatggagaagataaggctgaaattcagggtcatcactgcaagcttaggggtgaagttagagtatgaaggccaccccacatcatcaaagcaggatgttgaggatctgtgagcgcgatggacattacattttagtttctctgtctttgctgtcttaagctctccgaatcttgtcttcaactctttgggatcatgaggagctgccctgaaacaacaacgatcagagtcagaccataatcacttatatagttttaacaatgtcttaagttttgtcttattacctgctgtctggcgtctaccgtgtgttgtccatggtcagtcagtaggttttcgccagagatccagtgtaattgtgtaatcgttccctttcagaacgcaaaagcattatccattatatttatattatgaatggtcttccttcc

SEQ ID NO: 5939 - DNA, 1324 bp, Zea mays
acaccatctctaggccgcgtctcgcctcgtctcgtcgtccgatcattatctccctgactcgcctcgtcctccagatatcggccgccaccttcacctccaccgccccggcgcacctgtgcgtctccatcgtcgccgcctctcctccttcggacacgactgaccttccactggcgccaacgaagaaaacacataggaagaagctcaccgccaaacctcatccagatccagtcgctgccctccgaaggccgcatacggaacgtctcgtctcttcctttggatccggcggtcaactccatcacccccagcttcacctcccttagtccccctccgtccgctctcacccaccgcttctatatcgccacctctctcgttgtagaagaagacactgaggatctggctttctggaatcacatttcttgagaactatctgttggagaactaaactaggctcttgttcatattatggatcagcaagctaagattgatgctgattttcttgaaccaactgtactcttagatgagacacattaccaggaggggtacaaaaatggctataatgatggtttggcatctggaaaggaagaggggaggcaggttggtttaaagatgggtttccaggtcggtgaagaactgggtttctttcagggctgtctggatgtgtggacgtctgcaattctcattgatcagaatgccttcacagctcgggtcaggaagaatatcgagcaactggctgcactggtgggcagctatccgctgtctgatccggagaatgaacaaattcaagacgtgatggagaagataaggctgaaatttagggtcatcactgcaagcttaggggtgaagttagagtatgaagggcaccccaaatcatctaaacaggatgctgaggatctatgagcagtgattgaaattacattttagtttctccgcccttgctgtttaaagctcttcaactcattggcatcacgaggaactgccgtgagacatcaatggccagagtccgaccaaaaccacatatatagttttaacaatgtctcaagttttgtgttattacctgctatctgccatatgtaatagtttcctttcagaaggcaaaagcacttccttcccattttcttgaagtacttgttgacttgtattctacatgttgggagcatatagatctttcataaaaacacacgtcccatgtattgcaaatcttcatagatccaattatctcatgggtatgttcattatgttcatcccaagtgtagaaaatcagtgctagccccttgcattgcatggatttaatcccaaatcttggacagtgtgtttgttactctgc

SEQ ID NO: 5940 - DNA, 930 bp, Zea mays
tttccctctcttgatttacaacattattccagtgcagttttgttaactccttttttcctttagcatgtattcatttagtttcttattatgcccatccttttatttttgactatgaagcaggctttctggaatcacatttcttgagaactatctgttggagagctaaactaggctcttgttcatattatggatcagcaagctaagattgatgctgattttcttgaaccaactgtactcttagatgagacacattaccaggaggggtacagaaatggctataatgatggtttggcatctggaaaggaagaggggaggcaggttggtttaaagatgggtttccaggtcggtgaagaactgggtttctttcagggctgtctggatgtgtggacgtctgcaattctcattgatcagaatgccttcacagctcgggtcaggaagaatatcgagcaactggctgcactggtgggcagttatccgctgtccgatccggagaatgaacaaattcaagacgtgatggagaagataaggctgaaattcagggtcatcactgcaagcttaggggtgaagttagagtatgaagggcaccccaaatcatctaaacaggatgctgaggatctgtagcggtgattgaaattacattttagtttctccgcccttgctgtttaaagctcttcaactcattggcatcatgaggaactgcagtgagacatcaatggtcagagtccgaccataaccacatatatagttttaacaatgtctcaagttttgtgttattacctgctgtctgctgtctgccatatgtaatagtttcctttcaaaaggcaaatgcacttccttcccattttctttgaagtacttgtatcaaacactctgcgatgagaatcctgaatttcgttcttttctgaagaatatatgtactcctttctcata

SEQ ID NO: 5941 - DNA, 1274 bp, Zea mays
tagatttgtggtcatgggactgtgggacgatacaaaatagtggccgaaatatggttttcgtgatgaatttagaatcaacattgatttagggagtcccaataagaattctaaatgcaggaatgaaattggattttgtagggagtttgtaaatttaaggacaaatgttttatatagctgttgggaagagtttttctaaaaactttttaaattcatatctagacagagatgatttaagcagggagagatagtcacttgatagaagactcgtcgattcgtctcaggtagcggccgaaccagagccctgtcccaacccgaccacctctcttctctacggcgcgaggaagggcagcgcccaccgcagcgtcggcgggaaccgggcctcgctctccccatctcttcggctttctggaatcacatttcttaagaactatctgttggagagctaaactaggctcttgttcatattatggatcagcaagctatgattgatgctgattttcttgaaccaactgtactcttagatgagacacattaccaggaggggtacagaaatggctacaatgatggtttggcatctggaaaggaagaggggaggcaggttggtttaaagatgggtttccaggtcggtgaagaactgggtttctttcacggctgtctggatgtgtggacgtctgcaattctcattgatcagaatgccttcacagctcgggtcaggaagaatattgagcaactggctgcactggtgggcagctatccgctgtccgatccggagaatgaacaaattcaagacgtgatggagaagataaggctgaaattcagggtcatcactgcaagcttaggggtgaagttagagtatgaagggcaccccaaatcatctaaacaggatgctgaggatctgtgagcggtgattgaaattacattttagtttctccgcccttgctgtttaaagctcttcaactcattggcatcatggggaactgtcgtgagacatcaatggtcagagtctgaccataaccacatatatagttttaacaatgtctcaagttttgtgttattacctgttgtctgctgtctgccatatgtaatagtttcctttcacaagtcaaaagcacttccttcccattttctttgaagtacttgttggcttgtattctacatgttgggagcatatagatcttcctcgtaaaaacacacgtcccatgtattgcaaatctgcatagatccaattatctcatgggtatgttcatcccaagtgtagaaaatcagtgatggcc

SEQ ID NO: 5942 - DNA, 1426 bp, Zea mays
gtcaatcgttggttcccatgctctctcgtgcgtccatgtgtcttatctggaggcttctaggtgacacttctttcctcctcgcatcctctctctccatcctatgtctcctgcaactcacgctccctccctccctccccaagcatccctgcccacctacggctccggcgacagcggccgccgctttggactccgaatctggccgccatcgctgcaacggtccaggtaagcggctaatctgcttcgttgtgccctgctctgctcctagtcctagcgatgcaagggttttggttcagtttttttccctagggaaaagggaagggaaaagcgaagtgcatgaaatacaaagatttggtttgggattttttgggggcactgctagtgtgtgtcatggcattggaacggagtaaaaagcgagggtttggtttggtatttttggagcactcctgacttagtgtatgtgtcgtggtattttatttcaagatcaatccatttggtcccctattttctcatgtcggctaaacattttccctctcttgatttacagtattatttcagtgcagttttgttaactccttttttcctttagcatgtcttcatttagtttcttattatgcccatccttttattttttactatgaagcaggctttctggaatcacatttcttgagaactatctgttggagagctaaactaggctcttgttcatattatggatcagcaagctaagattgatgctgattttcttgaaccaactgtactcttagatgagacacattaccaggaggggtacataaatggctataatgatggtttggcatctggaaaggaagaggggaggcaggttggtttaaagatgggtttccaggtcggtgaagaactgggtttctttcagggctgtctggatgtgtggacgtctgcaattctcattgatcagaatgccttcacagctcgggtcaggaagaatatcgagcaactggctgcactggtgggcagctatccgctgtccgatccggagaatgaacaaattcaagacgtgatggagaagataaggctgaaattcagggtcaacactgcaagcttaggggcgaagttagagtatgaagggcaccccaaatcatctaaacaagatgctgaggatctgtgagcggtgattgaaattacattttagtttctccgcccttgctgtttaaagctcttcaactcattggcatcatgaggaactgccatgagacatcaatggtctgagtccgaccataaccacatatatagttttaacaatgtctcaagttttgtgttattacctgctgtctgccatatgtaatagtttcctttcagaaggcaaaaacacttccttcccattttctttgaagtacttgtatacactagatcatagcacatgatagagatatgatcaaaagtataataa

SEQ ID NO: 5943 - DNA, 450 bp, Zea mays
gctcttgttcatattatggatcagcaagctatgattgatgctgattttcttgaaccaactgtactcttagatgagacacattaccaggaggggtacagaaatggctacaatgatggtttggcatctggaaaggaagaggggaggcaggttggtttaaagatgggtttctaggtcggtgaagaactgggtttctttcacggctgtctggatgtgtggacgtctgcaattctcattgatcagaatgccttcacagctcgggtcaggaagaatatcgagcaactggctgcactggtgggcagctatccgctgtccgatccggagaatgaacaaattcaagacatgatggagaagataaggctgaaattcagggtcatcactgcaagcttaggggtgaagttagagtatgaagggcaccccaaatcatctaaacaggatgctgaggatctgtga

SEQ ID NO: 5944 - DNA, 1395 bp, Zea mays
gtcaatcgtgggttcccatgctctctcgtgtgcccatgtgtcttatctggaggcttctaggtgacacttctttcctcctcacatcctctctctccatcctgactcacgctccctccccaagcatccgtgcccacccacggctctggcgacagtggccaccgttttggactctggatccggccgccatcgctgcaacggtctaggtaagcggctaatctgctccgttgtgccctgctctgctcctagtcctagcgacgcaagggttttggttcagtttttttccctagggaaaagcgaagtgcatgaaatacaaagatttgctttgggattttttgggggcactgctagtgtgtgtcatggcattggaacggagcaaaaagtgagggtttggtttggtatttttggagcactcctgacttagtgtatgtgtcgtggtattttatttcaagatcaatctatttggtcccctattttctcatgtcggctaaacattttcccattcttgatttacaacattatttcagtgcagttttattaactcctttttttcctttagcatgtcttcatttagtttcttattatgcccatccttttatttttgactatgaagcaggctttctggaatcacatttcttgagaactatctgttggagagctaaactaggctcttgttcatattatggatcagcaagctaagattgatgctgattttttttgaaccaactgtactcttagatgagacacattaccaggaggggtacagaaatggctataatgatggtttggcatctggaaatgaagaggggaggcaggttggtttaaagatgggtttccaggtcggtgaagaactgggtttctttcagggctgtctggatgtgtggacgtctgcaattctcattgatcagaatgccttcacagctcgggtcatgaagaatatcgagcaactggctgcattggtgggcagctatccgctgtccgatccggagaatgaacaaattcaagacgtgatggagaagataaggctgaaattcagggtcatcactgcaagcttaggggtgaagttagagtatgaagggcaccccaaatcatctaaacaggatgttgaggatctgtgagcggtgattgaaattacattttagtttctccgcccttgctgtttaaagctcttcaacttattggcatcatgaggaactgccgtgagacatcaatggtcagagtccgaccataaccacatatatagttttaacaatgtctcaagttttgtgttattacctgttgtctgttgtctgtcatatgtaatagtttcctttcagaaggcaaaagcacttccttcctattttctttgaagtacttgttcttatttaatagataatgaacacatcccagatttatgct

SEQ ID NO: 5945 - DNA, 1051 bp, Panicum virgatum
  misc_feature (305)..(305): n is a, c, g, or t
  misc_feature (531)..(531): n is a, c, g, or t
cgcgccccgtttagggttcacgggactccccgcgccgccgtgcagtcctccctgggctgccgttggggtctcctgcgccgccatccgcgcctccccggagccgccgccgcgaggcagcgcccctcgctcgccttccgtcgcgcccttcctcaccgcccctccaatcgcctccccgagccgctgcccccccccccccccgcccagctccacgaaggcactgccgcagccgtcgccgccccgacccagcgcccctcacctacaggccttttggaataacagtttttgaagaactgtctgttgtatantgaaattaggctcctgatcattatggaccagcaactcaaaatgatgctgattttcttgaaccatcagtactcttagatgagacacattaccaggagggctacaaaaatggttatcatgatggcctgtcatcagggaaggaagatggaaggcaggttggtttaaagatgggtttccaggtcggtgaagaactgggtttctatcagggctgtgtggatgtgtggacgnctgcaactcgcattgatcagaatgtgttctcaactagggtcatgaagaacatcgagcaactagccgcgctggtgagcagctatccgctctctgatccggagaatgaacaagttcaagacgtgatggagaagataaggctgaaattcagggttatcactgcaagcttaggggtgaagttggagtatgaaggtcgcccagcatcatcgaaacaggacgttgaggatctgtgagtgtgaccgaaattttggtcctccccttatctttgccatatcgagttctcccaatcctgtgttcagctcattgctatcatgaagaatttaccgcgagacaacgtcaaagcatgaatcagtatactctactgttgtaaccttgtcttcagttttgtctacctgctctctcatccatgattagtctttagggtttcaccagagatccacaagtattttgtttaattgtggagtgattctcttcctctttcacaactcaaaacgcactataaatattatcaatagtcttcctt

SEQ ID NO: 5946 - DNA, 1771 bp, Triticum aestivum
attcgtcgcgctcctcgtattaggtgtagggggtggggatgataccccagtggagcaaccgaagaaactttacataagccccccaaatgctaaaagatttcaacttcctgatggacggcacctggcttacgaagaaaaaggaatttcagctgacagggcaagattttcactggttgctccccattcttttctttcgtcaaggctagcaggaatccctggaatcagctcatcacttctagaggaatttggggcacgacttgtgacctatgatcttcctggttttggtgaaagtgatcctcatccaggccgaaatctgaattcttctgcattagacatgcttcacttggccgatgcccttgggattgtggacaagttctgggttgtaggctattctggaggtggcatgcatgcttggagtgctctgcgctacattcctgaccgggtggcaggtgcagcaatgttcgcccctatggcaaatccgtatgactccaaaatgaccaaggatgagaaacgtaaaatttgggacaggtggtcaactaaacggaaactaatgcacattttagctcggagatttccatcactattgcgcctcttctatcacacaagcttcctttctggaaagcaaggacagactgagagttggttatcattgtcaatgggaaagaaggacaaaaccttactggaagctcctatgttcaacgcattctgggaaaaggatgttgcagagtctgtgcgccagggagatgcgcaaccatttgtagaggaagctgtgctgcaagtatctgattggggattcagtttgtcagacattcaaatgcagaagaaagaggatcagggagtatttgaatttatcaagtctctgttcagtcaggctgaacgagagtgggtgggatttctgggcccaatccacatctggcagggaatggatgaccgggtggtgcccccatcggcgaccgagtttgcccggaggatggttccaggagccactgtccacaagcttctggacgaaggccacttctcatacttctgtttctgcgatgagtgccaccgtcagatattctccaccctgtttggcaccccgcagggccctctgaatcctgcactggaatccagtgaagtggccccggaaccggtggaagaaacaagccctgcatatgacgaagaagttgcagggcaggagcaggaaacatcaggcgtggcctgaccatgctcagcctgaggatcatgagtatagatacaagagtacaagaagactgttactagtaggaacctcaaagaaaagataggcttttccttccttgccgccagtggagaaatgctgactgagtagagcgtcgagtataaaacgaagctctgggtctgggtctggttggggggctgcaccgattgtgctggttcggtataatgtacaggaaaagtcttgaaaggtctgcgcatgaaatcacctgcttggtgcgccgctagcgttctctctcgatattgacgttcgatttggcctgtgacgacgcgacgcccttgcatagcctattctgcgcatttgcttagtatgccgtgtaatgggatggttggttgtattgctctctcagctatgcagaagtagtctttgctgtgccagccttaccgattccggaaatctagcatttgcttcctctgtaatgtgttgccttttcccattttctgaaatatccaataggttattgatctggaaaacactagacattacaatgaaaaggtaacaagacacagaacgagcagtattagatttacctcg

SEQ ID NO: 5947 - DNA, 1518 bp, Triticum aestivum
gagtacctcgccgaggaccgcgaccccgtcaggtgctgggtcgtcgttgccgccgtcgcattcgtcgcgctcctcgtattaggtgtagggggtggggatgataccccagtggagcaaccgaagaaactttacataagccccccaaatgctaaaagatttcaacttcctgatggacggcacctggcttacgaagaaaaaggaatttcagctgacagggcaagattttcactggttgctccccattcttttctttcgtcaaggctagcaggaatccctggaatcagctcatcacttctagaggaatttggggcacgacttgtgacctatgatcttcctggttttggtgaaagtgatcctcatccaggccgaaatctgaattcttctgcattagacatgcttcacttggccgatgcccttgggattgtggacaagttctgggttgtaggctattctggaggtggcatgcatgcttggagtgctctgcgctacattcctgaccgggtggcaggtgcagcaatgttcgcccctatggcaaatccgtatgactccaaaatgaccaaggatgagaaacgtaaaatttgggacaggtggtcaactaaacggaaactaatgcacattttagctcggagatttccatcactattgcgcctcttctatcacacaagcttcctttctggaaagcaaggacagactgagagttggttatcattgtcaatgggaaagaaggacaaaaccttactggaagctcctatgttcaacgcattctgggaaaaggatgttgcagagtctgtgcgccagggagatgcgcaaccatttgtagaggaagctgtgctgcaagtatctgattggggattcagtttgtcagacattcaaatgcagaagaaagaggatcagggagtatttgaatttatcaagtctctgttcagtcaggctgaacgagagtgggtgggatttctgggcccaatccacatctggcagggaatggatgaccgggtggtgcccccatcggcgaccgagtttgcccggaggatggttccaggagccactgtccacaagcttctggacgaaggccacttctcatacttctgtttctgcgatgagtgccaccgtcagatattctccaccctgtttggcaccccgcagggccctctgaatcctgcactggaatccagtgaagtggccccggaaccggtggaagaaacaagccctgcatatgacgaagaagttgcagggcaggagcaggaaacatcaggcgtggcctgaccatgctcagcctgaggatcatgagtatagatacaagagtacaagaagactgttactagtaggaacctcaaagaaaagataggcttttccttccttgccgccagtggagaaatgctgactgagtagagcgtcgagtataaaacgaagctctgggtctgggtctggttggggggctgcaccgattgtgctggttcggtataatgtacaggaaaagtcttgaaaggtctgcgcatgaaatcacctgcttggtgcgcc

SEQ ID NO: 5948 - DNA, 2042 bp, Pennisetum glaucum
tcctcctcgccgtaccagccggcccccgccgccgcaacattcgccgccggcggcgcgtcccctccggcgtcggggaagcgaacgcccgtgttgtcccccacgagcgtggccaggtcctcgtgccacgtcatcgtcgccgccgccgacatctcgccgccgcggcgccgatcgcgctccgtttcgcgtgtacgtgctctcccgtgcaagagaggtttggaaattggaaagggaacgaagagaggaggagggcggaggaggggtgggcgcagcaggcgagggggtttgctgagtccacggcggagatgctgctggagctgggccgggggctgtgggacgtcgccgcgcagagcctcgccggcgccgaggacagcgagctcgcacggcggctcaggaagcgggcggcagccacgggggagcgactcagcttcatgaacgagtacctcccggaggagcgcgaccccgtgaggtgctggctcatcgtcgccgcagtcgcattcgtcacgctcctagttttaggtgttgggagcggcaatgaaaccccagtagagcttccaaagaaacttatcatcagtcccccaagtgctagtagaatccaacttcctgatggacgccatctggcatatgaagaacaaggagtctcagccgacagggcaagattttcactgattgctcctcattcttttctttcatcaaggctggcagggatcccgggaatcagtgcatcccttctggaagaatttggggcacgacttgtgacctatgatcttcctggtttcggtgaaagtgatccgcacccaggccgaaatctcaattcttctgcattggacatgctccatctggctaatgctctcgatattccagacaagttctgggttgtgggctactctggtggtggcatgcatgcttggagtgctcttcgttacattcctgaccgaattgctggtgcagcaatgttcgcacctatggcaaatccatatgattccaagatgaccaaggatgagaggcataaaacatgggatagctggtcgaccaaacggaaactaatgcacattttagctcggaggttcccgtcactactacccctcttctatcgccgaagcttcctttctggaaagcaaggacaggcagatagttggttgtcactgtcactggggaagaaggacaaaactttactggatggtcctgagttcaatgcattctgggaaaggaatgttgcagagtctgtacgccagggagatgcacgaccatttgtagaggaagctgtgttgcaagtatctgactggggtttcagcttgtccgatattcaaatgcaaaagaaagaagatcgaggcttttttgaactcatcaagtctttgttcaatcaagttgaacgagagtgggtgggatttctgggtccaatacatatctggcagggaatggatgaccgagttgtctcgccggcagtggctgaattcgtccggcgggttgtccctggagctacggtgcacagacttcttgacgaaggccacttctcatacttctgcttctgcgatgagtgccacaggcagatattctccacgctctttggcattccccagggcccaatcaacccggtcccgcaacctagcgaggtggcttcagagcttgccgaagaaacgacagcaccggacaatgttacggagcaggagcaaggaaaatcaaacctggcctgatcaagatcggctttcaggatcagcagtacagatacgagatgttactactacactatcactactactactaaatacaataccacacagttggacgggcctttcttcgctgcccatgggacaaagcctgcgtcaggtgaactgagctcctcttcttgcgcaagtattgaaggcaagagctttggataggaggcttcgatgcattgtgcggtttcagatcgatgtacaaatgctcatcccaaatgcgcacagcacctgctcggtgtgctcttagtatagtggctgttaaaattcgattaacctgtcataatgtgactccattagttataaacttcttgttgcacatctgcttac

SEQ ID NO: 5949 - DNA, 2149 bp, Zea mays
gccaaacgtctcaagctcgccatttcgcctcggtttccagctcccactcctcccttcctcgcttcccaatctccaaacctctcacttgcacgggagcacgtacagccgtacaggcggagccaaagcgatcggcgccgcggcggcaagacgtcgtcggcggcgacgatgacgtggcacgaggacctggccactcacgtggggaacacgggcgttcgcctccccggcgccggaggtcacgcgccggcggcggcgaatgttgctgcggcgggggccgggtggtacggggaggaggaagaggggagggcggaggaggggtgggcgcagcaggcgaaggggttcgcggagtcgacggcggagatgctgcgggagctgggccgggggctgtgggacgtcgccgcgcagagcctcgccggcgccgaggacagcgaggtggcgcggcggctccggaagcgggcggcggctacggggaagcgcctcagcttcatgaacgagtacctccccgaggagcgcgacccggtgaggtgttggctcaccgtcgccgcagtcgcattcgtctcgctcctagttttaggttttgggagtggcaatgaaactccagtagagcttccaaagaaacttatcatcggccccccaagtgctgatagaatccaacttcctgatggacggcatctggcttatcaagaacaaggagtttcagctaacagagcaagattttcactgatttatcctcattcttttctttcatcaaggctagcaggaatccctggaattagagcatctcttctggaagaatttggagtacgacttgtgacctatgatcttcctggttttggtgagagcgatccacacataggccggaatctcaattcttctgcaatggacatgctctatctggctaatgctctcaatattccggagaagttctgggttgtgggctattctggaggtggaatgcatgcctggagtgctcttcgttacattcctgatcgcattgctggtgcagcaatgttcgcacctatggcaaatccatatgactccaagatgaccaaagatgagaggcgtaaaacatgggatagctggtcaacgaaacggaaactgatgcacattttagctcggaggtttccatcactactaccattcttttatcgccaaacctttctttctggaaagcaaggacatccagagagttggttgtcgctgtcattggggaagaaggacaaaactttactggaaggtcctgcgttcaatgcattctgggaaaggaatgttgcagagtctgtgcgccagggagatgcaaggccatttgtggaggaagctgtgctgcaagtatctgactggggtttcagcctatctgacatccaaatgcagaagaaagaggctcgaggcttttttgaactcatcaagtctctcttcaatcaggctgaaagagagtgggtgggatttctgggcccaatacatatatggcaggggatggatgaccgagtgatctcgccgtcagtggctgaatttgtgcggcggttggttccaggagccacggtccacaagcttcttgatgaaggtcacttctcatacttctgcttctgtgacgagtgccacaggcagatattctccaccctcttcggcattccccagggccctatgaaccctgcaccgcaacccagcgaggtcgtttcagagctcaacgaagaaataacagtaccagacaatgtcacagatcaggaacaaggaaaatcaggcctgccctgatcaagatcagttttcaggatcaacagtatagatacaagacattactactaaacacaacacctcatatcgacgggacaggcttttcgtcgctccttgtggactgagctgctcctcttgcggagtcttgaaggatgaaggcaaagtattggatagaggctgtgccgtttcacttggatgtacaaaaatgctcattacagattcgcacggcacctgctcggtgtgcttttagtatagtcggcattaacattcgattaacctgctatgactgcattataggcttcttttagcacatttgttttggcatgcgaacccaatggttcaattgcgtcctcagctgaattttgttactttgtcagggactgtttgatgtagctccactaactctagattgacctaattcagc

SEQ ID NO: 5950 - DNA, 2161 bp, Triticum aestivum
gaggagtggtcctccgtgctcacggctatctcccgcgccgacgagaaaccgcagctcgacgtcaactttgagctcttcctgcgcgtctatgccgagatgcaactgcggctcaagggcgggaagaaggcgcgcgagcgcgacggcggccaaggcattaagcgctcctcctcctcgtctgccgccttcctcacggcgtccaccaccacgctgctgcacaccatcagcgaatctgagaaggcttcctacgtgggccacatcaatgcctacctcgccgaggatccgttcctcaagaacgcgctgcccgtcgatccggccaccgaccagctcttccacctcactaaagacggcgtgttgctatgtaagctcatcaacttggccgtgccggggaccatcgacgagcgtgctatcaacaccaagaggctgcttaacttgtgggagaaaaacgagaaccacaccctctgtctcaactctgccaaggccatcggctgcactgttgtcaatatcggcacgcaggatctcgcagaggggaggcctcatcttatcctagggctgatatctcagattatcaagatacaactattggcagatgtaaacctgaagagcacacctcagttggtcgaattggttcaagacagccaggagatggaggagcttatgagcctttctcctgaaaaaatactactaaggtggatgaactttcagctgaagaaaggaggtttccagagaacagtaacaaatttttcatcggatataaaagacagtgaggcatacgcttgcttgttaaatgtcctggctccagaatgcagtgctaaaccatcgccaatgtcagtaaaagatcttcttcatagagcaagattagttcttgagcatgcggataggatgggctgcaaaagatatctggccccgaaagacatagttgatggtttacaaaatctaaatctcgcctttgtggctcatatttttcaaaaaaggaatgggttgtcgaaacaaatgaaacaagtttcgtttgtggatggagtatctgatgatgctcaagtttcaagggaagagaggtcatttaggctatggattaacagccttggaatttctacatatataaacaatgtattcgaagatcttagaaatggatgggtgctccttgaggtcatggataaggttgctcctggttcagttaattggaagtttgcaaaccggcccccaataaaacttccattcagaaaagttgaaaactgtaatcaagttctgaagataggaaaggaaataaaattttccttggtgaatattgctggtcatgatattgtgcaaggaaacaagaaattgatattagcttttctctggcaattgatgcggtacaacatactacaactgctgaagaatcttagatttcattcgaatgggaaggagatcacagataatgacatactattatgggctaacaaaaaggttaaggattctggaagacagtctcaaatgggaagtttcaaggatagaagcctttcaagtggcatattttttgtcaacttactaagtgctgtggagcctcgcgttgtgaattggagccttgtaaccaaaggagaaaaagatgaagaaaaacaaatgaatgcttcctacatcatctctgtggctagaaagcttggttgctccatcttcttgttgccagaggatataatggaggtcaaccagaagatgatgctgactttgacagcaagcatcatgtattggcatttgaaaaggccaacatcatattcactggacgctgacaacagtagtttgtgtgagacaagttctatctcaacttcagatgactcagcatctgaatcatcaattgatgatagcggaactagatagatgaaattgcatggtctgactgctatttcaggactcgagattctatattcttgattctttgctataaattggagagcagacgcattcaagaatgaaggggagaatggtgaaagagttttgtttgtttcatttgaggttctgtagtgtgcaaattgatttggtgagtaatgtacaacatcctgtaaatattgacacaggtagcaagtatatgtaacatcatatagtggcagttgtttattcaaaatccaaccacactgattagtttgttgagcaattttgctcaggcgacgtcgatgactcatgtagtaatttt

SEQ ID NO: 5951 - DNA, 631 bp, Pennisetum glaucum
acgattccacgccgaaagcgtagagcgcaggcgcagcagaggacgcgagaaggggcggcgagttcttggatcctgtctcctccgctggtgacttggcatggatgcaaagaacacaggcaatgaacatcaagctcaacaaaagcctgatgcggtgacaggcagtgttccaagacctgatcaagggaccttgaaacagttcgcagatttagatgctggaaacatcagtccagtagcaagtggccaggaagctgacgtgaacatggaagctgccatctccaccgaggacgtcatgcgagccggcgggtttggagcaaaagacgacattggcagtctcctcccaacagctattgattcgacagatttcgaggcctcgctgcgggacgcccgcgacttcgaaggcgggaacgaggcaccatcacatcctggactgggctggaagggggagaaagctgatgatggtagcaaaccatcacatgtgccgcagcagctaccgtgatatcttaccttgtaggctaagtccagcttcagcttcagaaaacatttgctgatcacgtttgcgtagcttgatttccaagagctgcggtacgtatgaacctttttgcctcaatgttatgtgtgtagcattctgctg

SEQ ID NO: 5952 - DNA, 751 bp, Panicum virgatum
gagaaccgcaaaaggcaaaacgattccgcacgctccggtcgaagcgcggggggagcgcaggaaggagagggcgcgagaaggcgcgggtgtcggtcttgaatcttctctcctctgcacctgagcctgctgatcagcccggcatggatggaaagaaccttggcaatgaacaacaagctcaacaaaagaagcgtgatgcagtgacagacaatgttccaagccttgatcaagaggccttgaaacagttctcagattcagatgctggaaacatcagtccggcaaatggcaatgaagctgatgtcaacatggaagcagccatctccacagaggatgtcatgcgagccggcgggtttggagcaaaagacgacattggcagcgtcctcccaacagctattgattccactgatttcgaggcctcgctgcgggatgcccgtgactttgaaggtgagaaagaggcaccatcgcatcctggactgggctggaagggggagggaggtgatgatgggagcaaaccaacagatgtgccgcagcagttaccgtgatatctaaccttgtaggctagtccagcttcagaaaacacttgctgtgttcccaagagctgcagtacgtttgaagcttttgccacaatggtttgtgtgtaccaatctctgttgtttcagactttcagtgctgtatgaacactcaggtcacggttctcgactattgtccactctgttggatgcctgctaatgtatacttcagcctgttttttttt

SEQ ID NO: 5953 - DNA, 784 bp, Panicum virgatum
acaacagtagtagtagaagaacatcctggtgactgaaggaagcgaagggagagagaactgcagaacgattccacgctccggtcgaagcgcgcggagcgcaggagaggacgcgagaaggcgcgggtgtcggacggcgggttcctgaaccttctctcctccgcagctgagcctgcggatcggcccggcatggatggaaagaaccttggcaatgaacaacaagctcaacaaaagaagcctgatgcagtgacagacaatgttccaagcattgatcaagaggccttgaaacagttctcagattcagatgctggaaacatcagtccgacaaatggccatgaagctgatgtgaacatggaagcagccatctccacagaggatgtcatgcgagccggcgggtttggagcaaaagacgacattggcagcctcctcccaacagctattgattccactgatttcgaggcctcgctgagggatgcccgtgactttgaaggtgagaaagaggccccatcacatcctggactgggctggaagggggagaaaggtgatgatgggagcaaaccatcagatgtgccgcagcacggcagcagttaccgtgatatctaaccttaggctagtccagcttcagaaaacacttgctgtgttctttttttttttttgaagaatcacttgctgtgttcccaagagctgcactgctgcagtacgtttgaactttttgccacaatggtttgtgcctgttgtttcagactttcagtgctttatgaacactcaggtcacggttctcgtctat

SEQ ID NO: 5954 - DNA, 2236 bp, Saccharum officinarum
caccatggaagcaacaagaaaggattgtccttcctcggaaactaccaaagggatcaaaaggagcccatgcaagagaacaacctgctgcatcagttttcagtgatatagagaagcggctcaaggatcttgatttccaacaatcgaacaaggatcttagagcgcttaaacagattttggattccatgcaagcaaaaggactattggaaaacaagaaacgggaggaagcatctatgccaaagttgtatgatggaaaccatgatggccaagagatagccagtgtgaacatgagactgaacagtaacaccaacaacatgtggatgccagaagagagcaacgctgaaagctctttcaaatcgcctattgtgatcatgaaaccttcaaaatctgcaaaccttttcagcgaagtggattcttctgtcttaccattagggggttcatctgatcccccacagccgcaaacaagcaatagcactgatagaaggaaagcttcaacgatcaatagaacagctaaagagcaacatgcgaaatttagtcaaaaggtgcctacttctcaaccccttgtttcttatgacaggagatcatatggaaggactgacgattgcagcaacaaccaaaaatctagttcactgctggttactgagagctcatccagaagacagcagctgccaagagacagtagcataagtatgcaaaaaaataaaaattccactagcccaaggttactacagagaaaacttgattcagagcggagggctagactgcctattccttttgctgagtctaacaaaatccaaaggcaatctggagataggaataattcagaaacagtgtcaccccgaagcaaattcagaaggaaacttgtgcgtccacaagaaggtgatgatggcatgcccaatggattgaacaacaggacaaggagcctgaatcagcatggcaatgatatgtccacaaggtcagatggcagtataagtgttgcttcagagctggatattataagcaatgacagatctacagaagttaatatttctaactttgagcaaggcattggaactccatctggaaggaacccacaaaaagtgaaaacctcatatgatgcaagcaaggacgtgccatctgtagacccttcggctgctattccggaacggcccagtccagtttctgtgttggactcttcatttgatcaggaggatttgttccctaccagcaggactccaaattcacttgctgttgatgatgtgcaccgaacattagaggaaccctggaaaccttctgatacaaagccaacagaggtcgctatgcagtccaagaacaataaactcgctaatgttgcgagcttgcttgagaagctccaacagcttagcatgaacaaggatgaggatgcacctccggttgaccatattgctttcttgtgtgagacagaaagcccagaccaccgctacgtgtctgagatactgctggcctcgggtcttctgatgaaagacctaggttcaggacaggcaggtctccagctccactcttctggctacccgatcaaccctgacttgttccacgtgttggagcaaagaaagtcaggatgggtcagtatacctgatggcatccatcagagcaggagcggcgcaaaatctgatcccaagagagcgcaccggaagctgatgtttgacactgtgaatgagcttctgcttcagaagtttgagaaggaaaccgccgtttattcggtcagttccttcaccagagcgaaggatccacctgcaaagactcctagcgggcagcaactgctgaagttcatatcctcaggaatcgaagacctggacatggagcgatcgtccatctggcagaaggaaggcagcgtgatacctgatgcagagatcctgcagaggctgcagggatggacgagcttcagcaaggagctgccggggatggtgctggagatcgaaaggtcgatattcaaggagctggtggacgagatggtgcatggggaatctgctgatggcccggagatgaaggtggcaggcaggcggagaaggcggctctttgcttgatacggtttgtttgaccatcaccatccaccaggttgtccaagtggatgggcctgatttgtgaagcttgtaactttctttgttttgccatgagagcccttttcctctgaagagagaggtacacaagttgtataagcagcgcagatttgcagagaccagaaaacgggcattcgtttgtgctatatataccactgcttttt

SEQ ID NO: 5955 - DNA, 2638 bp, Pennisetum glaucum
tcggggatttggagacttttgagttgattggatccactggacctgagacaacaggtgttcgatccatgacattcaatcctgacggaagatctctgttatgtgggttgcacgaaagcttaaaggttttctcttgggagccaataagatgccatgatactgtggatgtgggatggtctagacttgctgatttgaatgtccacgagggaaaacttcttggttgttctttcaatcaaagttgtgttggaatatgggttgttgatctgacgcgtcttgagccatatgcaactggtacatcaagtaagctcaatggtcattctgaattgaagactgtgtcaagtggcactatgcctttacaaaatgacactggttcaaaagcaaacatcgggcgaccatcagttttgcaaaattcagagaataacttaaaagcttcttcaggaagactgtcagtctctcaaaactcagattctgcactaaaagaggcaaaatcaacagcatcaagcggattggtcccaagcacaccgcagcgggctggagttggctccaataatagatcttttggaaattcagcctttgcatctggtggtaccaccttgaagagaagtttgctgaggagtcacaacgcctctagtgttagcaatttcagtaaatctgatgtagtgcctgtgattgttccaagaactagctcaggaggggagctggctactgattctagaagtgatgctgctgatgtggcacctgttctttctaaggcaaacagaagggttgatcctgctactgattctagaaaagaaagtactgatgcggaacctgttattcctaaagcaagctctagaatggaaatatcttctgattcgacaccttccaagtcaagcagaaggctggagtctggtgctgattccaaaaaagaaagcgccgatgcagcacctgctgttgttcctagggaaaatacaaaaatggaaatggcctctgattctgcacctgttctttcaaaggcaagcagaaaggtagatcctggtaccgattcaaagaaagaaagtgctgatgcaacacctgtcattccccccaggacaagttcaagaacggaaatggcctcagattctaggagagaaccttcttctggaagaatatcaccattcagaatccagtcaagatatgctgagctacgcaagctaacccatgcgaaagttgatgcaaacaaagctgaaagcagaaataaaaatactgaaacggatgacttcaattgccaaatatttctcccccgaagaaatggtgtttttcatacaataagttctgaagaaactcgtgaagatataaagcatggtgcagttgacaggatggcattttcgaatccagcagaactgaatgcaagtgtccgcagtgagaactatgtttctagagtgcgtaaaccaagagataactgctatgttgaagtttcaagagcaggaagagcaaggtcaagtgtctctaattgggaagggagggatcaatcccctagtcatgaagaaccaacaacgagcagttcttcgctggctcctacaggccgttcatattcatctagaggaagcaatcaagcttctgaaactccaaccatagctagcgatgaagatgttctatcccttctaatggagcaacatgagctatttctaagctcaacacggtctcgcctgacaaaattgcagattattcatcaaatgtgggtacgaaacgacatcagaggtgttctctctgcaatggagaagatgtgtgatcatgctgtatctgctgatatggcaagtgttttgatggagaaaagtgaaacaatcacactggatttatgtacatccatcctgcctgtcgccgctgaccttctggagagtaaaactgacagacacttaggcgtttcattggagttgttggtgaagcttgtcaggacctttggtccaatgatacattcaacagtatcagcaggtcctttttctgttggtgtagatcttgaggcagagcaaaggcgggagcgctgcaacttatgcttcgttgaattggagaaagtaaaaaataagcttccttttcttaccagaagaaaaggtgcagttgcaaacgcagcacaggagctcactcttgtcttccaggaagttatgagttgactgaagacacactcataagcatacaccatatcagagtggcacctagatatcagctgctgctgagctctagttgctcgatcttgagctgccatcaagctccaaggccacaccagcaggagaagcattttgttgctgctgctcgtgccttttgtacacatgctaacaccagagggactgacacccatgtcatttgggaagagcagcagccatgaacagtgacttcggccacactattacatatgtggatgctgtttcggctgttgctgaagatgttgtagttctgaatcaaaatggtggtgaaaagggtagatggtgagcttttcgagcaattgtagtacttggccgtctatagtgtgttgtgtggacgattcagacacaggattgacgagtgttgtgtggttgattctgtcacaagattgacaagtgaagcgagccatgtacatcatttttctttttgtctttttttttgaatttttttgatatccagatgactcttctcttctgcttcaagcgcg

SEQ ID NO: 5956 - DNA, 785 bp, Saccharum officinarum
ccctagaaagaagaccaacaagcaggtcgcgcgagcccaataaaccaagagagatgtgtgcggcaggctactagtgagatgtgcctccatcataccacaccatgtgatgcgaggagcctcttctgcctctcatcctccccctacttccaagatgcaatcatgctgccccaagctcctcgggccctcggccgccatgattgcctcaccgcctctcaagagtcgcctccacctacttccaagaggaagaggccggagaagctatagtccatgaagaaattaagtggaggggcggcggtgtacggggggcagcggaggagagagagggggaggtgacagaaagctagagagagatgcatggtgcatgatgatggcgtggttgatctcttcgatctagtacttctatcattcgatcgagtcaagaagccatcatcagatcggtgcagttctccctcctcctcctccttccagctcctcatcagcttctttgtaacactgcgccggccgccatggctttggggaatcaagcgtcttggtccgaaatccgtcttctttcctagctaggatctacgtacttgtgcaagagtatgtcatgctatgctatatgttattcctacatgttcttattctgtctctatatatggttcgtgcagacaccaagattctttcgtcttgatttatttatttcgatcactctttgatttggagtttgattcatgtaatatttcattagttatgtggatttcttctttgagcttttctacttctctagttgaggaacttcgttc

SEQ ID NO: 5957 - DNA, 937 bp, Sorghum bicolor
ccctagaaagaagaccagcagcaagcaggtcgcgcgagcccaataaaccaaggagagatgtgtgcggccgcccggccggctactagtgatgagatgtgcccctccatcataccacaccatgtgatgcgaggagaggcctcctcttctgcctctcatccccctccccctacttccaagatgcaatcatgctgccccaagctcctcgggccctcggccgccatgattgcctcaccgcctcctcaagagagtcgcctccacctacttccaagaggaagaggccggagaagctatagtccatgaagaaattcagcggagggccggcagcgtacggggccggggccggccggggcagctatcggaggagagagagagagggagatggggaggtgacagaaagctagagagagagagagagagagagaggtgcatggtgcatgatgatggcgtggttgatctcttcgatctactctagtagtacatctatcgttcgatcgagtcaagaagccatcatcagatcggtgcagttctccctccctcctcctcctcctccagctcctcttcagcttcgtctttgtaacactgcgtcgccatggctttggggaatcaagcgtcttggtccgaaatcatccgtgtcttctttcctagctaggatctacgtacttgtgaaagagtatgtcatgctatatgctatatatgttattcctacatgttcttattctcgatctgtctctatatatggtttgtgcagacagcaagattcgtttgtcttttgattgatttatttcagttcgatcactctttgatttggagtttgattcatgtaatatttcactagttatattctttgagcttttctacttttctagttgagggaacttcgttcagagagatcagtttgagacgatgtgtttcttgattgatatgatccatgacccga

SEQ ID NO: 5958 - DNA, 1656 bp, Sorghum bicolor
atccactgccgtcggtatcacctgaactccgtacaggaggaaggaggaggagaccccctagaaagaagaccagcagcaagcaggtcgcgcgagcccaataaaccaaggagagatgtgtgcggccgcccggccggctactagtgatgagatgtgcccctccatcataccacaccatgtgatgcgaggagaggcctcctcttctgcctctcatccccctccccctacttccaagatgcaatcatgctgccccaagctcctcgggccctcggccgccatgattgcctcaccgcctcctcaagagagtcgcctccacctacttccaagaggaagaggccggagaagctatagtccatgaagaaattcagcggagggccggcagcgtacggggccggggccggccggggcagctatcggaggagagagagagagggagatggggaggtgacagaaagctagagagagagagagagagagagaggtgcatggtgcatgatgatggcgtggttgatctcttcgatctactctagtagtacatctatcgttcgatcgagtcaagaagccatcatcagatcggtgcagttctccctccctcctcctcctcctccagctcctcttcagcttcgtctttgtaacactgcgtcgccatggctttggggaatcaagcgtcttggtccgaaatcatccgtgtcttctttcctagctaggatctacgtacttgtgaaagagtatgtcatgctatatgctatatatgttattcctacatgttcttattctcgatctgtctctatatatggtttgtgcagacagcaagattcgtttgtcttttgattgatttatttcagttcgatcactctttgatttggagtttgattcatgtaatatttcactagttatattctttgagcttttctacttttctagttgagggaacttcgttcagagagatcagtttgagacgatgtgtttcttgattgatatgatccatgacccgaacatatacggctacaactagcccagctgttttctagagagataagatcacatgaacaacatgaaatatatgtgcatcttttagcttcgttcgatccataccttcccttgatatctccttatgaaacgcgctttatttctaagatgttgcaagtctagctttaccttaatatgtgcattttgtttttgtgggtgagggaaaaaagaagaagaagtaagataataagattcactacatgctagtactctatactaggaactacacgcaacacattacccgatcagcccaaccgtattcacgaatcacgagcttgagaaagaccagcagcctgctaaacaagattctttgactgccccaaatctctcttgggcattgcatactgctagtatctatgagagaggtccaggtgcagctagctggtgccaagctaaagctagcaagagctacccctgctactgctagcatgccatggtatcgtattggccagtcctcctagcgtcacatgcatgcacctctttcagtcttttcctacgcaacaacccccaatctgaggattacgtttactgctaaaattaaagagaaaatcattgaagagtagtatatattatctgtcatttcattattatcaactctcatatatgtgtaatctcaaatactatgtgtca

SEQ ID NO: 5959 - DNA, 2299 bp, Panicum virgatum
ctcgccggaggccggggcctgcgcggcgcacggcgtcaagtgcgacgtcgacgtggtgtcgtggcgggagcggcgggtgctcgcgtccgtgcccgtggccgccgacgtcgataccctgtggcaggtcatcaccgactacgagcgcctcgccgacttcatccccaacctcgtccagagcgtgaggattccgtgcccgcacgaagggcggatatggctggagcagaggggactgcagcgggcactctactggcacatcgaggcgcgcgtcgtgttggatctccaggaagtccctgattctattaatggacgagaactccatttctcgatggtagatggtgacttcaagaagtttgaaggaaaatggtccatcagatcgggtccaaggtcctctagtgcaattttgctgtatgaagttaacgtgataccaagatttaacttcccggcaatatttcttgagaggattataaggtcggatcttcctgtaaatcttcgagccttggcatctagagctgaaaagatttatttagaaaatcaaagatgtggttcgagaaaaatttctgctatggattcaaagacatcatctacttcttctcagcttaagttccatagtacagcaattgagactacttctagtaagttcaaagaagcacctcccacttctggtgttagtagtgtgcttccttcaccttcttctgagttgattagcaaatggggtgtatatggaaacgcatgcagaattgataggccttgtgtggtagatgagatccatcttcgaagatttgatggtctcttggaacatgagggggctcacaggtgtgtttttgctagtatcactgtgaaagcaccagttcgaaaggtatggaatgtttctcacggcatatgagaatttacctgaattcgtaccaaacctggctatcagtaggattgtccttcgtgataataacaaggtccgcctaatgcaggagggttgcaaaggcctactttatatggtccttcatgcccgtgttgtcatggatcttcgtgaaaaacttgagcaagaaatcagctttgaacaagttgagggtgatttctactcattcaaagggaaatggcgcttcgaacaacttggagaccatcacaccctgttgaagtacatggttgagactaagatgcataaggacacctttctctctgagtccatccttgaagaggtcatatatgaggatcttccatcaaacttgtgtgcaatacgtgattatattgaaaaggctggagcttaaggtagcaactccattactcattctgatgcaccaacacactcagatattgttcctgcgcaaagcaggcaattagagcaagaatctgcatcttgctccttcagttccacgaaacagagaccaaaagttcctggcttgcaaaaggacattgaagtcctcaaatctgagcttgagaatttcattgcaagctacggtcaggatggtttcatgcctaagagaaagcatcttcgttctcatggaagggtggatattgagaaggcaataacacgaatgggtgggttcaggaagattgccagcataatgaacctttccctttcctacaaaaatcgaaaaccaagaggttattgggataatctggagaacttgcaagaagagatcagccggttccagaagagttgggggatggatccttcttatatgccaagtaggaaatcttttgagagagcaggtcgatacgacattgctcgggcattggaaaaatggggtggggtgcaggaggtttcgcgccttctttctcttgaactaagacgtcctagaaggcgagctgactcagatgatgagaggcagtctgaatcacaagctggcagtggtatgacaaagaagcacggaatcaaacctgataaagccaacatgtccccagatgcacagaaatggctcctgaagctgaaggatttggatgtgaactgggtggaatactagattaataagcttcgaaaacgaaatgatgtggcactatcaactcaattcttttttggcgttggaggcgctctggaagcagtccgtcaaagacgctgtaaattatgtacagaaaatttgcaatgctcaggccaaccctgaattaacccatgctgaagctaccaacgggcaacggttttcatttgtcatctgtcacgactcttggtcctctactactactactactactactactgctgctgctactgcttatctagaagtgttgacaactatgcacagctttgttgcagtcaaatttgaaccgttgatttgggccactaagcacaatggggtgttgatctcgtata

SEQ ID NO: 5960 - DNA, 1837 bp, Pennisetum glaucum
caattttgctgtatgaagttaatgtgataccaagatttaacttcccggcaatatttcttgagaggattataaggtcggatcttcctataaatcttcgagccttggcctgtagagctgaaaagatttatttagaaaatcaacaatgtggtttgagaaaattttccactggggattcgaagccatcatccacttcttctcagcttacagcaatggagactatttctagtaagttcaaagaagcacctcccacttctggtgttagtggtgtgctcccgtcaccttcttctgagttgattagcaaatggggtgtatatggaaacgcgtgcagaattgataggccttgtgtggtagatgagatccatcttcggagatttgatggcctcttggaacaggagggtgctcacaggtgtgtttttgctagtatcactgtgaaagcaccagttcgagaggtatggaatgttctcacagcatatgagaatttacctgaattcgtaccaaacctggctatcagtaggattgtccttcgtgataataacaaggtccgcataatgcaggagggttgcaaaggcctactttatatggtccttcatgcccgtgttgttatggatcttcgcgaaaaacttgaggaagagatcagatttgaacaagttgagggtgatttctactcatttaaagggaaatggcgctttgaacaacttggagaccaacacaccttgttaaagtacatggttgagactaagatgcataaggacacctttctatctgagtctattctggaagagatgatatatgaggaccttccgtcaaacttgtgtgcgatccgagattatattgaaaaggctggacctgaaggtagcaactccacaactcattctggtgcccgaacacacccagatattgatcctgcagaaaacaggcaatcagagcaagaatctgcatcttgctccttcagttccacgaaacagagaccaaaagtccctggcttgcaaaaggacattgagatcctcaagtgtgttcattgctaagtatggtcagaatggtttcatgcctaagagaaagcatcttagatctcatggaagggtggatatcgagaaggcaataacacgaatgggtgggttcagaaagattgccagcataatgaacctttccctttcttacaaaaatagaaaaccaagaggttattgggataatctggagaacttgcaagaagagatcagtcggttccagaagagctgggggatggatccttcttatatgccaagtagaaaatcttttgagagagcaggtcgttacgacattgctcgggcgttagaaaaatggggtggcgtgcaggaggtttcgcgccttctttctcttgaactaaggcggcctagaaggcaagctgactctgatgatgagaggcagtctgaatcattagctggcagtggcattacaaagaagcatggaatgaaacctgacaaagccaacatgtccccggacccacataaatggctcctgaagctgaaggatttgaatgtcaactgggtggaatactagattaataagcttctaaagaaaatgctgtaaattggaggtaatctggaagcattcttttccatcgttggaaacttggaggtgatctggaagcattctttcaaagaagctgtaaatttgtacagaaaattgcaatgcacaggccaacccttgctgaaaggttacaggcaacaggttttcatttgtcaactgtcatgactcctgtctcttggtcctcagtattacttatctagaagttggatttgaccaaagacaaaccactaaacgcaaatggagtacctgttcaaagttgtttagagtcagc

SEQ ID NO: 5961 - DNA, 1718 bp, Brachypodium distachyon
tgtccaggtcgcacttcgcaggctgccaagacatgcaagttgctctgcttcgttcagccgaagaaaaatatgagtacggctgcagatgccatattatatggtgcgtttcgagtccggtccatctgggcttttatgagcccatcgtgccaaaaaagggcccaagcccacaaatgcattgcacggttgcacttgcacagcgtcattccggcggaaaaagaagaaaaaatggagcaaacgctgctgtaagctgttgcccgacaggacaccatccctttgctcacctcagcggctcagcgtggagctcgtagccttgggagggagcggaggatgagcggcggcggcggcgtgttgggcgccggctcgtcgtaccacaggttcgtccactcggcgatggagcagacccgcctccggaccgccctcgccccgcatccctcgcaggaaaagttcaagtgcataaaagccaatgacgatagtaccgtttttggagctctctcattcagcgcccccaaagtcagactgcttcgcagcttgacaattgagaaggaaaactcagttcaggttcttgactttgctgctttctctgaacctgaatacgatcttcccatattttgtgccaacgcgtttacatcccctgttcaaagtattgttgtcttggacctcaatcctttatatgatatcactttatacaaggattacaaagagaaatacttcaggaatttgatgccgcttatacagaagtacagcgagcttctgccatggggtggcaagattacgagcgagtcactgagattcttctctccggttgtgatctggtctatatttgaaccaaccgaacaaaaccatcatgtcctatattcagctttgatggattactacaaggtttggcttgagttagctgatcaagcaattaaagaaaacgacgcatcaaaaattgctcataacagagaagcacaacatagatatctcacatggagagctgagaaggatcctggctatccactcttgaagaaattaattggtgaaagccatgccaaggatttggtgacagagttcctattcgaaggagtgaattctctcgggagcaaatcttttctggactatttccctgaatatgcgcgcgacgatgggacggtaaacaagaagaggagtatgatcgggaagtctttcgaaactaggccctgggatgctgatggggaattcattggtggtgacgatgcaggatgaggtctttgctgtatgatatgcacgagcattcttaccacggacacgttctgccacgctctatcttccctggtttctgtttcactccttgttgtagtttcatccgagggttttgtgtagtttgaaaaaggctggaagaactcaatgaatttggataacatatgttcggctaacagcatgtgcagacacgtggcggcacgcagccacagcaagttagttgtttgatgtggagcagagagaaagagaataaagttcaggtactgcaaagaaacaaaagctgtaggatcaaacttattgtgttttgcaagttgttgtatttaatggtgactataatatggagaggtcgaagatcgactctatttctgcagattcctcgtctgcatagatgccccgggacttctttttctgccaaaagcgaatgatgaatttacaaaagtattggttatctgaatctcaaatcgtacgtcaacctattggttggcttgagccttggcatt

SEQ ID NO: 5962 - DNA, 1037 bp, Sorghum bicolor
taccctgattttttctttgttaacattagattatcgtcagataagcagaggtggcacccgcacggcacgatcagctcaacgcgtggcagctgatcggttaccagcggaatctgacgaatcgacgcggcggaggccgggagacgatgaaggatggagcaaacttacatacatgcgtttgtctgcgaaatgaaatggcccttgtagtagcatcatcgcttttgattattactacttcagttcggcactgctagattcggagagcacggtgatagaggggaaacatcaaacatccattgcctcaagtgcagtgccgttctgaaattaagcaccaaataccgtacaaaaccatgctatagcctataggctgtatagcagaacaactgcagacttttagaacttggtagatgtactcatgtaagagcaaggaactgtagacctctggttctacgtacatttgcttcattcaagaacagggggtgttctgttctagcaggagccaccaagaggctgaaggtgagcaacagcggaaggagaacgaaccaacgaacgaacgggacaaaacttgacaccaaaacaccctgttctaaagaggaaaactcatcagattgcattccgagcactcctcgacctcggcgcatgtcctcagcgagttactctactcctgatgctagcactgcttatctcccgaagccgcgatcccggttcttggcgaccggcgccgcgaggctgccgagcaaggtcttggcgatctgcagcttgagctggcccctcttgagcggcggcctcttctccttgttgcagccgctgctgccgttgcaggggtaccagtactccattgctccgcttgcttgctttcttgcttgctctgtcgctggtcgtgagctgtgttgtgtgcgtgagcttggatggatggcttgaggagggagcgtgcaaacctagtgttatatagccagagtttatagacacgttgctttggaaggtggaaacgcgcgttcttctttgtttgattttctgcagagtagacctggggtccggga

SEQ ID NO: 5963 - DNA, 1556 bp, Saccharum officinarum
cttcgcctagccgcaccggtccggaattcccggggtcccgagccgcgacggcgcgcatggcggcgacggcggcggcgctccggtgctgcttccccggctcctccgctgtcggcagtggcttcgtcaagcccacctcctccaggcgaggctggtgcgcagcggccgtggcggcgccgtcgcgggaggcggagccggtttcgtcgctggggcaccgcacccgcgtcgacttccccatccttcaccaggaattcgatggtgccaaattagtttacttcgacaacggtgcaacatcacagaaaccttatagtgtgatgagaacattagatgagtactaccgatcgtacaattcgaatgttcatcgtggtattcatgcactcagcgcgaaggctactcatgcatatgaggatgcaagaagaaaagttgcaaattttgtcaatgcagctgatagcagagagattgttttcactcgaaatgccactgaagctatcaatctggtagcctattcatggggactatctaacgtgaaagaaggagatgaaattattcttacagttgcggagcatcatagtgctattgttccatggcaatttgtttcccagaagactggtgccaccttaaagtatgttggattgactaaagaaaatgtcccagacattgagcagttaaaagggcttctgtcgaacaagacaaagatagttgttgttcatcatgtcgcaaatgttctaggttccatgcttcctatcgaggagattgtaacatggtcaaacagagttggagctaaagtccttgtagatgcttgccaaagtgttccccatatgccagttgatgttcagaaacttggcgcagactttcttgtcgcatcctctcataagatgtgtggccctactggcgtcggatttttgcatggtaaatttgagattttgtcatctatggaacctttcttaggtggtggcgaaatgattgcagatgtattccaagacaaatccacatacgctgagcctccctctagatttgaggctggaactcctgcaattggagaagctataggattgggagcagccattgattatttatcgtgcattggcatggagcagatccatgagtatgagaaagagttgggaacatatctctaccaaagccttctttcttttccaaatgtccagatatatggtccagcaccttccccaactgttcaccgtgctgcattatgttctttcaatgttgagaatgttcatccgacagatattgctgaaattcttgatctgcagcacggcgtagcaattcgatcagggcatcactgcgcacagattttgcataggacccttggtatcactgcaagtgctcgtgcaagtcttcacttctacaatacaaaagatgaggtggataccttcatcgatgcgcttaaagccactattgatttcctcacaactcgatactagtgtggttttgccagtttcatctcgcatttgagctgctgtacaaaaaagtataaaatacatacatttggtacaaataaagcatccaaagtgtacatcttctcaaaataaaatacataa

SEQ ID NO: 5964 - DNA, 1957 bp, Zea mays
atggcggaggggatgcagcaggaggccgcgaggaggacgcggcggaggagagacacccgcggcgtcgctcggcctcggagcggcggccgcggtggcgccgccaagcgaggacacgtcgggctgttccactcccacgccgattggtgggtccggtcaggcgggtcaacgcccgccccggcggcgggcatctggaggcttgctcttgtttggaggctgacacgtgggggccacaacacagcggcagaaataatcccgaccggaccaagcgcccaacaactgccgccccaagccaagggaagggaaaaggctatcgttctcgtcagtcgtcacgagagccgcgacggcgcgcatggcggcgacggcagcggcgctccggtgctgcttccccggatcctccggtgtcggtagtggcttcgtcaagcccaactcctccaggcgaggctggtgcgcagcggccgtggcggcgccgtcgcgggaggcggaaccggtttcgtcgctggggcaccgcacccgcgtcgacttccccatccttcaccaggaatttgatgatgccaaattagtttacttcgacaatggtgcaacatcgcagaaaccatgtagtgtgatgaaaacattagatgagtactaccgatcgtacaattcgaatgttcatcgtggtatccatgcactcagtgcgaaggctactcatgcatatgaggatgcaagaagaaaagttgcaaattttgtcaacgcagctgatagcagagagattgttttcactcgtaatgctactgaagctattaatctggtagcctattcatggggactatctaacttgaaagaaggagatgaaattgttcttacagttgcagagcatcatagtgctattgttccatggcaatttgtttcccagaagactggtgccaccttaaaatatgttggattgactaaagaaaatgtcccagacattgagcagttaaaagggtttctgtcgaacaagacaaagatagttgttgttcatcatgtctcaaatgttctaggttccatgcttcctatcgaggagattgtaacatggtcaaacagagttggagctaaagtccttgtagatgcttgccaaagtgttccccatatgccagttgatgttcagaaacttggcgcggactttcttgtcgcatcctctcataagatgtgtggccctacaggcgtcggatttttgcatggtaaatttgagattttgtcgtctatggagcctttcttaggtggtggtgaaatgattgcggatgtattcgaagacaaatccacatatgctgagcctccctctagatttgaggctggaactcctgcaattggagaagctataggactgggagcagccatcgactatttatcatgcattggcatggagcagatccacgaatatgagaaagagctggggacatacctctacgaaagccttctctctgttccaaatgtccagatatatggcccggcgccttcccagactgtccaccgtgctccgttgtgctccttcaatatcgagaacgtccatcctacagatatcgcagagattcttgatctgcagcatagcgtagcgattcggtcggggcatcactgcgcgcagatcttgcataggacccttggcatcaacgcaagtgctcgtgcgagtcttcacttctacaacacaaaagacgaggtggataccttcgtcgacgcgcttaaagccaccgttgatttcctcacggatcgatactagtgcggttcagttcagttcccttttttttttgccagtttcatcgctctctcgtttgaactgttgtatgcacacacaaaaaagtatgcatatatatttggtataaagaaaacatacaaagtgtacggcttggcaaagtgagctcccttatttggagttttggactgtactcccttatttggcggttgttgttgaattaaacgtagttcaggatgcagagagtacaaa

SEQ ID NO: 5965 - DNA, 1871 bp, Panicum virgatum
acagccaggccgcccccaactccacaaacccccgaagcccagacacggcgcgcatggcggcggcggcggcgctccgctgctgcttccccggctccgctgtcggtggcggcttcatcaggccctcctcctccaggcgaggccgacacgcagcggccgtggtggctccgcctcccgcttcgctggggcaccgtacccgcgttgacttccctatcctccaccaggaatttgatggtgccaaattagtttacttcgacaatggtgcaacctcacagaaaccttatagtgtaatgaaaacattagatgagtactacagatcgtacaactcgaatgttcatcgtggtattcatgcactcagtgcgaaagctactgatgcgtatgagggtgcaagaagaaaagttgcaaattttgtcaatgcagccgatagcagagagattgttttcacacgtaatgctacagaagctatcaatttggtagcctattcatggggtctatctaacataaaacaaggagatgagattcttcttactgttgcggagcatcatagtgctattgttccatggcaatttgtttcccagaagactggtgccactttaaagtatgttgggctgactaaagaagaggttccagacattgagcagttaaaagggcttctgtcaaacaaaacaaagatagttgttgtccatcatgtctcaaatgtacttggttcaatgcttcctattgaggagattgtaacatggtcaaaaggagttggagctaaggttcttgtagatgcttgtcaaagtgttcctcatatgccagttgatgttcagaaacttggtgccgactttcttgtagcatcctcacataagatgtgtggccctacaggcgttggatttatgcatggcacatttgagatcttgtcatctatggagcctttcttaggtggtggtgaaatgattgcagatgtgttcaatgacaaatctacatatgctgagcctccctctagatttgaggctggaactcctgcaattggagaagctataggattgggagcagcaattgactatctatcatgcattggcatggatcagatccatgaatatgagaaagagttggcaacatatctctatgaaagccttatttcagttccaaatgtccgggtatatggtccagcaccttcccaaacagatcaccgtgctcctttatgctctttcaatgttgagaatgttcatcctacagatattgcagaaattcttgatctccagcatggcgtagcaattcgatcagggcatcattgtgcacagattttgcataggacccttggtatcaatgcaagtgctcgtgcaagtcttcacttttacaatacaaaagaggaggtggatgctttcatcgatgcactgaaagatactattcacttccttacttctcaacactagtgctgttgaattagttagtccaccctttttgccattttcctcatttcttgtttcagccattgtatgatatagttggaacttggaacgagaaaaacatccaaaggctatgcctacataaattgtcaactccctttttgaccgtttttgtaaaaggaagtacacagtgcagagtacctttctaatctccatccatatgagaaatgaagtccctggtcggcattatgcagtaaaatatgtcatgtttgcttgttggacatgaagccatctcaactatttctagctaatgaacagtctttcaatgatggctttcatatgtggttaattattgatgcagtagtgtgtttatgtgcataattacctacgactgggaccagtgagagccaaggaaggacaggtagatgtgtgtaatttgaggtatggagtcccaattcaaagaagctgcagctggctcattgt

SEQ ID NO: 5966 - DNA, 1823 bp, Setaria italica
ggaagccctaaccaagccgccctcccaactcctccagcccccagacgaacacacgccggcgccaccgctccaaagcccagccacggtgcgcatggcggcggcggcggcggcggcggcggcgctccgctgctgcttccccggctccgctatcggtagcagcttcgtcagaccctcttcctgcaggcggggccgacacgcagcagccgtggcgtcgtcgtcgagggaggcggagccggccgcttcgctggggcaccttacccgcgtcgacttccccatcctccaccaggaatttgatggtgccaaattagtttacttcgacaatggtgcaacatcacagaaaccttttagtgtaatgaaaacattagatgagtactaccgatcatacaactcgaatgttcatcgtggtattcatgctctcagcgcaaaagctactgatgcatatgaaggtgcaagaagaaaagttgcaaattttgtcaatgcagctgatagcagagagataattttcacacgtaatgctacagaagctatcaatttggtagcctattcatggggcctatctaacataaaacaaggagatgagattcttcttacagttgcggagcatcatagttctattgttccatggcaaattgtttcccagaagactggtgccactttaaagtatgttgggttgactaaagaagaggttccggacattgagcagttaaaagggcttctgtcaaacaagacaaagatggttgttgtccatcatgtctcaaatgtactcggttcaatgcttcctattgaggagattgtaacatggtcaaaaagagttggagctaaggttctcgtggatgcttgtcaaagtgttccccatatgccagttgatgttcagaaacttggcgctgactttcttgtagcatcatcacataagatgtgtggccctacaggcgttggatttatgcacggcacatttgaaatgttgtcatctatggagcctttcttaggtggtggcgaaatgattgcagatgtgttctatgagaaatccacatatgctgagcctccctctagattcgaggctggaactcctgcaattggagaagctataggatttggagcagcaattgactatttatcatgcattggcatggatcagatccatgaatatgagaaagagttggcgatgtatctctatgaaagcctactttctgttccaaatgtccggatatacggtccggcaccttcccaaacagatcaccgtgctcctttatgctctttcaatgttgagaatgttcatcctacagatattgctggaattcttgatcttcagcataacgtagcaattcgatcggggcaccattgtgcacagattttgcataggacccttggtatcgatgcaagtgctcgtgcaagtcttcacttttacaatacaaaagaggaagtggatattttcatccatgcacttaaagatactattgacttacttacatctcaacactagtgcagttgaattagtaagtcctccccttttccagtttcctcattttcttgtttgggccgctgtttgatatggttggaaaaaggaaaacatccaaaggctatgcctacataaactgtcaactccctttttgactgctcttgtaaaatgaagtgcagaatgcaaactacctttctaatctccatcgatatgagaaatgaagttctgggtcagcattatgcaggttctatttgcttgttggatgtggatctgtctcaactagttctagctaatgaacactctttctgtgatggtgttgataaatgatatgtggttaattacttctgcagtaacgtgtttatgtgta

SEQ ID NO: 5967 - DNA, 1916 bp, Hordeum vulgare
cggcacgaggcggaaacacaccgcgaggctttggctaatccaacccacagagacggcgcgcatggcgacagcggcggcggtggcgtcgctccggtacttcccctcctccgtcaggaactgcagctatcccggagctatcagcggcggcggtggcggcggcgctgttgtcacgttttctccgcggcggggccgctgtgcgacggcggccgtggccgcgccttcgcgggaggcggagccggcctcctcgctcggggacctcactcgcgtggactttcccatcctcgaccaggaatttgatggtaacaaattagtttacttcgacaatggtgcaacatcgcagaaaccctctcatgtgatgaaagccttagacgattactaccgattttataattcgaatgttcaccgtggtattcatgctctgagcgcaaaggctactgatgcgtatgagagtgcaagaaggaaagttgcaaatttcgtcaatgcggctgatagtagagagattatttttactcgtaatgctacagaagctatcaatttagtagcttattcatggggcctatctaacttaaaagaaggagatgagattattcttacagttgcggagcatcatagtgcaattgttccttggcaatttgtatcccaaaaaactggtgctgtcctaaagtatgttgggctgactaaagaagaggttccagacattgagcagttaaaagggcttctgtcaagcaagaccaagattgttgttgtccatcatgtttcgaacgtcctgggttcaatgcttcctattgaggaggttgtatcatgtgcaaacaaagttggagctaaagttcttgtagatgcttgtcaaagtgttcctcatatgccagttgatgttcagaagcttggtgcagattttcttgttgcatcctcgcataagatgtgtggccctacaggcgtcggattcttgcatggaaaatttgagatcttgtcatctatggagcctttcttaggtggtggtgaaatgattgcagatgtgttagaagacaaatctacatatgctgagccgccttctagatttgaggctggaactcctgcaattggagaagctataggattgggagttgcgatagattatctgtcacactttggcatgcagaggatccacgagtatgagaaagagttggggtcttacctttatgagagccttctgtccgttccaaatgttcgtatctatggtccggcgccttctcagagtgatcaccgtgctcctttatgttctttcaatgttgagaatgttcatccaacagatattgcagaaattcttgatctccagcatggcatagcgattcggtcagggcatcattgtgcacagattttgcatcgcacccttggcatcaatgcaagcgcccgtgctagtcttcacttctacaacacaaaagaggaggtggatgttttcatccatgggctaaaagctaccattgatttccttacttcccaacactagttcagttcagttagcaaacattagcttcctcgttgtctctcacaagttgaagtgtgatatagaaagcctacctgctcaaactgcccgatatcttcagccttttcgtgtcaatcatgcacggacaagtttatctagtacccttttgctgcggaagttttgagataatttttggttatgtagcttgggcggcggtttatatttcctatatataaaaactgtattataccctgaccgttggttagttcatctgtaatttacgatctgtcaataatttcataacagtgagcacggtgcatacttgtgattttgaggccagcactttgcacattgtaataataagagactgaataaagttttgttttgcgagtccgtctgggaccggactggtctcacggcaagaaatacgtgcctcagtgtgcacgttttatagtgc

SEQ ID NO: 5968 - DNA, 1712 bp, Festuca arundinacea
  misc_feature (95)..(95): n is a, c, g, or t
  misc_feature (127)..(127): n is a, c, g, or t
  misc_feature (143)..(143): n is a, c, g, or t
  misc_feature (155)..(155): n is a, c, g, or t
  misc_feature (247)..(247): n is a, c, g, or t
  misc_feature (486)..(486): n is a, c, g, or t
  misc_feature (492)..(492): n is a, c, g, or t
ggcacgaggcagaagcacaccgcgaagctttggctaatctaacccacagagagagagagagagacggcgcgcatggcgaccgcggcggcggcggnggtggcgtcgctccgatacttcccctcctccntgaggaaccgcgtctnccccggaactancagcggcggcggtgcggtcacgttttctccgcggcggggtcgcggtgcgtcggcggcggccgttgcggcgccgtcgcgggaggctgagccgncctcctcgctcggggacctaacccgcgtagacttccccatcctcgaccaggaattcgatggtaacaaattagtttacttcgacaatggtgcaacatcgcagaaaccctctcatgtaatgaaagccctagatgactattaccgattttataattcgaatgttcatcgtggcattcatgctctcagcgcgaaggctactggtgcgtatgaggctgcaagaataaaggttgcaaatttcgtnaatgcngctgatagtagagagattattttcactcgtaatgctacagaagctatcaatttagtagcctattcatggggcttatctaacttaaagcaaggagacgagattgttcttacagttgcggagcatcatagcgcgattgttccttggcaatttgtttcccagaaaactggtgctgttctaaagtatgttgggctgactaaagaagaggttccagacattgagcagttaaaagggcttctttcaaacaagacaaagattgttgttgtccatcatgtttcaaatgtactgggttcaatgcttcctattgaggagattgtagcatgttcaaaaagagtcggagctaaagttcttgtagatgcttgtcaaagtgtcccccatatgccagttgatgttcagaagcttggtgcagattttcttgttgcatcctcgcataagatgtgtggccctacaggcgtcggattcttgcatggaaaatttgagatcttgtcatctatggagcctttcttaggtggtggtgaaatgattgcagatgtgttccaagacaaatctacatatgcggagccaccttctagatttgaggctggaactcctgccattggagaagctattgcattgggagcagcaatagattatatgtcacactttggcatgcagaggatccatgagtatgagaaagagttgggggcttatctttatgagagccttctttcggttccaaaggttcaggtctatggtccagctccttcccaaagtgaccaccgtgctcctttatgttctttcaatgttgagaatgttcatccaacagatattgcagaaattcttgatctccagcatggcgtggcaattcggtcagggcatcattgcgcacagattttgcatcgaaccctcggtatcactgcaagtgcccgtgccagtcttcacttctacaatacaaaagaggaggtggatgtcttcatccacggacttaaagataccatcgatttccttacttcccaacactagtgcagtccaggcagcaacgtacaggaaacctaatgcctgctcgtactgcctgctgtctatcaggcttttcttgtaaatcaagcacaggaaagattatttaatactttttgcactcttgaagttttgaaataagcattatgtagctcgggcagttcaattcgcattctgaaaccatggaataagcatatatgttcttttttttttgcgaaagcatatatgtt

SEQ ID NO: 5969 - DNA, 1896 bp, Secale cereale
ggaacggaagcacaccgcgaagctttggctaatccaacccacagagacggcgcgcatggcgaccgcggcggcggcggcggtggcgtcgctccggtacttcccctcttccgtcaggaaccgcacctatcccggtactatcggcggcggcggcgctgtggtcacgttttccccgcggcggggccgctgtgcgacggcggccgtggccgcgccttcgcgggaggcggagccggcctcctcgctcggggacctcacccgcgtagacttccccatcctcgaccaggaatttgatggtaacaaattagtttacttcgacaatggcgcaacatcacagaaaccctctcatgtgatgaaagccttagacgactactaccgatattataattcgaatgttcatcgtggcattcatgctctcagcgcaaaggctactgatgcatatgagagtgcgagaaggaaagttgcaaatttcatcaatgcggctgatagtagagagattatttttactcgtaatgctacagaagctatcaatttagtagcttattcatggggcctatctaacttaaaacaaggagatgagattattcttacagttgcggagcatcatagtgcaattgttccttggcaatttgtatcccaaaaactggcgctgtcctaaagtatgttgggctgactaaagaagaggttccagacattgagcagttaaaagggcttctgtcaagcaagacaaagattgttgttgtccatcatgtttcaaacgtcctgggttcaatgcttcctattgaggagatcgtatcatgtgcaaacaaagttggagctaaagttcttgtagatgcttgtcaaagtgttcctcatatgccagttgatgttcagaagcttggtgcagattttcttgttgcatcctcgcataagatgtgtggccctacaggcgtcggattcttgcatggaaaatttgagatcttgtcatctatggagcctttcttaggtggtggtgaaatgattgcagatgtgttcgaagaaaaatctacatatgctgaaccgccttctagatttgaggctggaactcctgcaattggagaagctataggattgggagttgcgatagattatctgtcacactttggcatgcagaggatccacgagtatgagaaagagttggggtcgtacctttatgagagccttctctccgttccaaatgttcgtatctatggtccagcgccttctgcaagtgatcaccgtgctcctttatgttctttcaatgttgagaatgttcatccaacagatattgccgaaattcttgatctccagcatggcgtagcgattcggtcagggcatcattgtgcacagattttgcatcgcacccttggtatcaatgcgagcgcccgtgctagtcttcacttttacaacacaaaagaggaggtggatgtcttcatccatggactaaaagctaccattgatttccttacttcccaacactagtgcagttcagttagcaaccattagcttcctcgttgtctctcacaagtggatgtgcggcatagataacctacctgctgtctttcagccttttcgtgtcaatcatgcacggacaagtttatctagtactcctccgctctggaagtttcgagataagtattgttggctatgcagcttgggtggctccgtttatttcctatatataaataaactgtattatacctggaccgttggtcagttcatctgtaatttacgatctgtcaataacttcataacagcgagtgcatacttgcgattttgaggccatcactttgcacatgtaataataagagactaaataaagtttcgttttactagtctatctggactggacaggcctcacggccaagaaataacaggtcagtgtgcacgatttatagtcgctgt

SEQ ID NO: 5970 - DNA, 1694 bp, Triticum aestivum
ggcgctgtggtcacgttttctccacggcggggccgctgtgcgacggcggccgtggccgcgccttcgcgggaggcggagccggcctcctcgctcggggacctcacccgcgtagacttccccatcctcgaccaggaatttgatggtaacaaattagtttacttcgacaatggtgcaacatcacagaaaccctctcatgtgatgaaagccttagacgactactaccgattttataattcgaatgttcaccgtggcattcatgctctcagcgcaaaggctactgatgcatatgagagtgcaagaaggaaagttgcaaatttcgtcaatgcggctgatagtagagagattatttttactcgtaatgctacagaagctatcaatttagtagcttattcatggggcctatctaacttaaaacaaggagatgagattattcttacagttgcggagcatcatagtgcgattgttccttggcaatttgtatcccaaaaaactggtgctgtcctaaagtatgttgggctgactaaagaagaggttccagacattgagcagttaaaagggcttctgtcaagcaagacaaagattgttgttgtccatcatgtttcaaacgtcctgggttcaatgcttcctattgaggaggtcgtatcatgtgcaaacaaagttggagctaaagttcttgtagatgcttgtcaaagtgttcctcatatgccagttgatgttcagaagcttggtgcagattttcttgttgcatcctcgcataagatgtgtggccctacaggcgtcggattcttgcatggaaaatttgagatcttgtcatctatggagcctttcttaggtggtggtgaaatgattgcagatgtgttcgaagacaaatctacatatgctgagccgccttctagatttgaggctggaactcctgcaattggagaagctataggattgggggttgcgatagattatctgtcacactttggcatgcagaggatccacgagtatgagaaagagttggggtcgtacctttatgagagccttctctccgttccaaatgttcgtatctatggtccggcgccttctgcaagtgatcaccgtgctcctttatgttctttcaatgttgagaatgttcatccaacagatattgccgaaattcttgatctccagcatggcatagcgattcggtcagggcatcattgtgcacagattttgcatcgcacccttggtatcaatgcgagcgcccgtgctagtcttcacttttacaacacaaaagaggaggtggatgccttcatccatgggctaaaagctaccattgatttccttacttcccaccactagtgcagttcagttagcaaacattagcttcctcgttgtctctcactagttgaagtgcgatatagaaggcctacctgctcaaactgtctgatgtctttcagctttttcgtgtaaaccatgcacgggcaagtttatctactcttgcgctctggaagtttcgagataagtattgttggctatgtagcttgggcggctccgtttatttcccatatataaactgtattatacctggaccgttggccataatagtcaatcttgtgatttacgatctgtcaataactccataacagtgagcacggtgcatacttgtgattttgaggcccgcactttacacatgtaataataagagactgaataaagttttgtttact

SEQ ID NO: 5971 - DNA, 1873 bp, Triticum aestivum
cggaaacacaccgcgaagctttggctaatccaacccacagagacggcgcgcatggcgaccgcggcggcggcggcggtggcgtcgctccggtacttcccctcttccgtcaggaaccgcagctatcccggaactatcggcggcggcgctgtggtcacgttttctccgcggcggggccgctgtgcgacggcggccgtggccgcgccttcgcgggaggcggagccggcctcctcgctcggggacctcacccgcgtagacttccccatcctcgaccaggaatttgatggtaataaattagtttacttcgacaatggtgcaacatcacagaaaccctctcatgtgatgaaagccttagacgactactaccgattttataattcgaatgttcatcgtggcattcatgctctcagcgcaaaggctactgatgcatatgagagtgcaagaaggaaagttgcaaatttcatcaatgcggctgatagtagagagattatttttactcgtaatgctacagaagctatcaatttagtagcttattcatggggcctatctaacttaaaacaaggagatgagattattcttacagttgcggagcatcatagtgcgattgttccttggcaatttgtatcccaaaaaactggtgctgtcctaaagtatgttgggctgactaaagaagaggttccagacattgagcagttaaaagggcttctgtcaagcaagacaaagattgttgttgtccatcatgtttcaaacgtcctgggttcaatgcttcctattgaggaggtcgtatcatgtgcaaacaaagttggagctaaagttcttgtagatgcttgtcaaagtgttcctcatatgccagttgatgttcagaagcttggtgcagattttcttgttgcatcctcgcataagatgtgtggccctacaggcgtcggattcttgcatggaaaatttgagatcttgtcatctatggagcctttcttaggtggtggtgaaatgattgcagatgtgttcgaagacaaatctacatatgctgagccgccttctagatttgaggctggaactcctgcaattggagaggctataggattgggggttgcgatagattatctgtcacactttggcatgcagaggatccacgagtatgagaaagagttggggtcgtacctttatgagagccttctctccgttccaaatgttcgtatctatggtccggcgccttctgcaagtgatcaccgtgctcctttatgttctttcaatgttgagaatgttcatccaacagatattgccgaaattcttgatctccagcatggcatagcgattcggtcagggcatcattgtgcacagattttgcatcgcacccttggtatcaatgcgagcgcccgtgccagtcttcacttttacaacacaaaagaggaggtggatgccttcatccatgggctaaaagctaccattgatttccttacttcccaccactagtgcagttcagttagcaaacattagcttcctcgttgtctctcactagttgaagtgcgatatagaaggcctacctgctcaaactgtctgatgtctttcagctttttcgtgtaaaccatgcacgggcaagtttatctactccagtactcttgcgctctggaagtttcgagataagtattgtcggctatgtagcttgggcggctccgtttatttcccatatataaactgtattatacctggaccgttggccagttcatctgtaatttacgatctgtcaataactccataacagtgagcacggtgcatacttgtgattttgaggcctgcactttacacatgtaataataagagactgaataaagttctgtttactaatcggtttgggaccttgtcgtttgatattttgcag

SEQ ID NO: 5972 - DNA, 2050 bp, Oryza sativa
aaaacacaccctttattcgatcatccgaaatccctaatcctttcgtccactctgcttgcgcgactctccttccgtagtccgtaccctcctcccccctgcctcgccggcggcgaccgcacgtgccccccttctcgccgtcgcgcacccaccccctcgccgcctgcctctcgccctctcctcgcgtgcgcgccaccaccaccggggaggcagccggcgaccgccgaccgaccggaaaggaacgggactccgtccgacggcgcgcatggtgtccgccgcggcggcggcgtcgtcgctccgctgcttccctccctccctcgggaaccgtggccccggggccgcgaccgcgcggggtggcctcgtcaggctctcctcgcggcgggcccggtccacggccggcgtggcggcgccgtcgcgggaggcggagtcggccgcctcgctgggcgacctcacccgcgtcgacttccctatccttgaccaggaatttgatggttccaaattagtttacttcgacaatggtgcaacttcgcagaaaccttcttgtgtaatgaaaactttggatgagtattaccggttttacaattcgaatgttcaccgtggaattcatgttctcagtgcaaaggctaccgatgcatatgagagtgcaagaacaaaagttgcaaattttgtcaatgcagctaatagtagagagattgtttttacacgtaatgctactgaagctatcaatttagtagcatattcgtggggcatgtccaacttaaaacaaggagatgagattgttcttacgattgcagagcatcatagcgctattgttccttggcaatttgtttcccagaagactggtgctactttaaagtatgttgggctaaccaaagaaggggttccagacattgagcagttgaaaggtcttctgtcaaacaagacgaagattgttgttgttcatcatgtctcaaatgtactcggttcaatgcttcctattgaggatattgtaacatggtcaaacagaattggtgctaaagttcttgtcgatgcttgtcaaagtgttcctcatatgcctgtcgatgttcagaggcttggtgcagattttcttgttgcatcatcacacaagatgtgtggccctacaggcgttggattcttgcatggaaagtttgacctcttatcatccatggagcctttcttaggtggtggtgaaatgattgcagatgtgttccaagacaaatccacatatgctgagcctccttctagatttgaagctggaacacctgcgattggagaagctataggattgggaacagcaattgattatttgtcacaaattggcatgcagaagatccatgagtatgagaatgagttggcgacctatctctatgagagccttattgctgttccaaatgttcggatctacggtccagctccatgccaaactgttcaccgcgccccattatgttcttttaatgttgaaaatgttcatccaacagatattgccgaaattcttgacctccagcatggcgtggcaattcggtcaggccatcattgtgcacagatattgcatcgaactcttggtatcaatgcaagtgctcgtgctagtcttcacttctacaataccaaagaggaggtggatgtctttgtcgatgcgctgaaagatactattgatttccttacttctgaacactagtaccacggttcgattagtatacggcattctccctttttacaagtttcaggttgactttatctagccaaggggtcatacaattacaaaatgaaacaaccaaccaaaacatgtgtattagattgcctactttggcctttcttgtaaatcaagtccctttttctcccatccctgaaattttgcagaagctgaatttgtacaacagaataatttaagtgttgcagcaagctgtgagaaagctcatgaccttgaaggtttatttgtaaattatgctgacctgtatgttctcttcgttgaaaatcataaacaaggttacacaagcataaacaagtttttttttaacacgtgatgccttctgtttcctgttggaattttttgaac

SEQ ID NO: 5973 - DNA, 1859 bp, Brachypodium distachyon
agaagcccaccgctcccggaagcatattttcttggccaatccaaacccaagacggcgcgcatggcgaccaccgcggcggcggcggcggcagcggcagcgtcgctgagatgcttcccctcctcctcctcctccgccctcaggaaccgcggccctatcagcaatcgcggcgttggcgtggtcgcgttttctccgcggcgctgcgcgtcatcggtggcggccgtggcggcgccgtcgcgggaggcagagccggcttcctcgctcggggacctcgcccgcgtcgacttccccatcctcgaccaggaatttgatggtaacaaattagtttacttcgacaatggtgcaacatcacagaaaccctctcacgtaatgaaagccttggacgactactaccgattttataattcaaatgttcaccgtggcattcatgctctgagtgcgaaggctactgctgcgtatgagaatgcaagaataaaagttgcaaatttcgtcaatgcggctgatagtagagaaattattttcactcgtaatgctacagaagctatcaatttagtagcctattcatggggcctatcaaacctgaaacaaggagatgagattgttcttacagttgcggagcatcatagtgctatcgttccttggcaatttgtttcccagaagactggtgctgtcttaaagtatgttgggctgactaaagaagaggttccagacattgagcagttaaaagggcttatctcaagcaaaacgaagattgtggttgtccatcatgtttcaaatgtactcggttcaatgcttcctattgaggaaattgtaacatgttcaaacagagttggagctaaagttcttgtagatgcttgtcaaagtgttccccatatgccagttgatgttcagaagcttggtgcagattttcttgttggatcttcgcacaagatgtgtggccctacaggcgtcggattcttgcatggaaaatatgaaatcttgtcatctatggagcctttcttaggtggtggtgaaatgattgcagatgtgttccaagacaaatctacatatgctgagccgccttctagatttgaggctggaactcctgcaattggcgaagctataggattgggagcagcaatagattatttgtcacagtttggcatgcagaggatccatgagtacgagaaagagctggggacatatctttatgagagccttctttctgttcccaatgttcggatctatggtccgtctccttctcaaagctgtcaccgtgctcctttatgttctttcaatgttgagaacgtccatccaacagatatcgcagaaattcttgatctccagcacggcatagcgattcggtcagggcaccattgtgctcagattttgcatcgcacactcgggatcaacgccagtgcccgtgctagcctccacttttacaataccaaagaggaggtggatgtgttcatcaacggactaaaagataccatcgagttccttacttcccaacactagtacagctcagttagagcaaccttctgcttcctccttttaactgaactgtggtatagaaacctaagcctgctgtctttcaggcttttcttgtaaatcattgcacagtccagtttatttaatactcttccacttgtggagtttcgaaataagcatgattggtcatgccagctctggcagctcaagtaattttctacataaactttgttatacatacatgtatatgtttattacttattagcactttgcacatgtatgagataaaatgaagttctgtaggttagtagctctcgtattgtgcactgcagctgttatttttgcttttcaacaaagatgggaaaatctaatggcaaggtcaattgtcttga

SEQ ID NO: 5974 - DNA, 1803 bp, Brachypodium distachyon
acggcgcgcatggcgaccaccgcggcggcggcggcggcagcggcagcgtcgctgagatgcttcccctcctcctcctcctccgccctcaggaaccgcggccctatcagcaatcgcggcgttggcgtggtcgcgttttctccgcggcgctgcgcgtcatcggtggcggccgtggcggcgccgtcgcgggaggcagagccggcttcctcgctcggggacctcgcccgcgtcgacttccccatcctcgaccaggaatttgatggtaacaaattagtttacttcgacaatggtgcaacatcacagaaaccctctcacgtaatgaaagccttggacgactactaccgattttataattcaaatgttcaccgtggcattcatgctctgagtgcgaaggctactgctgcgtatgagaatgcaagaataaaagttgcaaatttcgtcaatgcggctgatagtagagaaattattttcactcgtaatgctacagaagctatcaatttagtagcctattcatggggcctatcaaacctgaaacaaggagatgagattgttcttacagttgcggagcatcatagtgctatcgttccttggcaatttgtttcccagaagactggtgctgtcttaaagtatgttgggctgactaaagaagaggttccagacattgagcagttaaaagggcttatctcaagcaaaacgaagattgtggttgtccatcatgtttcaaatgtactcggttcaatgcttcctattgaggaaattgtaacatgttcaaacagagttggagctaaagttcttgtagatgcttgtcaaagtgttccccatatgccagttgatgttcagaagcttggtgcagattttcttgttggatcttcgcacaagatgtgtggccctacaggcgtcggattcttgcatggaaaatatgaaatcttgtcatctatggagcctttcttaggtggtggtgaaatgattgcagatgtgttccaagacaaatctacatatgctgagccgccttctagatttgaggctggaactcctgcaattggcgaagctataggattgggagcagcaatagattatttgtcacagtttggcatgcagaggatccatgagtacgagaaagagctggggacatatctttatgagagccttctttctgttcccaatgttcggatctatggtccgtctccttctcaaagctgtcaccgtgctcctttatgttctttcaatgttgagaacgtccatccaacagatatcgcagaaattcttgatctccagcacggcatagcgattcggtcagggcaccattgtgctcagattttgcatcgcacactcgggatcaacgccagtgcccgtgctagcctccacttttacaataccaaagaggaggtggatgtgttcatcaacggactaaaagataccatcgagttccttacttcccaacactagtacagctcagttagagcaaccttctgcttcctccttttaactgaactgtggtatagaaacctaagcctgctgtctttcaggcttttcttgtaaatcattgcacagtccagtttatttaatactcttccacttgtggagtttcgaaataagcatgattggtcatgccagctctggcagctcaagtaattttctacataaactttgttatacatacatgtatatgtttattacttattagcactttgcacatgtatgagataaaatgaagttctgtaggttagtagctctcgtattgtgcactgcagctgttatttttgcttttcaacaaagatgggaaaatctaatggcaaggtcaattgt

SEQ ID NO: 5975 - DNA, 2552 bp, Glycine max
ggaaaagaaaaaataaaacagagcaacacaccaaccgcatagagagggaaacaccgaaaaaactaactgaacctctctcagtcaaaatatgcgattgcggtggcgtcggcggtggcccgggttgttgagtccccgatcgacggccaatgcagcggctcgttgcggcggcgtgtggcgtcgttgatggccctgcagatgacttggcagccgagtctcctgagtcagaaacgcaaaaccggaaccggtcctccgttagggctccgtaacctaggcaactcgtgctacctcaacagcgtcctccagtgcctcacctacactcctcctctcgccaatttctgcctccgtctccaacactcttctctctgtgattcttctgcgtcttcgtgtccgttctgcatactggagaagcagattgcgcgttctcttcgattggatctcacgtacgacgcgccgtctaagatccagagctgcatccggatcttcgcggagaacttccgctgcggccgccaggaggacgcgcacgagttcctccgctacgtcatcgacgcctgccacaacacctgcctccgcctcaagaagctccgccgcaaaggcgccgaggctaatggcggcggtggcggtgacactggcggcggtacggtggtgaaggaaattttcggtggcgccttgcagagccaggtgaagtgtctgtgttgtggatatgagtcgaataaggttgacgagataatggatattagtcttgatgttttccatagtaactcgcttaaagactccatgcaaaagttctttcagcctgaggttttagatggcaacaataagtacaagtgtgatagttgtaagaaattggtggcagctaagaagcagatgtccatacttcaagcacctaacatccttgtgatacaactaaagagatttgagggtatattgggtggcaagattgacaaggctgttgcatttgaagaggttttggtgctttctagcttcatgtgtaaagcaagccaggatccccaaccggaatataagctctttggcactattgtgcattccggctactcccccgaatctggtcactactacgcttatataaaggatgcaatgggtcggtggtattgctgtgatgattcttgtgtaactgttgcaaccctgcaggaagttttgtcagaaaaggtttacattctttttttctctcgaactaaccaaaggccagtggcaagttgtaattctcttgcttcaaatggtgtaaagcctcattccaatgggagccaaacatctgaatgcccaaaggttggtgtaccaccaaaagcagtgcatgtgaaatcaaattctgagctatctccttgtaaggatatgccaagtgtatctaagactgctaaagcaccttccagctcaagagtgaagtttgacattaatggaagttcttctaaaagaaatcctgctcccgtgagtgtgaatgggaaagttgatgtttctaggaatcagccttcagtaataaatgggcatgtgaaagattcagtttctttggagaatggtaagaaagattcttcactacccaccagcaatggcattgacaaaaataaagttgctgttgacaaattgaaaagaaaggagtcaacagttacaaatggacacactggtaatcagacagttgatattcattctgtaaagtcagatctcaaggaagatactgatagaagcagggtaatagcaggtagagtgcctgacaattttaagcatgaaagcaatgacctcaacaacaaacctacaatattggggaataagagaaagctacaggaggacccatgcattttacttgcacatgatggtcagtctcaagcaagagttcaagaactgaaggacattcttgggaaagaggcaaagtcagttttgaggtcatgtggctggacagataaggtctatgaatttatgcgttcaaagaagttacatgcacaggaggctggaaatttgacaaatggagatgaaataaggaagttgttaataggagatgcacagggagctttcatatccaagattcccgagtcattgaaacaggatatgattgaacgactccgatcatttagccaagaaaaaaaatacaattttcaggaccttgatccgagaatgaatgttgatctgtcgtgctagcgaggggtggtgtgaattctgtattactaatatatggatttttgtagtgatggtggcacccttgctgggatgctcagtttgggtttgttacatactaactctttgagctagtgctggcaatagtagcaggagaaggtggagaattgttatcattgaagcatggctttgttgcgcttctaggtgcttcatgcatatttgagatagaagttcagatttcatatctggccataagttttctttcttcatggaggctataaagttctaattgaatcttgaggagagcatgccaggaatctattcattctgtacaatctatattttagttatgtactggagcaaaatcttaattttctataaaattgctcaacaaattttgcagcgaagatgaggccgtgcatcctattaacagt

SEQ ID NO: 5976 - DNA, 2649 bp, Cajanus cajan
actatttttcccctctcagcgggtaactaagaagttagaaggcgctagaaaaaaataaaagagagagagagagagcaagaagcgaagaagagagggaaagaaaagctgagccgaggcgcgagcgagcgagcgagacatgcgattgcggtggcggcgccgatcgacggccaatgcagcgggtcgttgcggcggtggtctcgggcggcgttgatggccctgcagatgacttggcagccgagtctcctgagtcagaagcgcaaaaccggtcctcccttagggctccgtaacctaggcaactcgtgctacctcaacagcgtcctccagtgcctcacctacactcctcctctcgccaatttctgcctccgcctccaccactcctctctctgtgactcttccgcgtcttcctgtccgttctgcatactcgagaagcagattgcgcgttctctgcgcttggatctcccgcacgacgcgccgtccaagatccaggcctctctgcggatcttcggcccgcacttccgctgcggccgccaggaggacgcgcacgagttcctccgctacgtcatcgacgcctgccacaacacctgcctccgcatcaagaagctccaccgcaaaggcggcggcggaggcggtggaggaggaggtggaggaagaggagatgttaacgctggcggcggcggcggcggcagcaccgtggtgaaggagattttcggcggcgccttgcagagccaggtgaagtgtctgtgttgtggatacgagtcgaataaggttgatgagataatggatattagtcttgatgttttccatagtaactcgcttagagactccatgcaaaagttctttcagcctgaggttttagatggcaacaataagtacaagtgtgatagttgtaagaaattggtggcggcgaagaagcagatgtctatacttcaagcgcctaacatccttgtgatacaactgaagagatttgagggcatattgggtggcaagattgacaaggctgttgcatttgaagaggttttggtgctttctagcttcatgtgcaaagcaagccaggatccccaaccagaatataagctctttggcactattgtgcattcaggctactcccccgaatctggtcactactatgcttatataaaggatgcaatgggtcggtggtattgctgtgatgattcttgtgtaacagttgcaaccctgcaagaagttttgtcagaaaaggtttacattctttttttctctcgaactaaccaaaggccagtgtcaagtagtaatgctcttgcttcaaacggtgtaaagcctcattccaatgggagccaagcatctgaatgcccaaaggttggtgtaccactgaaagcagagcatgaaaaatcaaattctgagctatctccttggaaggacatgccaagtgtgtctaagacaactaaagcaccgtccagtccacgagtgaagtttgacattaatggaagttctacttccaaaagaaatcctgctcctgtaagtgtcaatgggaaagttgatgtttctaggagtcaacctttagtaataaatgggcatgtgaaagattcggtttctttggagaatggtaagaaagatccttcatcattactcactaggaatggcattgacaaattgaaaagaaaggagccagcatttacaaatggacacactgataatcagactgttgatattcattctgtaaagtcagatcccagggaaaatactgatagaagcagggtagtagcaagtagagggcctgacaactttaagcaagaaagcaatggcctcaatagcaatcctaaaatactggggaataagagaaaggtacaggaggccccatgcattttgcttgcacatgatagtgagtctcaagcaagagttcaagaattgaaggacatccttggaaaagaggcaaagtcagttttgaagtcatgtggctggacagatatggtctgtgaaagaatgcgttctagaaagaagaagttacgtgaacaagaagctggaaattttacaaatgcagatgaaacaaggaagttgttaataggagatgcgcagggagctttgacatcacagattcctgagtcattgagaaaggatttgattgagcgactccgatcgtttagccaagaaaaagtacatttttaaggaccttgatcagagcatgcatgttgatctgtcttgctaattattgaggcgtggtgtgtatactctgtattactaattattttagtgatggtggtacccttactggcatgtcagttcgggtttgttacatactaactctttgagctagtgctggcgatagtagcaggagaatgtggagacttgttatcattgaagcatggcttggttatgcttctaggtgcttcatgcatatttgagctagaagttcagatttcatgtcttgccctaggtttagtttctccgtggaggttacgaagttctattcaatcttgaggagagcttgtcaggaattctattcattctgtacaatctattttagtcatgtattggagcaaattcttcatttctataaaattgctcaacaaattttgcagcgaggatgaggctgtgcatgacttgtggatatatgatgctatcaacaatgactgtactttccggtatttaaaaaaaaaaatcatttgctactaa

SEQ ID NO: 5977 - DNA, 2605 bp, Phaseolus coccineus
cttttccgcaatattatttccttctcgctcggtaccaaagaagtcgctagaagaattaaagaaaaaagagaaataaaacagctaacaaccgaagagagggaaacgaaaactgaaccgaaccccgcgaagagagagagatatgcgattgcggtggcggcggcggtggtcagggttgttgagtccccaatcgacggccaatgcagcggttcgttgtgacggcggacggcggcgttgatggccctgcagatgacttggcagccgagtctcctgagtcagaaacgcaaaaccggtcctcctatagggcttcgtaacctaggcaactcgtgctacctcaacagcgtcctccagtgccttacctacactcctcccctcgccaatttctgcctcactctccaacactcttctctctgtgatttctctgcgtcctcgtgtccgttctgtatactggagaagcagattgcgcgttcactgaaattggatctctcgcacgacgcgccttctaagatccagagctgtatccggatcttcgcggagcacttccgttgtggccgccaggaggacgcgcacgagttcctccgctacgtaatcgacgcctgccacaatacctgcctccgcctcaagaagctccgccgcaaaggcggagacgctaatggcggcggcggtggagacggtggcgggagtacggttgtgaaggagattttcggtggcgccttgcagagccaggtgaagtgtctgtgctgtggatacgagtcgaataaggttgatgagataatggatattagtcttgatgttttccatagtaactctcttaaagactccatgcaaaagttctttcagcctgaggttttagatggcaacaataagtacaagtgtgatagttgtaagaaattggtggcggctaagaagcaaatgtccgtacttcaagcacccaacatccttgtgatacaactaaagagatttgagggcatattgggtggcaagattgacaaggctgttgcatttgaagaggttttggtcctttctagcttcatgtgcaaagcaagccaggatccacagccagaatataagctctttggcactattgtgcattcaggctactcccccgaatctggtcactactatgcttatataaaggatgcaatgggtcggtggtattgctgtgatgattctagtgtaacagttgcaaccctgcaagaagttttgtcagaaaaggtttacattctttttttctctcgaactaatcaaaggccagtgtcaaatagtatttctcttgcttcaaacggtgtaaaacctcattccaatgggaaccaagcatctgaattcccaaaggttggtgtaccactgaaagctgtgtatgcaaagtcaagttttgagctatctccatggaaggatatgccaagtgtagctaagaatgctaaagtaccttccagctcacgagtgaagtttgacattaatggaagttctacttccaaaagaagtcctgctcctgtaaatgtgaatgggaaagttgatgtttctaggaatcagcctttattaataaatggacatgttaaagattcagtttttttggaaaatggtaagaaagatccttcaccattacccaccaggaatggtattgacaaaaataaagttgatattgacaaattcaaaagaaaggagtcatcacttacaaatggtcacggtgataatcagatggttgatattcattctgtaaaatcggatcccagggaagatactgataaaaacagggtaatagcagggaaaggttctgacaactttaagctaggaaaaaatggcctcagcaataaacccaaaatattggggaataagagaaaggtacatgaggacccatgcattttacttgcacatgatggtcagtctcaagcaagagttcaagaactgaaggacaatcttgggaaagaggtgaagtcatatttgatatcatgcggctggacaaatgtggtctatgaatttatgcgttctataaagaagttacgtgtacaagatggaaatttagagaatggagatgaaacaaggaagtcgttaattagagatgcgcaggtagctttcaaatcaaagattcctgagtcattgcgaaaggatatgattgaacgaatccaatcctttatccaagaaaacaatacagttttaaggaccttgatctgagcatgcgtacgagcatgttgatcttgtcttgatagtgaggcgtgttgtgtacacactgtattactaattattgtagtgatggtggtacccttactgggatactagtttgggtttgtgacatactaactctttgagctagttctggcgataggagcaggagaatatggagacttgttatcaccgaagcttggctttgttatgcttctagttctttcatgcatatttgagctagaagttcagatttcatgtcttgccataagttttctttctctatataggctgtgaagttgtattgaatcttgaggagagcataccaggaattatattcattatgtacaatctatttttgtcatgtgtactggagcagaatcttaattttctataaaattgctcaacaaattttgcaccgaaaatttggctgtgcatgactagtgataca

SEQ ID NO: 5978 - DNA, 2042 bp, Hordeum vulgare
cggggcagccctatgactccaagctttagtggtaggccatctggttttcattcagcagggaattttactgcaggaaccgaacttgttcagccatacaaaatgtacgggcaacttggggttcccatgcagccacccattcccgatccaaacttttttcagttctttcagcatccctcttttccacagtatgccagtggaaatcaatacaatacattggctccaaggggtagtgtttttggaaatgttactgataattttgatccacacaagttatttcctcaagctcaatatccgtctgatcagaggcttcaacttccaaaaactggaatttctaattctcctacaacgctaagaggaggaactgttccaaattatcatggcatatcaccctatgttggagcgccgttgacttatccgacaagcccagtgtttcaggggcaacctttctctggaatttccccctctggccgaaatgatcctgcaaggtttcagccagcctcgagaaatatgactgctgtttctgggtttcaagggcagcgagaaagggagaaatttgatagcccgaaggcatgcactttcctggaagaacttaagtccaacagagcacgtagggttgagctatctgatatcacaggtcgtatagtagatttcagcgctgaccaacatggtagccgtttcatccagcagaagttggaaaactgcactgccgaagagaaggcggccgtgtttgcagaagttcttcctcatgcttcatctttaatgactgatgtgtttgggaattatgtgatccaaaagttttttgaacatggaactcctgagcaaagaagggatcttgctgccaagcttgctggtcatgttgtacctttgagccttcagatgtatggatgccgagtaattcaaaaggctcttgaagttatggaacttgaccagaaaatagatctggtccgcgagcttgatggaaatattatgcgatgtgttcgtgaccaaaatgggaatcatgttatacagaagtgcatagaatgtgttcccacggaacatattggtttcgtagtatctgcttttcggggacaagttgctagcctttcaatgcatccatatggttgccgtgttattcagagagttctggagcattgtggtggtgattcacgaggtcagtgcataatagatgaaatattgcagtccgcttgcatcctcgcacaagaccagtatggcaactatgtcacacagcatgttgtggaaaaaggaaaaagtcatgaaagggctcaaataatcagtaaattggctgggcaggttgtcaccatgagccaaaataaatttgcatcaaatgtgatagagaagtgttttcaacatggagatattgcagaacgagatcttctaatcagagagattgtggagcagactgacggaaacgataccttgctggcaatgatgaaggatcagtacgctaattatgttgttcagaagatacttgaaacatgcaacgatgagcagcgggaacttctggtcagccgtgtaaagggtcacttgcaagcactgaggaagtacacctatggcaaacatatcgcgagccgggtcgagcagctttgcggtgaaggagatgccgagtgcgactcctaggggacgggaggtgcctcaacgctcgcccgattcatcgtcaaggaagaaatcaacgcccgcccaattcataggcaacgaagaaatcataacttggaaccgtggtgcttcaaagtgctaacaaaacttggaactccagcaaggaagattgtacatatgtgactgtaggcagtgtaggaggtgctaggcacaaggtttcttctgtgcgcatcagtgtatctatgttagggtgtgcttgtccacactgtactactgtagttggtagccgtgtgcaaaatatgtatagtagtagtggtttggcttgtgtgtgtgatacatatatgtttttcgaaaaggattgactgcttggtaatgtaattgcttgcttgcttgcttaaatctccagttatgtaataaaacatcgtccattcattggattgactgaagag

SEQ ID NO: 5979 - DNA, 3576 bp, Secale cereale
cgcaaaagagaaagaggggaagaccgatagaggagaaggaaggcttccagaaggagaagatcggcggagacgagagggagaagggggggactcgagctggttcttctccggggagcgagggagagggaagcgaggcctggccagctgccgcggcttggggccgaggcgggagaggggaaggaggaggccgggttggtgctggcgctggtgctcgcctagggtttggaaccttcggctgcctcggaggcgtcaagtgtaatggccacacagagtgctgttcggttaattggagggggaggggctggtggctggactaaggatttcggagcatttgactctccacttggaaatcttccaggagaaggcctggggtttgtggagaatggcagtgggatttatgggggctggggggaatctgtcccaaatcgaagtggaagtgcacctcctagcatggagggatctctggctgctcttggtaatcttataggtcagcggagtggaaacttcgacgccagtttaggtaacttggacaatgtgactggcagttccacggctgaggagcagttacgtgctgatcctgcatactttgactattatggttccaaggtgaatttgaacccaaggcttcctcctccactaatctcaagggagagtcgccgcttcatgaaccgagttggcaaggttaaagaatggagagtggtttcccaagatgacagcaataaaggctccttatttatagctcgatctactctatcaactcacaaggaagaacctgaagatgataagtctccaaggttggattcaagttctgcagatgatgaacagatgaatcttgtggattttgtgccggagagctttcagcagaaccccgattcgttgtatagctcttcgcatctatcaagtagcagtattggtgatggtgtagctgtccatcctaatattgactcatcaaggaatttgtcacatgatgttgtcaagccgtcagggttgaattcgtggacacctgtacctttggccagtgtactgagaagtacacttagcaacaatcttgcatctacatctgttcccagttcatcatgttctgataataaccctagcgtacaaatttctgagcaacagcaagaaaagcagagcatagacatgaagcctggaaatgacgtgcctgtcagtggggcagttgttactgaacttgatgttgtggactcaagcatgaagaatttgaagttaagtttggatagccagactacaccacaagttaagcagcagtggcagggcaatttcttgcagcagtatggcttctcacctctagtccagggcgagcatatgccaatgactcctcatagagcacatctgccccatgttccttttgttgacaatgtgtctcatactcagctaaaactacccactggtgacatgcagcaacttttacctcaacttggcatgccaacacccttttatgcaccgaattcctttggaagcccatattatcagaatttgcatccagccagtgtattggcaaatccttatgtgactgctgggtatgctttgggtggttcaggtttcccacccgttatgactagctattctccccagagttctgctgcgacacctcttgacagccctatgactccaagctttagtggtaggccatctggttttccttcagcagggaatcttactgcaggaaccgagtttgtccagccatataaaatgtatgggcaacttggggttcccatgcagccacccattcccgacccgaacttttttcagttctttcagcatccctcttttccacagtatgctagtggaaatcaatacagtacattggctccaaggggaagtgtttttggaaatgttgccgataattttgatccacgcaagttatttcctcaagctcaatatccgtctgatcagaggcttcagcttcccaaaactggaatttctaattctcctacaaccctaagaggaggaactgttccaaattatcatggcatttcaccctatgttggagcgccattgacttatccaacaagcccagtgtttcaggggcaacctttctctggaatgtccccctctggtagaaatgattccgcgaggtttcagtccgcctcaagaagtatgactgctgtttctgggtttcaaggacagcgagaaagggagaaatttgataacccgaaggcatgcactttcctggaagaactgaagtccaacagagcacgtagggttgagctatctgatatcacaggtcgcatagtagatttcagcgctgaccaacatggtagccgtttcatccagcagaaattggaaaactgcactgctgaagagaaggcagctgtgtttgcagaagttcttcctcatgcttcatctttaatgactgatgtgttcgggaattatgtgatccaaaagttttttgacatggaactcctgagcaaagaagggatcttgccgccaagcttgctggtcatgttgtacctttgagccttcagatgtatggatgccgagtaattcaaaaaggctctggaagttatggaacttgaccggaaaatagatctggtccgcgagcttgatggaaatattatgcgatgtgttcgtgaccaaaatgggaatcatgttatacagaagtgcatagagtgtgtccccacggaacatattggttttgtggtatctgcttttcggggacaagttgctagcctttcaatgcatccatatggttgccgtgttattcagagagttttggagcattgtggtggtgattcacgaggtcagtgcataatagatgaaatattgcagtccgcttgcatcctcgcacaagaccagtatggcaactatgtcacacagcatgttgtggaaaaaggaaaaagtcatgaaagggctcaaattatcagtaagttggctgggcaggttgtcaccatgagccaaaataaatttgcatcaaatgtgatagagaagtgtttccaacatggagatattgcggaacgggatcttctaatcagagagattgtggaacagactgacggaaatgataccttgctggtaatgatgaaggatcagtatgctaattatgttgttcagaagatacttgaaacatgcaacgatgagcagcgggaactactggtcagccgtgtaaagggtcacttgcaagcactgaggaagtacacctatggcaagcatatcgcgagccgagtcgagcagctttgcggtgaaggagatgtcgagtgcgactcctaggccacgggagcgcctcaacacccgccaaattcatcagcaagaaagaaaccataacttggaaccgcggtacttcaaagtgctaacagaacttggaactccagcaagaaagattgtacatatgtgactttgtttaggcagtgtagggaggtgctaggcacaaggtttattctgtgcgcgccagtgtatctatgttagggtgtgcttatccacactgtactagttggtgtccgtgtgcaaaatatgtatagtggctgtggtttggcttgtatgtgtgatacacgtgtgtatgtcgactgcttggtaatgtaattgcttgcttgtttaaaatctccagttgtgtggtaaaac

SEQ ID NO: 5980 - DNA, 4025 bp, Oryza sativa
gagcgtagcactcgcactgcacgccaccacaccaccgcagctcacctctcaagtctcaagtctcaagtcgactcgactcgagcggcgccgccacccctcgcctctgctcttctcctcttctcttttcctcctctttcgcttttgcttctccaaacccttgcctctctctctctctctctctctctttctctctctctctctctcctcctcctcctccgccggagaccacgggcctcaccctgctgctccgagctccccctccggcggcggcgaacatccacggtctggctctaggctgctgctcctcctggggtggggtggggtgtggcctcgtcggccggcgagcaggttcggaggagatagccaggaggcggccgggtggaatcgggctgaagtgtgatggctacagagagcgctgtccggttaattggaggaacggggtctggtaactggagcaaggacttcggtgcatttgactcatcactgggtagtctttcaggagaaggtctggggtttgtggacaataacagtggcgtttatgggggctggagggagtctgtcccaaatcgcagtggaagtgcgccgcctagcatggaagggtctcttgctgctcttggtcatatgataggtcagcagagtgggaacttggaagccactttaggggggaagctgggaaacgtagcggacagttccaaatctgaggagcagctacgtgctgatccggcatactgtgactattatggctccaaggtcaatttgaacccaaggcttccgccaccacttatgtctagggagagcagacgcttcatgaaccgggttggcaaagttaaagaatggagagtggtttctcaagatgacagcaacaaaggttccttgtttattcctcgatctactctgtcaacacacagagaagagcctgaggacgataggtcaccaaggttggattcaagttcagcagaggatgcccaaggttctggtaaaagtggatccaactttgatagccattatacttgtatgaatcttggagattttgcatcggagagttttcagcagaaagccgcttctttgtatgacagttctactcatccatcaaatagcaatactggtgatggtatatctgaccattctgacattaactcatcaacgaatttttcaattgatgctgtcaagacatctgggttgaattcatggacacctgttcctgtgactaacacagtgagaagtacacatagcaacagtatttcatctacatctgttcccagttcatcaagtcctgataacaaccccagtatgcaaacttctcagcaagagaagcctagcatagacatcaagcatgggaatgatgtgcctggcagcggttctattctgactgaactagatactgtgaactccaatatgaagaatctgaggataagtttggatagccatgataccatacatgttaagcagcagtggccggacaatgtcttgcagcagtttggcccctcacctttagtccagggtgatcctattcaaatgattcctcaaggaacacatcttccccatgttccttttgttgagaacttgtcgcatactcaattaaaattaccaactggtgacatgcagcaatttttaccaccgcctggtatgacaacacctttttatgcaccaaattcttttggaagcccttactatcaaaatttgcatccggctagtgtattgccaacaccatttggaactgctggatatgctttgagtggttcagctttaccacctgttatgactagctatgctccccaggtttctgttgctacacctgttgacagccctattactccaagctttagtggtagaccatctggttttccttcaccagggaatcttagtgcaggagcagaatttgttcagccatataaaatgtatggacaacaacttggggttaccatgcagccatccgttcctgacccaaacttctttcagttctttcagcatccttctttactttcatatgctggtataaatcaatacaatacaatgggaccaagggttagtgttgttgggaatcctgctgatagttttgatccccaaaaggtattatcccagcctgcgtatccatctgatcagaggcttcaacttccaagaactggaatttataactctcctgcagccagaagaggaggggccgctccaaattatcaaggcatgacaccatatgttggagcaccaatgacttacccaacaagcccagtgtttcagggacagactttcactggagtattttctcctggtaggagaaatgattctgtgagattccaaactccctcaagaaatatgaccgcttattctggtgttcaagggcagcgagaaagggagaaattcgatgacccaaaggcatgttccttcctggaagaactcaagtctaacagggctcgcagggttgaactatctgatattgcaggccatatagtagaatacagcgctgaccaacatggcagccgattcatccaacagaagttagagaactgcactgctgaagagaaggcatctgtgttttcagaagttctccctcatgcttcatcattaatgactgatgtgtttgggaattatgtgatccaaaagttcttcgaacatggaactcctgaacaaaggagggatcttgccactaagcttgttggtcatgttttacctttgagccttcaaatgtatggatgccgagtaattcaaaaggctcttgaagttatggaacttgaccaaaaaatagaactagttcgtgagcttgatggaaacattatgcgatgtgtccgtgatcaaaatgggaaccatgttatacagaagtgcattgaatgtgttcctacagaacatattggctttgtagtatctgcttttcgggggcaggtggccagcctttcaatgcacccatatggttgccgtgttattcagagagttttggagcactgcggtggtgattcacaaggccagtgcataatagatgagatactggagtcggcttgcgtcctcgcacaagatcagtatggcaactatgttacacagcatgttttggaaagaggaaggggacatgaaaggacccaaattatcagtaaattggctgggcaggttgttaccatgagtcaaaacaaattcgcatcaaatgtgatagagaagtgctttcaacatggggatatgacagagcgagatcttctgatccgggagattgtgaagcagactgagggcaatgataacttgctggcgatgatgaaggaccagtatgcaaactatgtagttcagaagatacttgaaacatgcaacgagcaacagagagagctcctgctcagccgtgtgaagggccatctgcaagcattaaggaagtacacctatggcaagcatattgtgagccgagttgagcaactttgtggtgaaggagacaccgagtcagattcttgaaaaattagcatatttcttcactggaggtgtatgcctggagccctcaagatgaacaacctccagtgcttccagaagggctaacaaaactcttgtctccttcagattgtacataagtgactctcattaggtggtagcctaggtgctagatacagtttagtggtgtgcatcagtgtatctatgttaggggtttgcttatttatagaatcaataatggtactgtaatagttgggtagctgtttgcaaaagaagatttagtggcttgtatgcgataaattatcgactgcttggtaatgtaatcgcttgcttagtggcttgaatcgcagctgtgcgccaatttgatgtgtccaatcatgtgatattgtgatgcatatatttgctagatttataggcagaagctgttcatccgctatgaagaaaaggtatataattcaagaacgaactgtactttgggccatattttattgccaaagttatcatcttatgtctaatcttttcatttttgttgcacaatgggccatcctaagattcttaattcttcacttgccatacgtaatgtctttttggcaaaggtacggcatgtgtataaatggtgaagttcgccggca

SEQ ID NO: 5981 - DNA, 3804 bp, Sorghum bicolor
ccgtcgtccatcgtcttctccaccgagtcggcaaaagaaaaagggaaaagcgtgcgcggggggagaggtagaggagagagaggaggaagtgaaggaaaagcttcccgagcgaagaagtgttttccgaaggcgtggataaggccgacgcggtttgaggctccggcgctggagaaagaaggaggcttgtcgagggccgagctccgggcggaggaggaggaggactgctggtggacttgctcggccgcctagggtttcgggctgccggccggccggctcggaggccgcaagtttaatggctactgagagtgctgtccgattaattggtgggacaggggctagggactggagtaagggatttggtgcatttgactcttcagtgggtggcctttcaggggaagatttaggatttgtggataacggcactggggtttatgggggctggagcaaatctgttccaaatcgcagtggaagcgcaccacctagcatggaaggatctcttgctgctcttggccatctcattggccagcagagtgggagctttgaagctagtttggcaaccttggataacataactgacagttcgaagtctgaggagcaactacgtgctgatccagcatattttgagtattatggctccaaggtgaatctgaatccaaggctccctccgccacttatttcaagagagagccgccgattaatgaaccgtgttggcaaggctaaagagtggagggtagtctcccaagataacagcagcaaaggctcgatatatgttcctcgatctacactgtcaactcacaaagaagaaccggaggatgataaatctccaagattggattcaagttcagtggaggatgcccagattatctccagtgcatccaactttcagagccaggattttagtctggagagctttcaacagaatgctgcttctttgcctgatagttcatcttctaatccttcaaatagcaacactggtgattctatgcctgtatattctgacataaatttgtcaaggagtttgtcagttgatgctgtcaagcaatcggacctgaactcttggaaatcaaaaaacccactgaaaagtaatgttagcagtgacctttcatcgccgccccttcccagttcatcatattctggtagcaaaactggtatgcaaacttctcagcaagaaaaggcggctgtagacaccaaacatggaaatgttgtgcttggcagtggtgcagctgttactgaacttgataatgtggactccagtatgaagaatttgaagttaagtttggatggccatacatcctcacctgtgaagcagaggtggcaggacaatgtcttgcagcagtatggctcctttctccaagcccaaggtgatcctattcaaatgactactcaaggaccccatcttccccatataccttttgttgataacttgtctcatgctcagctcaagttacctgctggtgacttgcaccaatttttaccgcagcctagtatgacaacacctttctatacaccaaattcttttggaaacccttattatcagaatttgcaccctgctaatgcttttccaacctcaattggaactggtgggtacgctgtaagtggttccattttgccaccttttatggctggctatgctccccaaggtcctcttggtacacctcttgacagtcctatgactccaagctttagtggcaggccatctggatttcctccagcagggaatcttacagggggaacagattttatgcagtcatataaagtatacggacaacttggggctggtatgcagtcgtccattcctgatccaaacttcattcatttctttcagcatccctctttatttcagtatactagtggaaatcaatacaatacaatgggtccaagatttactgttgttgggaatccagctgaaagctttgatccacaaaagatgataccgcaagcagcatatccatctgatcagaggcttccacttccaagaactggctttcctaattctactacacccagaagagggactgttccaaattatcaaggcatatcatcctacgttggagtgccgatgacttatcctacaagtccagtgtttcagggacaaacgttgcctggagtattgcctcctggtaggagaaatgactctgttggatttcagtccccctcaagaaatatcactgatagtcctgggattcaagggcagcgagaaagacagaagtttgatgaatcaaagacctgctctttcttagaagagttaaagtccaacagagcacgcagggttgagctatctgacatcacaggtcgtatagttgaatacagtgctgaccaacatggtagccgattcatccagcagaagttggaaaactgcactgccgaagagaaggcagctgtgtttgcggaggttcttcctcatgcttcatcattaatgactgacgttttcgggaattacgtgatccaaaagttttttgaacatggaactcgtgagcaaaggagggatcttgccaccaaacttgttggtcatgttttgcctttgagtcttcagatgtatggctgccgtgtaattcagaaggctcttgaagttatggaacttgaccagaaaatagatctagttcatgagcttgatggacatgttatgcgatgtgtccgtgatcaaaatggaaatcatgttatacagaagtgcattgagtgtgtccccacagaacatattggttttgtagtatctgcttttcagggacaagttgctagcctttcaatgcacccatatggttgccgtgtaattcagagagttttggagcattgcggtggtaactcacaagggcagtgcataatagatgaaatattgcagtcggcgtgcatccttgcgcaagatcagtatggcaactatgttacacagcatgttctagaaagaggaaaagctcatgagaggagccaaattattactaaattggctgggcaggttgttaccatgagccaaaataaatttgcatcaaatgtgatagagaggtgttttcaacatggtgatattgcggagcgggatcttctgatcaggcagattgtggagcagacagagggcaatgacaatttgctggcaatgatgaaggaccagtatgctaattatgtggttcagaagatacttgaaacatgcaatgagaatcagcgggaactcctgctcagccgtgtaaagggtcatatgcaagcattgaggaagtacacatacggcaagcacattgtaagccgagttgagcagctctgtggtgatggaactgccgagtcggattcttgaaaggaaccgcctaattcttcataggccaggggtgtcttgttcttttgctcagtccatcagtgaagaaagcaaaaacagatcaagtccaactctggtgcttctaaacagactaacaaaactgtcgtcgaagattgtataggtgtgactcttcaggatagtcttgaggttctagaacagaagcgtagtggtgtgcatcagtgtatctatgttagggtgtgcctatttacagaataatagtggttgttagctgtgtgcaaaaggagtttagcgttatggtttgtatgcgatacatattaactgtgcctggtaatgtatttgctttcttgcatcgcagttgtgggataaatgcaatgttcatgcttgtcctgattacctttcagttcaacctgcggttcctacatggcgatggagatcagctgctgtcaatcttttgttgtgatttggtgaaaaaagaaaggctgtgcacctttacactggttaggcatggagatgagctgcgctatttttgtttttaaatgtcggctgggatt

SEQ ID NO: 5982 - DNA, 3986 bp, Sorghum bicolor
gcacgcagaaggcagaccgacgccgcctcgtgactccgcccgcctccatccccgtcgcacatcgccacccgacacgaaccccaaagcacgccgcggcggtctcacacagcccagcaggcgcggtcgagggttttagaagccacccccgatcggtacggccgcacgcaccccattcaacagccccgtcgtccatcgtcttctccaccgagtcggcaaaagaaaaagggaaaagcgtgcgcggggggagaggtagaggagagagaggaggaagtgaaggaaaagcttcccgagcgaagaagtgttttccgaaggcgtggataaggccgacgcggtttgaggctccggcgctggagaaagaaggaggcttgtcgagggccgagctccgggcggaggaggaggaggactgctggtggacttgctcggccgcctagggtttcgggctgccggccggccggctcggaggccgcaagtttaatggctactgagagtgctgtccgattaattggtgggacaggggctagggactggagtaagggatttggtgcatttgactcttcagtgggtggcctttcaggggaagatttaggatttgtggataacggcactggggtttatgggggctggagcaaatctgttccaaatcgcagtggaagcgcaccacctagcatggaaggatctcttgctgctcttggccatctcattggccagcagagtgggagctttgaagctagtttggcaaccttggataacataactgacagttcgaagtctgaggagcaactacgtgctgatccagcatattttgagtattatggctccaaggtgaatctgaatccaaggctccctccgccacttatttcaagagagagccgccgattaatgaaccgtgttggcaaggctaaagagtggagggtagtctcccaagataacagcagcaaaggctcgatatatgttcctcgatctacactgtcaactcacaaagaagaaccggaggatgataaatctccaagattggattcaagttcagtggaggatgcccagattatctccagtgcatccaactttcagagccaggattttagtctggagagctttcaacagaatgctgcttctttgcctgatagttcatcttctaatccttcaaatagcaacactggtgattctatgcctgtatattctgacataaatttgtcaaggagtttgtcagttgatgctgtcaagcaatcggacctgaactcttggaaatcaaaaaacccactgaaaagtaatgttagcagtgacctttcatcgccgccccttcccagttcatcatattctggtagcaaaactggtatgcaaacttctcagcaagaaaaggcggctgtagacaccaaacatggaaatgttgtgcttggcagtggtgcagctgttactgaacttgataatgtggactccagtatgaagaatttgaagttaagtttggatggccatacatcctcacctgtgaagcagaggtggcaggacaatgtcttgcagcagtatggctcctttctccaagcccaaggtgatcctattcaaatgactactcaaggaccccatcttccccatataccttttgttgataacttgtctcatgctcagctcaagttacctgctggtgacttgcaccaatttttaccgcagcctagtatgacaacacctttctatacaccaaattcttttggaaacccttattatcagaatttgcaccctgctaatgcttttccaacctcaattggaactggtgggtacgctgtaagtggttccattttgccaccttttatggctggctatgctccccaaggtcctcttggtacacctcttgacagtcctatgactccaagctttagtggcaggccatctggatttcctccagcagggaatcttacagggggaacagattttatgcagtcatataaagtatacggacaacttggggctggtatgcagtcgtccattcctgatccaaacttcattcatttctttcagcatccctctttatttcagtatactagtggaaatcaatacaatacaatgggtccaagatttactgttgttgggaatccagctgaaagctttgatccacaaaagatgataccgcaagcagcatatccatctgatcagaggcttccacttccaagaactggctttcctaattctactacacccagaagagggactgttccaaattatcaaggcatatcatcctacgttggagtgccgatgacttatcctacaagtccagtgtttcagggacaaacgttgcctggagtattgcctcctggtaggagaaatgactctgttggatttcagtccccctcaagaaatatcactgatagtcctgggattcaagggcagcgagaaagacagaagtttgatgaatcaaagacctgctctttcttagaagagttaaagtccaacagagcacgcagggttgagctatctgacatcacaggtcgtatagttgaatacagtgctgaccaacatggtagccgattcatccagcagaagttggaaaactgcactgccgaagagaaggcagctgtgtttgcggaggttcttcctcatgcttcatcattaatgactgacgttttcgggaattacgtgatccaaaagttttttgaacatggaactcgtgagcaaaggagggatcttgccaccaaacttgttggtcatgttttgcctttgagtcttcagatgtatggctgccgtgtaattcagaaggctcttgaagttatggaacttgaccagaaaatagatctagttcatgagcttgatggacatgttatgcgatgtgtccgtgatcaaaatggaaatcatgttatacagaagtgcattgagtgtgtccccacagaacatattggttttgtagtatctgcttttcagggacaagttgctagcctttcaatgcacccatatggttgccgtgtaattcagagagttttggagcattgcggtggtaactcacaagggcagtgcataatagatgaaatattgcagtcggcgtgcatccttgcgcaagatcagtatggcaactatgttacacagcatgttctagaaagaggaaaagctcatgagaggagccaaattattactaaattggctgggcaggttgttaccatgagccaaaataaatttgcatcaaatgtgatagagaggtgttttcaacatggtgatattgcggagcgggatcttctgatcaggcagattgtggagcagacagagggcaatgacaatttgctggcaatgatgaaggaccagtatgctaattatgtggttcagaagatacttgaaacatgcaatgagaatcagcgggaactcctgctcagccgtgtaaagggtcatatgcaagcattgaggaagtacacatacggcaagcacattgtaagccgagttgagcagctctgtggtgatggaactgccgagtcggattcttgaaaggaaccgcctaattcttcataggccaggggtgtcttgttcttttgctcagtccatcagtgaagaaagcaaaaacagatcaagtccaactctggtgcttctaaacagactaacaaaactgtcgtcgaagattgtataggtgtgactcttcaggatagtcttgaggttctagaacagaagcgtagtggtgtgcatcagtgtatctatgttagggtgtgcctatttacagaataatagtggttgttagctgtgtgcaaaaggagtttagcgttatggtttgtatgcgatacatattaactgtgcctggtaatgtatttgctttcttgcatcgcagttgtgggataaatgcaatgttcatgcttgtcctgattacctttcagttcaacctgcggttcctacatggcgatggagatcagctgctgtcaatcttttgttgtgatttggtgaaaaaagaaaggctgtgcacctttacactggttaggcatggagatgagctgcgctatttttgtttttaaatgtcggctgggatt

SEQ ID NO: 5983 - DNA, 2015 bp, Panicum virgatum
gctagttatgctccccaaggttctcttgctacgcctcttgacagtcctatgactccaagctttagtggcaggccatctggttttccttcaactgggaatcctattgggggaacagattttatgcagtcatataaaatgtatggacaacttggggttggtatgcagccatccattcccgacccaaacttcattcatttctttcagcacccctctttacttcagtatactggtggaaatcaatacaatacaatgggtccaagatttactgttgctgggaatccagctgaaagctttgatccacaaaagatgatgcctcaaactgcatacccatctgatcagacgcttcagcttccaagaactggttttcctaattctcccacatccagaagaggaggagttgttccaaattatcaagccatgtcaccctacattggagtaccgatgagttaccctacaagtccggtatttcagggacaaacattgcctggagcattgcctcctggtaggagaaacgattctgttggattccagtcccccaccagaaatattactgctaattcagggactcaagggcagcgagaaaggcagaagtttgatgaaccaaaggcgtgctctttcctagaagagttaaagtccaacagagcacgtagggtcgagctatctgatatcacaggccgtattgtggaatacagcgctgaccaacatggtagccgattcatccagcagaagttggaaaactgcactgccgaagagaaggcatctgtttttgcagaagttcttcctcatgctgcatcattaatgactgacgtttttgggaactatgtgatccaaaagttctttgaacatggaactcgtgagcaaaggagggatcttgccactaagcttgttggtcatgttttgcctttgagtcttcagatgtatggctgcagagtaattcagaaggctcttgaagttatggaacttgaccagaaaatagatctagttcgtgagcttgatggacatgttatgcgatgtgttcgtgatcaaaatggaaatcatgttatccagaagtgcattgaatgtgtccctacagaacatattgatttcatagtatctgcttttcagggacaagttgctagcctttcaatgcacccatacggttgccgtgtaattcagagagttttggagcattgtggtggtaattcacaaggccagtgcataatagatgagattttgcagtcagcatgcatccttgctcaagatcagtatggcaactatgttacacagcatgttctagaaagaggaaaatctcatgagaggagccaaattattactaaattggctggacaggttgtcaccatgagccaaaataaatttgcatcaaatgtgatagagaagtgttttcagcatggtgatattgtggagcgggatcttctgatcaggcagatcgtggagcagacagagggcaatgacaatttgctggcaatgatgaaggaccagtatgctaattatgtggttcagaagatactcgaaacatgcaatgagagtcaacgggaacttctcctcagccgtgtaaagggtcatctgcaagcattgaggaagtacacctatggcaagcacatcgtaagccgagttgagcagctctgtggtgaaggatctgctgactcgggttcttaaaatgaacccacaaattcatcataggagaggtgacttgatatttgctatccatcagctgtgaagaaagcaaaacaagtctaactccggtaccttcaggcgggctaacaaaactgtcgtcgaagattgtataggtgtgactttctccagggtagtcttttgaggttctagaacagcagcttagcgtgtgcatcactgtatctatgttagggtgtgcctatttacagaataatagtggtcggttagctgtgtgcaaaaggagtttagcgttatggtttgtatgcgatacatatcagctctgcccggtaatgtatttgcttgcttgcatcgcagttctgggataaaagccctgtttatctgtg

SEQ ID NO: 5984 - DNA, 4499 bp, Setaria italica
atggcgcgctatatctttgtgacaaaccatgcagatgcctgggtcatgtggcgtctcaaagtccccgtacgcaaacgacgcctcgtgaccctgtccgtcccatcgccgccgctcatcaagccccggcacgaaccccaaagcacgccgccgcggtcgcgcccggcccagcagcagggcggttcgagggttttagaagcgaccgatcggtacggccgcacgcacccattcattcaaccccctccctctctcgtcgtccatcgtcgtctccaccgagtcgcaaaagaaaaagagggaaaagcggaggaggaggtggaggaggaaaggaaagcttctggaggagagagagtgttttcggaaggcgtggataaggccgccggggtggttggtggctccggagaaaggggggcgaggcttgtcgcccgggcgagcatccggaggagggctgctgctggtggcggcggcggcggcggcgctggtggagctgctcggcagcttagggtttcgggttccgccgtccggccggctcggaggccgcaaggtcgcgcctttcccccctccccgtgtctcgtcttcccccctgttgactgcttaatgcgtgtccccaatgtccgtgtatgcatagtgctgctaccgcataatcctgctgtcctagttcaccttacacaaacgatgccttgtgaccctgtttgtcccatccccactgcatgcctcccaaagcatgccaccacggtggcacccagcctagccgcacaggcacaggtggttgcaggttttataagcgaccgatcagtacggccgcacccattcgaccccgcctgtcatccatcctcttgtccactgagtcacaaaagaaagagagtaaaacggaggtggaggaaaggaaagctcatgccagagagagtgagtgttctcaatggggtggataaggctgaggttattggtgcctctggagaaagggagaagcttgtcacggcgagcttcgggaggggaaccactggtggtggcgctggtgcttggtcgcctagggtttccggctgccggccagctggatcgggggccacaagtctaatggctactgagagtgctgtccgattaattggtgggacaggggctagggactggagtaagggctttggtgcatttgactcatcagttggtggcctttcaggggaagatttgggatttgtggataatggcacaggggtttatagtggctggagggaatctgtcccaaatcgcagtggaagtgcaccgcctagcatggaaggatctcttgctgctcttggtcatctcattggccagcagagtgggagctttgaagccagtttagcaagcttggataacatgactgacagttccaagtctgaggagcaactgcgtggtgatccagcatattttgagtattatgggtccaaggtgaatctgaacccaaggctccctccaccacttatttcgagggagagccgccgattaatgaaccgggttggcaaggctaaagaatggagggtggtctcccaagataacagcagcaaaggctccatatatattcctcgatctactctatcaactcacaaagaagagccagaggatgataaatctccaagattggattcaagttcggtggaggatgcccagattatctccagtacatccaactttgagagccaggattttatgctggagagctttcagcagagtgttgcttctttgcctgatagttcatattctaatccttcaaataacaacactggtgatgctatggctgcacgttctgacataaatttatcaaggagtttgtcagtggatgctgtcaagcaatcggatttgaactcttggacaccaaaaagcccactgaaaagtactattagcaatgacctttcatcgtcacccctttccagttcatcatattctggtagcaaaactggtatgcaaacttctcagcaagaaaagctggccatagacaccaaacttggaaatgctgtgcttggcagtggtgcagctgttactgagcttgataatgtggaatccaatatgaagaatttgaagttgagtttggatgaccattcatcctcatctgttaagcagaagtggcaggacaatgtcttgcagcagtatggccccttgctcccagcccaaggtgatcctattcaaatgactcctcaaggaccacatctttcccatgttccttttgctgataacttggctcatactcagcttaagttgcctactggtgacatgcagcaatttttaccacagcttggtatgacaacacctttcttcacaccaaattcttttggaagcccttattatcagaatttgcaccctgcagcatttccaacctcaattggaactggcgggtaccctgtaactggttcagttttgccaccttttatgggcagttatcctcctcaaggttctcttgctacacctcttgacagtccaatgactccaagctttagtggcaggccatctggttttccttcaacagggaatcctactgggggaacagattttatgcagtcatataaaatgtacggacaacttggggttggtatgcagccatccattcctgacccaaacttcattcatttctttcagcagccctcattacttcagtataatggtggaaatcaatacaatccaatggtcccgagatttactgttgttgggaatccagctgaaagctttgatccacaaaagatgatacctcaaactgcatacccatctgatcagaggcttcaacttccaagaactggttttcctaattctcctacagccagaagaggaggggctgttccaaattatccaggcatgtcaccctatgttggagtaccgatgagttaccctacaagtccggtgtttcagggacaaacattgcctggagcattgcctcctggtaggagaaatgactctggatttcagtccccctcaagaaatattactgctaattctgggattcaaggacagcgagaaagacagaagtttgatgaaccaaaggcctgctctttcctagaagaattgaagtccaacagagcacgtagggttgagctatctgatatcacaggtcgtatagtggaatacagtgctgaccaacatggtagccgattcatacagcagaagttggaaaactgcactgccgaagagaaggcatctgtgtttacagaagttcttccacatgctgcatcattaatgactgacgtttttgggaactatgtgatccaaaagttctttgaacatggaactcgtgagcaaaggagggatcttgccactaagcttgttggtcatgttttgcctttgagtcttcagatgtatggctgcagagtaattcagaaggctcttgaagttatggaaattgaccagaaaatagatctagttcgtgagcttgatggacatgttatgcgatgtgttcgtgatcaaaatggaaatcatgttatacagaagtgcattgaatgtgtccctactgaacatattggtttcatagtatctgcttttcaaggacaagttgctaacctttcaatgcacccatatggttgccgtgtaattcagagagttttggagcattgtggtggtaattcacaaggccagtgcataatagatgagattttgcagtcagcgtgcatccttgctcaagatcagtatggcaactatgttacacagcatgttctagaaagaggaaaagctcatgagaggagccaaattattactaaattggctggacaggttgttaccatgagccaaaataaattcgcatcaaatgtgatagagaagtgttttcagcatggtgacattgcggagcgggatcttctgatcaggcagattgtggagcagacagagggcaatgacaatttgctggcaatgatgaaggaccagtttgctaattatgtggttcagaagatactcgaaacatgcaatgagagtcagcgggaactcctcatcagccgtgtaaagggtcatctgcaagcattgaggaagtacacctatggcaagcatattgtaagccgagttgagcagctctgtggtgaaggacctgccgagtcagattcttgaaacaaccctcaaattattcataggaggcgtgacttgatctttgctatccatcaagcaaaacaagtcgaactctggtaccttcagacgggctaacaaaactgttgtcgaagaatgtataggtgtgactttctccagggtagtcttttgagtttctagaacagcagcttagtggtgtgcatcagtgtatctatgttagggtgtgcctatttacagaataatagtggtcggttagctgtgtgcaaaaaggagtttagcgttatggtgtgtatgcgatacatatcaactgtgcctggtaatgtatttgcttgcttgcatcgcagttctgggataaaagccctgcttatgtttgccttgattgcgagtttgtgagatgatctctagttcagttcgaggtgcgttttctgcatggctaccagccgccgtccatttttgtatgtgtgttgatgaacaaa

SEQ ID NO: 5985 - DNA, 2554 bp, Saccharum officinarum
atgcctgtatattctgacataaatttgtcaaggagtttgtcagttgatgctgtcaagcaatcagacctgaactcttggacaccaaaaagcccactgaaaagtactgttagcagtgacctttcatcaccacccctttccagttcatcatattctggtagcaaaactggtatgcaaacttctcagcaagaaaaggtggctgtagacaccaaacatggaaatgttgtgcttggcagtggtgcagctgttactgaacttgataatgtggactccagtatgaagaatttgaagttaagtttggatggccatacatactcacctgtcaatcagaggtggcaggacaatgtcttgcagcagtatggctcctttcccccagcccaaggtgatcctattctaatgactactcaaggaccccatcttccccatataccttttgttgataacttgtctcatggtcagctcaagttacctgctggtgacatgcaccaatttttaccgcagcctagtatgacagcacctttctatacaccaaattcttttggaaacccttattatcagaatttgcaccctgctaatgcttttccaacctcaattggaactggtgggtatgctgtaagtggttccattttgccaccttttatggctggctatgctccccaaggtcctcttgctacacctcttgacagtcctatgactccaagctttagtggcaggccatctggatttcctccagcagggaatcttacagggggaacagattttatgcagtcatataaagtatacggacaacttgaggctggtatgcagccgtccattcccgatcaggacttcattcatttctttcagcatccttctttatttcagtatactggtggaaatcaatacaatacaatgggtccaagatttactgttgttgggaatccagctgaaagctttgatccacaaaagatgataccccaagcagcatatccatctgatcagaggcttccacttccaagaactggctttcctaattctcctacacccagaagaggagggactgttccaaattatcaaggcatctcatcctacgtcggagtgccgatgacttatcctacaagtccagtgtttcagggacaaacgttgcctggagtattgcctcctggtaggagaaatgactctgttggatttcagtccccctcaagaaatatcactgatagtcctgggattcaaggacagcgagaaagacagaagtttgatgaatcaaagacctgctctttcttagaagagttaaagtccaacagagcacgcagggttgagctatctgacatcacaggtcgaatagttgaatacagtgctgaccaacatggtagccgattcatccagcagaagttggaaaactgcactgctgaagagaaggcatctgtgtttgcggaggttcttcctcatgcttcatcattaatgactgacgtttttgggaattacgtgatccaaaagttttttgaacatggaactcgtgagcaaaggagggatcttgccaccaagcttgttggtcatgttttgcctttgagccttcagatgtatggctgccgtgtaatccagaaggctcttgaagttatggaacttgaccagaaaatagatctagttcatgagcttgatggacatgttatgcgatgtgtccgtgatcaaaatggaaatcatgttatacagaagtgcattgagtgtgtccccacagaacatattggttttgtagtatctgcttttcagggacaagttgctagcctttcaatgcacccatatggttgccgtgtaattcagagagttttggagcactgcggtggtaactcacaaggccagtgcataatagatgagatattgcagtcggcgtgcatccttgcgcaagatcagtatggcaactatgttacacagcatgttctagaaagaggaaaagctcatgagaggagccaaattattactaaattggctgggcaggttgttaccatgagccaaaataaatttgcatcaaatgtgatagagaagtgttttcaacatggtgatattgcggagcgggatcttctgatcaggcagattgtggagcagacagaggccaatgacaatttgctggcaatgatgaaggaccagtatgctaattatgtggttcagaagatacttgaaacatgcaatgagaatcagcgggaactcctgctcagccgtgtaaagggtcatatgcaagcattgaggaagtacacttacggcaagcacattgtaagccgggttgagcagctctgtggtgatggaactgccgagtcggattcttgaaatgaaccgcctaattcttcataggccaggggtgtcttgttcttttgctcagtccatcagtgaagaaagcaaaacagatcaagtccaactctggtgcttccaaacagactaacaaaactgtcgtcgaagattgtataggtgtgactcttcaggatagtctttgaggttctagaacagaagcgtagtggtgtgcatcagtgtatctatgttagggtgtgcctatttacagaataatagtggttggttagctgtgtgcaaa

SEQ ID NO: 5986 - DNA, 2426 bp, Pennisetum glaucum
cagcaagaaaagccagccgtagacaccaaacttggaaatgctgtgcttggcagtggtgcagctgtaacaactgagcttgataatgtggaatccaatatgaagaatttgaagttgagtttggatggccattcatcttcatctgttaagcagaagtggcaggacaatgttttgcagcagtatggccccttgttcccagcccaaggtgatcctattcaaatgactcaaggaccacatcttacccatgttaacctggctcatagtcagcttaagttacctactggtgacatgcagcaatttttaccacagcttggtatgacaacacctttcttcacaccaaattcttttggaagcccttattatcagaatttgcaccctgcagcatttccaacctcaattggaactggtgggtaccctgtaactggttcagttttgccaccttttattggcagttatcctcctcaaggttctcttgctacacctcttgacaatcctatgactccaagttttagtggcaggccatctggttttccttcagcagggaatcttactgggggagcagattttatgcagtcatataaaatgtacggacaacttggggttggtatgcagccatccattcccgacccaaacttcattcattactttcagcagccctttttatttcagtataatggtggaaatcaatacaatccaatgggcccaagatttactgttgttgggaatccagctgaaatctttgatccacaaaagacgatacctcaaactgcattcctatctgatcagaggcttccgcttccaagaactagttttcctaattctcctacagccagaagaggaggggctgttccaaattatccaggcatgtcaccctatgttggactaccgatgagttaccctacaagtccggtgtttcagggacaaacattgcccggagcattgcctcctggtaggagaaacgactctgttggattccagtccccctcaagaaatattagtgctaattctgggattcaaggacagcgagaaagacagaagtttgatgaaccaaaagcctgctctttcctagaagaattgaagtccaacagagcacgtagggttgagctatctgatattacaggtcgtatagtggaatacagtgctgaccaacatggtagccgattcatccagcagaagttggaaaactgcactgctgaagagaaggcatctgtgtttacagaagttcttccacatgctgcatcattaatgactgatgtttttgggaactatgtgatccaaaagttctttgaacatggaactcgcgagcaaaggagggatcttgccactaagcttgttggtcatgttttgcctttgagtcttcagatgtatggctgcagagtaattcagaaggctcttgaagttatggaaattgaccagaaaatagatctagttcgtgagcttgatggacatgttatgcgatgtgttcgtgatcaaaatggaaatcatgttatacagaagtgcattgaatgtgtccctactgaacatattggtttcatagtatctgcttttcaggggcaagttgctaacctttcaatgcacccatatggttgccgtgtaattcagagagttttggagcattgtggtggtaattcacaaggccagtgcataatagatgagattttgcattcagcgtgcatccttgctcaagatcagtatggcaactatgttacacagcatgttctagaaagaggaaaagatcatgagaggagccaaattattactaaattggctggacaggttgttaccatgagccaaaataaatttgcatcaaatgtgatagagaagtgttttcagcatggtgacattgcagagcgggatcttctgatcaggcagattgtggagcagacagacggcaatgacaatttactggcaatgatgaaggaccagtttgctaattatgtggttcagaagatacttgaaacatgcaacaagagtcagcgggaactcctcatcagccgtgtaaagggtcatctgcaagcattgaggaagtacacctatggcaagcatattgtaagccgagttgagcagctctgtggtgaagaacctgttgagtcggattcttgaaaggaaaccctcaaattatttataggaggcgtgacttatctttgctatccatcaagcaaaacaagtcgaactctggtaccttcagacgggctaacaaaactgtcgtcgaagactgtataggtgtgactttctccagggtagtcttttgagtttctagaacagcagtttagtggtgtgcatcagtgtatctatgttagggtgtgcctatttacagaataatagtggtcggttagctgtgtgcaaaaaggagtttagcgttatggtgtgtatgcgatacatatcaactgtgcctggtaatgtatttgcttgtttgcatcgcagttctg

SEQ ID NO: 5987 - DNA, 3785 bp, Zea mays
ccgtcgcccatcgtcttctccaccgagtcgccaaaagaaaaagggtaaaagcgtgcgtggcggagaggtggaggaggagcagcgaagcaaaagctcaccgagtgaagaagtgttgtccgaaggtgtggataaggccgacgcggttggaggctccggcgtcgcagaaagcgggacgcttgtcgccggcgtagctccaggcggcggaggaggactgctggtggacttgctcggctgcctagggtttcgggctgccagcctgccgtctcggaggccgcaagtgtaatggctactgagagtgctgtcagattaattggtggaacgggagctagggactggagtaagggatttggtgcattcgactcttcagtgggtgccctttcaggggaagacttgggatttgtagataatgatgctggggtttatgggggctggagcaaatctgttccaaatcgcagtggaagcgcgccacctagcatggaaggatctcttgctgctcttggccatctcattggccagcagagtgggagctttgaagctagtttggcaaccttggataacataactgacagttccaagtctgaggagcaagtacttgctgatccagcatattttgagtattatggctccaaggtgaatctgaatccaaggctccctcccccacttatttcaagggagagccgccgattaatgaaccgtgttggcaaggccaaagagtggagggtggtctctcaagataacagcaacaaagactctatatacattcctcgatccacattgtcaactcacaaagaagaacctgaggatgataaatctccaagattggatttaagttcagtggaggatgcccagattatctccagtgcatccaactttcagagccaggattttatgctggagagctttcgacagagtgctgcttctttgcctaacagttcatcttctaacccttcaaatatcaatactggtgattctatgcctgtatattctgacataaatttgtcagttgatgctgtcaagcaatcagacttgaactcctggacaccaaaaaggccactgaaaagtactgttagcaatgatgtttcatcgctgcccctttccagttcatcatcatattctggtagaaaacctggtatgcaaacttctcagcaagaaaaggcggctgtagacaccaaacatggaaatgttgtgcttggcagtggtgcagctgtttctgaacttgataatgtggactccagtatgaacaatttgatgataagtttggatggccatgcatcctcacctgtcaagcagaagtggcaggacaatgtcttgtggcagtatggctcctttctcccagcccaaggtgatcctactcaaggaatccatcttccccatgtaccttctattgataacctgtctcatgctcagctcaagttacctgctggtgacatgcaccagtttttaccgcagcctagtatgacaacacctttctatacaccaaattcgtttggaaacccttattatccgaatttgcaccctggtaatgcttttccaacctcaattggaactggagggtacgctgtaagtggttccattttgccaccttttgtggctggctttgctccccaaggtcctcttgctacacctctcgacagtcctatgactccaagctttagtggtaggccatctggattttctccagcagggaatcttacagggggaacagagtttatgcagtcatataaagtatacggacaacctggggctggtatgcagccatccattcccgattcgaactttattcatttctttcagcatccctctttatttcagtatactggtggaaatcaatacaatacaatgggtccaagatttactgttgtgaatccaactgaaagctttgatccacaaaagatgatacatcaagctgcatatccatctgatcagaggcttccacttccaagaactggctttcctaattctcctacatccagaagaggagggactgttccaaattatcaaggcatatcatcctatgttggagggccgatgacttatcctacaagtccagtgtttcagggacaaaccttgcctggagtattgcctcctgataggagaaatgaccctgttggatttcagtccccctcaagaaacatcaccgatagtcctgggattcaaaggcagcgagacagacagaagtttgatgaatcaaaaacttgctctttcttagaagagttgaagtccaacagagcccgcagggttgaactatctgacatcacaggtcgtataattgaatacagtgctgaccaacatggtagccgattcattcaacagaagttggaaaattgcactgccgaagagaaggcatatgtgtttgcagaggttcttcctcatgcttcatcactaatgactgacgttttcgggaattatgtgatccagaagttttttgaacatggaactcgtgagcaaaggagggatcttgctaccaagctcgttggtcatgttttgcctctgagtcttcagatgtatggctgccgtgtaatccagaaggctcttgaagttatggaacttgaccagaaaatagatctagttcatgagcttgatggacatgttatgagatgtgttcgtgatcaaaatggaaatcacgttatacaaaagtgcattgagtgtgtccctacagaacatattggttttgtagtatctgcttttcagggacaagttgctagcctttcaatgcacccatatggctgccgtgtaattcagagagttttggagcactgcggtggtacctcacaaagccagtgcatagtagatgagatattgcagtcggcgtgcgtccttgcgcaagatcagtatggcaactatgttacacagcatgttctagaaagaggaaatgctcatgagaggagccaaattattattaaattggctgggcaggttgttaccatgagccaaaataaatttgcatcaaatgtgatagagaagtgttttcaacatggtgatatggcggagcgggatctcttgatcaggcagattgtggagcagacagagggcaatgacaatttgctggcaatgatgaaggaccagtatgcgaattacgtggtccagaagatactcgaaacatgcaatgagaaccagcgggaactcctggtcagccgtgtcaagggccacatgcaagcattgaggaagtacacatacggcaagcacattgtaagccgagttgagcagctctgcggcgacggaaccgccgagccggattcttgaaatgaacccgcctaattcttcccaggccaggggtgtgagggtgtcttgttcttttgctcagtccatcagtggagaaagcagaacagatcaagtccacctctggtgcttccaaacagactaacaaaactgtcatcgaagattgtataggtgtgactcgcttcaggatagtcttgaggttctagaacaggaacttagtggtgtgcatcagtgtatctatgttagggtgtgcctatttacagaataacagtggttggctagctgtgtgcagaagggagtttagcgttatggtttgtatgtgatacatattatgcctggtaatgtatttgctttcttgcatcgccagttgtggggtaaatgcaatgttcacgcattgtcctgatatctcgttcagttcaagttgcgttttctacatggcaatggaggccagctgcatcattttttttggtttggtgaaaaaagaaaggttgtaccttcgcaccagttaggcatggagatgagctgtgtatttttttcttctaaaaacatatcagctgggattgagc

SEQ ID NO: 5988 - DNA, 3410 bp, Triticum aestivum
ggcgcggtctcggatcgcgccggatcagataaattgaggctgcagggtggatcagaccctaagaataatcatctaaccatccctcgcgatgggagcagccaaaacattgccgcacagattttcactttccgtgagcttgctgctgccactaagaacttcagacaagattgcatgttgggtgagggaggtttcggacgtgtatataaaggtcgcctagagagtgggcaggctgttgctgtgaagcaacttgatcgtaacggtctccaaggaaatagagaattccttgttgaggtcctcatgctcagtctcttgcatcacactaaccttgtcaatctaattggttattgtgctgatggtgaccaacgcctccttgtttatgagtttatgccactgggctcattagaagatcacttgcatgatgtgccacctgagaaggaacctcttgactggaacacacggatgaagatagctgcaggtgcagccaagggcttagagcatcttcatgacaaggccagccctcctgttatttaccgggatttcaaatcgtcaaacattcttcttggtgaagggtttcacccgaagctgtctgactttggccttgcaaaactcggtccagttggtgacaacactcatgtttcaacacgtgtgatgggaacttatggctactgtgccccagaatatgctatgactgggcagctcacagtgaaatcagatgtctatagctttggcgttgttttccttgaactgattacagggcgcaaagcaatcgacaacaccaaaccccagggggagcaaaacctggtggcatgggctcgtccactcttcaaggatcgcaggaagtttccgaagatggctgacccaatgcttcaaggccggtttcccatgaggggtctgtatcaggctttagctgttgctgccatgtgtttgcaagagcaagccacaacccgtcctcatataggagatgttgtcactgctctctcatatctagcttctcagacatatgatccaaatgccccaactcaacatactcggagcaattcatcgacccctagggccagaaatgttggtgggcggaacagcgaacagcgcaacggacgctcaccaaatcatcattctcctaggacatcaaagcacggaggggaggtcagccggactagttctactggtggtgattctggccggaggtcaggattggatgaaatggacatggcaggatcacaggcaggcagcccagcacagacaggaaggaagagagaaacccccaggaccgctgacaggcagcgcgccattgcggacgctaaaatgtggggggagaactccagagagcggaagcgaccgaacgacagctttgatagtacaaatgagtaaactggacagttctctttcacgacgtcactctagcagggggtcgacgagtttgctcatcagcaccagacgggccaggtttaggaacacggtgtttgttccagctctgtcccgttgtctgtgaataaaggcttttcttgccatcagcactgcctcacggttgctttatctgtaagttgttgcagttgacatgccttctccgggcggcgtccattccttgcgaatgtgattgtgtcatgtactcgtctcctttagagctcaggagcctacaagatgcagctggaaatgtaggaaagggaactgcaagaccgtcgaagccgcagagctgcgtctgtcaggcccttcctttcattcttctgcagttacacgatgtcgacgagtacgcaccgctgcacctgtgttctggaactgattgcgcaaccgtgccaggcagtttcttctgatggatgagatttcaggtttggttgggggataggatagagattacccatgtttcgtacagccgctattgtttttgtgtcgagtcgcgggatcggtcatttatttgtattagcttcgacgtacttctgcttgtatcttcgtgcgaacatggtttagcatgcagcaaaagtaccaggttattcagaatttcagtgcccatatgttatccctacttttgttcctggaaaccatgttgttcatgtatatactgctatttttgtcagtcatgcgcgcatcttgcaaatcagctcaaaacattttcaaattgattgtgggagcgatgaacatggaagaaaacttagtcaggtgttacatgtgagcaaagagaagagaagtattttgtactggaaaatgcttcacattaccaagcaaacatttacagcaagcatcttcctgtcgagcgtggtggtgttatcccctctctggatgcagaaacaatgaagcagagtggggaaggacatgttgcgtgcgtggtgctactatgatgacacagaacttctttacatgggtttcactgggcgctgtgtcttcttcgctcgttggacagaccagactgctgctgctgcttcgacaagacgacgtttccatggaggtccatcttgtaccgcagttcggcatagtccatgacaatcctgcagctgctccaggcctccgcgtgcatgctcacgcccaggtaggttatgtggtcctgaatgctgttaccgctcacagacctgctgcatgccgggtcttcgccggagtcgtcgcagatctgctcaaccgtgtataccagactcccgagcccgacatcatggacccatacctctcttggaaagtgatggtaggtcttctgagggaagaacgagaagtatggtggcagatgagggacgatatcatttgcattagtaactcgaatcgcgtgaggcaagtatctcttgaagtaagaagcaaaagcagcattgccgacacgaggttgcccaaatgtcatcagcttcacatcatccaacccgtagttcacaacaagatcaagtgcacaaaatgaagccatagctgcccccattgaatgcccagtgaccataattggaacatctccatgcaatttctgagtcttttgaataccgctgacgattccatcgcgtatggttgtgttatgataagcagagtaaaatcctcggtgtaccattgcttcaggcatgccagggtaatcaagatcaagttgtttccataacaagtcctctatccagttctggatgctgttctcttgagttcctctaaacacaacgacgacagcattaatatcactggcaaaaccaacatatgcctctaagcagttctccacatctacgatgatgtccatcatctcaaacccctcgatcaggtcaccgcatctatcacatgtccaggtgaacaattgtgtcaaatcagcagtatatatggcagcagcatattccactagtgtcttggcaagggttgagttgtatatggtagtggatggctgctgtataaccgtaggtactctcccggagcaaaccacgagcaagcacgacgccagtagagccgccttgagcaacccgcggcgctccatg

SEQ ID NO: 5989 - DNA, 1713 bp, Triticum aestivum
ggatcagaccctaagaataatcatctaaccatccctcgggatgggagcagccaaaacattgccgcgcagattttcacttttcgtgagcttgctgctgccactaagaacttcagacaagattgcatgttgggcgagggaggtttcggacgtgtatataaaggtcgcctagagagtgggcaggctgttgctgtgaagcaacttgatcgtgacgggctccaaggaaatagagaattccttgttgaggtcctcatgctcagtctcttgcatcacactaaccttgtcaatctaattggttattgtgctgatggtgaccaacgcctccttgtttatgagtttatgccactgggctcattagaagatcacttgcatgatgtgccacctgagaaggaacctcttgactggaacacacggatgaagatagctgcaggtgcagccaagggcttagagcatcttcatgacaaggccagccctcctgttatttaccgggatttcaaatcgtcaaacattcttcttggtgaagggtttcacccaaagctgtctgactttggccttgcaaaactcggtccagttggtgacaacactcatgtttcaacacgtgtgatgggaacttatggctactgtgccccagaatatgctatgactgggcagctcacagtgaaatcggatgtctatagctttggcgttgttttccttgaactgattacagggcgcaaagcaatcgacaacaccaaaccccagggggagcaaaacctggtggcatgggctcgcccactcttcaaggatcgcaggaagtttcctaagatggctgacccaatgcttcaaggccggttccctatgaggggtctgtatcaggctttagctgttgctgccatgtgtttgcaagagcaagccacaacccgtcctcatataggagatgttgtcactgctctctcatatctagcttctcagacatatgatccaaatgccccaactcaacatactcggagcaattcatcaacccctagggccagaaatgttggtgggcggaacagcgaacagcgcaacggccgctcaccaaatcatctttctcccaggacatcaaagcacggaggggaggtcagccggactagttctactggtggtgattctggccgtaggtcaggattggatgaaattgacatggcaggatcacaggcaggcagtccagctcagacaggaaggaagagagaaaccccaaggattgctgacaggcagcgcgccattgcagatgctaaaatatggggggagaactccagggagcggaagcgaccgaatggcagctttgatagtacaaatgagtaaactggacagttctctttcacgacgtcactctagcagggggtcgacgagtttgctcatcagcaccagacgggccaggtttaggaacacggtcattgttccagcactgtcccgttgtctgtgaataaaggcttttcttgccatcagcactgcctcacggttgctttatctgtaagtcgttgcagttgacatgccttctccgggcggcgtccattccttgcgaatgtgattgtgtcatgtacccatgtcctttagagctcaggagcctacaagatgcagctggaaatgtagcgaagaagaggggaatgttgtcgaagccgcagagttgcgtctgtggggccctttcatgtttttctgcagttacacgaagtcaacgagtacgctctgctgcacctg

SEQ ID NO: 5990 - DNA, 2316 bp, Saccharum officinarum
cccagcctcatatttctcctcctccttcctgtagctggagctggagctggagctggagcctttcaccccactcccatagtccctccacggcaccgcgcctccctcccccactacccaacccttccctcccctctcctccgctccctcccgaattgggccagtagcctgcttccagttgcggcgtcggtcagggaagaggcctcgctcccgtcccggcccgcagatcgggggaggagctccctgctcacccctcgccggctcggccgcttccccgccgccgggtctctctcccgcggaggcgtcagcgtcgccgatgagctgcttcgtctgcttcgggtcggcggcgcaggacggggaggtcaggaagccccccgccgcgggcgccggcaaggacgccccgccggatcgcgcggtggtacgcgtcggatcagataaatcaagatcacagggtggaccagactctaagaaggatctaattatccatagggatgggaatagtcaaaatattgcagcacagactttcacttttcgtgaacttgctgcagccactaagaacttcaggcaagattgccttttaggggagggaggttttggtcgtgtatataaaggacgcttggagaatgggcaggctgttgctgtgaagcaacttgatcgtaatggtctccaaggaaatagggaatttctggttgaggttctcatgctcagtctcttacatcacactaacctggtcagtctaattggatactgtgctgatggtgaccaacgccttcttgtttatgagtttatgccattgggatcactagaagatcatctgcatgatctcccaccagataaagaacctcttgactggaacacaaggatgaagatagctgcaggtgcagctaagggcttagagtaccttcatgacaaggcaagccctccagttatttaccgagattttaagtcatcaaacattcttcttggagaaggatttcatccgaagctatcagactttggccttgcaaaacttggtccagttggtgacaagacccatgtttcaacacgtgtgatgggtacatatggctactgtgccccagaatatgcaatgactgggcagctgacagttaaatcggatgtttatagctttggtgtcgtgttccttgaactcatcacagggcgtaaagcaattgacaacaccaaggtccagggggagcaaaacctagtggcatgggctcgtccactgttcaaggaccgaaggaaattccctaaaatggctgatccaatgcttcagggccgcttccctatgaggggtctatatcaggccttggctgttgctgccatgtgcttgcaagagcaagctgctacacgccctcacatcggggatgtcgtcactgctctctcatatctcgcttctcaggcatatgacccaaatgcccctgttcaacacagccggagcaattcatctacccccagggccagaaaccctgctggatggaacgaagaccagcgcagtgtgcgctcacctaataatcatcattctccagacccgcggcggagggatgcggccagggcatccaagtatggagcagagggtagcaggactagctctaccagcgactctggccgacgatcaggcctggatgacatggacctgaccgggtcgcaagtgggaagcccagctcagaccggaagaagaagagagctccaaggccactgacagacagcgcgctgtcgcagaggccagggtgtggggggagaattcaagggaccgaacaaatggccatggtagcttcgacagcacacatgagtgaagccgtcaggttccattccaggcatcattccagacccaccgtgggttgagttcactcatcagctccagtcggatccccgatcttgggacatggcgtcggtgccacctggtcccgagtgtctgtgaataaggcttttcttgccctcctgtggcgaatgcaattctcctggtgtccattccttgcgaatgtgacctgtgtcatgctttcggggagcctcaggaggagcctgtaggattcagtcagaggtagacaggtcagtgaagagaggtggggcgcggagtcacattggtgagttgtttttgttttggcggctaaatgctgagtatgttaagctgcatgtatcctttttgtgtatgggtatgggtaagagcaactgtgtcaggtttggctacctgagaggcctttgaagttgctgttggtgctgctgctgctggctgcttcttcctcccccccccctttgggagttcagagctgaaatgtaggataggcgatgttgttgagtagtacagcaactgttttatgttcg

SEQ ID NO: 5991 - DNA, 2439 bp, Secale cereale
ctcactcctcagtcggccatgagctgacttttgccctcggacctcggacatcctgttctctctcctcgctttctctctcttgcccgttctcccaatagttctgtccctgtccctccccccaaattccccgacccaccgctcccaaatcccatccaaatccctccacatcctccaaagatcggattttcggagggcctccgcccccagatcggggagggatccccgtttcctctggtgggtcggtccccgccgtccttttcttgatctttttcctggaggggaggttcttggatggggtgcctgccgtgcttcgggtcgagcggcaagggggagcccgccaagaagggcggcgcgcggaaggacgttccgtcggatcgccgcgccaccggggtcggatcagataaaccaaaaccacaaggtttattggactctaagaaggatacagttatcccaagggagggaaacaatcaacatattgcagcacacacattcacttttcgtgagcttgctgctgctactaagaacttcagacaggattgcctattgggcgagggaggtttcggccgtgtatatagaggacgtttggacaatggacaggctgttgcagttaagcaacttgatcgcaatggacttcaaggcaacagagagtttctggttgaggtccttatgctcagtctattgcaccacgataacttggtaaacctaattggatactgtgctgatggggatcaacgtcttcttgtatatgaatatatgccgctaggatcacttgaggatcatttgcacgacattccacctgaaaaggaacctcttgactggaatacacggatgaagattgctgctggtgctgccaagggattagaatacttgcatgacaaggcaagtcctcctgttatttaccgggatttcaagtcgtcaaacattcttcttggcgaagagtttcatccaaagctatctgactttggccttgcaaaacttggccctgtcggtgataagactcatgtttcaacgcgtgttatgggaacttatggctactgcgccccagagtatgcaatgactggacagcttacagttaaatctgatgtgtatagctttggtgttgtgttccttgaactgattactggtcgtaaagcaattgacaacaccaaaccacatggagagcaaaacctagtggcgtgggctcgtcctctgttcaaagaccgcagaaaatttccaaaaatggctgatccggcacttcagggccgctttcctatgaggggtctatatcaagctttagccgttgctgcaatgtgtttgcaagagcaagctgccactcggcctttcataggagatgtggtcactgctctttcatatcttgcttctcaggcgtatgatccaaatgcagccactcaacatagccggagcaatgcatctacccccagagccagagaccgtggtagtgtgaacggcgaccagcggcgtatccgctcgccaaatcaccattctccagatctgaggagaaaagaagtcgcaacaacatcgaagtatgaagccgaggttagcaggaatagttctggtggtggttctggtagacggtcaggcttggatgatagggatgtgacaggttcgcagcagggtagtcctgctcaggcaggaaagaggagggaaacttcaaggacctctgagaggcagcgtgctattgcagaggctaagacatggggtgagaattctagagagaggaaatggccgaatgttcggggcagcttcgatagtacaaatgaatagaactctggagcagaaggtctgagtcatcattctagaaagaggatgagtcgcaagccagtaccaagcaggggacagcttagggacatggggttcgatttcggttccatgtttaatgtgaatagagctttcttttctttcccggccatgccactgcttcatagtttctctcttccacacaaatatcaccaccgcaatcaccatcgacacgcctattcctggcgtccgttcctcgtgaatgtgatcatgcagatgtgccttcatcatcatggcacgaacgacatctggctggaaagttagtaagcaaaggatagaacggttctgaggaggacatgatccaatcaaatgagcctcttctgttgcctgcatgcatgacgggtaccacagttgttccgagtgtagagctttattgtgaagtctgagtaccgagggatgtgatgatttttctttcctcgagggtttgtaccgaggggttttacccatgttccatacgtctgtattgtgacatttttgtttgtattgagttgtcagaacatatcctttgatttatctcttctggcaaaagccgttgtgccccttccatctaagctgtgcaaaatatttaggaagcttgttagctatatgctcaaatttctttgtttcctgtttctgagctttctgtccatagcagataagccc

SEQ ID NO: 5992 - DNA, 2642 bp, Oryza sativa
tgaaaacgaaaaaaatccatgatgggggagacaaatggtacagtggattctcggaagatcctcccatctcactcttgcccctgggctgacttttgccctcccttgggcatccatctcctctccctccctcccctcccctcccatccctacccccaaaatcgccgaccgaccgcccccaaatcccatccaagagccgtcgcctcctccaaagatcggatttcgagaccccccagatcggggggagagatccccgtgtcgtctggtgtggtgggtcggcctccgccccccggccgccgcgcttctcttgatctttctttcttttttttgatttttttgcgtttcccctccgggagaggggaggggaggagggttcttggatgggctgctttccgtgcttcgggtcgggcggcaagggggaggcgaagaagggcggcggcgggcgcaaggacggcggctcggcggatcgccgcgtcgcccgggtcggatcagataaatcaaaatcacagggtggattggactctaggaaggatgcattcatcccaagggatgcgaatggtcaacctattgctgcacacactttcacttttcgtgaacttgctgctgccactaagaacttcagacaagattgtctattgggggagggaggttttggccgcgtatataaaggacacttggagaatgggcaggctgttgcagtgaagcaacttgatcgcaatggacttcaaggaaatagagagtttctggttgaagtccttatgctcagtctattgcaccatgataacctggttaacctaattggatactgtgctgatggggatcaacgtctccttgtatatgagtttatgccattgggatcacttgaggatcatttgcatgatattccacctgacaaggaacctctcgactggaatacacggatgaagattgctgctggtgcagccaagggcttggaattcttgcatgacaaggcaaatcctcctgttatttacagggatttcaagtcatcgaacattcttcttggtgagggataccatccaaaactatcagactttggcctggcaaaacttggccctgttggtgacaaaactcatgtttcgacacgtgttatgggaacttatggctactgtgccccagaatatgcgatgactgggcagcttactgttaaatctgatgtgtatagttttggtgttgtgttccttgaactgattactggccgcaaagcaatcgacaacaccaaaccacttggagagcagaacctagtggcatgggcccgtcccctgtttaaagaccgcaggaaatttcctaaaatggctgatccattacttgcgggccgatttcctatgcggggcctgtatcaggctttagcagttgctgcaatgtgtttgcaggagcaagctgccactaggccttttataggagatgtggtcactgctctttcatatcttgcttcccagacatatgatccaaatacacctgttcagcacagtcggagcaatgcatctacccctagggccagaaaccgtgttggtgcgaattttgaccagcgtcgtcttcactcaccaaatcaccaacaatctccagatttaaggaaagaaggcaccacaacatcaaaatatgaagctgaggttagcaggactaattctggcagtggctctggtcgacgagctggcttggacagcatggatgtgacaggttcacagatgggtagtcctgctcacgcaggaaggaagagggaatcatcgcggagtactgataggcagcgtgcagtcgcagaggccaaaacatggggggagaattcaagagaaagaaagtggccaaatgctcgtggcagctttgatagtacaaatgagtaaacctctgaagcagaaggttcagttaagtcgtcattctaggggaaaaaaaaagatgaatcacttgcagaacccaactgggtcgaattaggtacatggggcattttcgctccatctcggctctgcggtctatgtgaatagagcttctctttttcttttttctgtcctggagacaccaccgctgcttcagagctctcctctcgtccatacgaatagcatcaccgcgatctcatcgtcgacgcgcctattcctggcgtccattcctcgtgattgatcatgcaaatgtgccttttattcatcatgaagacagaaacaccgtttggctggaaatgtaggtagaaagcaaaagagaaaatttgctctggagctatccattgggtatctcatgtcgatgttgttgcatgatgagtgtcagcggctgcaccattgttcctgagtgttctagctctatgtgaagtgaagtctgcgtaccgagggatgtgatgttcttttttcttttcttttcttttctttttgtctcaatggtttgtacctagggggtacggcattttacctgtgtttcatacacctgtcatttgacaatttcatgtcggagttatctgttgttttatctctacgagtaagctgttcttcattcaatcttctaacctgtgctcttttttggctatggttcttccggtatatattactcatttttttctttgcttactaatttcttgcgagtcaatattggtggatggggtaacaaaaagcacttgtgtttccaagtacttaagcttaatatacttccca

SEQ ID NO: 5993 - DNA, 2339 bp, Sorghum bicolor
tcctccttgctctgtctggagctgacttttgcttaggaccttggacgccttcgctgtccttgcttccgcgctcgctccccgccgacccgccgctcccaaatcccatccaaattcttccgcgtctttcaaagatcggattttgggaggggcaccgcccccagatcggggaggaatccccgttcggtctggtgggttggcctccgctgctcgcttctttgctcttttctcctctcacaagggcggctcttggatgggctgcctgccgtgcttcgggtcggctggtgagggggcggccaagaaggttggtgcgcggaaggacggttcgtcggatcgtcgcgtcacccgggttgaatcagataaatcaaaagcacatggtggaccagactctaagaaggatgcagtcatcctgagggatgggagcaatcaacatattgcagcacacactttcacttttcgtgaacttgcagctgccactaagaacttcagacaagattgcttattgggtgagggaggttttggtcgtgtttataaaggacgtttggagaatgggcaggttgttgcagtgaagcaacttgatcgcaatggtcttcaaggaaacagggagtttctggttgaggttctaatgcttagtctgttgcaccatgacaacctagtgaacctaattggatactgtgctgatggggaccaacgtcttcttgtatacgagtttatgccattgggatcacttgaggatcatttgcatgatattccacctgaaaaggaacctctggactggaatacacgtatgaagattgctgctggtgccgccaagggcttagagtacttgcatgataaggcaagtcctcctgttatttacagggatttcaagtcctcaaacattctacttggtgaagggtttcatccgaagctatcagactttggacttgccaaacttggtcctgttggtgacaagactcatgtttcaacacgtgttatgggaacttatggctactgtgctccagagtatgcaatgacagggcagcttacagttaaatctgatgtatatagttttggtgttgtgttccttgaactgattactggccgcaaagcaattgacaacacaaaaccccacggagagcaaaacctagttgcatgggctcgtcctctattcaaggaccgcagaaaatttcctaaaatggctgatccattacttcagggtcgcttccccatgaggggactatatcaagctttagctgttgctgcgatgtgtttgcaagagcaggctgctactcgcccctttataggtgacgtggtcactgctctgtcatacttagcttctcagacatatgatccaaatgcgcctgttcaacataatcggagtaattcatctactccgagggttagccgaggtggcgggagcaatgaccaacgccgtctccgctcaccgaatcaccattctccagatttgagaagggaagccaccgcagcatcaaaatatgaagctgaggttagcaggacaaactctggtagtggttctggtcgccggtctggcttggatgatgtggatatgtcaggttcacaattgggtagtcctgctcacgcaggaaggaagaggggatctcctaggactgctgaaagccagcgtgctatagcagagaccaaaacttgtggggaaaaatcaagagggagaaagtgaccaaactctcagagcagcattgaatgtatgagcagaatgctgaagcagaaggatcttgctagcaccaaacaggacatcttggtcccttggtctttgtgaatagagctttccccttttcccttcaccggctgttgccactgcttcgtgacttctccatacaaatatcattgccaccacaaccaccatcaaaactcccattcctggcgtctattcctcatgaatgtgatcatcatgcttatgagccgttgtcatcacggtgtataacaacattcggttcaaaatattgaggtaaggcaaaaatctgcattggggagcacaggatctcacccagtgggtatcttctgttgctgttgcatgatgggtgtgagcaatcacaccattgtcgagggatgtgatgttcttttcttgaatggtttgtacctagggttacagcagtccacctgtgtttcatacatctgtcttgtgacatttttgtgttgagttgtcagaacacatcctttatgctctctgtaccagaaaactgtcgtgcccctttcatcgtatcttatgcatgctgttccgaaaactgtttcttcctttttttggtgcgccaaactttcattcattagatgttgcatcagaactgggtgccaatcatgactggtgatatagccattcacttcca

SEQ ID NO: 5994 - DNA, 2482 bp, Sorghum bicolor
taaaaaaattcgcacggtaggacgtggactcaaaggatctctcctccagtcctccttgctctgtctggagctgacttttgcttaggaccttggacgccttcgctgtccttgcttccgcgctcgctccccgccgacccgccgctcccaaatcccatccaaattcttccgcgtctttcaaagatcggattttgggaggggcaccgcccccagatcggggaggaatccccgttcggtctggtgggttggcctccgctgctcgcttctttgctcttttctcctctcacaagggcggctcttggatgggctgcctgccgtgcttcgggtcggctggtgagggggcggccaagaaggttggtgcgcggaaggacggttcgtcggatcgtcgcgtcacccgggttgaatcagataaatcaaaagcacatggtggaccagactctaagaaggatgcagtcatcctgagggatgggagcaatcaacatattgcagcacacactttcacttttcgtgaacttgcagctgccactaagaacttcagacaagattgcttattgggtgagggaggttttggtcgtgtttataaaggacgtttggagaatgggcaggttgttgcagtgaagcaacttgatcgcaatggtcttcaaggaaacagggagtttctggttgaggttctaatgcttagtctgttgcaccatgacaacctagtgaacctaattggatactgtgctgatggggaccaacgtcttcttgtatacgagtttatgccattgggatcacttgaggatcatttgcatgatattccacctgaaaaggaacctctggactggaatacacgtatgaagattgctgctggtgccgccaagggcttagagtacttgcatgataaggcaagtcctcctgttatttacagggatttcaagtcctcaaacattctacttggtgaagggtttcatccgaagctatcagactttggacttgccaaacttggtcctgttggtgacaagactcatgtttcaacacgtgttatgggaacttatggctactgtgctccagagtatgcaatgacagggcagcttacagttaaatctgatgtatatagttttggtgttgtgttccttgaactgattactggccgcaaagcaattgacaacacaaaaccccacggagagcaaaacctagttgcatgggctcgtcctctattcaaggaccgcagaaaatttcctaaaatggctgatccattacttcagggtcgcttccccatgaggggactatatcaagctttagctgttgctgcgatgtgtttgcaagagcaggctgctactcgcccctttataggtgacgtggtcactgctctgtcatacttagcttctcagacatatgatccaaatgcgcctgttcaacataatcggagtaattcatctactccgagggttagccgaggtggcgggagcaatgaccaacgccgtctccgctcaccgaatcaccattctccagatttgagaagggaagccaccgcagcatcaaaatatgaagctgaggttagcaggacaaactctggtagtggttctggtcgccggtctggcttggatgatgtggatatgtcaggttcacaattgggtagtcctgctcacgcaggaaggaagaggggatctcctaggactgctgaaagccagcgtgctatagcagagaccaaaacttgtggggaaaaatcaagagggagaaagtgaccaaactctcagagcagcattgaatgtatgagcagaatgctgaagcagaaggatcttgctagcaccaaacaggacatcttggtcccttggtctttgtgaatagagctttccccttttcccttcaccggctgttgccactgcttcgtgacttctccatacaaatatcattgccaccacaaccaccatcaaaactcccattcctggcgtctattcctcatgaatgtgatcatcatgcttatgagccgttgtcatcacggtgtataacaacattcggttcaaaatattgaggtaaggcaaaaatctgcattggggagcacaggatctcacccagtgggtatcttctgttgctgttgcatgatgggtgtgagcaatcacaccattgtcgagggatgtgatgttcttttcttgaatggtttgtacctagggttacagcagtccacctgtgtttcatacatctgtcttgtgacatttttgtgttgagttgtcagaacacatcctttatgctctctgtaccagaaaactgtcgtgcccctttcatcgtatcttatgcatgctgttccgaaaactgtttcttcctttttttggtgcgccaaactttcattcattagatgttgcatcagaactgggtgccaatcatgactggtgatatagccattcacttccaatgatcttttctagaggttacttgccgctatgggtttgtgttggttaaacttttctaagtttgactaggtttgtagaaaacattagcatcattt

SEQ ID NO: 5995 - DNA, 2367 bp, Panicum virgatum
cgccgacccgccgctcctgaatcccatccaaattcttccgcatcttttcaaagatcgggttttgggaggggcaccgcccccagatcggggagaaatccccgttccgtctggtgggtcggcctccgctgcccgtttcttggctattttccccttctcaagggcagctcttggatgggctgcctgccgtgcttcgggtcggctggtgagggggcagccaagaagggcggcgcgcgcaaggacggctcgtcggatcgccgcgtcacccgcgtcggatcagataaatcaaagccacagggtggatcagactctaagaaggatgcagttatcctaagggatgggaacaatcaacatattgcagcacacactttcacttttcgtgaacttgctgctgccactaagaacttcagacaagattgcttattgggggaaggaggttttggtcgtgtttataaaggacgtttggagaatgggcaggttgttgcagtgaagcaacttgatcgcaatggccttcaaggaaatagggagtttcttgttgaagttctaatgctgagcctattgcaccatgacaacctggtgaacctaattggatattgtgctgacggagaccaacgtcttcttgtatacgagtttatgccattgggatcacttgaggatcatttgcacgatattccacctgataaggaacctctggactggaatacacggatgaagattgctgctggtgccgccaagggcttagagtacttgcatgacaaagcaagtcctcctgttatttacagggatttcaagtcctcaaacattctacttggtgaagggtttcatccaaagttatcggactttggccttgctaaacttggccctgttggtgacaagactcatgtttcaacacgtgttatgggaacttatggctactgtgccccagagtatgcaatgacagggcagcttacagttaaatctgatgtatatagtttcggcgttgtgttccttgaactgattactggtcgcaaagcaattgacaacaccaagccccatggagagcaaaatctggttgcatgggctcgtcctctcttcaaggaccggcgaaaatttcctaaaatggctgatccattacttcagggccgtttccccatgaggggtctgtatcaggcattagctgttgctgctatgtgtttgcaagagcaagctgctacacgcccctttataggtgatgtggtcactgctctttcatacctagcttctcagacatacgatccaaacgcacctgttcaacatagtcggagtaattcatcaactccgagggctagccgaggtggcgggagcaatgaccaacgccgtctccgctcaccgaatcaccattctccggatttgaggagaagggaagccaccacagggtcaaaatacgaggctgaggtcagtaggacaaactctggcagtggttctggtcgtcggtctggcttggatgacatggatacggcaggtttgcaattgggcagtcctggacatgcaggaaggaagagggaatcttcgaggaccacagaaaggcagctagctgttgctgaggccaaaacatggggggagaattcgcgagacagaaattgaccaaaactctcagggcagcattgttgagagtatgaaggagtcgaactctgaagcagaaggttcaatccattcatcattcaaaagaaacgatgagttccttgccagcaccaaacaggacgattaaggactctgcatctgttccatcttggtcccttggtcatgtgaatagagctttccttttcccccctttcctggctgttgccgctgcttcacagcttctccatacaaatatcatcgccaccacaaccaccgtcaaaacgcccattcctggcgtccattcctcgtgaatgtgatcatgtgtatgagcctttgttgtcatggcaaagaacaacattcggctgaatatgtaacgggcatagggaaaatctgctctgaggagcaaaggatttcaccctatgggtatcttatgttgctgttgcatgatgggtgtcagcggctgcaccaatgttggagtgtagagcttatgtcaagtccatgtaccgagggttgagggatgtgatgttcttttcctgaagggtctgtacctgggttacagcagtctacctgtgtttgatacatctgtcttgttacatttttgagttgagttgtcagaacacatcctttatgttgtctgcatcaacaaactgtcgtgccccttgcctcttgtgcatgctgttttgaaaactggtgttgttccccttcctatgaaccaaacttgaaatcattagatttgttgcaccagaacttgatgcgaatcatgattagtgatatactcattcatttccaatc

SEQ ID NO: 5996 - DNA, 10916 bp, Sorghum bicolor
catcctttgttcataataaagtggctgagataattaccccttaaactaaaaaaggaccatggccattgccttggaagtactagagtagtagaggttaggctcgtcaaagatatgttcttttacacataagaagtgataatatttgttgagtaaatttcattaaaccaccacatagatgacgcaagtgggccattttagttcatctctccccagctaaattagttattgcatggcatgctgttttagttcattttagaaagttttggtcaactcagtgaccccaacaagtggaccttgcatccctaactccatatccttggcttaactaggaacactggagccagatttattttaagtcagctcgtttcttgttttataaaacacgcacaaacgtactctgcgaacaatggggtgggttggtatgttgtatgtttatcttctactattaaatgcaacggtacacaactctcctgtgtgttcacagaaaaagaaatgaaagtcagactcatgactaaactaccactaattttagcccctttccacaaactaccactcttttcctcctgcattatcctgaccacctgagccaacttgtcagcgtcacatagtgcaaaacagagtaaaacaacgtagtggtaaaatgtgacattgacgagtgggcccaggtgctgaggatactgtaggaggcataggtttatgagaagcgtccaaagtagtgtggttcaatggaatgtggaaatttgggagaattttctctaatttgtttgatgatgattattgagcacatatctgtctgccccagccccgagatttcaccctgcacactatgatcatgtgatattgattagcatcagtaggttcagttttacttattttctttgtttgttatgtatttcaccagtagatttaagtttccctacatttatcacttaatccttccggtttcaaatgtcagttgttttaggattttaggtggtcaaatttctttaacttggcccatcaatacatgtgcatgtgcattacacagatagacaacatatgattgattttattagtttttttagaccaaaggcatttaaccctgcttatattgagggcatcacagaagttttgctgggggataccagctcacaagaacgtgcaaagcccagttaaaactcacctccacttaagaccacctccacctaaaagcaaacaccaagccctacccaaccagagaaacactaccagaaacaggtaggttgctacaacaaaagacaaacagaaaaggaggaaaccacagcaagagagcaatcctgaacagcaaaacgagaacaagaaacagctaagccacagctgctttgcctttggcctcccttttcttcatgtcttttggccgccagaccctcatcatatctgtttgacatcatattcctgtctaggcacatttcaccatcttgaaagtccttccttcatcttcaacaggaattcctccatcttgtccctgtcttccttcttcaccagcgtctgccgctggtttagaaagccaagagatttgtaagccacttgtttaggagatttaaggattttttttttggagaaaactagagcatttcttgttttccacaacgcccaacccacaccagctactatcacccatgaggacttgttcctatccccaccacctctgttcaggcacagctcctggaatttatcaatggatgatagtagttttggccagcccaagctgtttctcacccagcaccaggtcaccatcgctatagggcatctgaacagcagatgacccacttgattttactatttaacatataacttccactatttcgaatgatatattacctcaaaaacacaaatcaaagtgtcacattggagcctaaatggcttacatttggaatcagatggagtactgtgtttttaaattaaagtccatatcagtgggatggtcaaagtttgctctgagaggctagatattcacacttgaatcaggtgaaaaacaaaatatgtacactgttgtatttttggtgggcttggacactattatacatcagtgggatattgtgcatattaaaactgttatagtttgttagttgcataattgatacatgcatatttccagttatatatattagacctttattaaggtcggcctgcaggacctctccccccaacctgataacaactcctttgatgcatggtgggcaagaacaaattctggggttgatgaccagacaagaaaaggtctcaattccatcatcattctgggaggttggttcatttggaatcatcacaatcactgtgtgtttgataggattcaaccgagcctaaatagtgttccggtttcagtaaaagatgagtttctcctgtggagttcggcagagctcggggaatatccaatctccttgctctagagctagccaatgtgtgagttcctctctaatggtcttgggtcaagtttgaaattcgagagagaggtacaacattagatgtaaaagggcgtgtgtatgtgtgtggctgtatggggtttctaaacccactcctttattcttcttaatataatgatacgcagctctcctgcgtgttcgagaaaaaaataggcctttataagagatagaagtctactgtatatttgcaagtgtggaacatggccgacaatattattttacaccaggaggtgcatcagcacaggtggcacctttttttctcgaaacacgcaggagagctgcgcttcattatattaagaagagaataaaagggcaagagcccatacaacacacacaaacacacacgcacacgcgcacgcacacacactcacagacacatgcacaccaccagtctcaagggttactatcgcgccagagactccattatataacacgaccacagctgagccaaacactctaactaccggggaggagggcagccaagagggatagcccccgagcacaggtggcaccttactctggttcctattctagtaaggctgcatgcaattcattcttctttaggtccatcaagtttgcgccttggaggagaatttggagatcctgggtgttatggtaggcaacacctaccaaaggaaacggaaggcgcgtggctgagggggagggcgcgcgcgcgtgcccagcccacgcggtgtctcagccgtgcggttaggacctagagtccaggagggttttgtttagaaagagagaaagtaggagatttgtttctgttttgtaatcagccaagactataaggctaggactagtccctttattgagattaagcctggattgagactttagtctcccctgggcgccaggtccctattccctatcttcctgttgctgctcccctagccagccgccgatcacggcgcctcccatccgccggcgtcgaactcgcctaccgccggccacctctcatccctaccacctccgtcctctccctcgccgtaacaacctggtatcagagaccatgtattctccggcacccacccggcccacctccatgccgccaacgtcggggatcccggtcaccgtgctgccaccgcccatcaccaccactacgccgcctcccaccaccaccgccaccaccaccacaatgctgctccactcgtccgccgctgtgatcgtcccatcctcgctgccagctgcgcagccgatcgagccgaccgccgccgctttcggcaacttggtcgccgccatctatgggatgcaaaagtagatcggcgatctctcgatccgcatgtcctccatggagagccgccagccctcaccgccgcagtcctatccctacggcctgccgggctacaacggtggcggcatcccggcgctgctagcgccagggccagccatctccgagctcttctccgtgccgccgtttcagccaccactacccgcatccgacgcccccaccccttccgccgtcgcatcgccgtcgatgactgtgggcgttcccatcacccaaatcccgtttccctacttgccatcgccgatccccaccatgtcctcgatcatgggcagcacgcacccgccgccgccccatcctccttatgtccctgaacccgccaatcccattgttcctcgctaccagaagctggaatttcccacctatgacggcaaggacgacccgctcgggtggctcaataaatgtgagcagttcttcagggcgcagcagacacgccacgccgactgggtctggctcgcgtccttccacctcaacggggtcgcgcagcaatggtaccttgtcctggagagtgactgtggccggccgacatgggctgacttccggagtctgtgccatcagcgctttggaccgccgctcagcaccaaccacctgtccgacctggcacttcacgtcgacagtcgaggcatacatggaggcgttccaggcacaggcggcacacgcgggccacctcgcgccttgccagaaggcgctgctgttcaccggtggcctcccggaccacatcagcatcgacgtcgaactccaggagccgcaagatctgcagagcgcgatgtacctcgcccgggcctacgagcgccggaacgcaccagcacagctggccctgccggtgcctcctcagcgcaccccacgtcgcgctccaaggcagcagcctgcgctgctcgccccgacggcgccagctccagcgctcgcgggcacggccgccgcccgcgcgcgccccttcaagcgcctctcgccggaggagatggccctacgtcgcaagcaggggctctgttacaactgtgacgagccctacgcccgcgggcacaagtgcgcccgcctcttctacctagaggtcgcggactacatcgtcgaggaaccggatgacgccgccgggaccccgacgacggagcaggccgcgtttgatccggacgcgcccatgatctcgtgtgccaccatcacgggcatccgcattgaggaaacgatgcagctccacgtccgcgtcggcaagcagacgctcacggacctcctcgactcggggtccacgcacaacttcatcagcactgcagcagccgcacgcgtgggcctccagttcggcgacagtaagggcgcgcacgttgtcgtggccaatggcgaccgtgtcgcgtgccgtggcctcaccagcgacgtggctgtgcagattggcgcagagtcgtttcaggtggacctctactccatcccactcgagtgctacgacatggtccttggcatcgcgttcctccgcacgctcggacccgtcttgtgagacttccatgccctgcagatggccttccaccgccacggatgtcgggtgctctggcagggcattggtgctgcccgcccagcgcaccagcccgcggtccgcgcccacgcaggccacctctatgccgccaaggagaccgatgtagcgctcttggagcttcttctcgatgcatacgccaacatcttcgccgcgccatctggtctgccaccggcctgaccgtgtgaccaccggatacacctcaaggcctcgaccgagctggtggctatacgaccgtacagatacctgcagctgcagaaagatgaggcgaagccatgctgcaacaggggatcatccgcgccagcacctcgctgttttcggcccctgtcctgcttgtcaagaaggccgatgtgacatggcgtttctgcgtcgactacagggcgctgaacacggcgaccgtgaaagacaagttccccattccggtcgtcgaggagctcctcgacgagctgcacggtgccaagttcttcaccaagctcgatctgtggtccggctaccaccaagtgcgcgtgcatcccaacgatgtggccaagacggcgttccggacacaccgcggccaattcgagttcctcgtcatgccgttcggcctctcgaacgcgccgtcgacgttccaggcgctcatgaacttcatcctcaagccgttcctccgccggtgcgtccttgtttctttgacgacattctcatctatagtgtttcctggaccgcaaacttgcagcagctccgcgccgtcctcgacacccttcgggcgcaccacctccacatcaagcgctcgtagtgctccttcgcagaacaggtcgtgcactacctcgggcacatcatcacggcgaccggtgtggccatggacacgtccaaggtgtccgcggtccaggcgtggccgcagccccgctccaccaaggggctgcgcggcatcctcggcctcgctggttactatcggtgcttcatccgcaactacggcaccatcactgcgcccctaacgcagctgttgcgcaaggccggtttctagtggaccgacgcggcgaccgcgacctttaacgagctccaggcagacctagcggctgcaccggtcctccatttaccggacttcacacgggatttcatcgtcgactgcgacgcctttggctttggcgcggtgctacaccaaggggaaggaccgatcgcctacttcagccgcccgttcgccgctcggcatctcaagtccgcgacatatgagcgggagctcatcggtttggtgcaggccgtacggcattggcggccgtatctctgggcgcgctttcatcgttcgcaccgaccactacgccctcaagtttcctcctcgaccagcgcctctccacgatcccgcagaaccactgggtgagcaagctcttcggctatgtttttttggtgtattatcgacagggccacctcaacgtggtcgccgacgccttgtcatggtgggacgacgactcccccctgctggactccttggcagccgagcctgcgcactgagctcttcgccgacctgcgcactgagctgcaggcgagcccggagctgcgtgcccgatgagatgccgtcgcagcgggcgagcacggtcccagctggagcatgcgcgacggcctcatcctccacaagtcgcgtgttcgttcccgctacgacgtaggtcctcgacgacatcctccagcttgtgcacaccagggcgcacgagggcatccagaagactctccagcgcctcagggccgaattttacgtcgagcatgatcgtcgagtggtccgtgactcttcatccagctggcctcctacagcccctgccggtcccctccagagtttgggcggacatctccatcgacttcatcgaggccctgcccaaggtgcacggcaaaagcgtcatcctcaccatcgtggatcagttctccaagtacgcgcacttcatcgcgttggggcacccgtacaccgccgcgcccgtcacccgcgcattcttccacgacattgttcggctccacggcttctcggagtccatcgtcagtgatcgcgacccggtcttcaccggccgggtgtggcgggatctattccgccaggctggcgtccagctgcgtctcagcacggccttccatcctcaaacggatggccagtctgaggcggtgaacaagaccatcgccatgtagctgaggtgcctcaccggcgaccgtccccgcgactggctgccctgggctgagttctgccacaacacggcgtttcactccgcgctccggacttcgccgttcgccgtggtctacggtcggccgccctcggatctcctgccgtacacgcaggggcgggccgacatggcagtagtggatgctatgctggccagccgggatgagttcctagctgaagttcgagctcgccttcttcaagctcaagagcacgcacgttgtacgcacgacgccaaacacagtccgctccagctctccatcggcgagtgggtttggctccgtctcctgcatccccctaccaaggcgctggtcccgggcggtcttgggaagcttggtcccaagtttgccggcccttaccaagtcgtcgagaagaccaacgaagttgcatacaggctggctcttcctgcaggcgcgcgcatccacgacgtcttccatgttggggtgctcaagccattccgcggcactccactggtcaacgtcccggctttgcccccgctacgccatgggtggctgctgctgcgtcctgagcgcgttctccgttccagcctccgtcgcggggagtggttcgttctcgtgcagtgggccgacatgccagcgtctgaggccacttgggagcaccgggaggagttccgcgctgcgcaccctgacctccagctcgaggacgagctgttccccgaggaggggagagatgttatggtaggcaacacctaccaaaggaaacggaaggcgcgtggctgagggggagggcgcgcgcgcgtgcccagcccacgcggtgtctcagccgtgcggttaggacctagagtccaggagggttttgtttagaaagagagaaagtaggagatttgtttctgttttgtaatcagccaagactataaggctaggactagtccctttattgagattaagcctggattgagactttagtctcccctgggcgccaggtccctattccctatcttcctgttgctgctcccctagccagccgccgatcacggcgcctcccatccgccggcgtcgaactcgcctaccgccggccacctctcatccctaccacctccgtcctctccctcgccgtaacactgggcacccctgaggtgtaaaattttcttgtggcttggcttgcttcaaaaagcagtcctggatggctaatcaattgtccaaatatagtttaacacatcctgctgattgcttattgtgtgacccaagttgaagagaccatccagcatattttagtttcttgtatttttgctcggcaggtctggaccttggtattacagaagtttgaacttgcgttactagaacctggtcgatgtaacatgtttccccagctggtggtatggtgctaccaagaagatacctaaagagataaatcaaaagcacagggtggaccagactctaagaaggatgcagtcatcctgagggatgagaacaatcaacatattgcagcacacactttcacttttcgtgaacttgcggctgccactaagaacttcagacaagattgcttattgggtgagggaggttttggtcgtgtttataaaggacgtttggagaatgggcaggttgttgcagtgaagcaacttgatcgcaatggtcttcaaggaaacagggagtttctggttgaggttctaatgcttagtctgttgcaccatgacaacctagtcaacctaattggatactgtgctgatggggaccaacgtcttcttgtatacgagtttatgccattgggatcacttgaggatcatttgcatgatattccacctgaaaaggaacctctggactggaatacacgtatgaagattgctgctggtgccgccaagggcttagagtacttgcatgataaggcaagtcctcctgttatttacagggatttcaagtcctcaaacattctacttggtgaagggtttcatccgaagctatcagactttggacttgccaaacttggtcctgttggtgacaagactcacgtttcaacacgtgttatgggaacttatggctactgtgctccagagtatgcaatgacagggcagcttacagttaaatctgatgtatatagttttggtgttgtgttccttgaactgattactggccgcaaagcaattgacaacacaaaaccccacggagagcaaaacctagttgcatgggctcgtcctctattcaaggaccgcagaaaatttcctaaaatggctgatccattacttcagggtcgcttccccatgaggggactgtatcaagctttagctgttgctgcaatgtgtttgcaagagcaggctgctactcgcccctttataggtgacgtggtcactgctctgtcatacctagcttctcagacatatgatccaaatgcgcctgttcaacataatcggagtaattcatctactccgagggttagccgaggtggcgggagcaatgaccaacgccgtctccgctcaccgaatcaccattctccagatttgagaagggaagccaccgcagcatcaaaatacgaagctgaggttagcaggacaaactctggtagtggttctggtcgccggtctggcttggatgatgtggatatgtcaggttcacaattgggtagtcctgctcacgcaggaaggaagaggggatctcctaggactgctgaaagccagcgtgctatagcagagaccaaaacttgtggggaaaaatcaagagggagaaagtgaccaaactctcagagcagcattgaatgtatgagcagaatgctgaagcagaaggttcatccactcatcattcagaaagaaaagatgagttccttgctagcaccaaacaggacatcttggtcccttggtctttgtgaatagagctttccccttttcccttcaccggctgttgtcactgcttcgtgacttctccatacaaatatcattgccaccacaaccaccatcaaaactcccattcctggcatctattcctcatgaatgtgatcatcatgctatgagcctttgtcatcacggtgtataacaacattcggttcaaaatattgaggtgaggcaaaaatctgcactggggagcacaggatctcacccagtgggtatcttctgttgctgttgcatgatgggtgtcagcaatcacaccattgtcgagggatgtgatgttcttttcttgaatggtttgtacctggggttacagcagtccacctgtgtttgatacatctgtcttgtaacatttttgtgttgagttgtcagaacacatcctttatgctctctgcaccaaaaaactgtcgtgcccctttcatcatatcttatgcatgctgttctgaaaactgtttcttcctcctttttttggtgcgccaaactttcattcattagatgttgcatcagaactgggtgccaatcatgactggtgatatagccattcacttccaatgatcttttctagaggatactcccgctatgggtttgtgttggttaaacttttctaagtttgactaggtttgtagaaaacattagcatcatttgtatcttcagataaatttattatgaaaatatat

SEQ ID NO: 5997 - DNA, 2265 bp, Sorghum bicolor
gtctggaccttggtattacagaagtttgaacttgcgttactagaacctggtcgatgtaacatgtttccccagctggtggtatggtgctaccaagaagatacctaaaggataacactttaataaatcaaaagcacagggtggaccagactctaagaaggatgcagtcatcctgagggatgagaacaatcaacatattgcagcacacactttcacttttcgtgaacttgcggctgccactaagaacttcagacaagattgcttattgggtgagggaggttttggtcgtgtttataaaggacgtttggagaatgggcaggttgttgcagtgaagcaacttgatcgcaatggtcttcaaggaaacagggagtttctggttgaggttctaatgcttagtctgttgcaccatgacaacctagtcaacctaattggatactgtgctgatggggaccaacgtcttcttgtatacgagtttatgccattgggatcacttgaggatcatttgcatgatattccacctgaaaaggaacctctggactggaatacacgtatgaagattgctgctggtgccgccaagggcttagagtacttgcatgataaggcaagtcctcctgttatttacagggatttcaagtcctcaaacattctacttggtgaagggtttcatccgaagctatcagactttggacttgccaaacttggtcctgttggtgacaagactcacgtttcaacacgtgttatgggaacttatggctactgtgctccagagtatgcaatgacagggcagcttacagttaaatctgatgtatatagttttggtgttgtgttccttgaactgattactggccgcaaagcaattgacaacacaaaaccccacggagagcaaaacctagttgcatgggctcgtcctctattcaaggaccgcagaaaatttcctaaaatggctgatccattacttcagggtcgcttccccatgaggggactgtatcaagctttagctgttgctgcaatgtgtttgcaagagcaggctgctactcgcccctttataggtgacgtggtcactgctctgtcatacctagcttctcagacatatgatccaaatgcgcctgttcaacataatcggagtaattcatctactccgagggttagccgaggtggcgggagcaatgaccaacgccgtctccgctcaccgaatcaccattctccagatttgagaagggaagccaccgcagcatcaaaatacgaagctgaggttagcaggacaaactctggtagtggttctggtcgccggtctggcttggatgatgtggatatgtcaggttcacaattgggtagtcctgctcacgcaggaaggaagaggggatctcctaggactgctgaaagccagcgtgctatagcagagaccaaaacttgtggggaaaaatcaagagggagaaagtgaccaaactctcagagcagcattgaatgtatgagcagaatgctgaagcagaaggttcatccactcatcattcagaaagaaaagatgagttccttgctagcaccaaacaggacatcttggtcccttggtctttgtgaatagagctttccccttttcccttcaccggctgttgtcactgcttcgtgacttctccatacaaatatcattgccaccacaaccaccatcaaaactcccattcctggcatctattcctcatgaatgtgatcatcatgctatgagcctttgtcatcacggtgtataacaacattcggttcaaaatattgaggtgaggcaaaaatctgcactggggagcacaggatctcacccagtgggtatcttctgttgctgttgcatgatgggtgtcagcaatcacaccattgtcgagggatgtgatgttcttttcttgaatggtttgtacctggggttacagcagtccacctgtgtttgatacatctgtcttgtaacatttttgtgttgagttgtcagaacacatcctttatgctctctgcaccaaaaaactgtcgtgcccctttcatcatatcttatgcatgctgttctgaaaactgtttcttcctcctttttttggtgcgccaaactttcattcattagatgttgcatcagaactgggtgccaatcatgactggtgatatagccattcacttccaatgatcttttctagaggatactcccgctatgggtttgtgttggttaaacttttctaagtttgactaggtttgtagaaaacattagcatcatttgtatcttcagataaatttattatgaaaatatat

SEQ ID NO: 5998 - DNA, 2400 bp, Setaria italica
ccctctccctctctctcttcactctgtccgagctgacttttaccctcgacaccttctctgtccttggctcatccccggccccttcccccaattcgccgacccgccgctcccgaatcccatccaaatttcctcttcatctttcaaagatcggattttgggaggggcaccacccccagatcggagaggaatccccgttccatctggtgggtcggcctccgctgcctgttttcttggctattatccccttcccaagggcggctcttggatgggctgcctgccgtgcttcgggtcggctggcgagggggcggccaagaagggcggcgcgcgcaaggacggctcgtcggatcgccgcgttacccgcgtcggatcagataaatcaaaaccacagggtggatcgggttctaagaaggatgcagtcatcctgagggaggggaacaatcaacatattgcagcacacactttcacttttcgtgaacttgctgctgccacaaagaacttcagacaagattgtttattgggtgaaggaggttttggccgtgtttataaaggacgtttagagaatgggcaggtcgttgcagtgaagcaacttgatcgcaatggccttcaaggaaatagggagtttctggttgaggttctgatgctgagtctattgcaccatgacaacctggtcaacctaattggatactgtgctgatggggaccaacgtcttcttgtatatgagtttatgccattgggatcacttgaggatcatttgcatgatattccacctgataaggaacctctggactggaatacacggatgaagattgctgcgggtgctgccaagggcttagagtacttgcatgacaaggcaagtcctcctgttatttacagggatttcaagtcctcaaacattctacttggtgaagggtttcatccaaagctatcggactttggccttgccaaacttggccctgttggtgacaagactcatgtttcaacacgtgttatgggaacttatggctattgtgccccagagtatgcaatgacagggcagcttacagttaaatctgatgtatatagttttggtgttgtgttccttgaactgattactggccggaaagcaattgacaacggcaagccccatggagagcaaaacctagttgcatgggctcgtcctctattcaaggaccgccggaaatttcctaaaatggctgatccgttacttcagggccgcttccccatgaggggcctgtatcaggctttagccgttgctgcaatgtgtttgcaggagcaagctgctacacgcccctttataggtgatgtggtaactgctctttcatacctagcttctcagacgtacgatccaaatgcacctgttcaacataatcggagcaattcatctactccgagggctagccgaggtggcgggagcaatgaccaacgccgtctccgctcaccgaatcaccattctccagatttgaggagaagggaagcaaccacaggaccaaaatatgaagctgaggttagcaggacaaattctggtagtggttctggtcgtcagtctggcttggatgacgtggatatgacagtttcgcaattgggtagtcctggtcatggaggaagaaagagggaatctcctaggactgcggaaaggcagggtgccattgcagaggccaaaacatggggggagaattcgagagggagaaattgactaaaatctcagggcattgaaagtatgaatgagcagaactctgaagcagaatgttcaatccactcatcattcagaaaaaaaaacattgatgagttccttgccagcaccaaacaggacgattaggaacattgcatctgttccatcttggtcccttggtcatgtgaatagagctttcctttttccgctttcctggctattgccactgcttcgcagcttctccatacaaatatcaccaccaccaccaccaccaccaccagaactaccgccaaaacccattcctggcgtgggaatgtgatcatgcttatgaacctttgtcgacacggcaaagaacaacattcggctgaaaatgtaaagagcaaagggaaaatctgctctaaggagcaaaaaacaacattgttgctgttgcatggtgggtgttggcggtggcaccattgttggagtatagagcttatgtcgagtctgagtactgagggttgagggatgtggtgttcttttcctgaagggtttgtaccggggttacagcagtccacctgtgtttggtacatctgtcctgtgacatttttgttttgagttgtcataacacatcctttatgttatctgtatcagctaactgttgtgccccttgcatcttatgcatgctgtttcgaaaactggttttgttccaccttccttttttcttgaactaaaacttgcaatcattatatttg

SEQ ID NO: 5999 - DNA, 1352 bp, Secale cereale
gctcgggggaccggtcccttggagcgagcggagatcctcgcctcgccgggaggggatcccgcgtcgtccggtcacgccgcggcggcctctctcctgtccgcgtccgccacgcgttttcctggttccgggcgagggaggggagggggagcgcgcctggatgagctgcttcttctgcttcggcccggccgtcgaggcggaggccggcaagccggggcccgacgccaaggacccccgcgccgccgccccggatcgcgccggatcagataaattgaggttgcagggtggatcagaccctaagaataatcatctagccctccctcgggatgggagcagccaaaacatcgccgcacagattttcacttttcgtgagcttgctgctgccactaagaacttcagacaagattgcatgttgggcgagggaggttttggacgtgtatacagaggtcgcctggagagcgggcaggctgttgctgtgaagcaacttgatcgtaacggtctccaaggaaatagagaattccttgttgaggtcctcatgctcagtctcttgcatcacactaaccttgtcaatctaattggttattgtgctgatggtgaccaacgcctccttgtttatgagtttatgccactgggctcattagaagatcacttgcatgatgtgccacctgagaaggaacctcttgactggaacacacggatgaagatagctgcaggtgcagccaagggcttagagcatcttcatgacaaggccagccctcctgttatttaccgggatttcaaatcgtcaaacattcttcttggtgaagggtttcacccgaagctgtctgactttggccttgcaaaactcggtccagttggtgacaacactcatgtttcaacacgtgtgatgggaacttatggctactgtgccccagaatatgctatgactgggcagctcacagtgaaatcggatgtctatagctttggtgttgttttccttgaactgattacaggacgcaaagcaatcgacaacaccaaaccccagggggagcaaaacctggtggcatgggctcgtccactcttcaaggatcgcaggaagtttcctaagatggctgacccaatgcttcaaggccggttccccatgaggggtctgtatcaggctttagctgttgctgccatgtgtttgcaagagcaagccacaactcgtcctcatataggggatgttgtcactgctctctcatatctagcttctcagacatatgatccaaatgccccaatcaacatactcggagcaattcatcgaccccgagggccagaaatgtcggtgggcggaacagcgaacagcgcaacggccgctcgccaaatcatcattctcc

SEQ ID NO: 6000 - DNA, 2417 bp, Zea mays
gtcctgcttgctctctctagagctgactttaggacattggaggctttgacgccttcggtgtccttgcgtccgcgtcgtgtccgcgcgcctgctgcccgccaacccgcctctcccaaatcccatccaaattcctccgcgtctttcgaagatcatattttgggaggggcaccgcccccagatcggggaggaatccccattccgtctggtgggtcggtctcccctgtccgtttttggctcttttcccctctcacaagggcggctcttggatgggctgcctgccgtgcttcgggtcggctggtgagggggcggccaaggagggcggtgcgcgcaaggacggtacgtcggatcttcgcgtcacccgggtcgaatcaggtctggaccttggtattacagaagcttggacttgtggcactagcacctgattctgatgtaacaagtttccccagctggtggtgtggtgctatcaagaagatacctaaggacataaatcaaaaccacagggtggactagactctaagaaggatgcagtcattttgagggaggggaataatcaacatattgcagcacacactttcacttttcgtgaacttgcagctgccactaagaacttcagacaagattgcttattgggtgagggaggttttggtcgtgtttataaaggacgtttggagaatggacaggttgttgcagtgaagcaacttgatcgcaatggccttcaaggaaacagggagtttctggttgaggttctaatgcttagtctgttgcaccatgacaatctagtaaacttaattggatactgcgctgatggagaccaacgtcttcttgtatacgagtttatgccattgggatcacttgaggatcatttgcatgatattccacctgataaggaacctctggactggaatacacgtatgaagattgctgctggtgccgccaagggcttagagtacttgcatgataaggcaagtcctcctgttatttacagggatttcaagtcctcaaacattctactcggtgaagggtttcatccgaagctatcagacttcggccttgccaaacttggccctgttggtgacaagactcacgtttcaacacgtgtcatgggaacttatggctactgtgctccagagtatgcaatgacagggcagcttacagctaaatctgatgtatatagttttggtgttgtgttccttgaactgattactggccgcaaagcaattgacaacacaaaaccccatggagagcaaaacctagttgcatgggctcgtcctctattcaaggaccgcagaaaattccctaaaatggctgatccgtcacttcagggctgtttccccatgaggggactgtatcaagctctagctgttgctgcaatgtgtttgcaagagcaggctgctacccgcccctttataggtgacgtggtcactgctctttcatacctagcttctcacacatatgatccaaatgcgcctgctcaacataatcggagtaattcatctactccgagggttagccgaggtggtgggagcaatgaccaacgccgtctccgctcatcaaaccaccactctccagatttgagaagggaagtcaccacagcatcaagatacgacgatgaggttagcagggcaaactctggtactggttctggtcgccggtctggcttggatgatgcggatatgtcaggctcacaattgggtagccctgctcacactggaaggaagaggggatctcctaggacttctgaaagccagcatgctatagcagaggccaaaacatatggggaaaattcaagaggcagaaagtgaccaaactctcagagcagcattgaccgtatgagcagaatgctgaaccagatggttcatccattcatcattcatagaaaaaaaaaatgataagttccttgctagcgccagacaggaacattgcatcagtccatctaggtcccttggtctttgtgaatagagctttcctcttttccctttacgggctattgccactgcttcttaacttctccatacaaatatcattgccaccacaaccaccatcagaactcccattcctgtcatctattcctcatgaatgcgatcatcatgcttacgagccttcgtcgtcacggtgtataacaacattcggttcacaatgtggaggtaaggcaaacatctgctctggggagcacaggatctcatccagttgggcatcttctgttgctgttgcatgctgggtgtcagcagtcacaccattgtcgaggggtgtgatgttctttttcttgaatggtttgtacctggggttacagcagttcacctgtgtttgatacatctgccttgtgacatttttgtgttgagttgtcggaacacatctattatcatctctaccataaaattgttgtggcccttgcatcttatcctatgcatgctgttttg

SEQ ID NO: 6001 - DNA, 975 bp, Triticum aestivum
tatgatattgattgtgtacctgatgcttacagaagcaataagcaggcttatatcaaagacagctcgatttcaaagaaatgtattcagaaagtgaaggttcaataccatatgaaagctccaatttatgtgtattacgaactcgacaacttctaccagaatcatcgtaggtatatcaaaagtagaagcgataagcaactacgccatgggctccaatacactgatagctcatgcagtccgatagaaaggagcaacggccttccagttgttccctgtggattgattgcctggagcttgttcaatgatacttatgattttacccgtgggtccatgggattgatggttgataggaaaaacatttcatggagaagtgatcgggaacataagtatggcaaggatgtctatcctttcaactttcagaatggatccttgattggaggaggaaaacttgaccctgatataccactaagcaatcaggaagatcttattgtgtggatgcgcgcagctgctcttccccagttccgaaagctgtatggtgtcattgaagaggatatacaagctgatgaaaccattaccatgcacataacaaacaattacaatacctacagttttggtggaaagaaaagcctggttcttacaacgtcaacctggctaggcggcaagaatgactttcttggatatgcataccttatcaccggttcctcgagcattttcttgtgcattctctttgctctgatccatgtgaaaatcccaaggccacatggcgatgctgcttacctatcttggagcaggaaaaacggcaataactaagcttccgtgcatagttttcttgtatgtaagagctagtaggatagcacccctttgccggaggttccccgtggcgttctgtctcgacgagcgcaccctgtctcgagggaaccggaatatagcaggtccaggtttcatgcacacttggatgcagactgctgaggatatatc

SEQ ID NO: 6002 - DNA, 796 bp, Lolium multiflorum
agcaggcttatatcaaagacagctcaatttcaaagaaatgtattcagaaagtgcaggttcggtatcgtatgaaagctccaatatatgtctattatgaactagacaatttctaccagaatcatcgtagatatgtcaaaagtagaagcgataagcaactacgccgtgggctcgaacacactgaaagctcatgcagtccaatagaaaggagcaatggccttccaattgttccctgtggactgattgcctggagcttgttcaatgatacttatggttttacccgtggatcaaaggatataatggttgataggaaaaatatttcatggagaagtgatcgggaacataagtttggcaaggatgtctatcctttcaactttcagaatggatccttgatcggtggaggaaaacttgaccctaatgtaccactgagcaatcaggaagatcttattgtgtggatgcgcacagctgcccttccccaattccgaaagctctacggtgtcattgaagaggatattcaagctgatgaaaccattaccatgcacataacaaataattacaacacctacacttttggtgggaagaaaagcctagttcttacaacatcaagctggctgggtggcaagaatgactttcttggatatgcatatatgatcactggttcactgagcattttcttgtccattctctttgctctgattcatgtgaaagttccaaggccacatggtgatgctgcttatgtatcttggagtaggacgaaacagcaatagctgaggtttccatctagttgcttgtgtaaggt

SEQ ID NO: 6003 - DNA, 1203 bp, Triticum aestivum
ttcaagcttcaaacagagttgcagaaatcgttcaccgttatgatattgattgtgtacctaatgcttacagaagcaataagcaggcttatatcaaagacagctcgatttcgaagaaatgtattcagaaagtgaaggttcaataccatatgaaagctccaatttatgtgtattatgaactcgacaacttctaccagaatcatcgtaggtatatcaaaagtagaagcgataagcaactacgccatgggctccaatacactgatagctcatgcagtccgatagaaaggagcaacggccttccagttgttccctgtggattgattgcctggagcttgttcaatgatacttatgattttacccgtgggtccatgggattgatggttgataggaaaaacatttcgtggagaagtgatcgggaacataagtatggccaggatgtctatcctttcaactttcagaatggatccttgattggaggaggaaaacttgaccctgatataccactaagcaatcaggaagatcttattgtgtggatgcgcgcagctgctcttccccagttccgaaagctgtatggtgtcattgaagaggatatacaagctgatgaaaccattaccatgcacataacaaacaattacaatacctacagttttggtggaaagaaaagcctggttcttacaacgtcaacctggctaggcggcaagaatgactttcttggatatgcataccttatcaccggttcctcgagcattttcttgtgcattctctttgctctgatccatgtgaaaatcccaaggccacatggcgatgctgcttacctatcttggagcaggaaaaacggcaataactaagcttccgtgcatagttttcttgtatgtaagagctagtaggatagcacccttgccggaggttccccgtggcgttctgtctcgacgagcgcaccctgtctcgagggaaccggaatatagcaggtccaggtttcatgcacacttggatgcagactgctgaggatatatctagtcggccatggttcgctgatgcagaatttaggatggccctgcgacggcgtccttggagaaaactagggtcgtgtaaaactgatatatgtatgtataaagcgccatataaaactgatgctatatgaatatacatacaatctttcagcttcagtttcactttcacatggacagtgaagcatggcgttgcctc

SEQ ID NO: 6004 - DNA, 2032 bp, Triticum aestivum
acaagatctcctggctggaggcgaagatggacgcccgcagcctgtttgacgagtttgtgcaggatgaatcagggcagttggaagcccactggcttgtcaggagatgcaaagagctgtgggcaatggccgcgcagaggttcgggtttactgatgatgagaggctaaggaagctgcagacaaggaaactcgtgattgggagcaggctgtcggattacaaggaaggccgtgcacctggtgctggcatagctttcattgtgttcaaggatgtgtacacggcaaacaaggctgtgagggatttccgaatggaaaggaagaagacacccattggcaggttcttcccagtgatggagctccagcttgagaggagccgatggagagtggagagggcgccaccagcatcagatatctactggaatcatcttgggatgaacaagacctcgctagccttgcggcggattgcggtcaacacctgcctcattgtaatgctcctgttcttcagttcgcccttgtcaatactcagtggaatgcaaaacgcagcacggatcatcaatgtggaggctatggataatgccaaatcatggattgtttggcttcaaggctcaagctggttctggacaataatctttcagtttctacccaatgtcctcatcttcgtgagcatgtatattatcatcccatcagtactctcgtacttctccaagtttgagttccatctgacagtgtcgggggagcagagagctgcattgctgaagatggtttgcttcttccttgttaatctcatcttgttgcgtgcgctggtggaatcgtcacttgaaagttggattcttagcatgggacggtgctacttagatagtgctgattgcaagcagattgaacattacctgagcccatcattcttgtcgagatcttcactttcttccctggcgttcttaatcacatgcacctttctgggaatatcttttgatctgctggctccaatcccttggataaagcatatactgaagaaattcagaaagaatgatatggtccagttggtccctgaagaaaatgaggagtacagatctatgaacaatgacgaagaaacaaatggtctggtatcgcctctaatgtctgagagagaagacagtgacattctgaatggtttcgaggggcatgatctttccatgtacccaataaaccggagcttccacatgccaaagcagaaattcgactttgcacaatactatgcatttgacatcacaatattcgcgctcacgatgatctactcactgtttgctccgcttgtggttcctgtcggtgcagtatactttggctaccgttaccttgtggacaagtacaatttcctgttcgtgtacagagtcagaggatttcctgcaggcaatgatgggaagctgatggatagggtgctgtgcatcatgcaattctgtgttatcttctttcttgctgctatgttgctcttcttcgcagtccagggtgattccatgaagctgcaggctatatgtactcttgggctgttagtgttctataagttgctgccgtctggaagtgatcgcttccagccgtccttgttagaagggatgcagtcagttaatagctttgtagacggtccaacggattatgaagttttttcacaacctgacctggattggaatctgtatcaatcctgaagaaaactcaaggtcaatacacacttgtttcatttcgaagtcatctactatcaccagagcttcacattgtacatctcttgttcttttgtatagttgatgtagattaactccttttttctctagccggtctgttcgttttggaaatgacaaacacttcaatttagatcatgtaggcatgagctgtctatctgaattgcatgaaaaaacatcaggcattatcatacatgatcagttcatcatcttgagattctccatctaacgcaaaaagccccaaccgcagcagatacatcagtgcatgccacatttattctttccatcttttctgtattagtgttccaactgtaagaggattattgttatgtttg

SEQ ID NO: 6005 - DNA, 1803 bp, Secale cereale
gtgggggaaggtccgcaacaagatctcctggctggaggccaagatggacgcccgcagcctgtttgacgagtttgtgcaggacgaatcagggcacttggaagcgcactggcttgtcaggagatgcaaggagctttgggcaatggcggcgcagaggttcgggtttactgatgatgagaggctaaggaagctgcagacaagtaaactcgtgattgggagcaggctgtcggattacaaggaaggccgcgcacctggtgctggcatagctttcgttgtgttcaaggatgtgtacacggcaaacaaggctgtgagggatttccggatggaaaggaagaagacacccattggcaggttcttcccagtcatggagctccagcttgagaggagccgatggagagtggagagggcgccaccggcatcagatatctactggaatcatctggggatgaacaagacctcactagccctgcggcggattgcggtcaacacctgcctcattgtaatgctcctgttctttagttcacccttgtcaatactcagtggaatgcaaaacgcagcacggatcatcaatgtggaggctatggataatgccaaatcatggattgtttggcttcaaggctcaagctggttctggacaataatctttcagttcctacccaatgtcctcatctttgtgagcatgtatattatcatcccgtcagtactgtcgtacttctccaagtttgagttccatctgacagtgtcgggggagcagagagctgcattgctgaagatggtttgcttcttccttgttaatctcatcctgttgcgtgccctggtggaatcgtcgcttgaaagttggatccttagcatgggacggtgctacttagacagtgctgattgcaagcagattgaacattacctgagcccatcattcttgtcgagatcctcactttcttccctggcgttcttaatcacatgcacctttctgggaatatcttttgatctgttggctccaatcccttggataaagcatatactgaagaaattcaggaagaatgatatggtccagttagtccctgaagaaaatgaggagtacagatctgtggacaatggcgaggaaacaaatggtctgatatcgcctctaatgtctgagagagaagacagtgacattctgaatggtttcgaggggcatgatctttccatgtacccaataaaccggagcttccacatgccaaagcagaaatttgactttgcacagtactacgcgtttgacatcacaatattcgcgctcacgatgatctactcactgttcgctccgcttgtggttcctgtcggtgcagtatactttggctaccgttaccttgtggacaagtacaacttcctgtttgtgtacagagtcagaggatttcctgcaggcaatgacgggaagctgatggatagggtgctgtgcatcatgcaattctgtgttatcttctttcttgctgctatgttgctcttcttcgcagtccagggcgattccatgaagctacaggctatatgtactcttgggctgttagtgttctataagttgctgccatctggaagtgatcgattccagccgtccttgttagaagggatgcagacagttaatagctttgtagatggtccaacggactatgaagttttttcacaacctgacctggattggaatctgtatcaatcctgaagaaaactcaagccatccttgttaatagggacgcagacagttaaatagctttgtagacgctccaacggattatgaagttttttcacaacctgacctggattggaatctgtatcaatcct

SEQ ID NO: 6006 - DNA, 2361 bp, Secale cereale
acggccccctcagggagtacttcgagcacaagtaccccggcaaggtgtaccgcgtcattgtgcccttcgacctctgcacgctcgagtacctcgccgacgagtgggggaaggtccgcaacaagatctcctggctgaggcaagatggacgccgcagcctgtttgacgagtttgtgcaggacgaatcagggcacttggaagcgcactggcttgtcaggagatgcaaggagctttgggcaatggcggcgcagaggttcgggtttactgatgatgagaggctaaggaagctgcagacaagtaaactcgtgattgggagcaggctgtcggattacaaggaaggccgtgcgcctggtgctggcatagctttcgttgtgttcaaggatgtgtacacggcaaacaaggctgtgagggatttccggatggaaaggaagaagacacccattggcaggttcttcccagtcatggagctccagcttgagaggagccgatggagagtggagagggcgccaccggcatcagatatctactggaatcatcttgggatgaacaagacctcactagccttgcggcggattgcggtcaacacctgtctcattgtgatgctcctgttctttagttcacccttgtcaatactcagtggaatgcaaaacgcagcacggatcatcaatgtggaggctatggataatgccaaatcatggattgtttggcttcaaggctcaagctggttctggacaataatctttcagttcctacccaatgtcctcatctttgtgagcatgtatattatcatcccgtcagtactgtcgtacttttccaagtttgagttccatctgacagtgtcgggagagcagagagctgcattgctgaagatggtttgcttcttccttgttaatctcatcctgttgcgtgccctggtggaatcgtcgcttgaaagttggatccttagcatgggacggtgctacttagacagtgctgattgcaagcagattgaacattacctgagcccatcattcttgtcgagatcctcactttcttccctggcgttcttaatcacatgcacctttctgggaatatcttttgatctgttggctccaatcccttggataaagcatatactgaagaaattcagaaagaatgatatggtccagttagtccctgaagaaaatgaggagtacagatctgtggacaatggcgaggaaacaaatggtctgatatcgcctctaatgtctgagagagaagacagtgacattctgaatggtttcgaggggcatgatctttccatgtacccaataaaccggagcttccacatgccaaagcagaaatttgactttgcacagtactacgcgtttgacatcacaatattcgcgctcacgatgatctactcactgtttgctccgcttgtggttcctgtcggtgcagtatactttggctaccgttaccttgtggacaagtacaacttcctgtttgtgtacagagtcagaggatttcctgcaggcaatgatgggaagcctgatggatagggtgctgtgcatcatgcaattctgtgtcatcttctttcttgctgctatgttgctcttcttcgcagtccagggcgattccatgaagctacagctatatgtactcttgggctgttagtgttctataagttgctgccatctggaagtgatcgattccagccgtccttgttagaagggatgcagacagttaatagctttgtagatggtccaacggactatgaagttttttcacaacctgacctggattggaatctgtatcaatcctgaagaaaactcaagccatccttgttaatagggacgcagacagttaaatagctttgtagacgctccaacggattatgaagttttttcacaacctgacctggattggaatctgtatcaatcctgaaggaaatactcaagccatccttgttaatagagacgcagacagttaaatagctttgtagatgatccaacggattacgaagttgttcacaacctgacctggattggagtgtgaatcaatcctgaagaaaaactcgaaggtcaatacacacttgtttcatgacttagacatctatagtatcaccggagcttctcattgtacgactctcagttgtttctgtacagtaatctaggatacctccctttttttctagctggaactgttgtattggaaaatggcatacacttcaatttggatcatgaaagcatgagctgtcattcggaaattccatgagagtatatctggtgtagtggtggtgtcctattcctacaggattagttcaccatcttgagactttttgtcctttaattgcgtccatctaacgcaaaggcccaaactcagcagatgtatcagcgcatgcca

SEQ ID NO: 6007 - DNA, 1627 bp, Pennisetum glaucum
tgagaggaagaagaccccgatcggcaggtttttccctgtgatggagctccagctcgagagaagtcgatggaaggtggagagagcaccgccggcttcagatatttactggaatcatctaggtcttagcaagatttcttcgaggttgaggaggattgcagttaacacctgcctactcttaatgctattgttcttcagttcgcccttggccatcatcagcgggatgcaaagcgcggcacggatcatcaatgtggaggctatggatcacgccaaatcatggcttgcatggcttgaaggctcaagctggttctggaccataatatttcagtttctccccaatgttctcatatttgtgagcatgtatatcatcatcccatcagtgttgtcttacttttccaagtttgagtgccatctgacggtgtcgggggaacagagggctgcattgctgaagatggtttgcttcttccttgttaatctgatcctgttgcgtgcgctggtggaatcatcacttgaaagttggatacttagcatggggcgatgctacttggatggcccagattgcaagcagattgaacactacttaagcccgtcctttttatcaagatcatcactttcatcccttgcgttcttgatcacgtgcacctttctggggatatcttttgatctgctggcaccaatcccttggataaagcatataatgaagaagtttaaaaagaatgacatggtccagttggtccctgaagaaaatgaggactatctaatgatgcagaatggtgaagaaactaataatctggcggcacctctgatccctgagagagaagacagtggccttctggatagtatcgaggggcatgatctttctctatacccattaaacaggagcttccacatgccaaagcagaaatttgactttgcacagtactatgcttttgacattacgatatttgcactcacaatgatttactccctgtttgctccactcgtggttcctgtgggcgcggcatacttcggctaccgatatcttgtggacaagtacaatttcttgtttgtctacagagtcagaggatttcctgctgggaatgatgggaagctgatggacagagtgctgtgcatcatgcaattctgtgtgatcttcttccttgctgcaatgctgctcttctttgctgttcagggtgactccatgaagctacaggctatatgtactcttgggatgctagtgttctataagctgctgccttctagaagtgatcgcttccagccatctttgttagaagggatgcagacagttaatagctttgtagatggtcccacggattacgaagctttttcacaacctgacctggattggaatatgtatcaatcctgaagaaaaaactcaagatcaatacactcttttgtttcgttacaatgacatcttttagcacttgatgagatccctagggtaccaaactgtcactcattctcactgtacagctgtgtagattatctgtcccttttttttgttttgaggtgacaaacacttgcaatttttgatcatggacctggtctatctaaattctaaacatacttcaagttattgtacaacatgtggccatcttgatttcctttaatatgatctaagctcctgtga

SEQ ID NO: 6008 - DNA, 857 bp, Pseudoroegneria spicata
  misc_feature (31)..(34): n is a, c, g, or t
  misc_feature (826)..(828): n is a, c, g, or t
aaatttagaaagaatgatatggtccagttannnnctgaagaaaatgaggagtacagatctatgaacaatggcgaagaaacaaatggtctgatatcgcctttaatgtctgagagagaagacagtgacattctgaatggtttcgaggggcatgatctttccatgtacccaataaaccggagcttccacatgccaaagcagaaattcgactttgcacaatactacgcgtttgacatcacaatattcgcgctcacaatgatctactcactgttcgctccgcttgtggttcctgtcggtgcagtatactttggctaccgttaccttgtggacaagtacaatttcctgtttgtgtacagagtcagaggatttcctgcaggcaatgatgggaagctgatggatagggtgctgtgcatcatgcaattctgtgtcatcttctttcttgctgctatgttgctcttcttcgcagtccagggcgattccatgaagctacaggctatatgtactcttgggctgttagtgttctataagttgctgccgtctggaagtgatcgcttccagccgtccttgttagaagggatgcagacagttaatagctttgtagatggtccaacggattatgaagttttttcacaacctgacctggattggaatctgtatcaatcctgaagaaaactcaaggtcaatacacacttgtttcatttcaaagtcatctactatcaccagagcttcacattgtacttctcttgttcttttgtatagttgatgtagattaactcctttttttctactagctggatctgttcgttttggaaatgataaacacttcaannnagatcatgtaggcatgagctgtttatcta

SEQ ID NO: 6009 - DNA, 694 bp, Leymus cinereus x Leymus triticoides
ccgttgctgtcgggtccagttagtcccagaagaaaatgaggagtaccgatctatgcacaatggcgaagaaacaaatggtctgatatcgcctctaatgtctgagagagaagacagtgacattctgaatggtttcgaggcacatgatctttccatgtacccaataaaccggagcttccacatgccaaagcagaaattcgactttgcacaatactacgcgtttgacatcacaatatttgcgctcacgatgatctactcactgtttgctccgcttgtggttcctgttggtgcagcatactttggctaccgttaccttgtggacaagtacaatttcctgttcgtgtacagagtcagaggatttcctgcaggcaatgatgggaagctgatggatagggtgctgtgcatcatgcaattctgtgttatcttctttcttgctgctatgttgctcttcttcgcagtccagggcgattccatgaagctacaggctatatgtactcttgggctgttagtgttctataagttgctgccgtctgggagcgatcgcttccagccgtccttgttagaagggatgcagacagttaatagctttgtagacggtccaacggattatgaagttttttcacaacctgacctggattggaatctgtatcaatcctgaagaaaaattcaaggtcaatacacacttgtttcattacga

SEQ ID NO: 6010 - DNA, 2137 bp, Triticum aestivum
gacagttcccagtttcgcctccatttcaatttcaaccccgtctcctctccattaactcgccactcctcgctgcgctgcgcagttacacccaccaaacgcacacgaggggaggcagtgatcggcgtcgtggcggcgagatggcggcggcgacgacgatgacgtggcacgaggagctggccacgctcgtcggcgacacgggcgcgcgcctccctgccgccgcagcgccggcgcccaattcggcggcggcggtcggggccggctggtacggggaggaggaggaggggaagatggaggaggggtgggcgcagcaggcgaggggcttcgccgagtccacggcggagatgctgcgggagctggggctcggcgtgtgggacgtcgccgcgcagagcctcgccggcgccgaggacagcgagctcgcgcggaggctccggcggccggcggcggccgcgggcaagcgcctcagcttcatgaacgagtacctccccgaggaccgcgaccccgtcaggtgctgggccgtcgttgccgccgtcgcattcgtcgcgctcctcgtgttaggtgtaggaagtagcgatgataccccagtggagcaaccgaagaaactttacataagccccccaaatgctaaaagattccaacttcctgatggacggcatctggcttacgaagaaaaaggaatttcagctgacagggcaagattttcactggttgctccccattcatttctttcgtcaaggctagcaggaatccctggaatcagctcatcccttctagaggaatttggggcacgacttgtgacctatgatcttcctggttttggtgaaagtgatcctcatccaggccgaaatctgaattcttctgcattagacatgcttcatttggccgatgcccttgggattgtggacaagttctgggttgtaggctattctggaggtggcatgcatgcttggagtgctctgcgctacattcctgaccgggtggcaggtgcagcaatgttcgcccctatggcaaatccatatgactccaagatgaccaaggatgagaaacgtaaaatatgggacagatggtcaactaaacgaaaactaatgcacattttagctcggaggttcccatcactattacgcctcttctatcaccgaagcttcctttctggaaagcaaggacagcctgagagttggttatcattgtcaatgggaaagaaggacaaaactttactggaagctcctacattcaacgcattctgggaaaaggatgttgcagagtctgtgcgccagggagatgcgcagccatttgtcgaggaagctgtgctgcaagtatctgattggggtttcagcttgtcagacattcaaatgcagaagaaagaggatcagggagtatttgaatttatcaagtctctgttcagtcaggctgaacgagagtgggtgggatttctgggcccaatccacatttggcagggaatggatgaccgggtggtgcccccatcggcgaccgagtttgcccggaggatggttccgggggccactgtacacaagcttctggacgaaggccacttctcatacttctgtttctgcgacgagtgccaccggcagatattctccaccctgtttggcaccccgcagggccctctgaatcctgcaccggaatccagcgaagcggccccggaaccggcggaagaaacaagccctgcatacgacgaagaagttgcagagcaggagcaggaaacatcaggcctggcctgaccatgttcagcctcaggatcatgagtatagatacaagagtacaacaagactgttactagtaggaacctcaaagaaaagataggcttttccttccttgccgccagtggagaaacgagtataaaacgaagctctgggtctgtgtctgggtggggggctgcaccgattgtgctggttcagtataatgtacaggaaaagtcttgaaaggtctgcgcaaaaaatcacctgcttggtgcgccgctagcgtagctctctcgatgttgggcattcgattggcctgtgattgcgcgacgcgcttgcgtacctattctgcacatttgcttaccatgtgatgtaatgggatggttggttgtattgctctctcagctatgctatgcagaagtaaagtaaccttggctgtgcca

SEQ ID NO: 6011 - DNA, 2050 bp, Triticum aestivum
gagatggcggcggcgacgacgatgacgtggcacgaggagctggccacgctcgtcggcgacacgggcgcgcgcctccctgccgccgcagcgccggcgcccaattcggcggcggcggtcggggccggctggtacggggaggaggaggaggggaagatggaggaggggtgggcgcagcaggcgaggggcttcgccgagtccacggcggagatgctgcgggagctggggctcggcgtgtgggacgtcgccgcgcagagcctcgccggcgccgaggacagcgagctcgcgcggaggctccggcggccggcggcggccgcgggcaagcgcctcagcttcatgaacgagtacctccccgaggaccgcgaccccgtcaggtgctgggccgtcgttgccgccgtcgcattcgtcgcgctcctcgtgttaggtgtaggaagtagcgatgataccccagtggagcaaccgaagaaactttacataagccccccaaatgctaaaagattccaacttcctgatggacggcatctggcttacgaagaaaaaggaatttcagctgacagggcaagattttcactggttgctccccattcatttctttcgtcaaggctagcaggaatccctggaatcagctcatcccttctagaggaatttggggcacgacttgtgacctatgatcttcctggttttggtgaaagtgatcctcatccaggccgaaatctgaattcttctgcattagacatgcttcatttggccgatgcccttgggattgtggacaagttctgggttgtaggctattctggaggtggcatgcatgcttggagtgctctgcgctacattcctgaccgggtggcaggtgcagcaatgttcgcccctatggcaaatccatatgactccaagatgaccaaggatgagaaacgtaaaatatgggacagatggtcaactaaacgaaaactaatgcacattttagctcggaggttcccatcactattacgcctcttctatcaccgaagcttcctttctggaaagcaaggacagcctgagagttggttatcattgtcaacgggaaagaaggataaaactttactggaagctcctacattcaacacattctgggaaaaggatgttgcagagtctgtgcgccagggagatgcgcagccatttgtcgaggaagctgtgctgcaagtatctgattggggtttcagcttgtcagatattcaaatgcagaagaaagaggatcagggagtatttgaatttatgaagtctctgttcagtcaggctgaacgagagtgggtgggatttctgggcccaatccacatttggcagggaatggatgaccgggtggtgcccccgtcggtgaccgagtttgccaggaggatggttccaggagccactgtccacaagcttctcgacgaaggccacttctcatacttctgtttctgcgacgagtgccaccggcagatattctccaccctgtttggcaccccgcagggccctctcaatccggcaccggaatccagtgaagtggccccggaaccggcggaagaaacaagccctgcatacgaagaagttgcagagcaggagcaggaaacatcagggctggcctgaccatgttcagcctcaggatcatgagtatagatacaagagtacaacaagactgttactagtaggaacctcaaagaaaagataggcttttccttccttgccgccagtggagaaatgctgaccgattaggcggactgagtagagcgtcgagtataaaacgaagctctgggtctgtgtctgggtggggggctgcaccgattgtgctggttcagtataatgtacaggaaaagtcttgaaaggtctgcgaaaaaaatcacctgcttggtgcgcctctagcgttctctctcgatattggcattcgattggcctgtgattgcgcgacgcgcttgcgtacctattctgcacatttgcttaccatgtgatgtaatgggatggttggttgtattgctctctcagctatgcagaagtctttgctgtgccagccttcctgattctggaaatatagcacttgctt

SEQ ID NO: 6012 - DNA, 2226 bp, Brachypodium distachyon
acagttcccagttctccctcgtttcaacttcaaccccctctcctcctctctccgtctcagtgtctcaccactcctcgctgcggaatttctcttacacccaccaaacgcacacagaggcacgtaccacccgaagtgatcggcgtcgtggcggcgagatggcggcggcgaagacgatgacgtggcacgaggagctggccacgctcgtgggcgacaccggcgtgcgcctccccggcgtcggcgtggatgcggcgccggcgccggcgggggtgaatcgggcggcggttgggggcaggtggtacggggaggaggaggaggaggggaaggtggaggaagggtgggcgcagcaggcgagggggttcgcggagtcgacggcggagatgctgcgggagctggggctcggggtgtgggacgtcgccgcgcagagcctcgccggcgccgaggacagcgagctcgcgcggcggctgcggaggcctgcagcggccgcggggaagcgcctcagcttcatgaacgagtacctcccggaggaccgcgaccccgtgaggtgctggctcgtcgttgccgccgtcgcgttcgttgcgctcctcgtattaggagctggaactggcgatgaaacaccagtagagcaactgaggaaactatacataagcccgccaaatgctaaaagatttcaacttcctgatggacgacatctggcttatgaagaaaaaggagtttcagctgaaagggcaagattttcactgattgctcctcattcctttctttcatcaaggctagcaggaatccctggaatcaacacatctcttctagaggaatttggggcccgccttgtgacctatgatcttcctggttttggtgaaagtgatcctcatccagggcgaaatctcaattcttctgcattagatatgcttcatttggctgatgccctcggggtcgcggacaagttctgggttgtaggctattctggaggtggcatgcatgcttggagcgctcttcgttacattcctgaccgagttgcaggtgcagcaatgtttgcccccatggcaaatccatatgactccaagatgaccaaggatgagaaacgtaaaacatgggacagatggtcaactaaacggaaactaatgcacattttagctcggaggtttccatcactattacgcctcttttatctccgaagcttcctttctggaaagcaaggacaacctgagagttggttgtcactgtcattaggaaagaaggacaaagctttactggaaggtgctatgttcaatgcattctgggagaaggatgtcgcagagtccgtgcgccagggagacgcgaaaccattcgtagaggaagctgtgatgcaagtatctgactggggtttcagcttgtctgacattcagatgcagaagaaagaggatcagggattgtttgaattgatcaagtctctgttcagtcaggctgaacgagagtgggtgggatttcttggcccaatacacatatggcagggaatggatgaccgggtggtgccgccatcagtgactgaatatgtccgtaggatggttccaggagctactgtacacaaacttcttgatgaaggccacttctcgtacttctgtttctgcgatgaatgccataggcagatattctccaccctgttcggcattccccagggccctatcagtcctgtacaggaatcaggtgaagtggccccagaattcgctgaagaaacaacagcatctgaggaattcgcagaacaggagcaagacacatcagagtgcttggcctgatcacattcagcttcatgatcatcagtacagatacgacttttaacacagatctcacagaaagataggcttttctttgccgctggcgaagaatgctgacaacaggcggggctgagctgctgcttgtaaggcgcgagtaaagcaaagaagctctggagtctggaacggaggctgcactaaatgggctagttcactataatgtacaaagaagtcctaaaaatctgcacaatcacctccttggtgcgcttctagtatagctcaatattgagatttgattgaccttcgataatgcaacgcccttgcaatacatactttgcacatcggcctcctgtgtggtgtaatggaatggatggttgtattgctctctcagctatgcagaagtaggaggaaattgactatttatcctgaagtcgctgtttgtttgattaaaaaaaagtgccacgtaggtgggtctgaccgt

SEQ ID NO: 6013 - DNA, 2018 bp, Brachypodium distachyon
atggcggcggcgaagacgatgacgtggcacgaggagctggccacgctcgtgggcgacaccggcgtgcgcctccccggcgtcggcgtggatgcggcgccggcgccggcgggggtgaatcgggcggcggttgggggcaggtggtacggggaggaggaggaggaggggaaggtggaggaagggtgggcgcagcaggcgagggggttcgcggagtcgacggcggagatgctgcgggagctggggctcggggtgtgggacgtcgccgcgcagagcctcgccggcgccgaggacagcgagctcgcgcggcggctgcggaggcctgcagcggccgcggggaagcgcctcagcttcatgaacgagtacctcccggaggaccgcgaccccgtgaggtgctggctcgtcgttgccgccgtcgcgttcgttgcgctcctcgtattaggagctggaactggcgatgaaacaccagtagagcaactgaggaaactatacataagcccgccaaatgctaaaagatttcaacttcctgatggacgacatctggcttatgaagaaaaaggagtttcagctgaaagggcaagattttcactgattgctcctcattcctttctttcatcaaggctagcaggaatccctggaatcaacacatctcttctagaggaatttggggcccgccttgtgacctatgatcttcctggttttggtgaaagtgatcctcatccagggcgaaatctcaattcttctgcattagatatgcttcatttggctgatgccctcggggtcgcggacaagttctgggttgtaggctattctggaggtggcatgcatgcttggagcgctcttcgttacattcctgaccgagttgcaggtgcagcaatgtttgcccccatggcaaatccatatgactccaagatgaccaaggatgagaaacgtaaaacatgggacagatggtcaactaaacggaaactaatgcacattttagctcggaggtttccatcactattacgcctcttttatctccgaagcttcctttctggaaagcaaggacaacctgagagttggttgtcactgtcattaggaaagaaggacaaagctttactggaaggtgctatgttcaatgcattctgggagaaggatgtcgcagagtccgtgcgccagggagacgcgaaaccattcgtagaggaagctgtgatgcaagtatctgactggggtttcagcttgtctgacattcagatgcagaagaaagaggatcagggattgtttgaattgatcaagtctctgttcagtcaggctgaacgagagtgggtgggatttcttggcccaatacacatatggcagggaatggatgaccgggtggtgccgccatcagtgactgaatatgtccgtaggatggttccaggagctactgtacacaaacttcttgatgaaggccacttctcgtacttctgtttctgcgatgaatgccataggcagatattctccaccctgttcggcattccccagggccctatcagtcctgtacaggaatcaggtgaagtggccccagaattcgctgaagaaacaacagcatctgaggaattcgcagaacaggagcaagacacatcagagtgcttggcctgatcacattcagcttcatgatcatcagtacagatacgacttttaacacagatctcacagaaagataggcttttctttgccgctggcgaagaatgctgacaacaggcggggctgagctgctgcttgtaaggcgcgagtaaagcaaagaagctctggagtctggaacggaggctgcactaaatgggctagttcactataatgtacaaagaagtcctaaaaatctgcacaatcacctccttggtgcgcttctagtatagctcaatattgagatttgattgaccttcgataatgcaacgcccttgcaatacatactttgcacatcggcctcctgtgtggtgtaatggaatggatggttgtattgctctctcagctatgcagaagtaggaggaaattgactatttatcctg

SEQ ID NO: 6014 - DNA, 2067 bp, Panicum virgatum
gtacaagcggagcggaagcgatcggcgccgcggcggcgagatgtcggcggcgtcgacgatgatgtggcacgaggacctggccaccctcgtgggggacacgggcgcccatctccacggcgccggaggggaggcgccggcggcggcggcgaatgttgcggcggccggggccgggtggtacggcgaggaggaagaggggagggcggaggaggggtgggcgcagcaggcgaaggggttcgcggagtcgacggcggagatgctgcgggagctgggccgcgggctgtgggacgtcgccgcgcagagcctcgccggcgccgaggacagcgagctcgcgcggcggctcaggaagcgggcggcggccacgggggagcgcctcagcttcatgaacgagtacctccccgaggagcgcgaccccgtgaggtgttggctcatcgtcgccgcagttgcattcgtcacgctcctagttttaggtgttgggagtggtgatgaaattccggttgagcttccaaagaaacttatcatcagccccccaagtgcgaatagaatccaacttcctgatggacgccatctagcttatgaagaacaaggagtctcagctgatagggcaagattttcactgattgctcctcattcttttctttcatcaaggctggcaggaatccctggaatcagtgcatcccttctggaagaatttggggcacgacttgtgacctatgatcttcctggttttggtgaaagtgatctgcacccaggccgaaatctgaattcttctgccctggacatgctccatctggctgatgctcttggtattccggacaagttctgggttgtgggctattctggtggtggcatgcatgcttggagtgctcttcgttacattcctgatagagttgctggtgcagcaatgtttgcacctatggcaaatccatatgactccaagatgaccaaagatgagaggcataaaacatgggatagatggtcaacaaaacggaaacttatgcacattttagctcggaggtttccatcactactgcccctcttctatcgccgaagctttctttctggcaagcaaggacagccagagagttggttgtcactgtcattggggaagaaggacaaaactttactggaaggtcctgagttcaatgcattctgggaaaggaatgttgcagagtctgtgcgccagggagatgcgcgaccatttgtagaggaagctgtgttgcaagtatccgactggggtttcagcttgtccgacattcaaatgcagaagaaagaggatcaaagcttttttgaactcatcaagtctctgttcaatcaagttgaacgagagtgggttggatttctgggcccaatacatatctggcagggaatggatgaccgagtggtctcaccgtcagtggctgaatttatccgtcgggtggttccaggagctacggtgcacaagcttcttgatgaaggccacttctcgtatttctgcttctgcgacgagtgccacaggcagatattctccacactcttcggcatcccccagggccctatcaaccctgcgccactacccagcgatgtggcttcagagcttgccgaagaaacaacagaagaaacaacagcaccggacaatcttacagaggaggaacaaggaaaatcaagcctggcctgatcaagatcagttttcaggatcagaagtatagatacaagaccttactactactactactactactacttgacacaatacatcacagatagacatgcttttcttcgctgccatgggacaaggcctacatcaggtggacagtggactgagcttgtcctcttgcattggatgggaggtgcagcgccggattatgtggtttcacctcgatgtacaaatgctcatcccgaatgtgcgcggcaactgcttggtgcgcacttagtatagtcggtgttaaaattcggttaacctgtcataatgagagaccgttatacacttctttctgcatatttgtttactctggcatgcaaacccgatggttgaagtgcgctctcggctgaatatctttccctcaactataattttggcatcactatctc

SEQ ID NO: 6015 - DNA, 2375 bp, Oryza sativa
acatcctacggcagtagatctgtggacgccaacgtggaggatgacagcaaccccggagcagccactccctcgcccactccagagaagcccacgaaaatccataccggtagtactagtggggcccacccagcagccactcatttattttccagttccgcctccgtttcaaccctctctccctcttcctcagccggggaaacttccttttacacccaccaaacgcgagcgcacacacacagagccacacgggagtggggatactctcgccgaagtgatcggcgccgcggcggcgtgatggcggcggcggcgacgatgacgtggcacgaggagctggccacgctggtgggcgacacgggcgtgcggttccccggcgcgggcgggggatcggcggcgaatgtggcggcggcggtggggggcgggtggtacaggggggaggaggaggatggggaggggagggcggtggaggaggaagggtgggcgcagcaggcgagggggttcttggagtcgacggcggagatgctgcgggtgctgggccgcgggctgtgggacatcgccgcgcagagcctcgccggcgccgaggacagcgagctcgcgcggcggctcaggggccccgccgcggccgcggggaagcgcctcagcttcatgaacgagtacctccccgaggaccgcgaccccgtctggtgctgggtcgtcgtcgccgccgtcgcgttcgtcacgctcatcgtattaggtgtagggagtgttgatgataccccagtagaactgccaaagaaactctacataggtcccccaagtgccaaaacaattcaacttcctgatggaaggcatctggcttataaagaacaaggagtcacagctgacagggcaagattttcactgattgctcctcattcttttctttcatcgaggttagcaggaatcccaggaatcaaaccatccctcctggaggaatttggggcacgacttgtgacctatgatcttcctggttttggtgaaagtgatcctcacccaggccgggatctgaattcatctgcacatgacatgcttcacttggctggtgcccttaggattgtggacaagttctgggttgtgggatattctgcaggtagcattcatgcttggagtgctcttcgccacattcctgaccgagtggcaggtgcagcaatgttcgcgcctatggcaaatccatacgactctaagatgaccaaggaagaaagacgcaaaacatgggagaggtggtcaaccaagcggaaactaatgcacattttagctcggaggtttccggccctattacctctcttttatcaccgaagcttcctttctggaaagcaagggcagcctgagagttggctgtcactttcactggggaagaaggacaaaacttcactggaaagtcctatgttcaatgcattttgggaaaaggatgttgcagagtctgtgcgccaaggagatgcacagccttttgtagaggaagctgtactgcaagtatcagattggggattcagcttgtcagacattcaaatgcagaagagagaggatctgagcttttttgaattgatcaaatctctattccgtcaggctgaacgggagtgggtgggatttctgggcccaatacacatatggcaggggatggatgaccgggtggtgccaccgtcagttactgaatacgtcaggcgggtggttccaggagccacagtgcacaaacttctcgatgaaggccacttctcgtacttctgtttctgcgacgagtgccacaggcagatcttctccaccctgtttgggattcctcagggccctatcaaccctgtaccagaacccattgaagttgcctccgaactcacagaagaaacaacagtacctgacaaagctaaagaagaggagcaggacatatcggacttggcctgatagcattcagattcaggaaatcagtatcagaagcagtatagacacgagacgatactacttaacacagacaccacagaaagatagctttcgtcggctctcaccggcggacattgttgacagcgggtggaccgagctggcttcttttgcgctagtatttgtataggcaaattcttgaagaaggatgctacggtgcggttgatgtgccggctcatttcaatgtacaaaagggctatttaaaagttctgcacgtcacctgctgggtgcgctgctgctactctggtagagctcagtgatagctatataacatttgattaaacttcttactacgttgcatgttgtttttagatactcctatgttcttcacgctgctatgatgatgggtcacagcactcatctgtgcagggacagccagtgttcttggtcgctaactaacataagaatatggtgcggttaatcattattgatttgtg

SEQ ID NO: 6016 - DNA, 2242 bp, Setaria italica
acatttcctacggcctagatccgtggacgctcgtggggaagaaagcaaccccggagccaccaccaaaaattccaaaaaccagagagacccaccggaactcctacccacacagcctagcggggcccgcaagtcagccaaacgtctcgagttcgccatttcgcctccgcttcctactccccagtctcccactcctcgcccccctcttcgctttccaatttccaaacctctcttgcacgggagagcacgtacacgcggagcggagcgcgatcggcgccgcggcggcgagatgtcggcggcggcgacgatgacgtggcacgaggacctggccacgctcgtgggggacacgggcgcccgcttccccggtgccggaggggacgcgccggcggcggcgaatgttgcggcggcgggggccgggtggtacggcgaggaggaagaggggaggacggaggaggggtgggcgcagcaggcgaaggggttcgcggagtccacggcggagatgctgctggagctgggccgggggctgtgggacgtcgccgcgcagagcctcgccggcgccgaggacagcgagctcgcgcggcggctcaggaagcgggcggcggccacgggggagcgactcagcttcatgaacgagtacctccccgaggagcgcgaccccgtgaggtgttggctcatcgtcgccggagtcgcattcgtcacgctcctagttttaggtgttgggagtggcaatgaaactccagtagagcttccaaagaaacttatcattagtcccccaagtgcgaatagaatccaacttcctgatggacgctatctggcatatgaagaacaaggagtctcagccgatagggcaagattttcactgattgctcctcattcttttctttcatcaaggctggcaggaatccctggaatcagtgcatcccttctggaagaatttggggcacgccttgtgacctatgatcttcctggttttggtgaaagtgatccacacccaggccgaaatctcaattcttctgcattggacatgctccatctggctaatggtcttgatattccggacaagttctgggttgtgggctattctggtggtggcatgcatgcttggagtgctcttcgttacattcctgaccgagttgctggtgcagcaatgttcgcacctatggcaaatccatatgattccaagatgaccaaagatgagaggcataaaacatgggatagctggtcaacaaaacggaaactaatgcacattttagctcggaggtttccatcactattacccctcttctatcgccgaagcttcctttctggaaagcaaggacaggcagagagttggttgtcactgtcattggggaagaaggacaaaactttactggatggtcctgagttcaatgcattctgggaaaggaatgttgcggagtctgtgcgccagggtgatgcacgtccatttgtagaggaagctgtgttgcaagtatctgactggggtttcagcttgtccgacattcaaatgcaaaagaaagaagatcgaggcttttttgaactcatcaagtcttttttcaatcaagttgaacgagagtgggtgggatttctgggcccaatacatatctggcagggaatggatgaccgagtggtctcgccgtcagtggctgaatttgtccggcgggtggttccgggagctacagtgcacaagcttcttgacgaaggccacttctcatacttctgcttctgcgacgagtgccacaggcagatattctccacgctcttcggcattccccagggccctatcaaccctgccccgcaacccagcgagttggcttcagagcttgccgaagaaacgacagcaccggacaatgttacagagcaggaacaaggaaaatcaagcctggcctgatcaagattggctttcaggatcagcagtatagatacaagacgttactagtactactacactactacttaacacaataccacacagttggacgggcttttcttcgctgcccatgggataaggcctgcgtcaggtggactgagctcctcctcttgcgcaagtattgaaggcaaaagctttggataggaggaggctgcaatggattatgcggtttcacttcgatgtacaaatgctcatcccaaatgcgcacggcacacctgctcggtgcgctcttagtatagtcactgtaaaattcgattaacctgtcataatgtgactccgttatttataaacttccttttgcacatctgcttactctgg

SEQ ID NO: 6017 - DNA, 2281 bp, Sorghum bicolor
acatttcctacggcctagatccgtggacgctcgtggggaagaaagcaacccaggaaccaccaaaggcagggagggacacccaccgaaactctgggccgaaactcctacccacacagcctagcgggacccacaagtcagcggaaacgtcccaagctcgccatttcgtctcactccaactcccaaagtgccccggtcttccactccccctcctcgcttcccaatttccaaacctctctcttgcacgggaggagcacgtacacgcgggcggagcgaaagcgatcggcgccgcggcggcaagatgtcggcggcggccacgatgacgtggcacgaggacctggccactctcgtgggtgacacgggcgttcgcctccccggcggcggggggcacgcgccggcggcggcgaatgttgcggcggcgggggccgggtggtacggggaggaggaagaggggagggcggaggaggggtgggcgcagcaggcgaaggggttcgcggagtccacggcggagatgctgcgggagctgggccgcgggctgtgggacgtcgccgcgcagagcctcgccggcgccgaggacagcgagctcgcgcggcggctccggaagcgggcggcggccacggggaagcgcctcagcttcatgaacgagtacctccccgaggagcgcgacccggtgaggtgttggctcatcgtcgccgcggtcgcattcgtcacactcctagttttaggtgctgggagtgacaatgaaactccagtagaccttcccaagaaacttatcattggtcccccaagtgccgatagaatccaacttcctgatggacggcatctggcttatgaagaacaaggtgtctcagctaacagagcaagattttcactgattgctcctcattcttttctgtcatcaaggctggcaggaatccctggaatcagtgcatctcttctggaagaatttggagtacgactggtgacctatgatcttcctggttttggtgaaagcgatccacacctaggccggaatctcaattcttctgcactggacatgctctatctggctaatgctctcaatattccggaaaagttctgggttgtgggctattctggaggtggcatgcatgcctggagtgctcttcgttacattcctgatcgagttgctggtgcagcaatgttcgcacctatggcaaatccatatgactccaagatgaccaaagacgagaggcgtaaaacatgggatagttggtcaacgaaacggaaactgatgcacattttagctcggaggtttccatcactgctaccgttcttttatcgccaaaccttcctttctggaaagcaaggacaacctgagagttggttgtcactgtcattggggaagaaggacaaaactttactggaaggtcctgtgttcaatgcattctgggaaaggaatgttgcggagtctgtgcgtcagggagatgcaaggccatttgtagaggaagctgtgctgcaagtatctgactggggtttcagcttatctgacatccaaatgcagaagaaagaggctcgaggcatttttgaactcatcaagtctcttttcaatcaggctgaaagagagtgggtgggatttctgggcccaatacatatatggcaggggatggacgaccgagtggtctcgccgtcagtggctgaatttgtgcggcggtcggttccaggggctacggtccacaagcttcttgatgaaggccacttctcatacttctgcttctgcgacgagtgccacaggcagatattctccacgctcttcggcattccccagggcccaatcaaccctgcgccgcaacccagcgaggttgtttcagagctcaccgaagaaacaacagtaccagacaatgccacagatcaggaacaaggaaaatcaggcctgccctgatcaagatcagttttcaggatcaacagtatagatacgagatgttactactactaaatacaataccccaaatagacgtgcctttcgtcgctgcctgtggactgagctgctcctcttgcgagaagtcttgaaggatgaagacaaagcattggatagaggctgtgtgccgtttcacttcgatgtacaaaaatgctcatcacaaattcgcacggcacctgctcggtgcgcttttagtatagtcggtattaaaatttgattaacctgctatgactccgttataggcttctttttgcacatttgcgccctcagctgaattttgttcctttattaaggctttatggcatgatgcaatagtccaatccagtttaaggtcagtaatgtcttcgc

SEQ ID NO: 6018 - DNA, 2518 bp, Sorghum bicolor
acatttcctacggcctagatccgtggacgctcgtggggaagaaagcaacccaggaaccaccaaaggcagggagggacacccaccgaaactctgggccgaaactcctacccacacagcctagcgggacccacaagtcagcggaaacgtcccaagctcgccatttcgtctcactccaactcccaaagtgccccggtcttccactccccctcctcgcttcccaatttccaaacctctctcttgcacgggaggagcacgtacacgcgggcggagcgaaagcgatcggcgccgcggcggcaagatgtcggcggcggccacgatgacgtggcacgaggacctggccactctcgtgggtgacacgggcgttcgcctccccggcggcggggggcacgcgccggcggcggcgaatgttgcggcggcgggggccgggtggtacggggaggaggaagaggggagggcggaggaggggtgggcgcagcaggcgaaggggttcgcggagtccacggcggagatgctgcgggagctgggccgcgggctgtgggacgtcgccgcgcagagcctcgccggcgccgaggacagcgagctcgcgcggcggctccggaagcgggcggcggccacggggaagcgcctcagcttcatgaacgagtacctccccgaggagcgcgacccggtgaggtgttggctcatcgtcgccgcggtcgcattcgtcacactcctagttttaggtgctgggagtgacaatgaaactccagtagaccttcccaagaaacttatcattggtcccccaagtgccgatagaatccaacttcctgatggacggcatctggcttatgaagaacaaggtgtctcagctaacagagcaagattttcactgattgctcctcattcttttctgtcatcaaggctggcaggaatccctggaatcagtgcatctcttctggaagaatttggagtacgactggtgacctatgatcttcctggttttggtgaaagcgatccacacctaggccggaatctcaattcttctgcactggacatgctctatctggctaatgctctcaatattccggaaaagttctgggttgtgggctattctggaggtggcatgcatgcctggagtgctcttcgttacattcctgatcgagttgctggtgcagcaatgttcgcacctatggcaaatccatatgactccaagatgaccaaagacgagaggcgtaaaacatgggatagttggtcaacgaaacggaaactgatgcacattttagctcggaggtttccatcactgctaccgttcttttatcgccaaaccttcctttctggaaagcaaggacaacctgagagttggttgtcactgtcattggggaagaaggacaaaactttactggaaggtcctgtgttcaatgcattctgggaaaggaatgttgcggagtctgtgcgtcagggagatgcaaggccatttgtagaggaagctgtgctgcaagtatctgactggggtttcagcttatctgacatccaaatgcagaagaaagaggctcgaggcatttttgaactcatcaagtctcttttcaatcaggctgaaagagagtgggtgggatttctgggcccaatacatatatggcaggggatggacgaccgagtggtctcgccgtcagtggctgaatttgtgcggcggtcggttccaggggctacggtccacaagcttcttgatgaaggccacttctcatacttctgcttctgcgacgagtgccacaggcagatattctccacgctcttcggcattccccagggcccaatcaaccctgcgccgcaacccagcgaggttgtttcagagctcaccgaagaaacaacagtaccagacaatgccacagatcaggaacaaggaaaatcaggcctgccctgatcaagatcagttttcaggatcaacagtatagatacgagatgttactactactaaatacaataccccaaatagacgtgcctttcgtcgctgcctgtggactgagctgctcctcttgcgagaagtcttgaaggatgaagacaaagcattggatagaggctgtgtgccgtttcacttcgatgtacaaaaatgctcatcacaaattcgcacggcacctgctcggtgcgcttttagtatagtcggtattaaaatttgattaacctgctatgactccgttataggcttctttttgcacatttgcgccctcagctgaattttgttcctttattaaggctttatggcatgatgcaatagtccaatccagtttaaggtcagtaatgtcttcgcgtcttcctgccggtgcacttgtcagctggcaggagacggatgtgctgtgctgctgcgatactgtgcgagtgttttgagatgatgtgtttggtatctggagcgttgtttgccaaacgggccgtcctgtccgctcgttacggtaaatgcccagtaccgaccagcagcgtttaggccttgtttcccaaaactttattacaagattctccgtcacgttgaatcttgcggcacttgtatgga

SEQ ID NO: 6019 - DNA, 2295 bp, Triticum aestivum
gccttattgggtcggtgagaattggcctaagtttttcccacgaccagccttatcccctttcgtctcccgctgcccccggcctcgcgctctacggcgcgccatggccatgccctccacttcttcctcctcgcggccgcctatcctgcaccctagctccaaaaccccgaacactccacgcctgctgccgctcgtctccagggctgctgcccctcgcccgctgcttctctccttcgctccgcccgcgcccgggcgcgggctccggaccgctgccgcccaacaacccgcctacgaaaatggagaggaggaagaggaaggggtggaggatgatgagtattacagcgacgaggaggatgaaggggagttggacgtggaggcgatggaggaagaggcgcggcgcgccgccgccgacctcgccgcgcgcctcgaccgggagctacgcgtcgatggtgatgttcgggagaaaagaagaaccatgagggataagacatcaacatctaaacatatcccagacagtaagcttccaaaggtggctgttattggtagacctaatgtgggtaaatctgcactattcaatcggcttgtcgggggcaatagggctatcgttgttgatgaacctggtgtaacaagggatcgtttgtatggacgatcttattggggtgatcaagagtttatggttattgatactgggggtgtgattactctatcgaagtctcaagcaggtgtaatggaagaacttgccatcacaactactgttggtatggatgggattccaatggcctctcgagaagctgctattgctaggatgccatctatgattgagaagcaagctgttgctgccgttgaagaagcagctgtccttcttttccttgtggatggtcaggctggtcttgtggcagctgatatagaaattgctgattggttacgtcgcaacttctcacacaagtgcatcatacttgctgtaaacaagtgtgaatcgccacggaaagggcaaatgcaagcattagaattttggtcattagggtttacacctttaccaatatctgctatcaccggcactggaactggagagctcctggatatggtctgttcggaactgaaaaagttcgagggactagaaggattggatgatgttgaagaagacgaaaaccgcgttcctgctatttctattgttggaagaccaaatgttgggaaaagtagcattctaaatgctttggttggagaagatagaactattgtgagcccagttagtggtaccacccgtgatgccattgatactgagttaaccacagtggatgggcagaaatacaaactcatcgatacggctggcatccgacggagagcagcagttgcttctgctggcagcacaactgaaacactttcagtaaaacgtgcatttagtgcaattcgtcgatctgatgtagttgcccttgttattgaagcgatggcctgtgtctcggagcaggattataaaattgcagaaaggattgagaaagagggaaaggcatgtgtcattgttgtgaacaaatgggacacaatcccaaacaagaacaatgagagtactacacattatgaacaagatgtaagagagaagcttcgtgtacttgactgggcacctattgtttactgttctgcgataaatgggaacagcgttgaaaagattatttctgctgcttctttggttgaaaaggaaaggtctagaagacttggcacctctattcttaaccaagtggttagagaagctgtagcattcaaagcaccaccacgaacaagaggtggcaaaagaggccgtgtttattacacaacacaggctgctgttcgtccaccaacgtttgtcctcttcgttaatgacgcaaaactcttccctgagccgtatcggcggtacatgcacaagcagctccggtctgacgccggattcccgggcacgcctattcgcctactgtggcgtagcaggaagcggactgataggcaacagaggagatcaaatacggaggctcgtggtgcgcttgtagcggcgagttagcatgtgaagcaatgttgctacgttcgaaaagaaaaggaaaatgtggcggagttagcagtaccacggcatcccttttcctccttgttcacgcgcttttcctggctgcgaacgtgtgactagcaatgcgccaatgaggttcatattattcaaatgaaaaaggttttgtttttcttcttagtcctcaactactgccaaagttgaagtatggtcactatactctaatactataactttttggtctctcaaatgctagaacgtctgaaatttgatctttt

SEQ ID NO: 6020 - DNA, 2372 bp, Hordeum vulgare
ttccatcccccgctgccccaggcctcgcgctctacggcgcgccatggccatgccttccactccttcctcctcgcggccgcccatgctgcaccccgcctccaaaactccgaacccgccccgcctgctgccgctcgtcaccagaggcgctgctgcccctcgccctcctctgctcatctccttcgctccgcccgcgcctggtcgtcgcgggctccgcgccgctgccgcccaacaacccgcctacgaagatggggaggaggaagaagatggggaggaggatggggagtgttacagcgaggaggaggaggaggatgaggaggagttggacgtggaggcgatggaggaagaggcgcggcgcgccgccgccgacctcgccgcgcgcctcgaccgcgagctccgcgtcgatggtgatgttcgggagaaaagaagaaccatgagggacaagacatcaacaacatctaaacatatcccagacagtaagcttccaaaggtggctattattggtagacctaatgtgggtaaatctgcgctgttcaatcggcttgtcgggggtaacagggctatcgttgttgatgaacctggtgtaacaagggatcgtttgtatggacgatcttattggggtgatcaagagtttatggttattgatactgggggtgtcattactctatcgaagtctcaagcaggtgtaatggaagaacttgccatcacaactactgttggtatggatgggattccaatggcctctcgagaagctgctattgctaggatgccatcaatgattgagaagcaagctgttgccgccgttgaagaagcagctgtccttcttttccttgtggatggtcaggctggtcttgtggcagctgatatagaaattgctgattggttacgtcgcaacttctcacacaagtgcatcatacttgctgtaaacaaatgtgaatcgccacggaaagggcaaatgcaagcattagaattttggtcattagggttttcacctttaccaatatctgctattaccggcactggaactggagagctcctggatatggtctcttcggaactgaaaaagttcgaggcattacagggactagaaggattggatgatgttgaagaagacgaaaaccgcgttcctgctatttctattgttggaagaccaaatgttggaaaaagtagcattctaaatgctttggtgggagaagatagaactattgtgagcccagttagtggtaccacccgtgatgccattgatactgagttaaccacagaggatgggcagaaatacaaactcatcgatacggctggcatccgacggagagcagcagttgcttctgctggcagcacaactgaaacactttcagtaaagcgtgcatttagtgcaattcgtcgatctgatgtagttgcccttgttattgaagcgatggcctgcgtctctgagcaggattataaaattgcagaaaggattgagaaagagggaaaggcatgtgtcattgttgtgaacaaatgggatacaatcccaaacaagaacaatgagagtactacacattatgaacaggatgtaagagagaagcttcgtgtacttgactgggcacctattgtttactgttctgcgataaatgggaacagcgttgaaaagattatttctgctgcttctttggttgaaaaggaaaggtctagaagactcggcacctctattcttaaccaagtgattagagaagctgtagcattcaaagcaccaccccgaacaagaggtggcaaaagaggccgcgtttattacacaacacaggctgctgttcgtccaccaacgtttgttctcttcgtcaatgacgcaaaactcttccctgagccgtatcggcggtacatgcacaagcagctccggtctgacgctggattcccgggcacgcctattcgtctactgtggcgtagcaggaagcggactgataggcaacagaggagatcaaatacggaggctcgtggtgcacttgtagcggcgagttagcatgcgaagcaatgttgctaccttcaaaaacacaaggaaaatgtggcgagctaggagtaccacggtatcccttttcctccttgttcacgcgcgtttcctggctgcgaacgtgtgactatcaatgtgccaagaagttaaggttcatattcctcaactactgccaaagttgaagtgcggtcactgtactctaatagtataattttatggcctctcaactgctagaatgtatggaattttatggcccctctctctctctcagatgaacatcaacttttctgttttcatgcgatgttgcatgcatgtatgattattgatggtttcttttgtcttcaatctcattttgatgatgtgctcatttgcaacaaaaaaaaaaaaaaaatac

SEQ ID NO: 6021 - DNA, 2233 bp, Triticum aestivum
cccgctcccccggtctcgcgctgtacggcgcgccatggccatgccctccacttcttacttctcgcggccgcctatcgtgcaccccagctccaaaaccccgaacactccacgactgctgccgctcgtctccagggctgctgcccctcgcccgctgctgccctccttcgctccgcccgcgcccgggcgcgggctccggaccgccgccgcccaacaacccgcctacgaaaatggagaggaggaagaggaaggggtggaggatgatgagtattacagcgacgaggaggatgaaggggagttggacgtggaggcgatggaggaagaggcgcggcgcgccgccgccgacctcgccgcgcgcctcgaccgggagctacgcgtcgatggtgatgttcgggagaaaagaagaaccatgagggataagacatcaacatctaaacatatcccagacagtaagcttccaaaggtggctgttattggtagacctaatgtgggtaaatctgcactattcaatcggcttgtcgggggcaacagggctatcgttgttgatgaacctggtgtaacaagggatcgtttgtatggacgatcttattggggtgatcaagagtttatggttattgatactgggggtgtgattactctatcgaagtctcaagcaggtgtaatggaagaacttgccatcacaactactgttggtatggatgggattccaatggcctctcgagaagctgctattgctaggatgccatctatgattgagaagcaagctgttgctgccgttgaagaagcagctgtccttcttttccttgtggatggtcaggctggtcttgtggcagctgatatagaaattgctgattggttacgtcgcaacttctcacacaagtgcatcatactggctgtaaacaagtgtgaatcgccacggaaagggcaaatgcaagcattagaattttggtcattagggtttacacctttaccaatatctgctatcaccggcactggaactggagagctcctggatatggtctgttcggaactgaaaaagttcgagggactagaaggattggatgatgttgaagaagacgaaaaccgcgttcctgctatttctattgttggaagaccaaatgttgggaaaagtagcattctaaatgctttggttggagaagatagaactattgtgagcccagttagtggtaccacccgtgatgccattgatactgagttaaccacagtggatgggcagaaatacaaactcatcgatacggctggcatccgacggagagcagcagttgcttctgctggcagcacaactgaaacactttcagtaaaacgtgcatttagtgcaattcgtcgatctgatgtagttgcccttgttattgaagcgatggcctgtgtctcggagcaggattataaaattgcagaaaggattgagaaagagggaaaggcatgtgtcattgttgtgaacaaatgggacacaatcccaaacaagaacaatgagagtactacacattatgaacaagatgtaagagagaagcttcgtgtacttgactgggcacctattgtttactgttctgcgataaatgggaacagcgttgaaaagattatttctgctgcttctttggttgaaaaggaaaggtctagaagacttggcacctctattcttaaccaagtggttagagaagctgtagcattcaaagcaccaccacgaacaagaggtggcaaaagaggccgtgtttattacacaacacaggctgctgttcgtccaccaacgtttgttctcttcgttaatgacgcaaaactcttccctgagccgtatcggcggtacatgcacaagcagctccggtctgacgccggattcccgggcacgcctattcgcctactgtggcgtagcaggaagcggactgataggcaacagaggagatcaaatacggaggctcgtggtgcgcttgtagcggcgagttagcatgtgaagcaatgttgctacgttcgaaaagaaaaggaaaatgtggcgagttagcagtatcacggcatcccttttcctccttgttcacgcgcttttcctggctgcgaacgtgtggctatcaatgcgccaatgaggttcatattattcaaatgaaaagggttttgtttttcttcttagtcctcaagtactgccaaagttgaagtatggtcactatactctaatactataactttttggtctctcaaatgctagaacgtctgaaatttgatcttttgctgc

SEQ ID NO: 6022 - DNA, 3080 bp, Triticum aestivum
tcccgctcccccggtctcgcgctgtacggcgcgccatggccatgccctccacttcttacttctcgcggccgcctatcgtgcaccccacctccaaaactccgaaccctccccgactgctgccgctcgtctccggggctgctgcccctcgcccgctgctgccctccttcgctccgcccgcgcccggtcgcgggctccggaccgccgccgcccaacaacccgcctacgaaaatggagaggaggaagaagaaggggaggaggatgaggagtattacagcgaggaggaggatgaagaggaattggacgtggaggcgatggaggaagaggcgcggcgcgccgccgccgacctcgccgcgcgcctcgaccgggagctacgcgtcgatggtgatgttcgggagaaaagaagaaccatgagggataagacatcaacatctaaacatatcccagacagtaagcttccaaaggtggctgttattggtagacctaatgtgggtaaatctgcactattcaatcggcttgtcgggggcaacagggctatcgttgttgatgaacctggtgtaacaagggatcgtttgtatggacgatcttattggggtgatcaagagtttatggttattgatactgggggtgtgattactctatcgaagtctcaagcaggtgtaatggaagaacttgccattacaactactgttggtatggatgggattccaatggcctctcgagaagctgctattgctaggatgccatcaatgattgagaagcaagctgttgctgctgttgaagaagcagctgtccttcttttccttgtggatggtcaggctgggcttgtggcagctgatatagaaattgctgattggttacgtcgcaacttctcacacaagtgcatcatacttgctgtaaacaagtgtgaatcaccacggaaagggcaaatgcaagcattagaattttggtcattagggtttacacctttaccaatatctgctatcaccggcactggaactggagagctcctggatatggtctgttcggaactgaaaaagttcgagggactagaagaattggatgatgttgaagaagacgaaaaccatgtccctgctatttctattgttggaagaccaaatgttgggaaaagtagcattctaaatgctttggttggagaagatagaactattgtgagcccagttagtggtaccacccgtgatgccattgatactgagttaaccataaaggatggggcagaaatacaaactcatcgatacggctggcatccgacggagagcagcagttgcttctgctggcagcacaactgaaacactttcagtaaaacgtgcatttagtgcaattcgtcgatctgatgtagttgcccttgttattgaagcgatggcctgtgtctcggagcaggattataaaattgcagaaaggattgagaaagagggaaaggcatgtgtcattgttgtgaacaagtgggatacaatcccaaacaagaacaatgagagtactacacattatgaacaggatgtaagagagaagcttcgtgtacttgactgggcacctattgtttactgttctgcgataaatgggaacagcgttgagaagattatttctgctgcttctttggttgaagaggaaaggtctagaagacttggcacctctattcttaaccaagtggttagagaagctgtagcattcaaagcaccaccacgaacaagaggcggcaaaagaggccgtgtttattacacaacacaggctgctgttcgtccaccaacatttgttctcttcgtcaatgacgcaaaacttttccctgagccgtatcggcggtacatgcacaagcagctccggtctgatgctggattcccaggcacgcccattcgcctactgtggcgtagcaggaagcggactgataggcaacagaggagatcaaatacggaagctcgcagtgcgcttgtagcgttgagttagcatgtgaagcaatgttgctacgttaaaaaagaaaggaaaacgtgggtatccttttcctccttgttcacatgcttttcctggctgcgaatgtgtgactatcaatgggccaataaggttcatattcaaatgaaaaaggttttgtttctcttcttactcctcgactactgccaaagctgaagtatggtcactgtactctaatactctaataattttttggtctctcaaatgctagaacatatgaaatttgtcttttgctgcactgagttgttttaagaagagtgaattacattttttaccccatagttttcgtttgtgacaacaattaccccatacagcagttttttctacacgttacccagtttaagcaaacttgtgccacaaattaccccatttatgtttttctttgtttcaatgctgactgcacgcaacgctggttggtttgttttactttttaagatttgctcttgaagattaagatttttgtgtggtggctctcccctttggaaggcctctttgcccttaaagattaagatttgtgtatggcaactactacgagattgcatcccttcggggaccgaggtgcttaagcggcatggcccggggatggagcgtgccccttatgcgctgtaccgaagactgggactcacatcctattctcatgtacgacggcacgggtcctttgggaggccgggggcctcacggagttcctccagaccagggctacccaccctgtgcgacatctcgcttatttggcttatttttgcggcaatgtcatggaatctttggacgatatgtaataaaatggtgattgagagggtctttctgaggcaggtgcccgaatccttcaaattccttgcttttctgcagaactggcacccgctctctaggcagcgcgaccgcggtggtcttggcttgtgctagatgcgcttctggttacaacgtgtcaactattggcttcgtagggccgcagtcgtcttgggcttgtgctggatgcacttctggttacagcgtgtcaactattggcttcgtagggccgcttcgcgacagtcactaggttgattttttcctcatatctgggcatgattgtgttgttgtcccaaccgtcgttgtgatttagagtctgg

SEQ ID NO: 6023 - DNA, 2369 bp, Hordeum vulgare
gatgctcttatccccttccgtcccccgctgccccaggcctcgcgctctacggcgcgccatggccatgccttccactccttcctcctcgcggccgcccatgctgcaccccgcctccaaaactccgaacccgccccgcctgctgccgctcgtcaccagaggcgctgctgcccctcgccctcctctgctcatctccttcgctccgcccgcgcctggtcgtcgcgggctccgcgccgctgccgcccaacaacccgcctacgaagatggggaggaggaagaagatggggaggaggatggggagtgttacagcgaggaggaggaggaggatgaggaggagttggacgtggaggcgatggaggaagaggcgcggcgcgccgccgccgacctcgccgcgcgcctcgaccgcgagctccgcgtcgatggtgatgttcgggagaaaagaagaaccatgagggacaagacatcaacaacatctaaacatatcccagacagtaagcttccaaaggtggctattattggtagacctaatgtgggtaaatctgcgctgttcaatcggcttgtcgggggtaacagggctatcgttgttgatgaacctggtgtaacaagggatcgtttgtatggacgatcttattggggtgatcaagagtttatggttattgatactgggggtgtcattactctatcgaagtctcaagcaggtgtaatggaagaacttgccatcacaactactgttggtatggatgggattccaatggcctctcgagaagctgctattgctaggatgccatcaatgattgagaagcaagctgttgccgccgttgaagaagcagctgtccttcttttccttgtggatggtcaggctggtcttgtggcagctgatatagaaattgctgattggttacgtcgcaacttctcacacaagtgcatcatacttgctgtaaacaaatgtgaatcgccacggaaagggcaaatgcaagcattagaattttggtcattagggttttcacctttaccaatatctgctattaccggcactggaactggagagctcctggatatggtctcttcggaactgaaaaagttcgaggcattacagggactagaaggattggatgatgttgaagaagacgaaaaccgcgttcctgctatttctattgttggaagaccaaatgttggaaaaagtagcattctaaatgctttggtgggagaagatagaactattgtgagcccagttagtggtaccacccgtgatgccattgatactgagttaaccacagaggatgggcagaaatacaaactcatcgatacggctggcatccgacggagagcagcagttgcttctgctggcagcacaactgaaacactttcagtaaagcgtgcatttagtgcaattcgtcgatctgatgtagttgcccttgttattgaagcgatggcctgcgtctctgagcaggattataaaattgcagaaaggattgagaaagagggaaaggcatgtgtcattgttgtgaacaaatgggatacaatcccaaacaagaacaatgagagtactacacattatgaacaggatgtaagagagaagcttcgtgtacttgactgggcacctattgtttactgttctgcgataaatgggaacagcgttgaaaagattatttctgctgcttctttggttgaaaaggaaaggtctagaagactcggcacctctattcttaaccaagtgattagagaagctgtagcattcaaagcaccaccccgaacaagaggtggcaaaagaggccgcgtttattacacaacacaggctgctgttcgtccaccaacgtttgttctcttcgtcaatgacgcaaaactcttccctgagccgtatcggcggtacatgcacaagcagctccggtctgacgctggattcccgggcacgcctattcgtctactgtggcgtagcaggaagcggactgataggcaacagaggagatcaaatacggaggctcgtggtgcacttgtagcggcgagttagcatgcgaagcaatgttgctaccttcaaaaacacaaggaaaatgtggcgagctaggagtaccacggtatcccttttcctccttgttcacgcgcgtttcctggctgcgaacgtgtgactatcaatgtgccaagaagttaaggttcatattcctcaactactgccaaagttgaagtgcggtcactgtactctaatagtataattttatggcctctcaactgctagaatgtatggaattttatggcccctctctctctctcagatgaacatcaacttttctgttttcatgcgatgttgcatgcatgtatgattattgatggtttcttttgtcttcaatctcattttgatgatgtgctcatttgcaaca

SEQ ID NO: 6024 - DNA, 3638 bp, Secale cereale
ctgctccttccccattccccatggaggtctctgcttccgcctctacgcctcaagctctcaccctactcacttgccccccttgcttcctctctctttacccttccgtccgcctgcacggccgcgccggcgggggagggctcctgctgcggcatccgcctcaacggaggctggagctggggtaccgtgcccgccgcccggtgggatgctctctcagcggctcatcctccactgcgctggacgtgttaggcggctcggtgggcgccgcggccgctgtcctcgctgccttacagctggtttggctcaggtggcgcggcgcaatgcatagggaatctccggaggttttacatacacaggtcaaaagcattgtaaacaaggccctccgaacaacaacacaatccgtacatgatagtaatgatgcacgttgtgcaactcatgaaaatagcttttcagagctatctatttctgaaggaatgactattaatgaattggagtgccgggctagtatttcgtgcatataccctgtaaataagacaacacaggcggtttctgtaactaatccaggggcaatgttacacacattagttgatgtatctcggcaagaagaagttggttgctcaacttcagcagaaaaaagaaattctacagaaaatgttattgatgttcttgcaacgccatattccggtccaccagggcaacataaaagcaagtatttctctaacagaattggctggcaaggtgggctctcgtaccaatttttatccctttcagaactacagaaagatgctcaaaatggcaatggtcttggtgacagccaaacaaacagcaacaatgctcatttatttcgatgccatcagagtaatgatgatgaaaatattgatttgacatctctttcatccttcaaaagaacagtggaatgccctctcaattttgttccacaagccagtattggaaatttgttcagaccaagaaaagcaattgggtttgctgattcatatgtagggggctctcatctgacaccagggaaattagctctatttgcatgcttaagggagggtcctgccagcaaacaacagaaagcagtgaaagaccatgatgatgcaaaaactattggctggagtatttctgatatactgcacaaagagaatctagataacttcattccagcgacaacagctggattaaacggcacagtggatacatcagattacatgaggcgatacaagagttctttaatggatggaaggttgaaggactgtgtggatttgttggaaagcatggagcagaagggattgcttgatacgaagaagatccatcatgccagctttttgagtgcatgtaaaaaacaaagggctgttatggaagctgttcgcttctgccgattgattgaaaatccgaaaatgagcaccttcaatatgcttttatcggtttgtgctaattcaaaagattttgaaggggccctccaagttatggtgctcctaaaggaggctgggctaaaacccgattgtaaactttacactacattgatatcaacttgtgcaaagtgtggaaaagttgatgcgatgtttgaggtcttccatgagatggttagtgctggaatagagccaaatgttaacacatacggtgcactaattgatggctgtgctaaagctgggcaagtagcaaaagcatttggtgcttacggcatcatgagttcaaagaaggtgaagccagatcgagttgtcttcaatgctttgatcagtgcatgtggtgaatctggagctgttgctcgagcttttgatgttttatcagaaatgacagcagaatcctcagaatcgaaaggatgcaagccaattcttcctgatcatgtcacagttggagcactcatgaagacatgtattcaggctggccaggctgatcgagctcgtgaggtttacaaaatgcttcaggagtacagtataaaaggtactccagaagtttacacaattgcactgagaagctgtagcttgactggcgatttagggtttgcattgaagatctatgaagatatgaacaagatcggagttcaacctgatgagatgtttctgagtgctctagttgatgtagccggccacgctaggagggctgatgctgcttttgaaataatcaaagatgtaagagcaaagggatttcatgttggaatcatggcatacagttcctgtatgggcgcttgctgcaatgccaaggactggaaaaaggcgctgcagctatttgaggagatcaaggctatcaaattaattccaacagttccgatgatgaatgctttaatcacttccctttgtgatggcgatcaagttttaaaatctgctgaggtccttaatgagataaaggaactaggtgtccgtccaaatgagataacctattctgtcttatgtgtggcttgcgaaagaaatggtgaagcacaactagctcttgatttgtttgagcaactaaaattagatggtattgtcctcaatcccaccattgttggttgtcttactggtttatgtctacaaatgttttcctatgatctttcacttggcaacatcattgtcagattcaaccaagggaagccacagattgacaataaatggacttcctcagcaattatggttttccgtcaggcaatcaccgctggtctgctaccctcaagcgacgttttatctcaagtgctgggatgtttgaggtttcctcatgacagttcactgaaaaccactttcattgataatatgggaataagttgtgatatgccacatcaccccaatacaaattcactgttggaaggattcggtgaatatgatatccgtgctttttcagtactggaggaaggtggtttgttaggagcagttgcaagcacttccacaaaatatagtcaaattgtcattgatgcaagaaagtcaaacatctacacagccgaggtttctcttctatcgacattgaagtctttgaagcatcgactagctgcaggtgcaaggttaccaaatgttacaattctattacccacagaaaagaaacaagttgatctcgatgaaagggagaaaacacttaaacttgctggaagagttgggcaagcagttggctccctgctgagaagattaggaattaaatatcaaggcgaggaatcccacgggaggatgaggatcaacggcctcacattaagaaggtggtttaacccaaaatttacaagcgcaccctccacaggagctccagttgagttgctcccactgccctcgcggttagcgaaagggattgctgatcagcagcgtgatatcagaagcctttctctatagtgcaggtcttaccttttccatgtcctgatttttgtgcttaccaagaaggcaattatgatacaatcagcagatagcagggccggccttgattttttttttttgagaacgttggcactttattaaggaaaaactaacgcccacacgtgtggcatcttgcacattgcccacatgtcttcaataccactcattttgtcacatatgaatagatgacatcagtaggaatctttttggttttcggcttaaaaatattttatcttctaattaaaaatctaattataacccctttttcaccattaaatacgtctcaacgagatgttcaaaactagaccctgtgttcatatgcttcaaaaagtc

SEQ ID NO: 6025 - DNA, 3163 bp, Triticum aestivum
cagtagcgatatccaaagcaactcatcgcggcacaccaccagtgcacgaacaaatgcaaacaccaaccatgccgacgcccatggccacgcggccgacgtcgacaatggcggcgaagctgcccgcgccgtcgacgccgcggcaatgctacctcctgccaggccgccgggcagggctcgcgcgcggcgccccctcggcgtcgtcgaagaagcggaacccgtggctcgacccgttcgacgacgggcccgacgaggagttcgactacacgggcgtgtactcgggcgggaagcaggaggaggacccgcggccgccggaggacgcggagaacccctacggcttcctccggttccccatggggtacatgccggagctggacagcctggcgtccaaggtgcgcggcgacgtgcgccgcgtctgctgcgtggtctccggcggggtctacgagaacgtgctcttcttccccgtggtgcagatgctcaaggaccggtaccccggcgtgctcgtcgacgtggtggcgtcggcgcgcgggaagcaggtctacgagatgtgcaagaacgtgcggtacgccaacgtgtacgaccccgacgacgagtggccggagcccgccgagtacacccaccagctcggcgtcatgaaaaataggtactacgacatggtcctgtcgaccaagctggcagggacggggcacgcgctgttcctcttcatgtcgtcggcgcgggagaaggtcggctacgtctaccccaacgtcaacggtgccggcgcggggctgttcctcaccgagatgttcaagccggcgaccaccaacctcgccgacggcggctacaacatgtaccaggacatgctggagtggctgggccggccggccaagggcgtgccgcagcagccgacgccgccgctcagggtgtccatctccaagaagctgagggcggtggtggaggacaagtacaaccgcgcgggcgtggagaagggcaagtacgtcgtcatccacggcatagaatcggactccgtcgccaacatgaagtcccggggagacgacgactgcctcctccccctcgaactgtgggcagagatcgccaaggagatcagctccggaggcaatgggctgaggcctctgtttgtgatgccacatgagaagcacagggaagagatcgaggagattgtcggtgaggagacggcctacctgttcatcactactcctggacagctcacatgcctcatcaatgactctgccggcgtcgtggcgaccaacaccgccgccgtccagctcgccaacgcccgtgacaagccatgtgtggcgctgttctcctccaaggcgaaggcgaggctgttcctgccgtacgcggaggagaggaagagctgcaccgttgtcgcgtcggcgacaggcaagctggccggcattgacatcgaggcggtgaagaaggcggtcaaggacttggagcccgctcctagcttcgcattggcacaaacataataaaaaagcatcgtcttcgttgtgttgtacatagatatgaaaatcgagctcatctgaccaacaaatgtgaccaagagttcggtttcttttcttttttgaatggtcacggggagggaaaggctccccacctgaatatatttcaaaggtagcagatgttacagagttcacagatggttcgaagagaggaactcacgccacaaagaagaacatctttagcaattagagatacttaagattttctgactaataaagaactgaaagtgcattttcaaaaggaatactacatgtggagacaacaaaataatctgatcagaaaacaagatctatcgtttgttagatctagtaagaagcagagtcctactcctggcaactaaaagaactacaaacttaaccagctcctccttcaccataaaaaggaccgaggcggcaagaacactctgtacaatctttgtacccattcctttgtaaaatccatgcaatccctcgtagcgaatcatcttcaatattgcatctaatgtacctgtatatctggacgccgcgttcctgccaatttcttgttttgcctgcaacctagacttgaccactaacaacgggtaggtcacaagagtagctcccagctttgccattgcacctattaagaatacctccatagcagtgatattcttcttggggaatcgctttccagaccgctttgacttgagacgctttgacagtgtttcatatatcataaactgaattgatggattgcataccataattagtgtcggaataagtcctttccagaatccacttatgcctgattcacgatagacctcccggatcgcttgaagtgtgccatatgggcgaggtttttcagaatcaagcttagctaatctatccttaagaatatgagcatccattggattggccctggatatttccttaagcaaaagctccctcttggactctatcaccttcctttctgcctgtgtatgtgtctgcatacgtgtgacaagaacccatattggaattgtaagaagaacattgattgacccagcaacagctgcaataacaagccaagaaaacatcccaacagtgccatcccctaggccctttttcccacgagcagctgccacatcttccaccttgttcttgagaagctggtagaagtagtaatagattccctgcgaggcagcggtgccaataagtgagggtttgaggccgctgtacaacccaccccagccttccgtttggaccagctggagcatctggaagagggtggaagcgtcggagccaccaccaccggccttcttcttcttcgctgacctctctgtctgctgccgggtgttcacggtctggagggggtatgtgatgatctgggcgatgataccgccgccggcgccggccagcccgctcaccaccgcgctcgacatgctccaaccttgctactggaacgctactgcttgtccggcggagacagccggcggaggcgcccaccgctgcgccgagctgccgcggacgcgagacaaggcgccaaggttggccgtcggcgcgccgtgtggagcccggagccggactgtggagcgagatttagggaaggggagatcgaattggttgccactggcactggcggacgacggggacgaacgagggtgtgctccgcgatttttcacatttcgctttccttcgcggggattaggggaagagagagtcag

SEQ ID NO: 6026 - DNA, 1805 bp, Hordeum vulgare
ggcaccaccatcatcccctctccctctcctccacctccacacactggaggaaaaaaacggtagcgatatccaaagtaagtcctcgcaacgcaccaccactgcaggaccaaatgcaaacgccaaccatgccaacgcccatggccgcgcggcccacgtcgacaatggcgacgaagcttcccgcgccgtcggcgacgccgcggcaatgccaccttctgcctggccgccgggtggcggggctcgcgcgggcgtcgtccaagaagaggaacccatggctcgacccgttcgacgacgggccggacgaggagttcgactacacgggcgtctactctggcgggaagcaggaggaggacccgcggccgccggaggacgcggagaacccctacggcttcctccggttccccatggggtacatgccggagctggacagcctggcgtccaaggtgcgcggcgacgtacgccgcgtgtgctgcgtggtctccggcggcgtctacgagaacgtgctcttcttccccgtggtgcagatgctcaaggacaggtaccccggcgtgctcgtcgacgtggtggcgtccgcgcgcgggaagcaggtctacgagatgtgcaagaacgtccggtacgccaacgtctacgaccccgacgacgagtggcccgagcccgccgagtacacccaccagctcggcgtcatgaaaaataggtactacgacatggtcctgtcgaccaagctggcagggacggggcacgcgctgttcctcttcatgtcatcggcgcgcgagaaggtcggctacgtctaccccaacgtcaacggtgccggcgccgggctgttcctcaccgagatgttcaagccggcgaccaccaacctcgccgacggcggctacaacatgtaccaggacatgctggagtggctgggccggccggccaagggcgtgccgcagcagccgataccgccgctcagggtgtccatctccaagaagctgcgggcggtggtggaggacaagtacaaccgcgcgggcgtggagaagggcaagtacgtcgtcatccacggcatagaatccgactccgtcgccaacatgaagtccaggggagacgacgactgcctcctccccctcgaactgtgggcagagatcgccaaggagatcagctccggaggcaatgggctgaggcctctgtttgtgatgccacatgagaggcacagagaagagatcgaggaaatcgtcggtgaggagacggcctatctgttcatcactactcctggacagctcacctgcctcatcaacgactctgccggcgtcgtggcgaccaacaccgccgcggtccagctcgccaacgcccgcgacaagccatgtgtggcgctgttctcctccaaggagaaggcgaggctgttcctgccatacgtcgaggagaggaaaagctgcaccgttgtcgcgtcggcgacaggcaagctggccggcattgacatcgaggcagtgaagaaggcagtcaaggacttggagcccgctcctagcttcgcattggcacaaacataatcaaaatcatcgtctccattgtgttgtacatatagacatgaaaagcaagctcatctgaccaacaaatgtgaccaagagttcggtttcttgtagttactccagttcggcacacaatatatgtattggcgcaccgacgcttatgggtcaatacctcctgtgcgacatatttgacgcgaaatggaagcagtgcgacgttgttgatcaaaatagctctggatgcgacatctttgaagcaaacaatagctacaatgcgacatggctctgtttaaccatgaaatgcaaaac

SEQ ID NO: 6027 - DNA, 1669 bp, Secale cereale
ctcatcgcagcacaccaccactgcacgaacaaatgcaaacaccaaccatgccgacgcccatggccacgcggccggcgtcaacaatggcggcgaagctgcctgcgccgtcgacgccgcggcaatgctaccttctgccaggccgccgggcagggctcgcgcgcggcgcgccctcggcgtcgtcgaagaagcggaacccgtggctggacccgttcgatgacgggccggacgaggagttcgactacacgggcgtgtactcgggcgggaagcaggaggaggacccgcggccgccggaggacgcggagaacccgtacgggttcctccggttccccatggggtacatgccggagctagacagcctggcgtccaaggtgcgcggcgacgtgcgccgcgtgtgctgcgtggtctccggcggggtctacgagaacgtgctcttcttccccgtggtgcagatgctcaaggacaggtaccccggcgtgctcgtcgacgtggtggcgtcggcgcgtgggaagcaggtctacgagatgtgcaagaacgtccggtacgccaacgtgtacgaccccgacgacgagtggccggagcccgccgagtacacccaccagctcggcgtcatgaaaaataggtactacgacatggtcctgtcgaccaagctggcggggacggggcacgcgctgttcctcttcatgtcgtccgcgcgggagaaggtgggctacgtctaccccaacgtcaacggtgccggcgctggactcttcctcaccgagatgttcaagccggcgaccaccaacctcgccgacggcggctacaacatgtaccaggacatgctggagtggctgggccggccggccaagggcgtgccgcagcagccgataccgccgctcagagtgtccatctccaagaagctgagggcggtggtggaggacaagtacaaccgcgcgggcgtggagaagggcaagtacgtcgtcatccacggcatagaatcggactccgtcgccaacatgacgtccaggggagacgacgactgcctcctccccctcgagctgtgggcagagatcgccaacgagatcagctctggaggcaacgggctgaggcctctgttcgtgatgccacatgagaggcacagggaagagatcgaggagatcgtcggtgaggagacggcctacctgttcatcactactcctggccagctcacctgcctcatcaatgactcggccggcgtcgtggcgaccaacaccgccgccgtgcagctcgccaacgcccgcgacaagccatgtgtggcgctgttctcctccaaggggaaggcgaggctgttcctgccgtacgtggaggagaagaagagctgcaccgttgtcgcgtcggcgacgggcaagctggccggcattgacatcgaggcggtgaagaaggcggtcacggacctggagcccgctcctagcttcgcgttggcacaaacataatcaaaagcatcgtcttccttgtgttgtactgtacatagatatgatatgaaaatcgagctcatctgaccaacaatgtgaccaagagttcggtttcttgtagatacttcaattcagcagacacataaatattgacgcaccgaggcgtactccgtgtttgtaaatttgacttcttctatacccctacctgatgtaatattaaaaggataagaaaatggttacaa

SEQ ID NO: 6028 - DNA, 1674 bp, Triticum aestivum
aaacagtagcgatatccaaagcaactcatcgcggcacaccaccagtgcacgaacaaatgcaaacaccaaccatgccgacgcccatggccacgcggccgacgtcgacaatggcggcgaagctgcccgcgccgtcgacaccgcggcaatgctacctcctgccaggccgccgggcagggctggcgcgcggcgccccctcggcgtcgtcgaagaagcggaacccgtggctcgacccgttcgacgacgggccggacgaggagttcgactacacgggcgtgtactcgggcgggaagcaggaggaggacccgcggccgccggaggacgcggagaacccctacggcttcctccggttccccacggggtacatgccggagctggacagcctggcgtccaaggtgcgcggcgacgtgcgccgcgtctgctgcgtggtctccggcggggtgtacgagaacgtgctcttcctccccgtggtgcagatgctcaaggaccggtaccccggcgtgctcgtcgacgtggtggcgtccgcgcgcgggaagcaggtctacgagatgtgcaagaacgtgcggtacgccaacgtgtacgaccccgacgacgagtggccggagcccgccgagtacacccaccagctcggcgtcatgaaaaataggtactacgacatggtcctgtcgaccaagctggcggggacggggcacgcgctgttcctcttcatgtcgtcggcgcgggagaaggtcggctacgtctaccccaacgtcaacggtgccggcgccgggctgttcctcaccgagatgttcaagccggcgaccaccaacctcgccgacggcggctacaacatgtaccaggacatgctggagtggctgggccggccggccaagggcgtgccgcagcagccgacgccgctgctcagggtgtccatctccaagaagctgagggcggtggtggaggacaagtacaaccgcgcgggcgtggagaagggcaagtacgtcgtcatccacggcatagaatccgactccgtcgccaacatgaagtcccggggagacgacgactgcctcctccccctcgaactgtgggcagagatcgccaaggagatcagctccggaggcaatgggctgaggcctctgtttgtgatgccacatgagaagcacagggaagagatcgaggagattgtcggcgaggagacggcctacctgttcatcactactcctggacagctcacctgcctcatcaatgactctgccggcgtcgtggcgaccaacaccgccgccgtccagctcgccaacgcccgtgacaagccatgcgtggcgctgttctcctccaaggcgaaggcgaggctgttcctgccgtacgcggaggagaggaagagctgcaccgttgtcgcgtcggcgacaggcaagctggccggcattgacatcgaggcggtgaagaaggcggtcaaggacttggagcccgctcctagcttcgcattggcacaaacataatcaaaagcatcgtcttcgttgtgttgtacatagatatgaaaatcgagctcatctgaccaacaaatgtgaccaagagttcggtttcttgtagttacttcagttcagcagacaatatatattggcgcaccgaggcgtattccgcgattgtaaatttgacttctctaaataagtggtcaatctaaatgtacgggacagttcacgc

SEQ ID NO: 6029 - DNA, 2707 bp, Oryza sativa
aaggagatcgaggaatggtggcacaagaaaacaggaccaattggcaccatcatcgtgcactttatccttcctcctccacacatccctaacccaccacatccaaacccctcctccacacaccaaaaaacaaaaaacatagaaataaataaataaaaacaatagcaatatccaaagcaactcatcagcacactcactctgcaacaagcatgcagacgccaaccatgtcgacgtccatggccacgccggcgaagctcccctcaccgccgtcgctgccgatagcgaggcaatgctgctgccacctgctgcagctagggcggcgcggcggcgcgggcgtggcgcgggcgtcggcgaagaagaagaacccgtggctggacccgttcgacgacgggcccgacgacgagttcgactaccgcggcgcgttctcgggggggaagcaggaggaggacccgcggccgccggaggacccggcgaacccgtacgggttcctgcggttcccggcggggtacaacccggagctggatagcctggcatccaaggtgcggcgcgacgtgcggcgggcgtgctgcgtggtgtccggcggggtgtacgagaacgtgctcttcttcccggtggtgcagctgctgcgggacaggtaccccggggtggtggtggacgtggtggcgtcggcgagggggaagcaggtgtacgagatgtgcaagaacgtcaggtacgccgacgtctacgaccccgacgacgactggcccgagcccgccgagtacacccaccagctcggcgtgctcaagaacaggtactatgatctgatcatatcgaccaagttggccgggatagggcacgcgctcttcctcttcatgtcgtcggcccgcgacaaggtcggctatgtttaccccaacgtcaacagcgccggcgccgggctgttcctcaccgagatgttccggccgccgaccaccaacctcgccgacagcggctacaacatgtatcaggacatgttggagtggattgggcggccagcgaagggtgtgccggagcacccggtaccgccgttgcgggtgtccatctccaagaagctccgagcgttcgtggaggacaaatatagccgtgccggcgtcgagaagggcaagttcgtcgtcgtccacggcatcgcctccgactccttcgccaacatgaggtcgaggggggacgatgactgcctcctccctctcgagcattgggctgagatcgccaaggagatcagctctgaagacaatggtctgaagcctctgtttgtgatccctcatcagaagcacagggaagaggttgaggagactgtggggaaggacaccaatatcctgttcatcaccactcctggccaactcacctgcctcatcaacgactccgtcggcgtcgtcgcgaccaacaccgccgccgtccagctcgccaacgccagggacaagccatgcgtggctctcttctcatccaaggagaaggcgaggctgttcctgccgtacttggaggagaagaagggctgcaccgtcgtcgcgtcggagaccgggaagctgatcgacatcgacgtcgaggccgtcaagaaggcggtgaaggagttcaaggccgccccaagcgttgcattggctcaaacatgatgaagaccatcatcttcttgttgcactgtacatagatctgcacggttacagtgagctcgcctgagcaagtgagcagcaaaagctccttgcctggctctgattcaatgtgtcttgtagtcgttcagttcagctacaaatgttccacatacaaccgcatgaaatgcccaaactcaccttgtctactgctcaccgagcagacaagcgatgcagcctgtgttactctgtttatagaatggaaatggcatacaccttgcacgtttttatgatataacaccagatacaataaacatatcatggcatggatcggcttagatgtgcaatgaatccaagcagagcaccccacacatgaagtttctcaggtctccttgttgcttagcctcagtaagcgatacagtacctatacacactaggggtttggagatctatacaagggggacaactgtaagtatcatggcttcccgagcctagatgcttctatccaatggtgctccacagaatgccggccctcaactcatgtacagaatctaacacaacaatagctccccgaaccaataaataccacaaactaatacattaatcgaatcaaccctaacctcacaggatcaattattttggacaggaactaccgcggaagtatctttcaagagggtattcttcatgtcatcgggattagttttaatgctgataagggtttgcgcagactccactgccttctcaccaccgatttctgaagtcttgcccttcatgggctcatcgccgccatccttcagcagactgatcggctgtttctgttctgatgttgaggtcattgtgctgggctgctcagatgttgtctctgctggaatgatcataggaacaggcccatccttcgactcactgttgtttctaaacggttgatcatggttgtgcttaccttcataggtcacaacaatattgttatcatcgtctggtgccttctcaacatgcttacggacagggcacccatcatgagtacaacggtagtagctcctgtatagaacaaaagaaattaataagaacttataaaaaatgcagtagctcctgcttggttaatcactcatattaacttgttg

SEQ ID NO: 6030 - DNA, 2443 bp, Sorghum bicolor
atccagccccaaatccaaaccccttctccctcctctcttcccttacccgaagggaaataaagatggaaaacaaacacacacagcagcaacaatatccaaaggtagcaactgatcaccagcagtctccaatagcatagcaacaccaagaagctacgccgaccatgtcgacgtccatggccaccacgcccacgacggcaagggccatggcgccagcgagaccccccgcgccgcggcaatgctgcaggtacctcgtcctcccctccaccggccaccgccgcagcatcgcggcgtggtctgcgaagaagaagaacccgtggctggacccgttcgacgacgggcccgacgaggagttcgactaccagggcatgttctccggcgggaagcaggaggaggacccgcggccgcccgaggaccccgcgaacccgtacgggttccttcggttcccgcagggctacaacccagagctggacagcctcgcctccaaggtccgcggcgacgtgcggcgcgcgtgctgcgtcgtgtcgggcggcgtgtacgagaacgtgctcttcttccccgtggtgcagatgctcaaggaccggtaccccggcgtgctggtcgacgtggtggcgtcggccaggggcaagcaggtgtacgagatgtgcaagaacgtcaggtacgccaacgtctacgaccccgacgacgactggccggagcccaccgagtacacgcacatgctcggcgtcctcaagaataggtactatgatctgatcgtgtcgacgaggctggccgggctcgggcacgccctcttcctcttcatgtcgtcggcgcgcgacaaggttggctacgtttaccccaacgtcaacagcgtcggcgcgggcctgttcctcgacgagatgttcaagccgccgaccaacaacctctccgacggagggtaccacatgtacaaggacatgctggagtggatcggccggccggcgaaggacgtgccccagcagccgacaccgccgctgcgggtgtccatctccaagaagctgcgggcgtacgtggaggacaagtacagccgcgccggcgtggagaagggcaagtacgtcgtcatccacggcatcgcctccgactccgtcgccaacatgaagtccagaggcgacgacgactgccttcttcccctcgagcactgggctcagatagccaaggagatcagctccggcgacaaggggctcaagcctctgttcgtgatcccccatgagaagcacagagatgagatcgaggaggaggtcggggaagacgcaaacatcctgttcatcaccaccccaggccagctcacgtgcctcatcaacgactctgccggcgtcgtcgcgaccaacacctctgccgtgcagctcgccaacgcccgcgacaaggcatgtgtggccttgttctcgtcggcagagaaggcgaagctgttcctgccgtacgtggaggataagagcagttgcaccgtcatctcgtcggccacggggaagctgatcgacatcgacatcaacgcagtgaagaatacggtgaaggacttcgagcccgctcccagcttcgcattggcataaaagtagcggctgccaacatcaatccattgcgttgtacacagttccagagaatttatgtgagcagacactctggagacaagacaatgatgcagctattacaaactgcaaataggacagcatgcataatgtgtattccgatgttataccgatatataaataaatcacatctcatatcagctatgcaataaatcgaactagaacaatacagcacacaaggttctaaagaaccatcccacacatgttatctggtctccttgttgctgagcctcatgtaaaatacagtacctatacacactagggaatgggaatctatacaggcagacgaccagtcatggcttcctgaacctaacgcttcctcaaatgttccccagtgctccacggaacgccgaacaccaaagcctcacctcatacacaagttaacacaataacatatcactgaaccaataaatatgacaacctaagatgtcaatcgaatcacctcctatctcagcatgctcaactgttttggacttgtactgcagcagaagtttctttcaggacagagttcttcatgtcatcggagttagttttgatgctgagcagtgtttgtgcagattcaagtgccttctcacctccaaattccaaagttgtctccttatcagactcactgttggcatccttctgagtaatggttggaggtttctcatctgatgtagttgatgtgttgggttgctcagtggttgttgctgacggactgattgcagaaactggtatgctgctgcttctgaatggttcatcgtgattgtgtttaccttcataagttacaacaatattgttaacatcatctggtgccttttccacatgcttacggacagggcatccaccatgcgtgcagcggtaataac

SEQ ID NO: 6031 - DNA, 2349 bp, Sorghum bicolor
aaaagagcacaggaaaccaaaaggctgataaacgccagcatcagcgtgccctttattatccctcctcgtccacacatccagccccaaatccaaaccccttctccctcctctcttcccttacccgaagggaaataaagatggaaaacaaacacacacagcagcaacaatatccaaaggtagcaactgatcaccagcagtctccaatagcatagcaacaccaagaagctacgccgaccatgtcgacgtccatggccaccacgcccacgacggcaagggccatggcgccagcgagaccccccgcgccgcggcaatgctgcaggtacctcgtcctcccctccaccggccaccgccgcagcatcgcggcgtggtctgcgaagaagaagaacccgtggctggacccgttcgacgacgggcccgacgaggagttcgactaccagggcatgttctccggcgggaagcaggaggaggacccgcggccgcccgaggaccccgcgaacccgtacgggttccttcggttcccgcagggctacaacccagagctggacagcctcgcctccaaggtccgcggcgacgtgcggcgcgcgtgctgcgtcgtgtcgggcggcgtgtacgagaacgtgctcttcttccccgtggtgcagatgctcaaggaccggtaccccggcgtgctggtcgacgtggtggcgtcggccaggggcaagcaggtgtacgagatgtgcaagaacgtcaggtacgccaacgtctacgaccccgacgacgactggccggagcccaccgagtacacgcacatgctcggcgtcctcaagaataggtactatgatctgatcgtgtcgacgaggctggccgggctcgggcacgccctcttcctcttcatgtcgtcggcgcgcgacaaggttggctacgtttaccccaacgtcaacagcgtcggcgcgggcctgttcctcgacgagatgttcaagccgccgaccaacaacctctccgacggagggtaccacatgtacaaggacatgctggagtggatcggccggccggcgaaggacgtgccccagcagccgacaccgccgctgcgggtgtccatctccaagaagctgcgggcgtacgtggaggacaagtacagccgcgccggcgtggagaagggcaagtacgtcgtcatccacggcatcgcctccgactccgtcgccaacatgaagtccagaggcgacgacgactgccttcttcccctcgagcactgggctcagatagccaaggagatcagctccggcgacaaggggctcaagcctctgttcgtgatcccccatgagaagcacagagatgagatcgaggaggaggtcggggaagacgcaaacatcctgttcatcaccaccccaggccagctcacgtgcctcatcaacgactctgccggcgtcgtcgcgaccaacacctctgccgtgcagctcgccaacgcccgcgacaaggcatgtgtggccttgttctcgtcggcagagaaggcgaagctgttcctgccgtacgtggaggataagagcagttgcaccgtcatctcgtcggccacggggaagctgatcgacatcgacatcaacgcagtgaagaatacggtgaaggacttcgagcccgctcccagcttcgcattggcataaaagtagcggctgccaacatcaatccattgcgttgtacacagttccagagaatttatgtgagcagacactctggagacaagacaatgatgcagctattacaaactgcaaataggacagcatgcataatgtgtattccgatgttataccgatatataaataaatcacatctcatatcagctatgcaataaatcgaactagaacaatacagcacacaaggttctaaagaaccatcccacacatgttatctggtctccttgttgctgagcctcatgtaaaatacagtacctatacacactagggaatgggaatctatacaggcagacgaccagtcatggcttcctgaacctaacgcttcctcaaatgttccccagtgctccacggaacgccgaacaccaaagcctcacctcatacacaagttaacacaataacatatcactgaaccaataaatatgacaacctaagatgtcaatcgaatcacctcctatctcagcatgctcaactgttttggacttgtactgcagcagaagtttctttcaggacagagttcttcatgtcatcggagttagttttgatgctgagcagtgtttgtgcagattcaagtgccttctcacctccaaattccaaagttgtctccttatcagactcactgttggcatccttctgagtaatggttggaggtttctcatctgatgtagttgatgtgttgggttgctca

SEQ ID NO: 6032 - DNA, 1713 bp, Zea mays
cccatctcccacctctccttccttaccggaagagaaaaaaagatgaaaaccaaacgaacatacacagatacaagcacagcagcaacgatatccaaagctagcagctcatcagataggcaaacaccaagaagctaagctagcgcgccatgcagacgccgaccatgtcgacgtccatggccaccacggcgccagcgaagccccccgcgccgccgcggcaatgctgcaggtacctcctcctcccctccaccggccaccgccggagcgtggcggcatggtctgccaaaaagaagaacccgtggctggacccgttcgacgatgggcccgacgaggagttcgattaccagggcatgttctccggcgggaagcaggaggaagacccgcggccgcccgaggaccctgagaacccgtacgggttcctgaggttcccgcagggctacaacccggagctggacagcctcgcctccaaggtccgcggcgacgtgcggcgcgcgtgctgcgtcgtgtcgggcggcgtgtacgaaaacgtgcttttcttccccgtcgtgcagatgctcaaggaccggtaccccggcgtgctggtggacgtggtggcgtcggccaggggcaagcaggtgtacgagatgtgcaagaacgtcaggtacgctaacgtctatgaccccgacgacgactggccggagcccgccgaatacacgcacatgctcggcgtcctaaagaataggtactatgatctgatcatctccacgaggctggcggggatcgggcacgcgctcttccttttcatgtcgtcggcgcgcgacaaggtcggctacgtttaccccaacgtcaacagcgtcggcgcgggcctcttcctcaacgagatgttcaaggcgccgactaacaacctcgccgacggcgggtaccacatgtataaagacatgctggagtggatcggccggccggcgaagaacgttccccagcagccgacacagccgctgcgggtgtccatctccaagaagctacgggcgtacgtggaggacaagtatagccgcgccggcgtggagaagggcaagtacgtcgtcatccacggcatcgcctctgactccgtcgccaacatgaagtccagaggcgacgacgactgccttcttcccctcgggcactgggctcagatagccaaggaaatcagctccggcgacagggggctcaagcctctgttcgtgatccctcatgagaagcacagagatgaaatcgaggaggaggtgggggacgacacaagcatcctgttcatcaccaccccaggccagctcacctgcctcatcaacgactctgccggcgtcgtcgcgaccaataccgctgccgtgcagctcgccaacgcccgcgacaagccatgtgtggcgttgttctcgtcggcagagaaggcaaggctgttcctgccatacgtggagggcaagagcagctgcaccgtcatatcttcggcgacggggaacctgatcgacatcgacctcaacgcggtgaagaatgtggtgaaggacttggagcccgctcccagcttcgcattggcacagaagtagcagctgcgttccaacatcacccccattgctttgtacatagttcaaacagcagcaacgctagagagaatggtgcagtattacaaactacaaacagcacacatgccgtgtattccgatgttataaataacatctcatatcagctatgcaacgaataaaacttagaaca

SEQ ID NO: 6033 - DNA, 1706 bp, Zea mays
atcccaaccctaatccaaaccccttctccatcctctcttcccttggtcgattggaaacaaatggaaaagaaactagtatcacacacacaggtaccaccggcacagcagcaacaataagcaaagagcagtctccaatagtatagcaacaccaagaaaataagcgccatgcagacgccggccatgtcgacgtccacggccacgacaacaagggccatggcgccagcgaagccccccgcgcggcggcattgctgcagctacctcctcctcctcctaccctccaccggccaccgccgcagcgtcgcggcgtggtccgcgaagaaaaagaacccgtggctggacccgttcgacgacgggcccgacgaggagttcgactaccagggcatgttctccggcgggaagcaggaggaggacccgcggccgcccgaggaccctgcgaacccgtacgggttcctgcggttcccgcagggctacaacccggagctggacagcctcgcgtccaaggtccgcggcgacgtgcggcgcgcgtgctgcgtcgtgtcgggcggcgtgtacgagaacgtgctcttcctccccgtcgtgcagatgctcaaggaccggtaccccggcgtgctggtcgacgtggtggcgtcacccaggggcaagcaggtgtacgagatgtgcaagaacgtcaggtacgccaacgtctacgacccggacgacgactggccggagccagcagagtacacgcacatgctcggcgtcctaaagaataggtactatgatctgatcgtgtcgacgaggctggccggcatcgggcacgcgctcttcctcttcatgtcatcggcgcgcgacaaggttggctacgtttaccccaacgtcaacagcgtcggcgccggcctgttcctgaacgagatgttcaaggcgccgaccaacaacctcgccgacggcggctaccacatgtacaaggacatgctggagtggattgggcggccggcgaagaacgtgccccggcagccgacgcagccgctgcgggtgtccatctccaagaagctacgggcgtacgtggaggacaagtacagccgcgccggcgtggagaagggcaagtacgtcgtcgtccacggcatcgcatccgattccgtcgccagcatgacgtccagaggcgacgacgactgccttcttcccctcgagcactgggctcagatagccaaggagatcagctctggcgacaaggggctcaagcctctgttcgtgatcccccatgacaagcacagagaggaggtcgaggaggaagtgggggacgacacgaacatcctgttcatcaccaccccaggacagctcacctgcctcatcaacgactctgccggcgtcgtcgcgacaaacaccgctgccgtgcagctcgccaacgcccgcgacaagccatgtgtggccttgttctcgtcggcagagaaggcacggctgttcctgccgtacgtggaggacaagagcagctgcaccgtcatctcgtcgatgacggggaagctgatcgacatcgacatcaacgccgtgaagaatgcggtgaaggacctggagcccgctcccagcttcgcattggcacagaagtagcagctcccagcatcattccatcgctttgtttgtacacagtaccagagaatgtaatggtgcaggctatcacaaactgcaaacggcacgcacgatgtgttataccgataaataaatgacaatctcgt

SEQ ID NO: 6034 - DNA, 785 bp, Panicum virgatum
  misc_feature (336)..(336): n is a, c, g, or t
  misc_feature (347)..(347): n is a, c, g, or t
  misc_feature (409)..(409): n is a, c, g, or t
  misc_feature (448)..(448): n is a, c, g, or t
  misc_feature (466)..(466): n is a, c, g, or t
  misc_feature (490)..(490): n is a, c, g, or t
  misc_feature (508)..(508): n is a, c, g, or t
  misc_feature (526)..(526): n is a, c, g, or t
  misc_feature (581)..(581): n is a, c, g, or t
  misc_feature (595)..(595): n is a, c, g, or t
  misc_feature (601)..(601): n is a, c, g, or t
ccaaccacccccatcatttctctccactccaccacggggccgcggcgactgcgccgccggctccggcggtgactgaccggtgaccctctgcagatcgacgaggagcgtcgttacagcgcagcgcagatgcttggccagtagccgccggccgcatatgtcagctctcgccttgtgcgagggagccgccaagtcgccgtgctggtcggaatgctctggatcgaggctgctttttcctacatcccgcgttcggagggggcccatttcctgccgccgggagaagccagggaccttttgcttgctcacggcatctccttccttgcgcacaaactcgaggcngatgcaatggnccgtcaagaccatgtcagacgatagtagtgaccaatcaggcaataacactcgccttttcagngcaattcaatccttttggaacaagttttctgccaagctnaacaaagcaaggagaggnttaccaatgaagatcctattcttnctgattggattctattgngcgacggcctttgctacngtcattgggcaaacaggtgactgggatatattgtctgccggacttgctgttgccnttgtggagggtatnggtgcnctgatgtacagggcgtcctttgcatttcttggtaggatcaggaatatgattaccatattcaattactggaaagctgggcttacacttgggttgtttttggattcttttaaatatgaagtggatgagcttcttgaatcgtgtaatccattcaacttcgagattaatatatttgctggcctttggt

SEQ ID NO: 6035 - DNA, 841 bp, Zea mays
attcgccgcccagccctcacagactcgtctcgtcgtcggccactcccgtccgcgagccgctccatccaaccacctcatccctctccgacacgggccgcggccgaccgccggctccgtggccttgacaccagttgacgaggagcatctctactctacagcgcaaatcggcagatgcttggtcaatatccggcggcggcatatgtcaactctccccttatgcgatggaactgccaactcgccgtgctggtcggagtgctctggatcgaggcttgctgctgcgcgccgtgttgggagggaagctgccgtctcctgccgctgggagaagccggggaccctctgtttgctgagggcaaaatctccttccttgcgcaggcactcgaggaaggtgcaatgggctatcagaaccatgtccgacgacagcggtgaccaatcaggcaacagcactcgcctcttcagcgcgatccgttcattctggaaccagttgtctgccaagctgaagaaagcaaggagagggttgccagtgaagatcctattctttctgatcgggttctactgcgctaccgcgttcgctaccgtcatcgggcaaacgggtgactgggacatattgtcggccggacttgctgttgccatcgtggaggttatcggtgcgctgatgtatagggcctcctttgcattcctcggtaggatcgggaacatgattaccgtgtttaattactggaaagctgggcttacacttgggctgttcttggactctttcaagtatgaagtggatgaatttcttgaatcgtgtaacccattcaactttcagattaatatatttactgggttttgttggtgaatt

SEQ ID NO: 6036 - DNA, 823 bp, Sorghum bicolor
tatgcagcgcagatgcttggtctgtagccggcggcggcacatgtcagctctccccttgtgcgatggaactgccaactcgccgtgctggtcggagtgctccggatcgaggctttgctgctgcgccccgtgttgggaggggagctgccgtttcctgctgctgggagaagccagggaccctctgcttgctgagggcaaaatctccttccttgcccagacactcgaggaaggtggaatgggccatcagaactatgtcagacgacagtggtgaccagtcaagcaacagcactcgccttttcagtgcaattcgatcattttggaacaaattgtctgccaagctgaagaaagcaaggaaagggttacccgtgaagatcctattctttctgattggattctattgcgctactgcgttcgctaccgtcattgggcaaacgggtgactgggacatactgtcagccggacttgctgttgccgttgtggaggttattggtgcgctgatgtacagggcttcctttgcgttacttggtaggatcaggaacatgattaccatatttaattactggaaagctgggcttacacttgggctgttcttggattcattcaaatatgaagtggatgagtttctcgaatcatgtaacccattcaactttcagattaatatattcactgggctttggtaaattttcctccaggtcctgttactatttctaccaatggaaagtgttggtttacccaacatattgttcacatcatgtttgtttttgtttccttccatttgatcgatttttttctaaaaagaaaaagtcatggctgatgaatttttcac

SEQ ID NO: 6037 - DNA, 1518 bp, Setaria italica
aactgctatcaccgacgatattcattatggcaaccatcgccgccgccgccgctcgctgcaactccccagcccgccgccagctcctcactcgccgctgcctcccgttctccgtttccttctcctccgccacgccgcccgccgccgcggcgggcttcggctgggccgatgctctccgcgtcgccggcgacggcgggcgcggcgacgagtccgacctatccgggtacttccggaaggtcgacacctgcaaccggggaatggacaaaaggggggagttcgtgaagttcttggtggaggatcaagtcgtgggatacatccacaagggatttgtcgagcacctccgagacttccatgatgtgtttaccattgtctcgggcaacaatggcagcaacactctggaaaatgtgtctctccggtcatcgcttaggacgccagaggaaagaacaaatgctattggagatgtcataaaaaaccttggagaattgattccaggtattcggaatgagctctacccagtaacatcatcttatggcatgcctgtgtacttctctctggaacgtgctgctgctccctactttggtataaaggcttacggagttcatatgaatggatatgttgagaaagatggtcagaaatttctttggattggtaagagaagtgatgtgaagcaaacatatccgggaatgcttgatcatcttgttgctggtggcctgccatatggaatctcatgcaaagagaacatcatcaaggaatgtgaagaggaagctggaattccaagatccgtatcaaccaatgctacttctgttggagcgatttcttacatggatattgaaggctttagatacaaaagggatgtcctcttctgctatgacctcaaacttcttgcagattttgttcctaataatgaagatggagaggttgatagcttcaggctaatccctgtgccacatgctgcaaacattatccggaggacagaatttttcaagccaaattgcaaccttgtgatcatcgacttcctcttccgtcatgggtacataaacccagattctcgcggctacctaaatctgttgcaaagcttgaggagcggtgattgttcttagctgccgtttgctgttaaattttttttgttgacaattcacttttatgaaatagaaaaatcatggagtaggctggaaagatagctgatcattgatcaaaaatatttatgggacttaattgtcaaatctcactatgaacagagcattatcttcagagttctgttgattagaattagcaacggattagtttgatttaaggggacaaaataaggaagaaatgatactgaatatggaactcttgttattcagttgtctcgtctgtttttattttttggtttgctgtagttccagtacctgtatatagatggtgctgatgtatcattgtgaaacttgttaaagatgtaggtctttagatgcttgtgagttgtgaccagtccactgtccagtgtctacagttacacaaaatttatgaaaaatgctaact

SEQ ID NO: 6038 - DNA, 1530 bp, Panicum virgatum
cccattgcgaaaatgtctcctctggcatttcccgatttctcccggtagaacaagcgatatcccccatggcaaccatcgccgccgtcgccgccgctcgctgcagccccccaacccgccgtcagctcctcacccgccgccgcctcccgttctcagtttccttctcctccgtcgcgccgcacgccgccgcggcgggcttcggctgggccgacgccctccgcgtcgccggcgacggcgggcgcggcgacgagtccgatctctccgggtacttccggaaggtcgacatctgcaaccggggaatggacaaaaagggggagttcgtgaagttcctggtggaggatcaagtcgtgggatatgtccacaagggatttgtcaagcacctcagagactttcatgatgtttttacaatctcgggcgataatagcaacaacactttggaaaatgtgtctctccagtcatcacttaggacgccagaggacagaacacatgcaattggagaagtcataaaaagtcttggtgaaatgattccaggtattcggaatgagctctacccagtaacatcatcttatggcatgcctgtgtacttctctcttgaacgtgctgctgctccctactttagtataaaggcttacggagttcatatgaatgggtatgttgagaaagatggccagaaatttctttggattggtaaaagaagtgatgtgaagcaaacatatccaggaatgctcgaccatcttgttgctggtggcttgccatatggaatctcctgcaaagagaacatcatcaaggaatgtgaagaggaagctggaattccaagatccatatcaaccaatgctatttctgttggagcggtttcttacatggatattgaaggctttagatacaaaagggatgtcctcttctgctatgacctcaaacttcctgaagattttgttcctaataatgaagatggagaggtcgatagcttcagattaatccctgtgccacatgctgcgaacattatccgaaggaccgaatttttcaagccaaattgcaaccttgtgatcatcgacttcctcttccgtcatgggtacatacacccagattctcgtggctacctaaatctgctgcaaagcttgaggagtggtgattgttcttagttgccatttgctattaaagtttttattgacaattcatttttatgaaataaaagaaaatcattgagtaggctggaaagatagccgatcatagtgaaaactattcatttacttcaatgtcaatctcacggcgaacagggcattatcttcagatttctgttgactaggattagcaacagattagctaaggggacaaaataaggaagaaatggtgctggctaaggaactcttgttattcagttgtctggatatttttgcttagttccagtacttacatatagagattgtgaaacttgttaaagattgtccgcagttactcaaaatgtatcaatatgttgacagctggaggttctatgctctgttgtaagtctaattaattcatcaaggcaaaatagac

SEQ ID NO: 6039 - DNA, 1527 bp, Triticum aestivum
acaattccaactaaaaaaaacgaaatcccgcttaggcccttaaaattaccaacaatcagcatttatccaatggtcgccatcgccacctccttctccgccgccgccgccgtcgccgtcgcccgccggagctccccggctcacctccagctcgtcgctcgccgccgcctcccgttctgcaccgctgcctcctcttcctccgcgccccctgctgctgcggcgggctttgggtgggccgacgccctccgagttgccagcgaattcggggtcggcgatgagtccgacctttcggggtacttccggaaggtcgacatctgcaaccgaggaatgggtaacaagggggagtttgtggagttcatggtggaggatcaagtggtgggatacatccacaagggttttaccgaacacctgagggacttccctgatgtttttaccattgtctcgggcaacaatggtaagaacagtgtggagcatgtgactctccactcatcgctcaggactccaaaagatcgaacaatcgccatcggagatgtcataaaaggcctaggggaactcattcctggtatacgaaatgagctctatccagtaacctcatcttacggcatgcctgtgtacttctctctggaacgtgctgctgctccctactttggtataaaggtttatggtgttcatatgaatgggtacatcgagaagcatggtgaaaagtctctttggattggtaagagaagtgatgtgaagcaaacttaccctgggatgctagatcatcttgttgctggtggcctgccttacggaatctcctgtaaagagaatgtcatcaaggaatgtgaagaggaagcaggaataccaagatccatgtcaaccaacgctacttctgttggagccgtttcttacatggatatcaatgggtttagatacaaaagggatgttctgttctgctatgaccttagacttcctttagatttcgttcctaataatgaagatggagaagttgatagcttcaggctaatccctgtaccacatgctgcaaacattatacggaggacagattttttcaagtcaaactgcaaccttgtgatcattgacttcctcttccgtcatgggtacataaacccagactgtaatgggtacctgaagctgctgacaagcttgaggagtggtgattgttcctagggcttgcagttcgctgttcaaacagaagaatcagattaccagcattaatcgttgattttttggagtaagctagatggctgtccatcaaaatcagaatattaactttaaagtacaaactgtacatgattttttttctttctctaaatgcatttctgttcgcacattatctttgactcttcagtgagtttagggaggtaaggaagttcaggaggaaaggggggcataataaaaggaacattagtatacatggtgctgaacatgatggcctgcttatttctgtagtcttttatatgcttgcgctattggctattttcttgcaaatatttttcttttcaaaatggttttggtaactgcaggcct

SEQ ID NO: 6040 - DNA, 1491 bp, Secale cereale
gcaacaattccaactaagaaaaagcgaaatcccgcttaggcccttaaaattaccaacaatcagcatttatccaatggtcgccatcgccgcctccttctccgccgccgccgccgtcgccgtcgcccgccggagctccccagctcacctcaagctcgccgctcgccgccgcctcccgttctgcaccgccgcctcctcttcctccgcgccacctgctgctgcggcgggctttgggtgggccgacgccctccgagttgccagcgaactcggggtcggcgatgagtccgacctttcgggatactcccggaaggtcgacatctgcaaccgaggaatgggtaacaagggggagtttgtggagttcatggtggaggatcaagtggtgggatacatccacaagggttttaccgaacacctgagggacttccatgatgtttttaccattgtctcgggcaacaatggcaagaacagtgtggagcatgtgactctccactcatcgctgaggactccagaagatcgaacaatcgccatcggagatgtcataaaaggcctaggggaactcattcctggtatacgaaatgagctctatccagtaacctcatcttacggcatgcctgtgtacttctctctggaacgtgctgctgctccctactttggtataaaggtttatggtattcatatgaatgggtacgtcgagaagcatggtgaaaaatctctttggattggtaagagaagtgatgtgaagcaaacctaccctgggatgctagatcatcttgttgctggtggcctgccgcacggaatctcctgtaaagagaataccatcaaggaatgtgaagaagaagcaggaataccgagatccatgtcaaccaacgctacttctgttggagctgtttcttacatggatatcgatgggtttagatacaaaagggatgttctgttctgctatgaccttagacttcctgtagatttcgttcctaataatgaagatggagaagttgatagcttcagactaattcctgtaccacatgctgcaaacattatacggaggacagattttttcaagccaaactgcacccttgtgatcattgacttcctcttccgtcatgggtacataaatccagactgtaatggatacctgaagctgctgacaagcttgaggagtggtgattgttcctagggcttgtgtttcgctgttcaaacagaagaatcagattaccagcattattcgctgattttttggagcctgaagctgaacaccggcgtgcgctctcatccagcagaatggaagtttgagatcacactttatcaagctgtattgagcttcgactgatcaagccatatgctagacaatgcgcttatttgttttagcatcaaatgcttaatgttttttcgtaggtgcatatgtaagtagctttagtaaattaatactgctcccttcggctcaaattaattgacgcagagaactaatagaataggaccaatttttttaaaccctga

SEQ ID NO: 6041 - DNA, 1446 bp, Leymus cinereus x Leymus triticoides
ggcccttacaaattatcaagcatttatccaatggtcaccatcgccacctccttctccgccgccgccgccgtcgtcgcccgccggagctcgccggctcacctccagttcgtcgctcgccgccgcctcccgttctgcaccgctgcctcctctttctcggcgccacctgcttctgtggcgggctttgggtgggccgacgccctccgagttgccagcgaattcggggtcggcgatgagtccgacctttcgggatactcccggaaggtcgacatctgcaaccgaggaatgggtaacaagggggagtttgtggagttcatggtggaggatcaagtggtgggatacattcacatgggttttaccgaacacctgagggacttccatgatgtttttaccattgtcacgggcaacactggcaagaacagtgtggagcatgtgactctccactcatcacttaggactccagaagatcgaacaatcgccattggagatgtcataaaaggcctaggggaactcattcctggtatacgaaatgagctctatccagtaacctcatcttacggcatgcctgtgtacttctctctggaacgtgctgctgctccctactttggtataaaggcttatggtgttcatatgaatgggtacatcgagaagcatggtgaaaaatctctttggattggtaagagaagtgatgtgaagcaaacctaccctgggatgctagatcatcttgttgctggtggcctgccttatggaatctcctgtaaagagaatatcatcaaggaatgtgaagaggaagcaggaataccaagatccatgtcaatcaacactacttctgttggagctgtttcttacatggatatcaatgggtttagatacaaaagggatgttctgttctgctatgaccttagacttcctgtagatttcgttcctaataatgaagatggagaagttgatagcttcagactaatccctgtaccacatgctgcaaacattatacgaaggacagattttttcaagccaaactgcaaccttgtgatcattgacttcctcttccgtcatgggtacataaacccagactgtaacgggtacctgaagctgctgacaagcttgaggagtggtgattgttcctagggcttgcggctcgctgttcaaacagaagaatcagattaccagcattagtcgctgagtttttggagcctgaagctggtcctggttttgtgaacaccgctgcgctctcatccagcagaatggaagttcgagatcactctttatcaagctgattgagcttcgactaatcaatccatatgctagacaatgtgcttatttgttttagcatcgatgcttaatgatttttcatgggtgcatatataagtagctttaataaatagatagataattcaatcatctatgaactggagggagtatatgtatcatggtttttagtccacttct

SEQ ID NO: 6042 - DNA, 1640 bp, Sorghum bicolor
gcctccgcgcgcccccacctgtgctttgagattcgcgcttcgtcgcctcctagctacctcgtgtctcccgctgactcgccggcgaacgctcgcctcttggagatgccgcccgccgcggcgacgctcctccggcgggccccagcggtcccattcacggcacgccgtaccgctgtttcccgctcgggcatggcgcggcgtctggtgacagcgagcgctggggccggcgggcgggcgccggcgtacggtgggctgctgctcgacgccggcggcacgctgctgcaggtcgcgcagccggtcgccgagacgtacgcctccatcggccgacgctacggtgtgatgaagcctgagaaaagaatcatggaggggttcaagcgggcattctcggcgccatggcccaagacactcaggtaccagggagatgggcggccattctggagaattgtcgtggcagaagctaccgattgcaccgatgacgattactttgaggaagtgtatcagtattatgcacatggagatgcttggcgtttgcctgttggagcagacacagcactgcgtgagctgaaggatgctggagttaagctagctgttgtatctaactttgatacaaggttacggaaattacttaaggaccttaatgtctctgatatgtttgatgccattgtggtatcatcagaggtcggatatgagaaacctgctccagagatattcaagatagcattagataacattggtgtggaagccagcaaggcagtgcatgtaggagatgatgaagctgcagacaaggcgggtgccaatgctataggacttgaatgctggctgtggggtgatgatgtgaagacattttcagaaatacaggacaggattctgacaacagatgatcctcaatgagtgtggatttagcatggtgcaagaccgccacgacagttgtttctttattccttcctttttttttctcttaatgccttcttttcctttcacctcttgtgctggcatgtccattttgctttcatgaaataagctcattccatgactactgctgtcccgtcacattcttttgcattctgtgatgaacacttttattcgtcacaggcagcagattgcagatgagtcatgagtgattctgcttgctatgtgaatgtgatttgcatgtaaacattatcctaagtacaagtgtataactgacagaacacacatgtgaaaatgttgcatactgctgctgctcccctacatggattgctgcagcgatggaatgtacacgtagcctcaggctgcagctacgagcttattgtgctgtgtctacagaagattgctgtttggctgccggcacaccgacagcaagctctatctctattattatcataggagcctcgacgggctctggtaatgggcaccaagggacgacgaggatcagaagatgatatcctcgtccctgtcgccattctctagcatgctctccgcagtgtcgacggaaacgacgccgcgcttgagcgcgacctcgccggttggtcgtcctgatggccgcgtccagcgtcaggaacgtcgtctgcagcgacgccagctccaccagcacctccagcgcgcgcgcgtgcgccgcccggcacgccgccacctgctgcccgccgccggccagccccgcgagc

SEQ ID NO: 6043 - DNA, 1493 bp, Setaria italica
gccttgccgcccccaaccccctgcttgctttgagattcgcggcgcgcactcgaggcctcgcatctcctgcggactcgccggcgaacgcttccttctttggagatgccgcccgccaccgcggcggcggcgcgctgtcccctcctccggcgggctccggcggcactccgtggcgctctatcccgctcaggcatggcgcggcgtctggtggcagcgagcgctgggggcggcgggcgggcgccagcgtacggcgggctgctgctcgacgccggcggcacgctgctgcaggtagcgcggccggttgccgagacctacgcctccatcggccgccgctacggtgtgacgaagcctgagaagggcatcatggaggggttcaagcgggccttctcggcgccatggccgaagacgctcaggtaccagggagatgggaggccattctggagaattgtcgtagcagaagcaaccaattgcactgatgatgattatttcgaagaagtgtatcagtactatgcccatggagatgcttggtgtttgcctgatggagcagacacaatacttcgtgagctgaaggatgctggagttaagctagctgttgtatctaactttgatacaaggctaaggaaattgcttaaggacctcaatgtctctgatatgtttgatgccattgtggtatcatcagaggttgggtacgagaaacctgctccagagatcttcaagatagcattagatcaaattggtgtggacgccagcaaggcagtgcatgtaggagatgatgaaactgcagacaaggcaggtgcaaatggtataggacttgagtgctggctgtggggtgctgatctgaagacattttctgagattcggtaccggattctaacagatgatcaatgagtgcggatttggcatgtttgtggccacgtcacggcagccctttttttttcaccccaaaatcgtccattgttgacctttccattctgcgttcgatgaaagttttttttttatcttgcccctactttgaagtgcaattgtatttttacccccattttttgaactttgtgattttgccctcacctattcacaagtcaatgcgattttgcccttggtctttgcgtatttgcccctgttttgaccattgactgggggtaaaatcgcattgacttgtgaatagttgggtcaatgcgattttgcccttggtctttgcgtatttgcccctgttttgaccattgactgggggtaaaatcgtattgacttgtgaatagttgggtaaaatcacaaagttgataaaatgagggcaaaatcatatttacacttcaaagcaggggtatgaacacaaatgccccttcacgaaataagctaatcgtatgaataaaagtactgttgactgtcatacagcgatgaaaaaatagagttgatgagcaaatgagtgatgagtcatcagtcatgagttctggctatgtaatttgcaagtaaatattattatttttaagcatgaaccggtg

SEQ ID NO: 6044 - DNA, 1767 bp, Sorghum bicolor
gcggcggccgccgccatggcgtcgtcgtgcatcccggccggcggcatccggctgccggacctggagatggtcaaggccgcgccgcctccggcgccgcccaggccggcgcactccgccgcggcgtcctccacgctctccgaggcgtcgtccaacgcgtccgcggcttcctcgtcggccacctcgtcgtcggtggcggcgtcgctgtcgctcaagcgcccccgcacgccaaggaagcggcccagccagacgtacaacgaggcggcggcgctgctcgcgtccatgtacccgtccgtcttccccgtcgccaaaggctttgggggcctcgaggcgccgccgccgccgcgcctcctcggcctcgcttccgcgctcgccgacgacccgtcctgctccgacctcctcccgccgttccccgtccccggcggccaggccgccttcctcctccgcgacctgccgccgccgccgccgccgcggcctctgacgccgcggagccccgccgccaggggctgcccttcgccgtcggccgtcagcagcgtcttcagcgagttccgcgacccggcgccgtcccctgcaacacctgacgatgctgcggcggcgcctgacgagcccggggagctcgacttcgacgatgacgacggtttcgacgccgactctattctgtgcggcgtcgacgagggcgcggccgagggcatcgatggcatcatggggaagctctccatggaaaacaacgtgacgtccgtgtcaagcggcgactccaacctgcccagatccaagatgatgcacccttgcctcaggaaccttatggtgctcgggctcagcttccggcacgatcagagtatcatcaatcaagccctcaagcggcatagcgtcgatcctgaatggtggatgtgccctgccatacctgtgaaagacattacaccggtgccgccttcagtggcaatggcaaaagtgacagacaagaagaagactaagaagaagtcactcgggacaatatatgaggaggggactcctgagtttgccaatggagacactggagctttggcactgccagagacaggattggggctgagcttgaacactgacggggtgctcaaggcatggcgtggcagaggctctgtgttcgctaatggcaatgggcctgacttgccattgtcctctgctcatgtagtagttgtacatgttaaacatgaagacagtgatctcttcccaaagaatggtaccagcgctgttatcagggaaggcaacattctaaagatgcagcacaagcagaagccgtgcactcccctcccctctaataagcagagtcggtactaccggcctcgggtcaaggggaggtttgtcagcaaggcttattttctccagcaacagcaagcattagagaaggagagctaaagaggatggatcttgctccaaggggcatttctggggcttttcactcttgctctctaggagaagcagcagagcttctcaattttcatttctgcagcgttatagcgaggcagatgtagagatgcctgtagagtggcatgtagtaagttgtaaccatggggatctgattgtggtttccttgcaacttctccagctccagatgctgtgatgtaaagaaggccgtgaagtgatatcccaaccagttaatggaaccgtgttattatcactctgtttctgcaattatgttgtttgtttgccgggctaaatttttcctgagctgtgatgtgagtgaagtctggaaaaagtaataagaattgtaccagaaaactgagaagagttgac

SEQ ID NO: 6045 - DNA, 3195 bp, Sorghum bicolor
cgggaaagtgggatgggaggtaccgtaccatgcggggcccacccaccggaaggccgatgagtgaggtggatgacagtgacaagctgaaagcgcagttcgtctcttccgctgggcgctggccgccgggcgcggccctgttctgttcgctcctcctctgggaaaaaaaaacgaaccttttccggggtcctcttcctctcgccccttcgctaatggtgtgtattggtgtacgtacagcggtaataaagtgctaatactagaggattcctcaatcaagtcaaagcctcttcctccctcgtcatctctgacgaatccaagcgctaggatctcgctgcttgcttcctctcggatccgaaggcgggggggcggctctgtttcctccgcccgatcgaccctccagttccactccactccaaccacgcctccgctgtccgtccctgctggcctctgctgctgcccctcttctccgtccggaactgccacgcacgacctcgccacctcccgaagctcgaacgctcgtttacttttgcctccaacccgcccttgttccaggttggtgcggcgctggtggctggtgctgagtgctgacgccgccgccgctttgattaacaacaagccaccacacctgcggttccttctccgctttgattaatcctttgattaatcgcctctttttctttctcggtgatcgccttttcccgagattgcatttttatttgtcggcggcacccggcaccgcgctttggctccgtctccgaggccggccgcccggcccaggcaggcggcaggcggcagatgcagcacaagctggtggtggcgttgtgaacaagaaattcctcgggttccacgcgcctcccgtcgctttggcgttttggcccctctttccttttcttcctttccgctggttttctgctggcaggcggcggggggtttttgcgctggttcgggttgggtttaggacggcaccggcacagccgcacggcaccacctgatttcccttcccttccccaccaagctccctcttgcgcttccgcttccgcctccgcccgtgacctccgagatcgcgggctccttcccgatttggtccgccccgcccagctgggaaacggaaatctctgatgggttttgcaaggaaaaaactcgcgatttgtgggtgaggttttccgtttccttccattgctggatcgacttgactgactgactgactgactgatcgatcggcggcggccgccgccatggcgtcgtcgtgcatcccggccggcggcatccggctgccggacctggagatggtcaaggccgcgccgcctccggcgccgcccaggccggcgcactccgccgcggcgtcctccacgctctccgaggcgtcgtccaacgcgtccgcggcttcctcgtcggccacctcgtcgtcggtggcggcgtcgctgtcgctcaagcgcccccgcacgccaaggaagcggcccagccagacgtacaacgaggcggcggcgctgctcgcgtccatgtacccgtccgtcttccccgtcgccaaaggctttgggggcctcgaggcgccgccgccgccgcgcctcctcggcctcgcttccgcgctcgccgacgacccgtcctgctccgacctcctcccgccgttccccgtccccggcggccaggccgccttcctcctccgcgacctgccgccgccgccgccgccgcggcctctgacgccgcggagccccgccgccaggggctgcccttcgccgtcggccgtcagcagcgtcttcagcgagttccgcgacccggcgccgtcccctgcaacacctgacgatgctgcggcggcgcctgacgagcccggggagctcgacttcgacgatgacgacggtttcgacgccgactctattctgtgcggcgtcgacgagggcgcggccgagggcatcgatggcatcatggggaagctctccatggaaaacaacgtgacgtccgtgtcaagcggcgactccaacctgcccagatccaagatgatgcacccttgcctcaggaaccttatggtgctcgggctcagcttccggcacgatcagagtatcatcaatcaagccctcaagcggcatagcgtcgatcctgaatggtggatgtgccctgccatacctgtgaaagacattacaccggtgccgccttcagtggcaatggcaaaagtgacagacaagaagaagactaagaagaagtcactcgggacaatatatgaggaggggactcctgagtttgccaatggagacactggagctttggcactgccagagacaggattggggctgagcttgaacactgacggggtgctcaaggcatggcgtggcagaggctctgtgttcgctaatggcaatgggcctgacttgccattgtcctctgctcatgtagtagttgtacatgttaaacatgaagacagtgatctcttcccaaagaatggtaccagcgctgttatcagggaaggcaacattctaaagatgcagcacaagcagaagccgtgcactcccctcccctctaataagcagagtcggtactaccggcctcgggtcaaggggaggtttgtcagcaaggcttattttctccagcaacagcaagcattagagaaggagagctaaagaggatggatcttgctccaaggggcatttctggggcttttcactcttgctctctaggagaagcagcagagcttctcaattttcatttctgcagcgttatagcgaggcagatgtagagatgcctgtagagtggcatgtagtaagttgtaaccatggggatctgattgtggtttccttgcaacttctccagctccagatgctgtgatgtaaagaaggccgtgaagtgatatcccaaccagttaatggaaccgtgttattatcactctgtttctgcaattatgttgtttgtttgccgggctaaatttttcctgagctgtgatgtgagtgaagtctggaaaaagtaataagaattgtaccagaaaactgagaagagttgaccagtactcctaagtttttatattggtctaatgatccaagatgtggaggggttggtgagtttgaaagcccatggcaacaaaccagagatctgttgctgcatgtacaagctattaggagcaggttggaagttaaacaccaacccaaaatcctcaatttggttgatggtgacagcagcaccactgctggtccggttcatactcaggctagagac

SEQ ID NO: 6046 - DNA, 2549 bp, Zea mays
ttcctcaatcaggtcaagcctcttccttcctcgaatccatgtcatctttgacgaatccaagcactaggaatctaggatcttgcttggtctcggagttggaggcggctctaattcctccgcccgatcctcggttcggtccaaccacacacctccgctgtcagtccctactgctattctctccttcactcctcgccgaaactgccacgcaggagcacgaggacctcgtgagcccaagcttgaacgctcgtttacttttcgaggttggtgcggttctcgcagctgctgatgccgccgccgccgctttgtttaagcagcaaaccaccgcacctgctgtttcttctcggtccgctttgatcaatcgcctccctttctttctcggtgatcgccttttcctgagattgaaattttatttgtcggtggtccggcactttggctccgtctccgtggccggccgaacaggcggcagacgcaggcagcagcagcagcaggcgctggtggtggcgctggccgttggcgttggcgttgtgaacaagaaattcctcgggtttcacgcggctcccgtcgctttggcgttttggtcccttccttttcttcctttccgctagttttctggtgacggggggtttttgcgctctggttcgtgttgggtttataggacggcacggcaccagctgagttcgcttccccatccccatccccatcccgctcccgcttgctccgtgccgtggtctccgagatcggggttcctttccttgccgatttgatccgcccagctggaaaacgaaaatcgctgatgggttttggaaggaaagttgtcatttcttggtgaggtttccgtttctggatcgactagctgatcgatcgtagtatcgtactagccaccatggcgtcgtcgtgcatcccggccggcggcatccggctgccggacctggatatggtcaagaccgcaccgccgccggcgccgcaccgcccggcggcgtcctccacgctctcggaggcgtcccactcgtccccagcctcctcctcgtcggtggcgtcgctgtcgctcaagcgcccgcgcacgcgcacgccgcggaagcggcccagccagacgtacaacgaggcggcggcgttgctcgcgtccatgtacccctccgtattccccgtcgccaggggctggggggcccccgaggcggcgccaccccgcctcctcggcctcgcctccgcgcttggcgacgacccgtcctgctccgacctcctccctccgttccccgttcccggaggccacgccgccttcctcctccgcgacctgccgccgccgccgccgcagagccctgccggcgtcgccaagagctgcccgtcgcccgcggccgtcagcagcgtcttcagcgagttccgcgacccggcaccgtcccctgcaacccctgacgatgctgctgcggcacctgacgagcccggagagctccacttcgacgttgacgacggtttcgacgctgactctattctgtgcggcgtcgaccagagcgcggccgagggcatcgacggcatcatgggtaagctctctatggaaaacagcgggacgtccgtgtcaagctcaagcgtcaactccaacctgcccatatccaagatacacccttacctcaggaaccttatggtcctcgggctgagcttccggcacgatcagaatatcttcaaccaagcgctcaagcgccatagcgtcgatcatgaatggtggatgtgccctgccatacctgtaaaagacattacccctgcgccgccaccttcagtagcaatgtcgaaagtgacagacaagaagactaagaagtcactggggacaatgtacgaggagggggttcctgagtctgtcaatggcgacgctggaactttggcactgccagagacaggattggggctgagcttgaacactgacggggtgctcaaggcgtggtgcggcagaggctctgtgttcgctgatagcaatggctctgacttgccgttgtcttctgctcatgtggtagttaaacatgaagacagtgatagtgatatcttcccaaagaacggtatcagcgctgttatcagggaaggcaacattctgaagatgcagcgcaagcagaagccgtgcgctcccctcccttctaataagcagagtcggtactaccggcctcgggtcaaggggaggtttgtcagcaaggcttatttcctccagcagcagcaggtattggagaaggagagctaaagaaaatgggtcttgcgggcatttctggggctttactcttgctctctaggagaagcagcagagcttctcaattttcatttctgcagcgttacagcacggcagatgtagagatgcatgtagagttgcatgtaagttgtgaccatggtttccttgcaacttctctagctccagatggcttaatggccatgaagtgatatcccaaccagttaactgaatcgtgttctcactctgtttctgcaaatcctattctttgtttgctggggttccgccccagagctgtcatgtgagtgaaggctgcagcagtaccaaaaaactgagaagagttgacctgcaa

SEQ ID NO: 6047 - DNA, 1031 bp, Sorghum bicolor
atttttcttgggccgcattttcctccggagtcggcatctggaagggtgaccacggctggttctgtctctgtctgcgcacgagtctgagagggaaaaaccctagccgccttcctccatcagtccgtcccaagcccgcgacaccatggctgcatccaacggcggtggcggcggcccgggccccgggccgatctcggccgaggcggaggcggcgtttggagaggccatcaggctagtgttcgggcggtggacggcgctgcagatggcggtggagaaccagtggggcggccgcgactctcgctccaaggccgatcagttcggcgagtccatcctcttctggttctgccgcactaagggtccacattatttcgaagacttggtggatatgatgtatgacacaatttctgaatccttcaattctgactttgaggataatagtgttgaggaggttgctgaacagttattgatcatacatgaagaatgtctgcaaaacaattattcttctatagagaagttaaggaactcacatgttcaggggaatgctgtttctcaaagtagacagatagtggccgatgatgacgatgacagtgatagctcagatgatggtgatgacacatcaatgatggaggatcaagaggctcctccggaagaaatggcagtggacaggccaaggccgcccaggcctacacccgatgccgatgggtggaccgttgtgcctcctaggcgtggtggtcgcaacaggaattaggcacagctggaaaccttgctgaatatatacatgttgctagctgccggctttcgtacgcggtgtttctgagtgttgcggcttcatcctttacaatgtatcactcgggattttactcgacagggatgatgttgagtgtgtagtagtatgttttgtttgccaccgcccaccaaattgttgtaaacatggtaattattatagatacaactgtgatcaggttgagtgctgcagtgtcatcgtttacatgctgtccgtcccacaaagagcttattcgtagcgattctcagac

SEQ ID NO: 6048 - DNA, 1175 bp, Sorghum bicolor
cctggcgtggcgtgtgcacatttttcttgggccgcattttcctccggagtcggcatctggaagggtgaccacggctggttctgtctctgtctgcgcacgagtctgagagggaaaaaccctagccgccttcctccatcagtccgtcccaagcccgcgacaccatggctgcatccaacggcggtggcggcggcccgggccccgggccgatctcggccgaggcggaggcggcgtttggagaggccatcaggctagtgttcgggcggtggacggcgctgcagatggcggtggagaaccagtggggcggccgcgactctcgctccaaggccgatcagttcggcgagtccatcctcttctggttctgccgcactaagggtccacattatttcgaagacttggtggatatgatgtatgacacaatttctgaatccttcaattctgactttgaggataatagtgttgaggaggttgctgaacagttattgatcatacatgaagaatgtctgcaaaacaattattcttctatagagaagttaaggaactcacatgttcaggggaatgctgtttctcaaagtagacagatagtggccgatgatgacgatgacagtgatagctcagatgatggtgatgacacatcaatgatggaggatcaagaggctcctccggaagaaatggcagtggacaggccaaggccgcccaggcctacacccgatgccgatgggtggaccgttgtgcctcctaggcgtggtggtcgcaacaggaattaggcacagctggaaaccttgctgaatatatacatgttgctagctgccggctttcgtacgcggtgtttctgagtgttgcggcttcatcctttacaatgtatcactcgggattttactcgacagggatgatgttgagtgtgtagtagtatgttttgtttgccaccgcccaccaaattgttgtaaacatggtaattattatagatacaactgtgatcaggttgagtgctgcagtgtcatcgtttacatgctgtccgtcccacaaagagcttattcgtagcgattctcagacacctgggccctgttaggtgtgattaccgtgcatgcttttgccagcacattgattgcgcatgcatttggggtcatttggtcactgataagcatcttaatttactggaagtgtggactctgttggcc

SEQ ID NO: 6049 - DNA, 1849 bp, Sorghum bicolor
gctgaaactctagcgccaccggctttttccacggcccggcccggcccgtcaaaatccatgtactgcagttggcaaaggaccacgcgcccccgccaccgcgccgcgcggcttcacggttcggcggcgctcgggcaaggcacgtcttaaaaccctagaaaaacactagcccttgctcccctccaaaaaaaacttttcctcctccccctttccaccgcgccggcgagccgaagcgacgcggagtaaggatgccgcggaccaccgtggtggagagccccggctgcccgccgctccgtgccctcaccactgacatcatcggcctcgtcaaagtcgtcgaggcccacacgaagccggcgggcgccgccaaggtcgtcgagacgtggggcgatcctgacgcctcccgcgccatcgtcgctgcctcccttgccgatcgtgccgccgaccccgtcttggctgtggcaaggaagaacggcgtggttgagttgctgaatcccctgaacggggatgctctggctgctgtcaagaccgtggggccatcaccaaatgatggtggcgcagaaggtgatcccctcgccgcattgcaccttttcacaagacaggcttcagactcgatcttaggaacgtttcttgcctgcacggagcaggggaaagcttctataaggtccatcacgaaagaaaatgcagcttcgggctcggatgttgggccatcagccacatgggatgtgtgcagtggggccaatgtgcaattttgctcagttgatcatggtgaaagctatgcgatgtttggagggaaaggtatagaagtgaacttgtgggatatcacatcttgtagtaagatatggtctgctaaatctccccgagcaaatagccttggtatattcactcgaccttggttcactgctgggaccttcttgtgcaaggatgatcatcgtaaaattgtagcctgcactaatgatcatcaggtccgcttgtatgatactgcattgcaaagaagacctgccatctctgttgattttagggagtcaccaatcaaggcagttgctgctgatccgaatggccatgatgtctatattggcacaggaacaggggatcttgcttcctttgacatgagaacagggaaattgctcggatgctatattggcaaatgcagtggaagtattagatctattgttaggcatccagagctacctttgatagcatcttgtggactggatagctacttacgtatctgggacacaaacacaagacagctgctatccgctgtctttctgaagcagcatcttactactgtggtccttgattcacatttttctcttgaagagcctgaagagataaaatccaagcaactggagttttcagtggaagctgaggctgaagtccgaaaagaaaagaagcaaaagagtaagacaacagaggatgagactgaggctcaagtccgaaaagaaaagaagaaaaagaagagtgaaacaattgaggaggatgaagaacaagttggagtggtcgaccatagcaatattaatggtgaaatatatgccagaaaagaaaagaagaaaaagaagagtagagctattgaacaggatgaggagccagacagcgatggtgaaatgtgcagtcccaacagaagaaaatctggagaaagaagcaaatgcctgaagaagaagagcaagaaacagctggtcgcctagaacatgtatcatttatcttattacctgccttttactttattttgcagaattacacagttttgtgttgtactttgaacagcgtatcccttatgaaaccctgcaagggcatttcaccgtccatatatatatttgaatggctgcatatgcgtcactagctggattgccac

SEQ ID NO: 6050 - DNA, 1700 bp, Sorghum bicolor
ggctgaaactctagcgccaccggctttttccacggcccggcccggcccgtcaaaatccatgtactgcagttggcaaaggaccacgcgcccccgccaccgcgccgcgcggcttcacggttcggcggcgctcgggcaaggcacgtcttaaaaccctagaaaaacactagcccttgctcccctccaaaaaaaacttttcctcctccccctttccaccgcgccggcgagccgaagcgacgcggagtaaggatgccgcggaccaccgtggtggagagccccggctgcccgccgctccgtgccctcaccactgacatcatcggcctcgtcaaagtcgtcgaggcccacacgaagccggcgggcgccgccaaggtcgtcgagacgtggggcgatcctgacgcctcccgcgccatcgtcgctgcctcccttgccgatcgtgccgccgaccccgtcttggctgtggcaaggaagaacggcgtggttgagttgctgaatcccctgaacggggatgctctggctgctgtcaagaccgtggggccatcaccaaatgatggtggcgcagaaggtgatcccctcgccgcattgcaccttttcacaagacaggcttcagactcgatcttaggaacgtttcttgcctgcacggagcaggggaaagcttctataaggtccatcacgaaagaaaatgcagcttcgggctcggatgttgggccatcagccacatgggatgtgtgcagtggggccaatgtgcaattttgctcagttgatcatggtgaaagctatgcgatgtttggagggaaaggtatagaagtgaacttgtgggatatcacatcttgtagtaagatatggtctgctaaatctccccgagcaaatagccttggtatattcactcgaccttggttcactgctgggaccttcttgtgcaaggatgatcatcgtaaaattgtagcctgcactaatgatcatcaggtccgcttgtatgatactgcattgcaaagaagacctgccatctctgttgattttagggagtcaccaatcaaggcagttgctgctgatccgaatggccatgatgtctatattggcacaggaacaggggatcttgcttcctttgacatgagaacagggaaattgctcggatgctatattggcaaatgcagtggaagtattagatctattgttaggcatccagagctacctttgatagcatcttgtggactggatagctacttacgtatctgggacacaaacacaagacagctgctatccgctgtctttctgaagcagcatcttactactgtggtccttgattcacatttttctcttgaagagcctgaagagataaaatccaagcaactggagttttcagtggaagctgaggctgaagtccgaaaagaaaagaagcaaaagagtaagacaacagaggatgagactgaggctcaagtccgaaaagaaaagaagaaaaagaagagtgaaacaattgaggaggatgaagaacaagttggagtggtcgaccatagcaatattaatggtgaaatatatgccagaaaagaaaagaagaaaaagaagagtagagctattgaacaggatgaggagccagacagcgatggtgaaatgtgcagtcccaacagaagaaaatctggagaaagaagcaaatgcctgaagaagaagagcaagaaacagctggtcgcctagaacatgtatcatttatc

SEQ ID NO: 6051 - DNA, 2196 bp, Zea mays
cgcccggcatggggcactccatgaatgaataaccggagtgtcgcttccggtggaactgccatggacgcccgcggagctgacgactctgttcgatctgttcaagggatgatgcttgtggaagagcttatgtactaaaattcaatccaccgtaagctatcaaaccaaaaaatgaaaatgctcgtttgcacgcttgcaaataagagccccttgcaccacagtcgacgatcaggaccgaacacggagaaaagccacactctgcgactgctcacgccaccacctttgtttgtttgaggaaattctaagcaccacctggccaggctgaaactctagcgcgactggctttttccacggcccggcccgtcaaatccatgtactgtactcgttgtcgcggagaacgcgcccctgccacctccgcgcgggcacggcacgtcgtagtaaaaccctagaaaaacagtagcccaccgcgccggcgagccgaagcgagcgcggagctaaggatgccgcggaccaccgtggtagagagctccggctgcccgccgctccgcgccctcaccaccgacatcctcggcctcgtcaaagtcgtcgaggcccacgcgaggccggcgggcgccgccaaggtcgtcgagacgtggggcgcgcctgacgcttcccgtgccatcgttgctgcctccctcgccgatcgtgccgccgaccccgtcttggctgtggcgaggaggaacggcgtggttgagctgctgaatcccttgaatggaagtgctctggctgctgtcaagaccgcggggtcagcgccaaatgacagtggcgctgaaggtgatcccctcgccgcactgcatcttttcgcaagacagacttcggactcgatcttaggcacatttcttgcctgcacggagaaggggaaagcttctatcaggtccatcacgaaagaaaatgcagattcgggttcggatgttgggccatcagccacatgggatgtgtgcaatggggccaatgtgcaattttgctcagtagatcatggcgaaagctatgtgatatttggagggaaaggcatagaagtgaacttgtgggatatcacatctagtagtaagacatggtctgctaaatctccccgagcaaatagtcttggcatattcactcgaccttggttcactgctggaaccttcttgtgcaagaatgatcatcgtaaaattgttgcctgcacaaataatcatcaggtccgcttatatgatactgcattgcaaagaagacctgccgtctctgttgattttagggagtcaccaatcaaggcagttgctgctgatccaaatgggcatgatgtctatattggcacaggaacaggggaccttgcttctttcgacatgagaacagggaaattgctgggatgctatattggcaaatgcagtggaagtattagatctattgttaggcatccagagctacctttgatagcatcttgcggactggatagctacttacgtatctgggacacaaacacaagacagttgctatctgctgtctttctgaagcagcaccttacaacggtggtccttgattcacatttttctgttgaagagcctggagagatgaaattcaagcaattggagtctttagtggaggcggaggctgaagtccgaaaagaaaagaagaaaaagaagagcagaccaactgaagaggacgaagaacaagttggagtggtcgaccatagtgataataatggtgaaatgtatgctagaaaagaaaaaaagaaaaaaaagaaaaagaagagtagaactattgaacgggacgaggagccagacaacgatggtgaaatgtgcagtcccaagagaagaaaatctgtagaaagaagcaaatgcctgaagaagagcaagaaacagcaggtcgcatagaacatagaacaagtaccatttatctcagtatttgcattcgcttgattttgcagaattacacaattttgtgctgtagttgttttgaacagtatattccttttgaaactatgcaagggaatttcgccgtccattctacgagatacttttttttatggctgcaactgcatatgcgtcactaggggcgtgttttatttgtggatatttctggtgaaagtatctggtccactagttgggttttgttgcgttttgctgattaataggagcactatattattgtgactaaattaaaatgtattttgcagaggtaaattaa

SEQ ID NO: 6052 - DNA, 1593 bp, Saccharum officinarum
gcgccggcgagccgaagcgacgcggagctaaggatgccgcggaccaccgtggtggagagccccggctgcccgccgctccgcgctctcaccaccgatatcctcggcctcgtcaaagtcgtcgaggcccacgcgaagccggcgggcgccgccaaggtcgtcgagacgtggggcgcgcccgacgcctcccgcgccatcgtcgctgcctccctcgccgatcgtgccgccgaccccgtcttggctgtggcgaggaagaacggcgtggttgagttgctgaatcccctgaatggggatgctctggctgctgtcaagaccgtggggccagcaccaaatgatggcggcgctgaaggtgatcccctcgccgcattgcaccttttcacaagacaggcttcggactcgatcttaggaacgtttcttgcctgcacagagcaggggaaagcttctatgaggtccatcacgaaagaaaatgcagcttcgggctcggatgttgggccatcagccacatgggatgtgtgcagtggggccaatgtgcaattttgctcagttgatcatggcgaaagctatgcgatgtttggagggaaaggtatagaagtgaacttgtgggatatcacatcttgtagtaagacatggtctgctaaatctccccgagcaaatagtcttggtatattcactcgaccttggttcactgctggaaccttcttgtgcaaggatgatcatcgtaaaattgtagcctgcacaaatgatcatcaggtccgcttgtatgatacggcattgcaaagaagacctgccatctctgttgattttagggagtcaccaatcaaggcagttgctgctgatcctaatgggcatgatgtctatattggcacaggaacaggggaccttgcttcctttgacatgagaacagggaaattgctgggatgctatattggcaaatgcagtggaagtattagatctattattaggcatccagagctacctttgatagcatcttgcggactggatagctacttacgtatctgggacacaaacacaagacagttgctatctgctgtctttctaaagcagcatcttacaactgtggtccttgattcacatttttctgttgaagagcctggagagacgaaatccaagcaactggagccttcagtggaggctgaggctgaagtccgaaaagaaaagaagaaaaagagtaagacaacagaggatgagactgaggctcaagtccgaaaagaaaagaagaaaaagaaaagtaaaacaattgaagaggacgaagaacaagttggagtggtcgaccatagcgatattaatggtgaaatatatgccagaaaagaaaagaagaaaaggagagtagaactattgaacaggacgagccaagcagtgacggtgaaatgtgcagtccccaagagaagaaaatctggagaaagaagcatacgcctgaaaaagaagagcaaggaaacaactgggcgcctagaacgaggtatatttatctcattaccctgccttttacttgattttgcaaaatacacaaatttgtgttgaatttggacagcggatcccttttgaaaccttgaagggcatttacttggccaatctacc

SEQ ID NO: 6053 - DNA, 876 bp, Sorghum bicolor
ctgatctgatgaatctgatgatgccgtcgcccgtcgcccgctctatccacactccctccctagtccctcactcactccccccagacccagagtcgtccgtccacatggcgacttatctcaacgcaccgccggcagctaccaccatggctgcaagctactgccatgccttctccggcggcagcctccgtctgctccggccgagccgacccacgctgcacgtgacgtgccaagcctcctcgtcctcctcccagcagcagccgtccccgtccaggaggtcagcctgcctcggcctcggcctcagcttcgcgtgcgccgtcctgctccgcccacgcgccgtcgccgccgcaaccgacggcggcgacgaggagccggccaacaacggctggtggctcaccgagttccccttgccaacgcccaagatcgtcaacaaggagatcaacaacgccgagacagggacgcggtccttcatcaagaacggcatctacatggcggacatcggccccagcttcgcggcgcacgcgtaccggctgcgcagcacggccttcgacctgctggcgctggaggacctgctcggcaaggacgcctccaactacgtcaacaagtacctccgactcaagtccaccttcatgtactacgacttcgacaagctcatctccgccgccgacgacaagcccaccttcgtcgacctcgccaaccgcctcttcgacagcttcgagacgctccaggaggccgtcaccgccaaggacgacgacaggataagcggccgctacgcagagaccaaggtcatcctccaggagctcatggcgaagatggcctagctaagccatttcagatttcattcatatatatgatatgatgatatgtataaataatccc

SEQ ID NO: 6054 - DNA, 1142 bp, Sorghum bicolor
tagaaaggagtgatgcaagatctgatcataggcaacaaagtcattaataatcaactacagcttaaggcccattgggcgcttcagaaactgaccacaaacgtaacacggactaatatgagcgagcccagtaataaaacccaatataagaaaacattacagcccagcccaaatttcctagatgcaatgcaggcaaacctcatccgaacggaagggtgtcgaaacggccggcagccgctttcttcctttttttttttcccctcctttttctgatctgatgaatctgatgatgccgtcgcccgtcgcccgctctatccacactccctccctagtccctcactcactccccccagacccagagtcgtccgtccacatggcgacttatctcaacgcaccgccggcagctaccaccatggctgcaagctactgccatgccttctccggcggcagcctccgtctgctccggccgagccgacccacgctgcacgtgacgtgccaagcctcctcgtcctcctcccagcagcagccgtccccgtccaggaggtcagcctgcctcggcctcggcctcagcttcgcgtgcgccgtcctgctccgcccacgcgccgtcgccgccgcaaccgacggcggcgacgaggagccggccaacaacggctggtggctcaccgagttccccttgccaacgcccaagatcgtcaacaaggagatcaacaacgccgagacagggacgcggtccttcatcaagaacggcatctacatggcggacatcggccccagcttcgcggcgcacgcgtaccggctgcgcagcacggccttcgacctgctggcgctggaggacctgctcggcaaggacgcctccaactacgtcaacaagtacctccgactcaagtccaccttcatgtactacgacttcgacaagctcatctccgccgccgacgacaagcccaccttcgtcgacctcgccaaccgcctcttcgacagcttcgagacgctccaggaggccgtcaccgccaaggacgacgacaggataagcggccgctacgcagagaccaaggtcatcctccaggagctcatggcgaagatggcctagctaagccatttcagatttcattcatatatatgatatgatgatatgtataaataatccc

SEQ ID NO: 6055 - DNA, 3962 bp, Sorghum bicolor
cgagccctcctcagctccaacccccagctgtttttaattcgaaaattttcgaaccaagcccatctctctcgtcttccacctcctgccttccccacccccaccgcacagcgcccggcccggccccaaccagagaccagacagctccgtttcccctcccccgtcctgcctccacctcgaccgcgcaccaaacccgcagccacattccctcctccagccagcccatccccgctctcgcgcccctccgctccgagcggcggcggcggcggcggatacggcggcgcccgcccctaccgggcagttgcggcggcggacgagtcttccccggaagagggaggcaggctctggccggagtgtgtacggccgcctcgtgctgaggacaggcggggcgcgagatccgggctggaagggtggaggggtcgcgttggtggcgccgtggcgtcggcgtgatctgaaatgagattggacccgacggcgcggtattcgctgcggaggtagacggccatgacgaccaacaccaagcgcgcctacaagctccaggagtttgtggcgcactcttccaatgttaactgcctcaagattgggaggaagacctcgcgggttcttgtcacaggaggagaggatcataaggtcaatctttgggctattgggaagcccaattcaatattgagtttatcagggcacacaagtgctgtggagtcggttggttttgattccacggaagtgtttgtggctgcaggagcagccagtggaacaataaaactatgggatttggaggaggcaaagattgtccgcactcttactgggcatagatcaaactgtatgtcagttgatttccatccgtttggggaattctttgcctctgggtcgttggacactaatctgaagatatgggatataagaaggaagaattgcatccatacatacaaaggtcacacacgaggggtgaatgctattagattcacacccgatggtcggtgggttgtgtctggtggtgaagataatatagtaaagctctgggatctgactgctggaaagttattacatgaattcaagtgtcatgagggtcagatccagtgcatagatttccacccccacgagttccttctggcaacaggttcagctgataaaactgtcaagttctgggatttggagacttttgagttgattggttctactggacctgagacaacaggtgttcgatccatgacattcaatcctgacggaagatctttgttatgtgggttgcatgaaagcttaaaggttttctcctgggagccaataagatgccatgatactgtggatgtgggatggtctaaacttgctgatttgaatgtccacgagggaaaacttcttggttgttctttcaatcaaagttgtgtaggaatatgggttgttgatctgacgcgtcttgagccatatgcaacgggtacttcaacaaaactaaatggtcattctgaattgaagactgtgtctagcggcactttgcctttacaaaatgatagtggctcaagggctaacatagggcgatcatcaaccttgcaaacttcagagaataacctaaaagcttcttcaggaagattgtcggcacaaaactcagattctgcacccaaagagactaaattggcaccctcaagcgggttggtcccaagcacaccacaaagggctggagttagctccaataatagatctgttggaaattcagcttttcaatctggtggtaccaccttaaagagaagttcattgcggagtaacagtgcatctaatgtccacaatttcagtaaagctgatgtagtgccagtcattgttcccagaactagctcaggaggggagttggctactgattctagaagtgatgctgctgatgtggcacctgttcttcctaaggtaaccagaagggttgatcctgctactgattctagaaaagaaagtaatgatgtggatcttgttattcctaaagcaagctcaagagtggaaatagcctctgattcagcacccgtttctactttcaagtcaggcagaaggttggaggctgcccctgattcaaaaaaagaaagtgctgatacaacacctgttgttcccaatcctagggcaaatgcaagaatggagatggcctctgattctgcgcctgctctttcaaaggcaaacagaaagctagattctggtactgattcaaagaaagaaagtgttgatgcagtacctgccattgtacccagagcaaattctagaatggaaatgaattctgattctaggagagaaccctctgctggaagagtatcaccattcagaatccagtcaagatatgctgagctacggaagctaacccatgccaaaattgatgcaaacaaagttgacagtggaagtaaaattactgaaacagatgacttcaattgccaaatatttcttccccgtagaaatggtgtttttcaaataagttctgaagaatcccgcgaagatgtaaagtgtggtccagctgacaggatgggattttcaaattcgtcagaaccaaatgcaagtgtccgcagtgagaattatgtttctagaatgcgcaaaccaagagataactgctatattgaagtttcaagagcagggagagcaaggtcaaatgtctctaattgggaagggagggatcagtcccctagtcacgaagaaccgacaacaagcagttcttcgctggctcctacaggccgtccatattcatctagaggaagcaaacaagcttctgaaactccaatcatagttagtgatgaagatgttctatcacttctcatggaacaacatgacttatttctaagctcaacaaagtctcggctgacaaaattgcagattattcatcaaatgtgggaaagaaatgacatcaggggtgtgctctccgcgatggagaggatgggtgatcatgctgtctgtgctgatatggctagtgttctgatggagaaaagtgaaataataacacttgatttatgtacctctatcctgcctgctgtcactgatcttctggagagtaaaattgacagacacttgtccgtcacattggaattgttggtgaagcttgtaaggacttttggtccaatgatacattcaacagtatcatcaggtccttgtgttggcgtagaccttgaagcagagcaaaggagggagcgctgcaacttatgcttcattgaattggagaaggccaaaaataagcttccgtctctaacaagaagaaaaggggcggttgcaaatgctgcacaagagcttgctcttgtcttccaggaaatcatgagttgactgacgacacactagatatacacaattagatgggacatgcttccccctgatggcaacaagattggatattagctgccatggagcgctagctagctattcagtcttagcaccgtcatcaagctccaaggccacagcagggacaaaggcactttgttgctgctgatcgcgccttttgtacacatgctgacacataatccatgtcatttgtgaagagaagctgccatggacaatgacttcagccacactattatgtggatgtcgtttcagcgactgccggagatgttataggccccaatcaatgatgatgagcagatgtgacttgggattgcttctctggcacagtttgctgtctgtaacatctttcgcatgtaccgttagcatgtgcatgtgcaccagtgaagtggttgcatttggtagtttatggttgggttgtgttgtgttgtcgttttagtgatcattgacgagtgaagcgagctatgtacatcatttttgaagattcgatatcttttttcctcgataactccctttgttatacttagtgaaaatgatatcttgtggtgtttcattaacagctttcattgagattccatttcccttgatctggaaaatatctgggtatttgtactgttatttggaacttggaaggcatgctaaggccttgtttagttccaaaatttttgagaaatcgacactgttgc

SEQ ID NO: 6056 - DNA, 4035 bp, Sorghum bicolor
gaggtgagaagacaagatccacctccacccccacactgcccaacgccgcagcgccatttttaatcatcggcgagccctcctcagctccaacccccagctgtttttaattcgaaaattttcgaaccaagcccatctctctcgtcttccacctcctgccttccccacccccaccgcacagcgcccggcccggccccaaccagagaccagacagctccgtttcccctcccccgtcctgcctccacctcgaccgcgcaccaaacccgcagccacattccctcctccagccagcccatccccgctctcgcgcccctccgctccgagcggcggcggcggcggcggatacggcggcgcccgcccctaccgggcagttgcggcggcggacgagtcttccccggaagagggaggcaggctctggccggagtgtgtacggccgcctcgtgctgaggacaggcggggcgcgagatccgggctggaagggtggaggggtcgcgttggtggcgccgtggcgtcggcgtgatctgaaatgagattggacccgacggcgcggtattcgctgcggaggtagacggccatgacgaccaacaccaagcgcgcctacaagctccaggagtttgtggcgcactcttccaatgttaactgcctcaagattgggaggaagacctcgcgggttcttgtcacaggaggagaggatcataaggtcaatctttgggctattgggaagcccaattcaatattgagtttatcagggcacacaagtgctgtggagtcggttggttttgattccacggaagtgtttgtggctgcaggagcagccagtggaacaataaaactatgggatttggaggaggcaaagattgtccgcactcttactgggcatagatcaaactgtatgtcagttgatttccatccgtttggggaattctttgcctctgggtcgttggacactaatctgaagatatgggatataagaaggaagaattgcatccatacatacaaaggtcacacacgaggggtgaatgctattagattcacacccgatggtcggtgggttgtgtctggtggtgaagataatatagtaaagctctgggatctgactgctggaaagttattacatgaattcaagtgtcatgagggtcagatccagtgcatagatttccacccccacgagttccttctggcaacaggttcagctgataaaactgtcaagttctgggatttggagacttttgagttgattggttctactggacctgagacaacaggtgttcgatccatgacattcaatcctgacggaagatctttgttatgtgggttgcatgaaagcttaaaggttttctcctgggagccaataagatgccatgatactgtggatgtgggatggtctaaacttgctgatttgaatgtccacgagggaaaacttcttggttgttctttcaatcaaagttgtgtaggaatatgggttgttgatctgacgcgtcttgagccatatgcaacgggtacttcaacaaaactaaatggtcattctgaattgaagactgtgtctagcggcactttgcctttacaaaatgatagtggctcaagggctaacatagggcgatcatcaaccttgcaaacttcagagaataacctaaaagcttcttcaggaagattgtcggcacaaaactcagattctgcacccaaagagactaaattggcaccctcaagcgggttggtcccaagcacaccacaaagggctggagttagctccaataatagatctgttggaaattcagcttttcaatctggtggtaccaccttaaagagaagttcattgcggagtaacagtgcatctaatgtccacaatttcagtaaagctgatgtagtgccagtcattgttcccagaactagctcaggaggggagttggctactgattctagaagtgatgctgctgatgtggcacctgttcttcctaaggtaaccagaagggttgatcctgctactgattctagaaaagaaagtaatgatgtggatcttgttattcctaaagcaagctcaagagtggaaatagcctctgattcagcacccgtttctactttcaagtcaggcagaaggttggaggctgcccctgattcaaaaaaagaaagtgctgatacaacacctgttgttcccaatcctagggcaaatgcaagaatggagatggcctctgattctgcgcctgctctttcaaaggcaaacagaaagctagattctggtactgattcaaagaaagaaagtgttgatgcagtacctgccattgtacccagagcaaattctagaatggaaatgaattctgattctaggagagaaccctctgctggaagagtatcaccattcagaatccagtcaagatatgctgagctacggaagctaacccatgccaaaattgatgcaaacaaagttgacagtggaagtaaaattactgaaacagatgacttcaattgccaaatatttcttccccgtagaaatggtgtttttcaaataagttctgaagaatcccgcgaagatgtaaagtgtggtccagctgacaggatgggattttcaaattcgtcagaaccaaatgcaagtgtccgcagtgagaattatgtttctagaatgcgcaaaccaagagataactgctatattgaagtttcaagagcagggagagcaaggtcaaatgtctctaattgggaagggagggatcagtcccctagtcacgaagaaccgacaacaagcagttcttcgctggctcctacaggccgtccatattcatctagaggaagcaaacaagcttctgaaactccaatcatagttagtgatgaagatgttctatcacttctcatggaacaacatgacttatttctaagctcaacaaagtctcggctgacaaaattgcagattattcatcaaatgtgggaaagaaatgacatcaggggtgtgctctccgcgatggagaggatgggtgatcatgctgtctgtgctgatatggctagtgttctgatggagaaaagtgaaataataacacttgatttatgtacctctatcctgcctgctgtcactgatcttctggagagtaaaattgacagacacttgtccgtcacattggaattgttggtgaagcttgtaaggacttttggtccaatgatacattcaacagtatcatcaggtccttgtgttggcgtagaccttgaagcagagcaaaggagggagcgctgcaacttatgcttcattgaattggagaaggccaaaaataagcttccgtctctaacaagaagaaaaggggcggttgcaaatgctgcacaagagcttgctcttgtcttccaggaaatcatgagttgactgacgacacactagatatacacaattagatgggacatgcttccccctgatggcaacaagattggatattagctgccatggagcgctagctagctattcagtcttagcaccgtcatcaagctccaaggccacagcagggacaaaggcactttgttgctgctgatcgcgccttttgtacacatgctgacacataatccatgtcatttgtgaagagaagctgccatggacaatgacttcagccacactattatgtggatgtcgtttcagcgactgccggagatgttataggccccaatcaatgatgatgagcagatgtgacttgggattgcttctctggcacagtttgctgtctgtaacatctttcgcatgtaccgttagcatgtgcatgtgcaccagtgaagtggttgcatttggtagtttatggttgggttgtgttgtgttgtcgttttagtgatcattgacgagtgaagcgagctatgtacatcatttttgaagattcgatatcttttttcctcgataactccctttgttatacttagtgaaaatgatatcttgtggtgtttcattaacagctttcattgagattccatttcccttgatctggaaaatatctgggtatttgtactgttatttggaacttggaaggcatgctaaggccttgtttagttccaaaatttttgagaaatcgacactgttgcact

SEQ ID NO: 6057 - DNA, 4816 bp, Setaria italica
gcgagccctccaaccccaacccttttttaattcgaaatttttcgaaccaaaccatctctctctctctctcgtcttcctcctcctgcgcctcctccacccccaccccaccgcacagcgcccggcccggccccaaccagacagctccgtttcccctccccgtccttcctccacctcgaccgcgcaccaaacccaaaagcgcagccgcattccctccacctcccccgctctcgcgcccctcccctccgcgtcacccggagcggcggcggcggcggccgtggtggcgggcgccctccctcccggggcagtggcggtggctgcgtaagggtttgttttacccggaacagggaggctctggcgggagtgtgtacggccgcttcgtgctgggggcaggcgcggagcgagatccgggccggaaggtgcggggggtctcgagggtggcgccgtggcgtcggcgtgatctgaaatgagattgggcccagaggcgcggtattcgcagcggaggtgccggccatgaccaccaacaccaagcgcgcctacaagctccaggagtttgtggcgcactcgtccaatgttaactgcctcaagattgggaggaagacctcacgggttcttgtcacaggaggagaggatcataaggtcaatctttgggctattggaaagcccaattcaatattgagtttatctgggcatacaagtgctgtggagtccgttggttttgattccacagaagtttttgtggctgcaggagcagccagtggaacaattaaattatgggatttggaggaggcgaagattgtccgcactcttaccggacataggtcaaattgtatgtcagttgatttccatccctttggggaattctttgcctcggggtcattggacactaatctgaagatatgggatataagaaggaagaattgcatccatacatacaaaggtcacacacgaggggtgaatgctattcgattcacacctgatgggcggtgggttgtgtctggcggtgaagataatacagtaaagctctgggatctgacagctggaaagttattacatgaattcaagtgccatgagggtcagattcagtgcatagatttccatcctcatgagttccttctggcaacaggttcagcagataaaactgtcaagttctgggatttggagacttttgagttgattggatctaccggacctgagacaacaggtgttcgatccatgacattcaatcctgacggaagatccctgttatgtgggttgcacgaaagcttaaaggttttctcttgggagccaataagatgccatgatactgtggatgtgggatggtctagacttgctgatttgaatgttcacgagggaaaacttcttggttgttctttcaatcaaagttgtgttggaatatgggttgttgatctgacgcgtcttgagccatatgcaaccggtacatcaactaaactaaatggtcattccgaattgaagactgtgtcaagcggcactatgcctttacaaaatgacactggttcaaaggcaaacattgggcgatcatcagttttgcaaaattcagagaataacctaaaagcttcttcaggaagactgtcggtttctcaaaactcagattctgcactaaaagaaacaaaatcgacagcctcaagcggattggtcccaagcacaccacaacgggctggagttggctccaataatagatcttttggaaattcagcctttgcatctggtggtaccaccttgaagagaagttcgttgaggagtcacaatgcctctagtgttagcaatttcagtaaatctgatgtagtgcctgtgattgttccaagaactagctcaggaggggagctagctactgattctagaagtgatgctgctgatgtggcacctgttctttctaaggcaaccagaagggttgatcctgctactgattctagaaaggaaagtactgatgtggaacctgttgttcctaaagcaagctcaagaatggaaatatcctctgattcagcacctgttgttatttccaagtcaagcagaaggctggagtctggtgctgattccaaaaaggaaagcgccgatgcagcatctgttgttgttcccagggaaaatacaaaaatggaaatggcctctgattctgcacctgttctttcaaaggcaagcagaaaggtagatcctggtacggattcaaagaaagaaagtgctgatgcggcacccgtcatccccagggcaagttcaagaacggaaatggcctctgatgctaggagagaaccttctgctggaagaatatcgccattcagaatccagtcaagatatgctgagctacgcaagttaacccatgcaaaagttgatgcaaacaaagttgatagcagaagtaaaaatactgaaacagatgacttcaattgccaaatatttttcccccggagaaatggtgtttttcaaacaataagttctgaagaaactcgtgaagatataaagcatggtgcagttgacaggatggcattttcgaatccagcagagttgaatgcaagtgtccgcggtgaaaattatgtttctagaatgcgtaaaccaagagataactgctatgttgaagtttcaagagcaggaagagcaaggtcaagtgtctctaattgggaagggagggatcaatcccctagtcatgaagaaccaacaacgagcagttcttcgctggctcctacaggccgttcatattcatctagaggaagcaatcaagcttctgaaactccaaccatagctagcgatgaggatgttctatcccttctaatggagcaacatgagctatttctaagctcaacacggtctcgcctgacaaaattgcagattattcatcaaatgtgggtaagaaacgacatcagaggtgttctctctgcgatggagaagatgtgtgatcatgctgtatctgctgatatggcaagcgttctgatggagaaaagtgaaacaatcacactagatttatgtacctctatcctgcctgttgtcactgaccttctggagagtaaaactgacagacacttaggcgtttcattggaattgttggtgaagcttgtcaggacctttggtccaatgatacattcaacagtatcagcaggtccttcttctgttggtgtagatcttgaggcagagcaaaggcgggagcgctgcaacttatgcttcattgaattggagaaagtaaaaaataagcttccttttcttacaagaagaaaaggggcagttgcaaacgcagcacaggagctcactcttgtcttccaggaagttatgagttgactgaagacacactcataagtatacaccatgttagagtggcacctagatatcagctgctgctgagctctagttgttcaatcttgagctgccatcaagctccaaggccacaccagcaggagaaacattttgttgctgctgttcgtgccttttgtacacatgctaacacaagagggactgacatccatgccatttgggaagagaagcagccatggacaatgacttcagccacaatattatgtgggtgtcgtttcatcggcagctgaagatgttatagttctgaatcaaatggtgatgaaaaggtagatggtgggcttttcaagcatttgtattcgccatctatagtgtgttgtgtggatgattcagtcacaagattgatgagttttgtgtggttgattctgtcacaagattgacgagtgaagcaagtcatgtacatcatttttgaatatttgatatctggatgactctctttcttctacttcaagcgcgaaaatgatttcactctgctgttcaatgtagctggtgaacttgtgctttcttggtccggcaaataccactctgtttggactgttaagacaaactgcaggtctgtctggcatggtaaagaacgatatctgattgatttgtacagcattatctttctctggttacgatcctctcggaaagtaaacactgaacttccattcatattaaaataattgccgccaagacagtatgcctagacacaaacctgtttttgaacgaaactagacacaaacctgtaacccaaacaaaagataggcatcagagaggcacgcatgcagcaagtgcccctccttattccttccatctacttcaacgcaacgcacaagataaacttcaccacaggactcaagtctgaagggctcgatcgagatctcggccacggcccacggcccatggctccggctcctagcaggtgggtacacaggacttggtgcacttggcagcgcacttgctgtgggccgagagcgtgcagcccttgccgcagagcatcttcttcttgtggcactcctctttggtgaggcagctcttgccctgcttctcgccctccttgttgctcccttcctccttgccgtgctcgccgctgccgctgctggtgccgctgccttccgacgagctctggtcgtcgccctgcgtggccacgccgccgcccgacgagctctggtcgtcgcccagcgtagccacgccgccgctcggcttcgcctcaagcggctgcaactgcgcctgcatgtccttcttcgccgcccatatggctgccagcgtcgcgccctccgcggccagcaggcgcgcggtctcctcgtcgatgtgcgaggcgtcgctcgggatggtccgcttgtcctgctggcgcgcctcgtacggcgaggccgcggcggcggcgctggctgccacggcgagcgcaaggagcagtgacgccacgaggtagcgagagcgagacatcgctgcagctagctagctatctcgatgtaggttatgtagtgtgttttaattgtttggctgatgccaggagcgaactgcaaggctc

SEQ ID NO: 6058 - DNA, 3286 bp, Zea mays
acggccatggcgaccaacaccaagcgcgcctacaagctccgtatcctcgtcgattcgtttccgctgtttcgctaccttttttttgtggaattccttgtcggggaggagtttgtggcgcatgcgtccaatgtgaactgcctcaagattgggaggaagacctcacgggttcttgtcaccggaggagaggatcataaggtcaatctttgggctattgggaagcccaattcaattctgagtttatcagggcacacaagtgctgtggagtcggttggttttgattccaccgaagtttttgtggctgcaggagcagccagtggaacaataaaactatgggatttggaggaggcaaagattgtccgtactcttactggacatagatcaaattgtatgtcagttgatttccatccttttggggaattctttgcctctgggtcattggacactaatctgaagatatgggatataagaaggaagaattgcatccatacatacaaaggtcacacacgaggagtgaatgctattagattcacacccgatgggcggtgggttgtgtctggtggcgaagataatatagtaaagctctgggatcttacagctggaaagttattacatgaattcaagtgtcatgagggtcagatccagtgcatagattttcatccccatgagttcctcctggcaacaggttcagctgataaaactgtcaagttctgggatttggagacatttgagttgattggatctacaggacctgagacgacaggtgttcggtccatgacattcaatcctgacggaagaactctgttatgtgggttgcacgaaagcttaaaggttttctcctgggagccaataagatgccatgatactgtcgatgtgggatggtctagacttgctgatttgaatgtccacgagggaaaacttcttggttgttctttcaatcaaagttgtgttggaatatgggttgttgatctgacgcgtcttgagtcatatgcaacgggtacttcaacaaaattaaatggccattctgaattgaagactgtgtctagtggcactatgcctttacaaaatgatagtggttcaagggctaacatagggcaatcatcagtcttgcaaagttcagagaataacttaaaagcttcctcaggaagactgtcggtttctcagaactcagattctgctcccaaagagactaaatcaacaccctgtatcgggttggtcccaagcacaccacaaagggctggatttagctccaataatagatctgttggaaattcaacttttcaatctggtggtaccactaccaccttgaagagaagttcgttgcggagtaacagtgcctctaatgttcacaatttcagtaaagctgatatagtgcctgtcattgttcccagagctagctcaggaggggagttggttacgggttctagaagtgatgctggtgatgtggcacctgttctccctaaggtaaccagaagggctgatccttctagtgattctagaaaagaaagtaatgatgtggaacctgttattcctagagcaagctcaacaatggaaatagcctctgattcagcacccatttctacttccaagtcaggcagaaggttggaggctgcccctgattcaaaaaaagaaagtgctgatacagcacctgctgttcccaatcccagggcaaatgcaagaatggagatggcctctgattctgcacctgctcttttaaagacaaacaaaaagctagattctggtactgattcaaagaaagaaagtgctgatgcagtacctgttattctgatttctgattcaaggagagaaccctctgctggaagagtatcaccattcagaatccagtcaagatatgctgagctgcggaagctagcccatgccaaaattgacagaggaagtaaaactactggaacagatgacttcaattgccaaatatttcttccccgtaaaaatggtgtttttcaaacaataagttctgaagaaacccgtaaagatgtaaaatgtggtccagttgacaggacggaattttcaaattcatcagaaccaaatgcaagtgtccgcagtgagaattatgtttctagaatgcgcaaaccacgagataactgctatattgaagtttcaagaaaagggagagcaaggtcaagtgtctgtaattgggaagggcgggaccagtcccctagtcacgaagaaccgatgacagccagttcttcgctggctcctacaggccgtccaaattcatctagaggaagcagtcaagcttctgaaactccaatcatagctaatgatgaagatgttatatctcttttcatggaacaacatgagttatttctaagctcgacaaagtctcggctgacaaaattgcagatcattcatcaaatgtgggaaagaaatgacatcaggggtgtactctctgcgatggaaaggatgggtgatcatgctgtctgtgctgatatggctagcgttctgatggaaaaaagtgatgtaatcacacttgatttatgtacctctatcctacctgccgccactgatcttctggagagtaaaattgacagacacttaggcgtcgcattggaattgttggtgaagcttgtaaggacttttggtccaatgatccattcaacagtatcatcaggtccttgtgttggtgtagaccttgaggcagagcaaaggagggagcgctgcaatttatgcttcattgaattggagaatgccaaaaataagcttccatctcttacaagaagaaaaggggcagttgcaaatgctgcacaagagcttgcgctcgtcttccaggaaatcatgagctgactgacgacatactagacacacagaattagatgggacgttcttccctctgctggcaccgagattggatatcagctgcccatggagcgctaagagctactcagtcttagcgccgtcatcaagctccaaggccacagcagcggtgaagggcattttgctgctgctattcccgcagtctgtacacatgctaacacataatccgtgtcatttgtgaagagaagctgctgccatggacaatggacttcagccacaatattatgtggatgtcgtttcatgggctgccggcgatgctacaggtcccgatcgaatgatgatcagcagatgggaactcgtagttccttgctgtctgcagcacctttctcatgtaccgttagcatgtgcgtgtttgtggttgggttgggttgtttggccgatttactgatcattggcgaatgaagtgagccatgtacatcattttgaagaattaatatcttttcttcttctgagt

SEQ ID NO: 6059 - DNA, 3231 bp, Panicum virgatum
tcaagattggaaggaagacctcgcggattcttgtcaccggaggagaggaccataaggtcaatatctgggctattgggaagcgcagctcgatactgagtttgtcagggcatacaagtgctgtggagtcggttagttttgattccacggaagtgtttgtcgctgcaggagcagccagtggaacgataaaactatgggatttggaggaggcgaaaattgtcagcactcttactggacacagatcaaactgtatgtcagtcgatttccacccctttggggaattttttgcctctgggtcattggacactaatctgaagatatgggatataagaaggaagaactgcatccatacatacaaaggtcacacacaaggagtgaatgctattagattcacacctgatggtcggtgggttgtgtctggtggcgaagatgatacagtaaagctctgggatctgacagctggaaagttattacatgaattcaagtgccatgaaggtcagattcagtgcatagatttccatccccatgagttccttttggcaacaggttcagctgataaaactgtcaagttctgggatttggagaccttttagttgattggatctactggacctgagacaacaggtgttcgatccatgacattcaatcctgacggaagatctctgttatgtgggttgcacgaaagcttaaaggttttctcttgggagccaataagatgccatgatactgtggatgtgggatggtctagacttgctgatttgaatgttcatgagggaaaacttcttggttgttctttcaatcaaagttgtgttggaatatgggttgttgatctgacgcgtcttgagccatatgcaactggtacatcaacaaaagtaaatggtcattctgaattgaagactgtgttaagcagcactatgcctttacaaaatgacagtggttcaagggctaacattgggcgatcatcagttttgcaaaattcagagaataacttaaaagcttcttcaggaagactgtcggtttctcagaacacagattctgcactcaaagagacaaaatcaacagcctcaagcggattggtcccaagcacaccacaaagggctggagttggctccaataatagatcttttggaaattcagcttttgcatctggtggtaccaccttgaagagaagttcattgaggagtcacaatgcctctagtgttagcaatttcagtaaagctgatatagtgcctgtgattgttccaagaactagctcaggaggcgagctgaccactgattctagaagtgatgctgctgatgtggcacctgttctttctaaggcaaccagaagggctgatcctgctactgagtctagaaaagaaagtactgatgtggaacctattattcctagagcaagcccaagaatggaaatatcctctgattcagcacctgttattatttccaagtcaggcagaaggctggagtctggcgctgattcaaaaaaaggaaagccccgatgcagcacctgttgttcctaggtcaaatacaaaaatggaaatggcctttgagtctgcacctattctttcaaaggcaaacagaaaggtagattccggtaccgattcaaagaaagaaagtgctgatgcgacacctgtcatcgcccccagaacaagttcaagaacagaaatgtcctctgattctaggagagaaccttctgctggaagagtatcgccattcagaatccagtcaagatatgctgagctacgcaagttaacacatgcgaaagttgatagcggaattaaaaatactgaaacagatgacttcaattgccaaatatttcttccccggagaaatggagtttttcaaacaataagttctgaagaaactcgtgaagatatgaagcatggtgctgttgacaggatgccattttcaaattcagcagaaccgagttcaagtgtccgcagtgagaattatgtttctagaatgcggaaaccaagagataactgctatgttgaagtttcaagagcaggtagagcaagatcaaatgtctctaattgggaagggagggatcaatcccctagtcatgaagaaccaacaacaagcagttcttcgctggctcctacaggccgttcatatttatctaggggaagcaatcaagcttctgaaactccaaccattgctagcgatgaggatgttctgtcccttctaatggagcaacatgagctatttctaagctcaacgcggtctcgcctgacaaaattgcagattattcatcagatgtgggtaagaaacgacatcagaggtgttctctctgcgatggagaagatgtgtgatcatgctgtcagtactttggctactctttcttatgcatccaataatcatcatcttgctgattatatcgtttctgttaattgcaggtctctgctgatatggcaagtgttctgatggagaaaagtgaaacaatcacactagatttatgtacctctatcttgcctgttgtcactgaccttctggagagtaaaactgacagacatttaggtgtttcattggaattgttggtgaagcttgtcaggacctttggtccaatgatacattcgacagtatcatcaggtccttcttctgttggtgtagatcttgaggcagagcaaaggcgggagcgctgcaacttatgcttcattgaactggagaaagtaaaaaataagcttccttttcttacaagaagaaaaggggcagttgcaaatgcagcacaggtgctcactcttgtcttccaggaagttatgagttgacaattagatgggaaatgcttcccccttatggtgcattgatatcagcagctgctgagcgctagctgttcaatcgtgagctggcatcaagctccaaggccgcaccagcagcagaaacattttgttgctgctgttcgtgccttttgtacacatgctaacagccggactgacatccatatcatttgagaagagaagcagccatggacaatgacttgagacacactattatgtggaggtcgtttcatggctgctgaagatggtgggcttttcgagcacttcttctagtacttcgccatctatagtgtgctgcgtggttgatttagtcacaagattgatgagtgaagcaagcgaggcatgtatatcatttttgaatgtttgatatctattctctggatgactctctttgttctacttaaagcgcggaattgatttcaccttgttgttcaatttaagctttcgatgaacttgtgctgtt

SEQ ID NO: 6060 - DNA, 1736 bp, Sorghum bicolor
cctgactgaccccgtgacctcggagccggagggtggaggctttgcctaaaccctcgtccaccgtcttcgtcgccggccccctttagcctcacccggtcaccccaatccggccatggtgaccgcggatccggacgggagcggaggcgcgccggacgtctccgagcttttctgccactacaactccctctacttccgcgattccctcggctcctgcgccgtctcatgggccgaggacccactacccaattctgatgtaagcatatgcgactattaccctggaggcggtggctgtataatacttctttcgaaatccttatgcggatctcataatggatctgatctgaagaatgctttgcttcatgagatgattcatgcctatatttgcatcaaatacaacaacagtaaccatagtgatcatggtgcaaaatttcagaaactggtgaatacgatcaatttgagttctgtagctgatccccatcgaccagtcgatggctacagcataactctgctccatgagatccataagaaatattatcactacaaatgtcaaagctgtgcagattttatcaagtcaaccaatatgagaggaccttctggtgatgactgcattgagagaaaaggtggagatgacccatgtcataattctaactgtcactggcatagacacaagcagcggtgctcgggtaattattgtagagttcaagaatcatcaccaggaggtctagaactaaaatgttcggaagctgtagaagtattcaatgagggcaaggttgaagaacctgcctgtacaagttggcaccccacacatacatcaaataagagcagaagaagcaatagaaacgagcaggaagatgcctctacagagtttcttcacgttgctgataatgcagttggctgttcaggactggattcctcttcaaaagatgggtctaataagaaaatcaaattttctaaggatgttagctctgaccttcgaaggacagaaactgttcaggaaacaccaaaacgcccaagagcagctgtactagataaccaagaatgcagcagacggaagaaaaggaaacaaagcaagcggtatggttcctactcggtaataattgaatggttgaattactactgtcttagtgagtcggatgaagatgaggtgccattgatcaataagcgaacagaaagaaggcgccgacaaagatttcatgaaatgtctctagccagggaatccagcgatgttgttgagtttggcagctcaaattctcatatggttggttcttgcgcactagctcccaaggacaataccaaacttgaaattgtgccagcttctcaacctgaagaaagatcctgctcaagtcatcctgtggctagcaacggagttgctggaaatcaaactggtcgtgaacctatgtcttctccaatggattcactaattagaggtgaaattgttgacatttcagatggttgagtacttgagtgcaagagttccgtgttagttccttgttactggagcctggatgaaagattatccagtgtaatggctgtaaagactggttttcctgtgcaccttgcaactgctagacatgcgcaggctgccaagccgttgcctttgtatgagtttttccccccttaatctgccgttgtatataagcttatttgttcccttctgcatttcgccacttattcctggctgtagattgtttctcccaaggtaacacatctgtttggaacgctgatctataaaagac

SEQ ID NO: 6061 - DNA, 1817 bp, Sorghum bicolor
cctaaccgtaaccaccccctgaaattgtgcagatggctaaacacacttccagaaccctgactgaccccgtgacctcggagccggagggtggaggctttgcctaaaccctcgtccaccgtcttcgtcgccggccccctttagcctcacccggtcaccccaatccggccatggtgaccgcggatccggacgggagcggaggcgcgccggacgtctccgagcttttctgccactacaactccctctacttccgcgattccctcggctcctgcgccgtctcatgggccgaggacccactacccaattctgatgtaagcatatgcgactattaccctggaggcggtggctgtataatacttctttcgaaatccttatgcggatctcataatggatctgatctgaagaatgctttgcttcatgagatgattcatgcctatatttgcatcaaatacaacaacagtaaccatagtgatcatggtgcaaaatttcagaaactggtgaatacgatcaatttgagttctgtagctgatccccatcgaccagtcgatggctacagcataactctgctccatgagatccataagaaatattatcactacaaatgtcaaagctgtgcagattttatcaagtcaaccaatatgagaggaccttctggtgatgactgcattgagagaaaaggtggagatgacccatgtcataattctaactgtcactggcatagacacaagcagcggtgctcgggtaattattgtagagttcaagaatcatcaccaggaggtctagaactaaaatgttcggaagctgtagaagtattcaatgagggcaaggttgaagaacctgcctgtacaagttggcaccccacacatacatcaaataagagcagaagaagcaatagaaacgagcaggaagatgcctctacagagtttcttcacgttgctgataatgcagttggctgttcaggactggattcctcttcaaaagatgggtctaataagaaaatcaaattttctaaggatgttagctctgaccttcgaaggacagaaactgttcaggaaacaccaaaacgcccaagagcagctgtactagataaccaagaatgcagcagacggaagaaaaggaaacaaagcaagcggtatggttcctactcggtaataattgaatggttgaattactactgtcttagtgagtcggatgaagatgaggtgccattgatcaataagcgaacagaaagaaggcgccgacaaagatttcatgaaatgtctctagccagggaatccagcgatgttgttgagtttggcagctcaaattctcatatggttggttcttgcgcactagctcccaaggacaataccaaacttgaaattgtgccagcttctcaacctgaagaaagatcctgctcaagtcatcctgtggctagcaacggagttgctggaaatcaaactggtcgtgaacctatgtcttctccaatggattcactaattagaggtgaaattgttgacatttcagatggttgagtacttgagtgcaagagttccgtgttagttccttgttactggagcctggatgaaagattatccagtgtaatggctgtaaagactggttttcctgtgcaccttgcaactgctagacatgcgcaggctgccaagccgttgcctttgtatgagtttttccccccttaatctgccgttgtatataagcttatttgttcccttctgcatttcgccacttattcctggctgtagattgtttctcccaaggtaacacatctgtttggaacgctgatctataaaagacgattgagcttatttgctgaatctgcc

SEQ ID NO: 6062 - DNA, 2634 bp, Sorghum bicolor
gtttcactggacccgatgcccaacgttatggccgccgccccagccggctgcttacctcgcggggtgattcctccggcgcgatcgagcagaggcagagcatctcttcccggggtcgccagagcatatgcggagaggcggttggttgcagaaaacacaagcctgccaaacaagcatgtgcagcataaggaggaactggagactaggataaggaatcagctccggaggccccagttgccaccttctttgtacgacacagcctgggtttctatggtgccaatgcggggctctcatcatactccctgcttcccacagtgtgttgagtggatactgcagaaccagcaggatgatggatcttggggtgtcagccaatctggctcagaagtcaacaaggatgttctcctgtccacgttggcatgtgttcttgcgttgaagagatggaatgttggcagagagaacatgtggagaggactgcatttcattgggcggaacttctatgttgctatggacgagcaggtcgctgctcctgtaggtttcaacatcacttttcctggtttacttagcctcgccattgatatgggtttagaaattcctataagacaaactgatgtctgtgggattcttcacctccgtgagatggaattgaaaagacaggctgtggacagttcttatggaagaaaaacatatatggcttatatcgcagaagggttaggaagcatggtggactgggatgaagttatgaagttccagaggaagaatggatcattgttcagctctccttccacaactgctgttgcattaatccacaaatacaatgatccagcccttcaatacctaaatttgcttgtcagtgaatttggcagttcagatgcacttgaaagaatgggaatttctcagcactttgtcagtgaaatagaaagcatcctggacatggcatacagttgctggttacagaaagacgaggaaatcatgatggacaaagcaacatgtgcaatggcatttcgccttttgaggatgaatggttatgatgtttcctcagatgtgctgtctcatgttgctggaccttccactttccatgattcactacaaggatatttaaatgatacaaaatccctactggaattgtacaaggcttcaaaagtcagcttatcagaaaacgatttggtcttagatggcataggattctggtctggcaacttattgaaggataagttgtgctctagtagggtgaaaaaggacctgatttttggagagatggagtatgctgttaagtttcccttttatgccacactggagcgtctagaacacaagagaaacatcgaaaattttgatgcttggggtcctctgatgctaacaacaaaatcctcgtctttctgtatcgatcaggaatttgtagctttggctgtcgaagatttcagtttctctcaatatgtttaccaggatgaacttcggcatctcgatagttgggtgaaggagaacaagctggaccagctacaatttgctcggcagaaactgacatattgctatctgtctgctgctgctaccatattttcttctgaattgtctgacgctcgcatttcatgggccgaaaatggcgttctcacaactgtggttgatgacttcttcgatgttgggggatcaaaagaagaattagaaaacctgatagcactagttgagaaatggcatgcacaccatacagttgggttctactcagagcaagtgaaaatagtattttctgctatttatacaacagtgaaccatcttggagtaatcgcttctgcagcacaaggccgtgatgttacaaaccacctagtagaaatatggctggatttgttgaggtctatgatggtcgagacagaatggcagagaagccaatatgtgccaacagttgaagaatacatgacgaatgctgttgtctcatttgcactgggcccaattgtgctcccagcattgtatttcgtagggcaagaggttttagagcatgctgtcaaagatgaagagtatgatgaattatttaggctaatgagcacttgtgggaggctcctcaatgacagtcaaagcttcgagagggaaggcaaccaggggaagctgaatagcgtttctctacttgtccgccacagtggtggttctatgtccatagaagccgctaaaaaggcactgcagaagtccatagacgtctctaggagagacttgctaagattggttctcaggaaagaaagcgttgttcctaggccatgcaaggagctcttctggaagatgtgtaagatacttcacttgttctactttcagactgatggatttagctccccaaaggaaatggtcagtgcagtgaatgctgttatcaacgagccactcacagtccaaaatactactagttcgtttttgtctagttcatcagggaagtgaggatcacatgtaatttatcctgttcatatggatcagaagcagcagcggcaagcttaagatatttgtaagtttgtaactgggctgatgtagattggtgaaggtacatctttgctgtatgtggatcaaggtattgggaacacctgagtcattggtagtgagagttattcactctttcgcgagattttgtcgagaatttgccacatcctgcaaaaatctggtccctatccttgt

SEQ ID NO: 6063 - DNA, 3098 bp, Sorghum bicolor
atcgtactcaagaaattcagagcagagcatggttcatggctgtgactgtgagcctgtccgtccttgtcccagtcctccatctccatcttgagcgttcactcatcaagcaaagcagaacaagcatcctaatccgacgacaaaagtcatcactccagcaaaaaggcgctcgcgcacgtcggggcccccgattcgaacactttctcctccgccgcctcctccgctcggctcgcctcttcttcttcttcttcgccgccgctgatccggaccagttctcctcggttcctcgcagtcccacccaccgaggttctctcctctcaccgtccccagcccccgacagctgattgccttcgtactctgctggttcctcttcttcttcagggcgccaagtccgtcgacatcgacgccacaggaaccggctccccaggagcggtttcactggacccgatgcccaacgttatggccgccgccccagccggctgcttacctcgcggggtgattcctccggcgcgatcgagcagaggcagagcatctcttcccggggtcgccagagcatatgcggagaggcggttggttgcagaaaacacaagcctgccaaacaagcatgtgcagcataaggaggaactggagactaggataaggaatcagctccggaggccccagttgccaccttctttgtacgacacagcctgggtttctatggtgccaatgcggggctctcatcatactccctgcttcccacagtgtgttgagtggatactgcagaaccagcaggatgatggatcttggggtgtcagccaatctggctcagaagtcaacaaggatgttctcctgtccacgttggcatgtgttcttgcgttgaagagatggaatgttggcagagagaacatgtggagaggactgcatttcattgggcggaacttctatgttgctatggacgagcaggtcgctgctcctgtaggtttcaacatcacttttcctggtttacttagcctcgccattgatatgggtttagaaattcctataagacaaactgatgtctgtgggattcttcacctccgtgagatggaattgaaaagacaggctgtggacagttcttatggaagaaaaacatatatggcttatatcgcagaagggttaggaagcatggtggactgggatgaagttatgaagttccagaggaagaatggatcattgttcagctctccttccacaactgctgttgcattaatccacaaatacaatgatccagcccttcaatacctaaatttgcttgtcagtgaatttggcagttcagatgcacttgaaagaatgggaatttctcagcactttgtcagtgaaatagaaagcatcctggacatggcatacagttgctggttacagaaagacgaggaaatcatgatggacaaagcaacatgtgcaatggcatttcgccttttgaggatgaatggttatgatgtttcctcagatgtgctgtctcatgttgctggaccttccactttccatgattcactacaaggatatttaaatgatacaaaatccctactggaattgtacaaggcttcaaaagtcagcttatcagaaaacgatttggtcttagatggcataggattctggtctggcaacttattgaaggataagttgtgctctagtagggtgaaaaaggacctgatttttggagagatggagtatgctgttaagtttcccttttatgccacactggagcgtctagaacacaagagaaacatcgaaaattttgatgcttggggtcctctgatgctaacaacaaaatcctcgtctttctgtatcgatcaggaatttgtagctttggctgtcgaagatttcagtttctctcaatatgtttaccaggatgaacttcggcatctcgatagttgggtgaaggagaacaagctggaccagctacaatttgctcggcagaaactgacatattgctatctgtctgctgctgctaccatattttcttctgaattgtctgacgctcgcatttcatgggccgaaaatggcgttctcacaactgtggttgatgacttcttcgatgttgggggatcaaaagaagaattagaaaacctgatagcactagttgagaaatggcatgcacaccatacagttgggttctactcagagcaagtgaaaatagtattttctgctatttatacaacagtgaaccatcttggagtaatcgcttctgcagcacaaggccgtgatgttacaaaccacctagtagaaatatggctggatttgttgaggtctatgatggtcgagacagaatggcagagaagccaatatgtgccaacagttgaagaatacatgacgaatgctgttgtctcatttgcactgggcccaattgtgctcccagcattgtatttcgtagggcaagaggttttagagcatgctgtcaaagatgaagagtatgatgaattatttaggctaatgagcacttgtgggaggctcctcaatgacagtcaaagcttcgagagggaaggcaaccaggggaagctgaatagcgtttctctacttgtccgccacagtggtggttctatgtccatagaagccgctaaaaaggcactgcagaagtccatagacgtctctaggagagacttgctaagattggttctcaggaaagaaagcgttgttcctaggccatgcaaggagctcttctggaagatgtgtaagatacttcacttgttctactttcagactgatggatttagctccccaaaggaaatggtcagtgcagtgaatgctgttatcaacgagccactcacagtccaaaatactactagttcgtttttgtctagttcatcagggaagtgaggatcacatgtaatttatcctgttcatatggatcagaagcagcagcggcaagcttaagatatttgtaagtttgtaactgggctgatgtagattggtgaaggtacatctttgctgtatgtggatcaaggtattgggaacacctgagtcattggtagtgagagttattcactctttcgcgagattttgtcgagaatttgccacatcctgcaaaaatctggtccctatccttgttctttctttcttttcccccataacataaatacccc

SEQ ID NO: 6064 - DNA, 2940 bp, Setaria italica
gcggctgattgcttgctgcgcttcctcgtcattggtgtcggcgatctcaccgccggccgccggagacagcgagccggaccctcatcccaccgaggccgcatctccccgtgcgtgaggttgctcctcttcagcgtgcaaattcagtcccggttgacgccacaggaattggcacccgagattcttttttcttcctttgcctttgtgaggtttcactgaatcccgatgcccaacattacggccgccgccccagccagctgctcgccatgcggggcgattctggcgagcagagctcctcgccgcggggtcgttaaagcatatcctgagaagaggttggtagcagaaaatgtgagggtgcaaaacatgcataggaaggaactagagactagaataaggaatcagctgcagagacctgaattgccaccttcttcatacgacactgcatgggtttcgatggtgcccttgcggggttctcatcagtctccatgcttcccacaatgtgttgagtggatattgcagaaccaagaggatgatggatcttggggtgtcaatcaatttgactcatcagtcaacaaggatgttcttttatccacgttggcatgtgttattgcattaaagagatggaatgttggcagggagaacatcaggagaggactgcatttcattgggagaaatttctcagtcgctatggatgagcagaccactgctcctataggtttcaacatcacttttgccggtatgcttagactcgccattgatatgggtttggaatttcctataagacaaaccgatgtccatggtattcttcacctccgggagatggaattgaaaagacaggctgtggacagttcttatggaagaaaagcatatatggcttatatcgcggaggggttaggaaacatgctggattgggatgaaattatgaagtttcagaggaagaatggatcattgttcagttgcccttccacaacagctgctgcattaatccacaaatacaatgatcaagcccttcaatacctaaatttgcttgtcagtgaatttggcagtgcagtaccagcagtgtatccttctaaaatacattggcagcttctaatggtggatgcgcttgaaaaaatgggaatctctcagcgctttgtcagcgaaataaaaagcatcctggacatgacattcagtcgctggttacagaaagatgaagaaatcatgatggacatagcgacatgtgcaatggcatttcgccttttaaggatgaatggttacgatgtttcctcagatgagctgtctcatgttgctgaagcttccactttctgtgattcacttcaaggatatttaaatgatacaaaatccctactggaattgtacaaggcttcaaaagtcagcttatcagaaaatgatttgatcttagatagcataggatcctggtcaggcaacttattgaatgataagctgtactctaatagggcacaaaaaaccccgatttttggagagatggagtatgttgttaagtttcccttctatgccacactagagcgtttagaacacaagagaaacatcgaacattttgatgcttggggttctctgatggtatcgacaaaatgctcgtcttttcgtgtcaatcaagaatttctagctttggctgttgaagatttcagtttctctcaatctgtttaccaggatgaacttcagcatcttgatagttgggtgaaggagaacaagctggaccaactacaatttgctcggcagaaattgacatattgctatctgtctgctgctgctaccatattcccttctgaattgtctgatgctcgcatttcatgggccaaaaatggtgttctcacaactgtggttgatgacttctttgatgttgggggatcaaaagaagaattagaaaacctgatagcattagttgagaaatggcatgagcaccatgcagataagttctactcagagcaagtaaagatagtgttttctgctatttatgcaacaacaaaccagcttggagcaaaggcttcagcagcacaaggccgcgacgttacaaaacacctagcaaaaatttggctagatctgttgaggtctatgatgacggaagcagaatggcagagaagccagcatgtaacaacagttgaagaatatatgacaaatgctgttgtctcgtttgcactgggccccattgtactcccagcattgtattttgttggggaagagctctcagagcacgctgtcaaagatcaagagtacaataaattatttaggctaatgagcacttgtggccggctccttaatgacatccaaggttttgagagggaaggcagcgaagggaagctgaatagcgtttcactacttgttcacagtggcagttctgtgtccatagaagcggctaagaaggtgatacagaagtccatagacacgtctaggagagacttgctaagattagttctcaggaaagaaagcattgttcctaggccatgcaaggagctcttctggaagatgtgcaagattcttcacctgttctactttcaaaccgatggatttagctctccgaaggaaatggtcagtgcagttaacgcagtcatcaatgagccactcaaaatccaactggatgattcatccttgaacattttatcagaaaaatgaggacctcctgcattctatatatcaagttcatatgaatcagaggcagcagcaggccaacagctagtatcatacattataatttggttggtgtagcgatgtgcaacataggtttttccggctgctaccttgttgtacatgtatcttgtgcatagatcatggtcttatgaagaccttttgattctttgatagtgagagttcgttgttctctttcgcaaaattttgtcaaaaacttagggtattctgggagtttctgaccaaaatcccaaacctattcgcagctcctttccccttaacatcagtagtaagatgtgt

SEQ ID NO: 6065 - DNA, 2659 bp, Sorghum bicolor
cgatgagagctctcgcctcgcccaccgcctccttcctcccggggatcccgagccctagccctcgcgcgcgcggggctctccgttccgcgccggccgcgctctcgcgggccccttccgggcgctccgtcgccgcctcggccgcggccgccacaggggaccactggggcgccgaccaccagcactaccacggaggacgcgcgggcgcgtcggaggccgggtcccccgcgtcggcgcgcggcgtcaagtgcgacgtcgacgtggtgtcgtggcgggagcggcgggtgctcgcgtccgtgcctgtggccgccgacgtcgacaccctctggcaggtcatcaccgactacgagcgcctcgccgacttcatccccaacctcgtccagagtgggacgattccgtgcccgcatgaagggcggatatggctggagcagagaggcctgcagcaagcgttgtactggcacattgaggcgcgtgtcgtgttggatctccaggaaatccatgactccattaatgggcgagaactccatttctcgatggtagatggtgacttcaagaagtttgaaggaaaatggtccataagatctggtccaaggtcctctagtgcagttttgctgtatgaagttaatgtgataccaagatttaacttcccggctatatttcttgaaaagattataaggtcagatcttcctgtaaatcttggtgccttggcttgtagagctgaaaagatttatctggaaaatcaaagttgtggttcgagaaaattctctgttgaggacttgaagccatcatctacttcttctcagcttgataacttccgtagtaggacagttgatacttcttctagtaaatttaaagaagcacctcccacttctggtgttaacagtgtgcttccatcacctgcttctgaattgattagcaaatggggtgtatatggaaatgtatgcagaattgataggccttgcgtggtagatgagatccatcttcgaagatttgatggcatgttggaacatgagggggctcataggtgtgtttttgctagtatcactgtgaaagcaccagttcgggaggtatggaatgttctcacagcatatgagaatttgcccgaattcgtaccaaacctggctatcagtaggattgttcttcgtgataataacaaggtccgcataatgcaggagggttgcaaaggcctgctgtatatggtccttcatgcccgtgttgttatggatcttcgtgaaaaatttgagcaagagatcaggtttgaacaagttgagggtgatttttactcgtttaaagggaaatggcgcttagaacaacttggggatcagcacaccctgttgaagtacatggttgagactaagatgcatagggacacctttctctctgagtctatccttgaagaggtcatatatgaagatcttccatcaaacttgtgtgcaatccgtgattatattgaaaaggctggagccaagggtagcaactccacagctcattctgatgtgtccatagacccagatgcttatcatgctgaaagcaggcaatctgagcaagcatctgtgtcttgctcatccagtaccatgaagcagagaccaaaagtcccagggttgcaaaaggacattgaggtcctaaaatcagagcttgagaatttcattgcagaatatggtcagtatggtttcatgcctaagagaaagcatctccggtctcatggaagggtggatatcgagaaggcaataacacgaatgggtgggttccggaagattgccagcataatgaacctttctctttcttacaaaaatcgaaaaccaagaggctattgggataatctggagaacttgcaagaagagatcagccggttccagaaaagttgggggatggatccttcttatatgccaagtagaaaatcttttgagagggcaggtcgttacgacattgctcgggcattggaaaaatggggtggggtgcaggaggtttcacgccttctctctcttaaactaagacgtcctagaaggcaaggcgacttggatgacgagagccggtctgaatccccatctgagatgacaaagaagcacggggtgaaacctgataaaggcaatgtttccccagatgcccagaaatggctcctgaagctgaaggatttggatgtcaactgggtggaatactagattagctttgaacaaaagatatggtctctcattattagctcaactctttcccttcttcggaggtgatctggaagcattccgacaaaagaccccgcaaattgtgtacagaaaagtgcgatacaccggccaaccctgaaggcaagccaccagcaggcaacaggttttcttgtgtcagtaatcacgactcttggctactgcgtatctagaactgttgacaatactaacagctttgttgcggtcaaattgatccgtggatttgacaaagtctagccactaaacgcagaacgggtgtgcaatttcgtgtttgagtcagccttgcctttcaaagcaggtggtcatcgctgggttaaactgtggtgttgacacttcacagtttggtcgcctactttgttagtgatgatgtaagttgacctggcccttttgttttgacacggaaaagagaaggttaccatccagtagcagtttcagtcggcacgttttacattacattacattggtcttaa

SEQ ID NO: 6066 - DNA, 3093 bp, Sorghum bicolor
ctcgccttcccgccacacatcccccgctcgcctctcaccgtcgcaacagaaacaatcgctcgtcgccgtcgacccaagccacgccaccgacacgtgggaccataccactggtcccactcagcagagactccggcggtccttcgagacagcgagagccagaggcaacggctccggtcaccacgcgcgtctccgtctccttcctcgacacgactcccagtgggcaagtacactctcccgctcgactcgagcgcacgagcgatgagagctctcgcctcgcccaccgcctccttcctcccggggatcccgagccctagccctcgcgcgcgcggggctctccgttccgcgccggccgcgctctcgcgggccccttccgggcgctccgtcgccgcctcggccgcggccgccacaggggaccactggggcgccgaccaccagcactaccacggaggacgcgcgggcgcgtcggaggccgggtcccccgcgtcggcgcgcggcgtcaagtgcgacgtcgacgtggtgtcgtggcgggagcggcgggtgctcgcgtccgtgcctgtggccgccgacgtcgacaccctctggcaggtcatcaccgactacgagcgcctcgccgacttcatccccaacctcgtccagagtgggacgattccgtgcccgcatgaagggcggatatggctggagcagagaggcctgcagcaagcgttgtactggcacattgaggcgcgtgtcgtgttggatctccaggaaatccatgactccattaatgggcgagaactccatttctcgatggtagatggtgacttcaagaagtttgaaggaaaatggtccataagatctggtccaaggtcctctagtgcagttttgctgtatgaagttaatgtgataccaagatttaacttcccggctatatttcttgaaaagattataaggtcagatcttcctgtaaatcttggtgccttggcttgtagagctgaaaagatttatctggaaaatcaaagttgtggttcgagaaaattctctgttgaggacttgaagccatcatctacttcttctcagcttgataacttccgtagtaggacagttgatacttcttctagtaaatttaaagaagcacctcccacttctggtgttaacagtgtgcttccatcacctgcttctgaattgattagcaaatggggtgtatatggaaatgtatgcagaattgataggccttgcgtggtagatgagatccatcttcgaagatttgatggcatgttggaacatgagggggctcataggtgtgtttttgctagtatcactgtgaaagcaccagttcgggaggtatggaatgttctcacagcatatgagaatttgcccgaattcgtaccaaacctggctatcagtaggattgttcttcgtgataataacaaggtccgcataatgcaggagggttgcaaaggcctgctgtatatggtccttcatgcccgtgttgttatggatcttcgtgaaaaatttgagcaagagatcaggtttgaacaagttgagggtgatttttactcgtttaaagggaaatggcgcttagaacaacttggggatcagcacaccctgttgaagtacatggttgagactaagatgcatagggacacctttctctctgagtctatccttgaagaggtcatatatgaagatcttccatcaaacttgtgtgcaatccgtgattatattgaaaaggctggagccaagggtagcaactccacagctcattctgatgtgtccatagacccagatgcttatcatgctgaaagcaggcaatctgagcaagcatctgtgtcttgctcatccagtaccatgaagcagagaccaaaagtcccagggttgcaaaaggacattgaggtcctaaaatcagagcttgagaatttcattgcagaatatggtcagtatggtttcatgcctaagagaaagcatctccggtctcatggaagggtggatatcgagaaggcaataacacgaatgggtgggttccggaagattgccagcataatgaacctttctctttcttacaaaaatcgaaaaccaagaggctattgggataatctggagaacttgcaagaagagatcagccggttccagaaaagttgggggatggatccttcttatatgccaagtagaaaatcttttgagagggcaggtcgttacgacattgctcgggcattggaaaaatggggtggggtgcaggaggtttcacgccttctctctcttaaactaagacgtcctagaaggcaaggcgacttggatgacgagagccggtctgaatccccatctgagatgacaaagaagcacggggtgaaacctgataaaggcaatgtttccccagatgcccagaaatggctcctgaagctgaaggatttggatgtcaactgggtggaatactagattagctttgaacaaaagatatggtctctcattattagctcaactctttcccttcttcggaggtgatctggaagcattccgacaaaagaccccgcaaattgtgtacagaaaagtgcgatacaccggccaaccctgaaggcaagccaccagcaggcaacaggttttcttgtgtcagtaatcacgactcttggctactgcgtatctagaactgttgacaatactaacagctttgttgcggtcaaattgatccgtggatttgacaaagtctagccactaaacgcagaacgggtgtgcaatttcgtgtttgagtcagccttgcctttcaaagcaggtggtcatcgctgggttaaactgtggtgttgacacttcacagtttggtcgcctactttgttagtgatgatgtaagttgacctggcccttttgttttgacacggaaaagagaaggttaccatccagtagcagtttcagtcggcacgttttacattacattacattggtcttaatgtgtcaattttttttggtgctaatttggctagtagcatggcgggtctgtatgagaaaccagctaatcagaacgtgaattttaaagaccaaaaaaaaattaatgggaaattaaaaggtcccaccgggattcgaacccaggtcgccagattcaaagtctggagtgctaaccactacact

SEQ ID NO: 6067 - DNA, 2671 bp, Setaria italica
cgcgtgcatgagcgatgagagctctctcatcgcccgccgcctccttcctcccgggaatcctcaatcccagcgcaaatcctaaccctcgcgcgcctctccgttcggcggtggcggcgctctcgcggggcccttgcccttccggccgctccgtcgccgccgcggctgccgccgccaccggggaccactggggcgccgaccactaccacggcggcggccacgcgagctcgcaggaggccgcggcccgtgcggcgcacggcgtgaagtgcgacgtggacgtggtgtcgtggcgggagcggcgggtgctcgggtccgtggccgtggccgccgacgtcgacaccctgtggcaggtcatcaccgactacgagcgcctagccgacttcatccccaacctcgtccagagcgggaggattccgtgcccgcacgaagggcggatatggctggagcagaggggactgcagcaggcgttgtactggcacatcgaggcccgcgtcgtgttggatctccaggaagtccctgattccattaatggacgagaactccatttctcaatggtagatggtgacttcaagaagtttgaaggaaaatggtccatcagatctggtccaaggtcctctagtgcaattttgctgtatgaagttaatgtgataccaagatttaacttcccggcaatatttcttgagaggattataaggtcggatcttcctgtaaatcttcgggccttggcttgtagagctgaaaagatttatttagaaaatcaaagatgtggtttttctgctgtggattcgaagccatcgtccacttcttctcagcttaagttccatagttcaacaattgatactacttctagtaagttcaaagaagcacctcccacttctggtgttggtagtgtgcttccgtcaccttcttctgagttgattggcaaatggggtgtatatggaaacacatgcagaattgataggccttgtgtggtggatgagatccatcttcgaagatttgatggcctcttggaacatgagggggctcacaggtgtgtttttgctagtatcactgtgaaagcaccagttcgagaggtatggaatgttctcacggcatatgagaatttacctgaatttgtgccaaacctggctatcagtaggattgtccttcgtgataataacaaggtccgcataatgcaggagggttgcaaaggcctactgtatatggtccttcatgcccgtgttgttatggatcttcgcgaaaaacttgaggaagagatcagctttgaacaagttgagggtgatttctactcattcaaagggaaatggcgctttgaacaacttggtgatcagcacaccttgttgaagtacatggttgagactaaaatgcataaggacacatttctctctgagtctattcttgaagagatcatatatgaggaccttccgtcaaacttgtgtgcaatccgtgattatattgaaaaggctggagctgaaggcagcaactccacaactcattctgctgcaccaacacacccagatattgatcatgcagaagacaggcaatcagagaaagaatctgcatcttgctccttcagttccatgaaacagagaccaaaagtccctggcttgcaaaaggacattgaggtcctcaaatctgagcttgagaatttcattgctaagtacggtcaggatggtttcatgcctaagagaaagcatcttcggtctcatggaagggtggatatcgagaaggcaataacacgaatgggtggattcaggaagattgccagcacaatgaacctttccctttcttacaaaaatcgaaaaccaagaggttattgggataatctggagaacttgcaagaagagatcagtcggttccagaagagctgggggatggatccttcttatatgccaagtagaaaatcttttgagagagcaggtcgttacgacattgctcgggcattggaaaaatggggtggcgtgcaggaggtttcacgccttctttctcttgaactaaggcggcctagaaggcaagctgactctgatgatgagaggcagtctgaatcaccagctggcagtggcattacaaagcagcatggaatgaaacctgataaagccaacacgtccctggacgcacataaatggctcctgaagctgaaggatttggatgttaactgggtggaatattagattaataagcttcgaaaaagaaatgctgtaaattggaggtgatctggaagcattcttttccatcgttggaggtgatctggaagcattctttcaaagaagctgtaaattgtgtacagaaaaattgcaatgcacaggccaacccatgctgaaaggttacaggcaacaggttttcatttgtcaactgtcatgactcttggtcctcaagtgttacttatctagaagtgtcgactactactcccagctttgttgcagtcaaattgatccgtggatttgaccaaagacaaaccactaaacgcaaatgggggtgttgattgcatgtacctgttcaaaggtgtttagagtcaggtggtcaatcgttggggttaactcgcgttcacaggttactgatgatgtcagttgaccgcttacttgttgatgtgagttgacttgacccttcttttttgacacagaaagagaaggttactgtccagtagtttcaatcagcacggttacattagtctgtc

SEQ ID NO: 6068 - DNA, 1457 bp, Sorghum bicolor
aaatcgaatgcccacagattctgtaaaattggccggtttatttactgacgaccactgaatcgccgatgatgcatcattagatgactagtcgcattgcacaaacaaaaaggaatcgaattcctgaccctttctccgccccaaaacgcctaaactccaagcaaccgcaaaataaccaccgattccttgcagccccgcgaatcttcggccccttccccacccgacacggcacaccaccactctctgccgcccccccttccttcccctgcgctcctctttgccctccgaatccccgctcgcgaaccctagccggcctccgcgagatggacgaggactgggagctcctcctcgcgtcccccaaggcggcggtggcggccgagccgtacgctggcggcggaggcgggggcggggaggacgacgccggcgccatcaagcacgactacttcgacctcggctccgacgccaagtacccccggagggcgtcgctgtcgaaggggaacgacgaggtggacgaggaggagggtgtggatgaggggcttcttggggcgtcagacaactcgagctgggtggagccggaccctgacgaccttctcttccccggccgcgaccgcgcggcgctctggtcggactcgtcctccgacggggagaggcccgaggtcgaggccaccgatccggtggagcgggccagggaagaggacggcgtcacggtggcagccgcggctgatgggggcgagggggccgtggcgaagggaggaggaggaccggtcccgtggtggaagctgtcgctggacgcgctgcgggtgtgggcgctacgcgcggcgaggagcgcctggtcggtgccgttcgccgtcgcgctgcttggattcgccgtgctcgggcgacggctgtaccggatgcgccgccagagcaaggccgtcgcgcgcgtccgcctcgtcctcgacgaaaagaaggtctcccaattcaagggccaatcatcacgtctgaatgaatccatgacgatggtgcggcgaactcctatcataaaacctatgcttcctgccaatggagtgactccatggcctgtgctggggcacctgtgagatgtgtgatcagtgacgtgatagaggcatagagctaataatacaactgcgccagccatgcagagacgcttacaggccggcatattatgcaatgcccagcagcagatgtactggctgcttgtaatttggaactatacacttgtggaagaccttgtaagtttccgttcacgcggaatgatatttaggcctgatctagtttgtgtttcttttgtgtatacccatgtttataattttattttctgaatccttatgtcatggatcttatgtgctggagatgtaaatgattgagtactgagtacccatggtactatggtaatgtgctgtatatgactattacccataaatcaatgtacaagtggaatttaggttatgtgctggcca

SEQ ID NO: 6069 - DNA, 1519 bp, Sorghum bicolor
gggggggaaacaaagctgtaaatctactcagtgcatttcctgctgaagtaaaagccatgtggaaatcgaatgcccacagattctgtaaaattggccggtttatttactgacgaccactgaatcgccgatgatgcatcattagatgactagtcgcattgcacaaacaaaaaggaatcgaattcctgaccctttctccgccccaaaacgcctaaactccaagcaaccgcaaaataaccaccgattccttgcagccccgcgaatcttcggccccttccccacccgacacggcacaccaccactctctgccgcccccccttccttcccctgcgctcctctttgccctccgaatccccgctcgcgaaccctagccggcctccgcgagatggacgaggactgggagctcctcctcgcgtcccccaaggcggcggtggcggccgagccgtacgctggcggcggaggcgggggcggggaggacgacgccggcgccatcaagcacgactacttcgacctcggctccgacgccaagtacccccggagggcgtcgctgtcgaaggggaacgacgaggtggacgaggaggagggtgtggatgaggggcttcttggggcgtcagacaactcgagctgggtggagccggaccctgacgaccttctcttccccggccgcgaccgcgcggcgctctggtcggactcgtcctccgacggggagaggcccgaggtcgaggccaccgatccggtggagcgggccagggaagaggacggcgtcacggtggcagccgcggctgatgggggcgagggggccgtggcgaagggaggaggaggaccggtcccgtggtggaagctgtcgctggacgcgctgcgggtgtgggcgctacgcgcggcgaggagcgcctggtcggtgccgttcgccgtcgcgctgcttggattcgccgtgctcgggcgacggctgtaccggatgcgccgccagagcaaggccgtcgcgcgcgtccgcctcgtcctcgacgaaaagaaggtctcccaattcaagggccaatcatcacgtctgaatgaatccatgacgatggtgcggcgaactcctatcataaaacctatgcttcctgccaatggagtgactccatggcctgtgctggggcacctgtgagatgtgtgatcagtgacgtgatagaggcatagagctaataatacaactgcgccagccatgcagagacgcttacaggccggcatattatgcaatgcccagcagcagatgtactggctgcttgtaatttggaactatacacttgtggaagaccttgtaagtttccgttcacgcggaatgatatttaggcctgatctagtttgtgtttcttttgtgtatacccatgtttataattttattttctgaatccttatgtcatggatcttatgtgctggagatgtaaatgattgagtactgagtacccatggtactatggtaatgtgctgtatatgactattacccataaatcaatgtacaagtggaatttaggttatgtgctggcca

SEQ ID NO: 6070 - DNA, 1236 bp, Panicum virgatum
atcttcgacccccttcccaacccgacacgccacaccatgagtccatgacaccactcgcccctttccagccttccttccccttctcgtggcctccgaatcccccagctcacgcctccgctgccaaaccctagccggccatctccgcgagatggacgaggactgggaactcctgctcgcgtcccccaaggcggcggcggccgaaccgtacgccggtggcggcggggaggacgacgccggcgccatcaagcacgactacttcgacctcggctccgacgccaagtaccccaggagggcgtcgctgtcaaaggaggacgaggaggagggggaggcggaggggcttcttgcggggtcggacaacgcgagctgggtggagccggaccccgacgatcttctctttcccggccgtgaccgagcggcgctgtggtcggactcgtcctcggacggggagaggccggaggtcgaggtgaccgaacccgtggagcggaccagggcggaggccggggcggcggcggaggaggagggggccgaaggcgcggtggcgaagggaggaggacctgtccggtggtggaagttgtcgctggacgcgctgcgcgtgtgggccctgcgcgccgcgaggagcgcctggtcggtgccgttcgccgtcgcgctgctcggcttcgccgtgctcgggcgtcggctgtaccggatgcgccgccagagcaaggccgtcgggcgcgtccgcctcgtcctcgacgaaaagaaggcatcccaattcaggggccaagcatcacgtctgaatgaacccaccactatgctgcggcgagctccaatcataaagcctatgcttccagcaaatggagttactccatggcctgtcctgggacacctgtgagatttgcgaccagtgacatagagctaataataccttaatccccagtcaaccagcgtcactcgccttgctactggcgagtggctagcatactatgcaaacccatatgtaccggcagcttgtaatttggaattgcacagttgtggttgtggaatgtggaagaccttgaaagtttccgtccatgcggaatgatatttaggcctgctctagttcatgtttcttttgtaaccttgtttacatttttattttctgtagcattgtatcaccgatcctttgtgcttgagatgtatatgactgaagtgcccatactgtggatgtatatgactaaaatatacataagtcaatacagagtggtagttcgattctgt

SEQ ID NO: 6071 - DNA, 1090 bp, Saccharum officinarum
cccagccgctcctctttgccctccgaatcccgctcgcgaaccctagccggcctccgcgagatggacgaggactgggagctcctcctcgcgtcccccaagggtgcgggggtggcggtggcagcggccgagccgtacgccggcggcggaggcagaggcggggaggacgacgccggcgccatcaagcacgactacttcgacctcggctccgacgccaagtacccccggagggcgccgctgttgaaggcggacgaggagaaggaggaggttgtggaggaggggcttctcggggcgtcggacaacgcgagctgggtggagccggaccctgacgatcttctcttccccggccgcgaccgcgcggcgctctggtcggactcgtcctccgacggggagaggcccgacgtcgaggccaccgatccagtggggcgtgccacggaggaggccggggtcacggcggccgcagcggctgatgcgggcgaggggaccgtggcgaaggggggtggaccggtcccgtggtggaagctgccgctggacgcgctgcgggtgtgggcgctgcgcgcggcgaggagcgcctggtcggtgccgttcgccgtcgcgctgctcggattcgccgtgctcggccgccggctgtaccggatgcgccgccagagcaaggccgtcgcgcgcgtccgcctcgtcctcgacgaaaagaaggtctcccaattcaagggccaatcatcacgtctgaatgaatccatgacgatggtgcggcgaactcctatcataaaacctatgcttcctgccaatggagtgactccatggcctgtgctggggcacctgtgagatgtgtgatcagtgacgtgatagagctaataatacaactgcaccagccatgcagagacgctctcaccttgctacaggccggcatattatgcaatgcccagcagctgatgtactggctgcttgtaatttggaactacacacttgtggaagaccttgtaagtttccgttcacgcggaatgatatttaggcctgatctagtttgtgtttcttgtgtatacccatgtttatatttttattttctgaatccatatatcatcgatcttatgtgtgt

SEQ ID NO: 6072 - DNA, 1264 bp, Setaria italica
cgcgaatcttcgacccccttccccacccgacacgccacaccactctcctcctcccccttccttccccttcacctctttgcctccgaatcccagctcacgcctccgctgtccgctcccaattcccaaaccctagccagccagctacgcaagatggacgaggactgggagctcctcctcgcgtcccccaaggcggcggcggcggccgaaccgtacgccggcggcggcggggaggacgacgccggcgccatcaagcacgactacttcgacctcggctccgacgccaagtaccccaggaggacgtcgctgtcgaaggaggacgaggaggaggaggaggaggaggtggaggggcttctcgcggcgtcggacaacgcgagctgggtggagccggacccggatgatcttctcttccccggccgtgaccgagcggcgctgtggtcggactcgtcctcggacggggagaggcccgaggtcgaggtgaccgaaccggtggagcgggccagggcggaggccggggctgctgctgctgcggcggcggcggaggcggaggcggagggggccgagggcgcggtggcgaagggaggtggacctgagccgtggtggaagctgccgctggatgcgctgcgcgtgtgggccctgcgcgccgcgaggagcgcctggtcggtgccgttcgccgtcgcgctgctcggattcgccgtgctcgggcgccggctgtaccggatgcgccgccagagcaaggccgtcgggcgcgtccgcctcgtcctcgacgaaaagaaggcatcccaattcaagggccaagcatcacgtctgaaggaatccacggccatgctgcggcgagctccaatcataaagcctatgcttcccgccaatgcagtgactccatggcctgtgctggggcacctgtgagatgtgtgatcggtaacttagagctagtaataccatattaccatagtccgcagccaaccagtgtcactcgccttgctactggcaagcatactatactatgcacgcccctgcagtctgcagatgtacagactgattgtaatttggaactacacagttgtggaatgtggaagaccttgtaagtttccgttcatgcggaatggtatttaggcctgctctagttcatgtttcatttgtacccgtgttcatatttttattttctgtagcctttatattgtcgatctgatgtgcttgagatgtatatgactgaagtaatcatggtagtgtggatgtatatgactaaattacacataaatgaatgcag

SEQ ID NO: 6073 - DNA, 1158 bp, Cenchrus ciliaris
  misc_feature (700)..(700): n is a, c, g, or t
  misc_feature (702)..(705): n is a, c, g, or t
  misc_feature (708)..(708): n is a, c, g, or t
  misc_feature (711)..(714): n is a, c, g, or t
  misc_feature (734)..(734): n is a, c, g, or t
  misc_feature (736)..(739): n is a, c, g, or t
  misc_feature (741)..(742): n is a, c, g, or t
  misc_feature (745)..(745): n is a, c, g, or t
  misc_feature (747)..(749): n is a, c, g, or t
  misc_feature (752)..(754): n is a, c, g, or t
  misc_feature (777)..(777): n is a, c, g, or t
cccttccccacccgacacgccacaccactctcatcctcccgcttcccttccccttctcctcgtcgcttccgaatcccaagctcacgcctccgctgtccgctcccgattcgcaaaccctatccggccacctacggaagatggacgaggactgggagctcctcctcgcgtcccccaaggcggtggcggcggcggccgaaccgtacgccggcggcggtggggaggacgacgccggcgccatcaagcacgactacttcgacctcggatcggacgccaagtaccccaggagggcgtcgctgtcgaaggaggacgaggcggaggaggaggtggaggggcttctcgcggcgtcggacagcgcgagctgggtggagccagacccggatgatcttctcttccccggccgtgaccgagcggcgctctggtcggactcttcctcggacggggagagaccggaggtcgaggtgaccgaaccggtggagcgggccagggcggaggccggggctgcttctgcggcggcggccgaggggggcgagggtgccgtggcgaagggaggtgcacccgtccggtggtggaagctgccgctggatgcgctgcgtgtgtgggccctgcgcgccgcgaggagcgcctggtcaataccatttgccgtcgcgctgctcggattcgccgtgctcgggcgccggctgtaccggatgcgccgccagancnnnnccntcnnnngcgtccgcctcgtcctcgangnnnngnnggnannnaannnaagggtcaagcatcacgtctgantgattcaaggccatgctgcggcgagctccaatcataaagcctatgcttcccgccaatggagtgaccccatggcctgtgctggggcacctgtaagatgtgtgatcggtaactcagagctactaataaccatattatcatagtccctagccaggcggggtcacttgccttgttactggcaagcataccatgcatgcccctgcagtctgcagatgtacaaactgaatgtaatttggaactaaacagttgtggaatggggaagtccagaagaccttgtaacttgtaagtttccgttcatgcggaatgttatttggaccatgtcatgcgagttccttcatcttcgggtctcccggaaatggtatttcgacatgctttagtgcgcca

SEQ ID NO: 6074 - DNA, 1932 bp, Sorghum bicolor
agcaagtggactctccactcttgttctgcggtcggatcccccgggctccggcgagccgctgacgagggtttgtgcagcgagcgagctcgtggcgggaggagatggacgaagccagcacctccgcgtccggcgccgcgacgaggcgcgccttcccgccggcaagatcgggagttttctataggttcacccagcagaatctcccagcttggaagccagcaatgacacctggatgtttaatagccatgttcttgattattggaatcattttcgtaccttttgggcttctttgtctccaaagttcaaatcatgttgcagaaatcattcaccgctatgatgttgactgtgtacctaatgcttacagaggaaataggcaagcttatattaaggacagctcgattttaaagaactgtactctgcaagcgaaggttctggaacacatgagagcaccaatttatgtttattatgaactcgagaatttctatcagaatcatcgcaggtatatcaaaagtagaagtgataaacagctgcggtttggggcgaaatacacggctgagtcgtgcagtcctgttcagtgggataataatggttccccaattgtcccctgcggcttgattgcctggagcttattcaatgatacctatgattttactcgtgggtccaaggaaataaaggtcaacagaaaaaacatttcatggaagagtgatcgggagcataagtttggcagagatgtgtttccttccaactttcagaatggaaccttgattggagggggaaaactcgaccctactgtcccactgagtgagcaggaagatcttattgtgtggatgcggacttctgctcttcccaagtttcgaaagctgtatggtgtaattgaagacgatctacatgccgatgagaccataaccattctcataggaaataattacaacacctacacttttggtggaaagaaaagcatagttctttcgactgcatcctggctaggtggcaagaataacttccttggacatgcttatattgtcactggttcattgagcatcttcatatcaatcctctttgctctgattcatgtgaagtacccaaggccccaaggtgaccctaattgcctatcctggaacaggaaaaacagcaatagctaaggagcctgtatctgttattaccagcccagctaacatgcattagatcccttgtaagacatctctatctgaaacaagtcagacgccatgccgccgggttaatcccagatgaaaagaaaactgtgtactacatcatgcccttgagaaatagtttgaattccgacacatctgctgtgcatcaaggttaacacctggaggtttttaccatgcttcgtttataagagtgagcacagtaatttgaaaatgaaattctggtgggtacccggtgcggatctgtacggtgaaattctggtggccgccgaggaccatgcccctcccaaggcgaaagcaaagttgtaaaaaagcttcagctgtgaaaaatgagaagtggttattctggcttggctgctgcttttgtgacttgtgagagatgcaatgcttgtcagccctgaactcaaaagttcgttttctcttgccgagacaacatttatttgtgttattggagttctctccatcaccgaatatatgtcggcgtgattgctatctatgctatccaaacccatagccttttgaggtcgggttgcgatcctgacgatgcactcgaggttgatcgcatttatcagcagcagccatcagttgatgatgatgaccccatgagtgaggcgtgaaggtcacgtctcgcaggtgcgcgagtgcccatcggtgacgccaaccagccgcacaatcattcattccctttgatttgacgccattcgcatgtctctccctgcttgagatgacctgtggctcggtggagcgtaccgaccatgatattatg

SEQ ID NO: 6075 - DNA, 1513 bp, Setaria italica
gaggagtggactattctgtctgacaatcccatccccttctccactcttcttcttctctggtcggatcccgcggcgggtcgggctgcggagcacgggctccggcgagcttctgacgagggcttgtgcggcgagcgagctcgccggggaggggatggacgaagctagcacctccgcgtccggtggcgcgacgaggcgcgccttcccgccggcgagatcgggagtttactataggttcacccagcagaatctcccagcttggaaaccagcaatgacacctggatgtcttatagccacattcttggttattggaatcattttcgttccttttgggctgttttgtctccagacttcaaatcatgttgcagaaataattcgccgctatgatgttgactgtgtgcctaatgcttacagaggaaataagcaagcttatattaaggacagctcaatttcaaagaactgttctctggaagtgaaggttctggatcatataagagcaccaatttatgtttattatgaacttgagaacttctaccagaatcatcgcaggtatgtcaaaagtagaagtgataaacagctgcgttttggggcgaaatacactgctgaatcatgcagtcctgttcaattggatgataatggttttccaattgttccctgcggcttgattgcctggagcttattcaatgatacttatgattttactcatgggtccaaggaaataaagatcaacaggaaaaatatttcatggaagagtgatcgggagcataagtttggcaaaaatgtatttccttccaactttcagaatggaagctttattggaggaggaaaactcgaccctactgtcccactgcgtgagcaggaagatcttattgtgtggatgcgtactgctgctcttccgaaatttcgaaagctctatggtgtaattgaagaggacctgcaagttgatgagaccatatccatactcatcagaaataattacaacacctacacttttggtggaaagaaaagcatagttctttcgacagcaacctggctaggtggcaagaatgacttccttggatatgcttacattgtcaccggttcattgagcatcttcatgtcaattctctttgctctgatccatgtgaagtacccaaggccgcaaggtgatcttaattgcctatcgttgaaccggaaaaacagcaatagctaaggagcatgtatcaatggcggaaacctgtaggtagcagcccagctaacatacattaggtaccttgtaagacaaaactctatcagaaacaagtcatacaacgtgccagggttaagcccagatgaaaattgactgtatacaccattcagttcagagaaaattccgacgcatctgctgtgcttctagaacaacggcagcaggtttcctcgtgttccttgtatgagtatgcatacaatacctattgaaaggaaactctagtaaaactattgcacctggttcgtccacacctgcagaacgaaatcatgacggctgctgtggatttttgtg

SEQ ID NO: 6076 - DNA, 1480 bp, Pennisetum glaucum
ctctggtcggatcccgcagcggattgggctgcggagcacgggctccggcgcggcgagcttctgacgagggcttttgcggcgagcgagcgagctcgcgggggaagcgatggacgaagctagcacctctgcgtccggcggcgtgacgaggcgcgccttcccgccggcgagatcgggagtttactataggttcacccagcagaatctcccagcttggaaaccagcaatgacacctggatgtcttatagccacattcttggttattggaatcattttcgttccttttgggctgttttgtctccagacttcaaatcatgctgcagaaataattcgccgctatgatgttgtctgtgtgcctcatgcttacagaggaaataagcaagcttatattaaggacagctcaatctcaaagaactgttctctggaagttaaggttctggatcatatgagagcaccaatttatgtttattatgaacttgagaacttctaccagaatcatcgcaggtatgtcaaaagtagaagtgataaacagctgcgttttggggcgaaatacactgctgaatcatgcagtcctgttcagttggatgataatggttttccaattgttccctgcggcttgattgcgtggagcttattcaatgatacttatgattttactcatgggtccaaggaaataaagatcaacaggaaaaatatttcatggaagagcgatcgggagcataagtttggcaaaaatgtatttccttccaactttcagaatggaagctttattggagggggaaaactcgaccctactgtcccactgagtgagcaggaagatcttattgtgtggatgcgtactgctgctcttccgaaatttcgaaagctctacggtgtaattgaagaggacctgcaagttgatgagacgatatcaatacttgtcagaaacaattacaacacctacacttttggtggaaagaaaagcatagttctgtcgacagcaacctggctaggtggcaagaatgacttccttggatatgcttacattgtcactggttcattgagcatcttcatgtcaattctctttgctctaatccatgtgaagtacccaaggccgcaaggtgaccttaattgcctgtcgttgaaccggagaaacagcaatagctaaggagcatacgtcaatggcggaagcctataggtagcagccagctcacatacattaggtcccatgcaagacaaaactgtatctgaaacaagtgggacaatgtgccagggttaagcccagtcagacaatgtgccagggttaagcccagatgaaacttggctatatacatcattcgattcgtagaaaaaatccgacgcatctgctgtcattgtagaacaaccaccagcaggttccctcgtgttccttctacgagcacgcacgcatgctgtaccttttgaaatgaaaactctagtaaaattaatgtaccttgttagtccacacctgcagaatgaaatcaaa

SEQ ID NO: 6077 - DNA, 1043 bp, Saccharum officinarum
gggcgtggaggtacaagaaagctgcgctgccattccccccacgaccgccgagcggatcaaacagccaaaaaggaagaaggaaaggggagagcagttatagcttgagcgcgcgcgcgacagggtccagtcgagggggaatcgctggagaatggggatgggcagggctccgcgacgaccggcgtccccagcggcggcggcggctgtgccttcgctgcttctcttcgccgttctgttcgtgggccgggcggcggcgttcggcgacccgcaaggcgccgccacgacggagctgtacaagcacgcgtcgttcttcgaccgcgacggcgacggcgtcgtctccttcgcggagacgtacggcgcgtttcgggctctcgggtttggactcggcatgtccggcgtcagcgctgccttcatcaatggcgcccttggcagcaagtgcagacctcaaaatgcaacgtcatcgaagttggacatctacgtagaggacatctataaggggaaacatggaagcgattcaggctcatatgacgcagaaggaaggtttgttcctgagaagttcgaagagatattcgccaagcacgcgaagactgtccctgacgccctgacatcggacgagatcgaccagctgctcgaagcaaacagacagcccggggactacagcggatgggctggcgcagaagcggagtggaagatcctgtacagcctcggcaaggacaaggacggtctcctccacatggacgtcgcaagaagcgtctacgacgggacgctgttccacaggctcgcgcccgactggaaatcccccgagagggagaaacttagcgtgatccgggagaactgaaccgagagcaccatgccatctggtacaagcaaatccgattaagataagggctctgggctctgaacacgttgtcaagcaacttgtatagcggtgtgaacaagtgtttctttagatgaaaggtttgcgtacgaatgtttatggagcgagtgtacgtgtttgtgtttgaccttgtgtaattcgcaaaaaaaatctgaatgcattatcattg

SEQ ID NO: 6078 - DNA, 1485 bp, Sorghum bicolor
ggcgtcgtcgatcgagccgcttcgcggtcgcggctggggcgcgagcgctaggtgaccgcgaaggccggcacggcacggcacgcttcggttgcgcaggagtgcggatctagtgctgaggtttgttttgtagtacttttgttgtgtctagtgctcctggctcctgcgggctgcggcctgggcttgtccacctgtattttagggggcggaggggcgtgggggtacggccacccgcacaagcacaagaagctgcgctgcaagcgcgagcaaacagccaaaaaggaggaaggaaaggggagagagcagttagcttgagcgcgcgcgcgacagagtcgagtcgagtcgagggggaatcaccgccggagaatggggatgagcagggctccgcgacgacgggcgtccccatccgcggcggcggctgtgccttggctgcttctcttcgccgttctattcgtgggccgggcgacggcgcaaggccccggcgcgacgccgctgtccaagcacgcgtcgttcttcgaccgcaacggcgacggcgtcgtctccttcgaggagacgtacggcgcgtttcgggctctcgggtttggattcggcatgtccggcgtcagcgctgccttcatcaatggcgctcttggtagcaagtgcagacctcaaaatgcaacgtcatcgaagttggacatctacattgaggacatctataaggggaaacatggaagcgattcaggctcatatgacaccgaaggaaggtttgttcctgataagttcgaagcgatattcgccaatcacgcaaagactgtccctgacgccctgacatcggacgagatcgaccagctgctccaagcaaacagagagcccggggactacaccggatgggccggcgcagaagcggagtggaagatcctgtacagcctcggcaagaaccagaacggcctcctccacaaggacgtcgcaagaagcgtctacgacgggacgctgttccacaggctcgcgcccaactggaaacctctcgacaaggagagcgtgatcagggagaactgaaccgagaggaccgtgccatctgcgttctcttgcgttacttgttggtacaagcaaatccgattaagataaggactgtgggctctgaacatgttgtcaagcaacttgtaaagcggtgtgaacaagtgtgtatattaaattataactaagtacatcatcacgttacgagcactctgcaatataatatgtataccaactatttcttcatctattatattttactcacgcttttcatagctcaaaatttcaatcccaaatctcaaatccatataacaattcgtatgaatgactgtataggcaaacactgaacaaaaggactgagaatacatggccaacattcctgcaggtgtacgtggaactaaggccttgtttagttccgaaaagatttcagatttggtaccgtagcattttcgtttgtttgtagcaaatattgtccaatcataaactaactagact

SEQ ID NO: 6079 - DNA, 1436 bp, Setaria italica
atgcgcgtacgaccaggttggcctcgaccgaactcgctcgctgctgctcgggccgccggggcgcgaggccacgccacgccacgctgcagttgtcgtgcttgtgggaaaggctcgggcgcttggagccgagtcagagtgggagatgttactgtacaagatcgcggcaccagcaaccggccaaccagtaccagccgcgccgcgaccgccgagctgaacaaaccgccaagaaggaaggggaggggagaggggccagtgcgcgcgcgcgggacagacagcatcgagagggaatcgccggggatgggcggcgctccgcgacgaccggcggcgatggcggccgtgccttcttcgctgctcctgttcgccgtgctcttcgtgggccgggcggcggcgtacggagacggcgcgacggcgctgcacaggcacgcggcgttcttcgaccgcgacggcgacggcgtcgtcaccttatcggagacgtacggcgcgttccgggctctcggatttggatttggcctgtccagcgtcagcgcggccttcatcaatggcgccctcggcagcaagtgcagacctgaaaatgcaacgtcgtcgaagttggacatctacatcgaggacatccagaacgggaagcatggaagtgacacaggctcatatgacactgaagggaggttcattccggagaagttcgaagagatattcgccaagcacgccaagaccgtcccagacgccctgacatcggacgagatcgaccagctgctccaagcgaacagacagcccggggactacgccggatgggctggagcagaagcggagtggaagatcctgtacagcctcggcaaggacaaggacggcctgctccacaaggacgtcgcgcggagcgtctacgacgggagcctcttccacaggctcgcacccaactggaattctcccgacaaggagaaactgagacgtgagaactgaagccgagaggagagatggccatgccatctgcgttctctcgcgctgcctgcccgtacaagcaaacccgattaagataagggcctgggctctgaacacgctgtcaagcaacatgtaatagcggtgtgaacgggtgtgaacgcttatgaaagattaaagggaagtgtgaacggaatctgcagataggtcgacggatggttccgtgcggtctgtttgttcgtatcctgggaccgcgatggttctgtagtctgtacatgcaagtggctgccaatggatttgcatgcttgacatttgccgtccgtgaggccgtgatgcttcatgcttgtcgctgtccttgttgcgatcagagtaccaaacccgttttgttcgctggaaggcggataggtctgtactctgtagcattatcttgcctggttgctgatggaccttccgatctgctgcaggtcgttactgttcagttcatcctgttcagatggcatctggct

SEQ ID NO: 6080 - DNA, 2582 bp, Sorghum bicolor
gtttcatctatggggcaagatgctggcttcaagcgcgagggtcattctggattgggagcaggtcctgaaactttgaagacctcttgctgtaccagtgaagaaaatgagagtcgaaacagaagataccatcagttgaaaggctcagagagcaactcggggcagttacacctggactacatcccaaatttccactgcaagagcttgccaacaagaagccgcaagacgaatgctgaacaaagtgtcatagggaagcgtggttctatgtaccagagctctagtgaaattagcagaatcagaaaaatccaggagggcaggaggaaaatagattctgcatttgatggggatgcatttctgtcctttgatattgttgatgcatcctctcgccctagcacaagtggagcttatctgcattcccatcagaaccggaggtcaggtgctaagccttctgtagaaactgctcgtaagattaatcgagcatcaaaggacttcctggacctttcgttccgtgaacttcctgatgagaattttaagctggaccgaccacgcttggacagtaccttgttgaaaaatgatggagatgatggtttcttggagatttctcttgagaaagagataacgaagggtggcccctgcagaaatgcagctcctgtcttgctaagcactgaatcaggtaaatgcactgaaacaaataacctgcacaagatgaggggatgccccagtgagaacgactgtggtgagagggggagggattcagcaagcagttccaaatcaacacctgtgaaagcaagctcctttgatggtacctgtcaatctaacggtgttcaacatcatatcatagagaacagcactaaagctcgatcaagccccttcaagaagatgctggaccctatcatgaagtccaaatctcttaggagcccgtctctcatggaaaaaggagactccaactctataactgggacaggtagcaagaaaaattccatgtctcgaaaatcactgttgggtgatttttcaagaactgaacaagcatctaattgccagcctaatggacaagcacagcgtgtcaaatctgctttgtcacctgctcatcttcaagcggttcttagattggattccaagaatggtgtacaggtttttgaattctgtgttgagggcccagaagaatccatttctgccaggaattggaaaactggagatgagttgaactctatatacaccttccatagtggtgggaaacgatccagtgctgctggaaggatctccaaagatggaggcttgaatttaccgccaattgtaggccaggtgcaggtttcatcttatttatgctctgaagttggaaaagatggtacggtgaataactctgtcgtcactgagtttgtttcatacgatattgctcatgcaaggcggattgttgaggaaaagactcaatgtacagagacccctcaacaaccactgtgtggtgtcgttgataaatcaatctccggtgattctccacagaggattaatctgatggaagagaacaagattgggagaaataactcggatgtatctacatcttgcccatggtctgaagaagatctttatcctcattttgagattgcagcaactgtgatagagattccatttagtaaagacaagtccaaagaaatgaagaacggttcatctccttgtactgtcaaagttgttacacctagtggactgcatggttcacctagtgatgatgaagcaagcccatctcccttgctagatagatggaggtatagtgggggttgtgattgtggtggatgggacatggcttgtcccattgaaattcttggcaatgtatatgataataactgggctgagtctgtaaccaccaatgcgaaacatcccatggagctctttgttcagggtagcaaagaagagctccctgtcctttctatgaaggagaatgggagaggacagtttttggtggatttccatgggcgactatcagcattacaggcattttcagtttgcatctctctgctgcactgttctgaagcttcgatcgccatcagtctcgagaaggggaagcagaaactgtattccagctcacttaagttgctccttgaggaggatgtgaggcacctaatcgaggccgttacagctgaagagaagaagcagcagaagaagaagaggagagaaaaggcacctccatctgttctgcttgacccacctttttctcccattggaagagtatagcaaggcagggcgcggctgaagctttaggacccattgtgtgtaacattgtttactatcggtcaagatttgtcctcatgttcatattttccttttactgaaggggcaaattcatgttgttcataaggatgggggggttgcatacttgcatgtagtgttagattttagcaggcagtaaggtcataatgtactgttgagatgttgaatagaaaaaaaattaggaggcagttgcatgttccagttggaagaagataagtgaatggagaaaagctggctgtcgcctctgtatgtaaacatcagctgaaacaaaatgtagcatgaagtagtgttcagttttcactctgattgcgcatttcaaatttgca

SEQ ID NO: 6081 - DNA, 3138 bp, Sorghum bicolor
gtgccattttcctttcttttcgttttgtcgcctctctccccactcgctctgagtgtgctctcgctttcgcctccaagtcttgtacctccaaaaagagggagggaggagaggagacgagaggtttgcgtgacagcgagcgagtgattacctcagccggcagacagccgccaaagcagtgttagtgagtggtagtgagagctagtagagcccagaggaggaggggagcaccaagcacgagcatctccacttctccactctccagtccacgcgcgccccatgcccgtctgctccgtttccacctccacctccacctccatgagggccagctgaggaagacaaggaaggggaatctctcccccattcgcctagccgtcctgatctgccggctcccggcggcaaccccttctcttccccccctacaggtttcatctatggggcaagatgctggcttcaagcgcgagggtcattctggattgggagcaggtcctgaaactttgaagacctcttgctgtaccagtgaagaaaatgagagtcgaaacagaagataccatcagttgaaaggctcagagagcaactcggggcagttacacctggactacatcccaaatttccactgcaagagcttgccaacaagaagccgcaagacgaatgctgaacaaagtgtcatagggaagcgtggttctatgtaccagagctctagtgaaattagcagaatcagaaaaatccaggagggcaggaggaaaatagattctgcatttgatggggatgcatttctgtcctttgatattgttgatgcatcctctcgccctagcacaagtggagcttatctgcattcccatcagaaccggaggtcaggtgctaagccttctgtagaaactgctcgtaagattaatcgagcatcaaaggacttcctggacctttcgttccgtgaacttcctgatgagaattttaagctggaccgaccacgcttggacagtaccttgttgaaaaatgatggagatgatggtttcttggagatttctcttgagaaagagataacgaagggtggcccctgcagaaatgcagctcctgtcttgctaagcactgaatcaggtaaatgcactgaaacaaataacctgcacaagatgaggggatgccccagtgagaacgactgtggtgagagggggagggattcagcaagcagttccaaatcaacacctgtgaaagcaagctcctttgatggtacctgtcaatctaacggtgttcaacatcatatcatagagaacagcactaaagctcgatcaagccccttcaagaagatgctggaccctatcatgaagtccaaatctcttaggagcccgtctctcatggaaaaaggagactccaactctataactgggacaggtagcaagaaaaattccatgtctcgaaaatcactgttgggtgatttttcaagaactgaacaagcatctaattgccagcctaatggacaagcacagcgtgtcaaatctgctttgtcacctgctcatcttcaagcggttcttagattggattccaagaatggtgtacaggtttttgaattctgtgttgagggcccagaagaatccatttctgccaggaattggaaaactggagatgagttgaactctatatacaccttccatagtggtgggaaacgatccagtgctgctggaaggatctccaaagatggaggcttgaatttaccgccaattgtaggccaggtgcaggtttcatcttatttatgctctgaagttggaaaagatggtacggtgaataactctgtcgtcactgagtttgtttcatacgatattgctcatgcaaggcggattgttgaggaaaagactcaatgtacagagacccctcaacaaccactgtgtggtgtcgttgataaatcaatctccggtgattctccacagaggattaatctgatggaagagaacaagattgggagaaataactcggatgtatctacatcttgcccatggtctgaagaagatctttatcctcattttgagattgcagcaactgtgatagagattccatttagtaaagacaagtccaaagaaatgaagaacggttcatctccttgtactgtcaaagttgttacacctagtggactgcatggttcacctagtgatgatgaagcaagcccatctcccttgctagatagatggaggtatagtgggggttgtgattgtggtggatgggacatggcttgtcccattgaaattcttggcaatgtatatgataataactgggctgagtctgtaaccaccaatgcgaaacatcccatggagctctttgttcagggtagcaaagaagagctccctgtcctttctatgaaggagaatgggagaggacagtttttggtggatttccatgggcgactatcagcattacaggcattttcagtttgcatctctctgctgcactgttctgaagcttcgatcgccatcagtctcgagaaggggaagcagaaactgtattccagctcacttaagttgctccttgaggaggatgtgaggcacctaatcgaggccgttacagctgaagagaagaagcagcagaagaagaagaggagagaaaaggcacctccatctgttctgcttgacccacctttttctcccattggaagagtatagcaaggcagggcgcggctgaagctttaggacccattgtgtgtaacattgtttactatcggtcaagatttgtcctcatgttcatattttccttttactgaaggggcaaattcatgttgttcataaggatgggggggttgcatacttgcatgtagtgttagattttagcaggcagtaaggtcataatgtactgttgagatgttgaatagaaaaaaaattaggaggcagttgcatgttccagttggaagaagataagtgaatggagaaaagctggctgtcgcctctgtatgtaaacatcagctgaaacaaaatgtagcatgaagtagtgttcagttttcactctgattgcgcatttcaaatttgcactttgaactggaggtgcattgcattggaactgacagttgtggccattgttaatctaatgctagtactatgtgttagggttcctggaacgcagtgcccgttcaaggcctttggtggtgtgatttgtttaacagca

SEQ ID NO: 6082 - DNA, 2231 bp, Sorghum bicolor
aggtttcatctatggggcaagatgctggcttcaagcgcgagggtcattctggattgggagcaggtcctgaaactttgaagacctcttgctgtaccagtgaagaaaatgagagtcgaaacagaagataccatcagttgaaaggctcagagagcaactcggggcagttacacctggactacatcccaaatttccactgcaagagcttgccaacaagaagccgcaagacgaatgctgaacaaagtgtcatagggaagcgtggttctatgtaccagagctctagtgaaattagcagaatcagaaaaatccaggagggcaggaggaaaatagattctgcatttgatggggatgcatttctgtcctttgatattgttgatgcatcctctcgccctagcacaagtggagcttatctgcattcccatcagaaccggaggtcaggtgctaagccttctgtagaaactgctcgtaagattaatcgagcatcaaaggacttcctggacctttcgttccgtgaacttcctgatgagaattttaagctggaccgaccacgcttggacagtaccttgttgaaaaatgatggagatgatggtttcttggagatttctcttgagaaagagataacgaagggtggcccctgcagaaatgcagctcctgtcttgctaagcactgaatcaggtaaatgcactgaaacaaataacctgcacaagatgaggggatgccccagtgagaacgactgtggtgagagggggagggattcagcaagcagttccaaatcaacacctgtgaaagcaagctcctttgatggtacctgtcaatctaacggtgttcaacatcatatcatagagaacagcactaaagctcgatcaagccccttcaagaagatgctggaccctatcatgaagtccaaatctcttaggagcccgtctctcatggaaaaaggagactccaactctataactgggacaggtagcaagaaaaattccatgtctcgaaaatcactgttgggtgatttttcaagaactgaacaagcatctaattgccagcctaatggacaagcacagcgtgtcaaatctgctttgtcacctgctcatcttcaagcggttcttagattggattccaagaatggtgtacaggtttttgaattctgtgttgagggcccagaagaatccatttctgccaggaattggaaaactggagatgagttgaactctatatacaccttccatagtggtgggaaacgatccagtgctgctggaaggatctccaaagatggaggcttgaatttaccgccaattgtaggccaggtgcaggtttcatcttatttatgctctgaagttggaaaagatggtacggtgaataactctgtcgtcactgagtttgtttcatacgatattgctcatgcaaggcggattgttgaggaaaagactcaatgtacagagacccctcaacaaccactgtgtggtgtcgttgataaatcaatctccggtgattctccacagaggattaatctgatggaagagaacaagattgggagaaataactcggatgtatctacatcttgcccatggtctgaagaagatctttatcctcattttgagattgcagcaactgtgatagagattccatttagtaaagacaagtccaaagaaatgaagaacggttcatctccttgtactgtcaaagttgttacacctagtggactgcatggttcacctagtgatgatgaagcaagcccatctcccttgctagatagatggaggtatagtgggggttgtgattgtggtggatgggacatggcttgtcccattgaaattcttggcaatgtatatgataataactgggctgagtctgtaaccaccaatgcgaaacatcccatggagctctttgttcaggtacaagggtagcaaagaagagctccctgtcctttctatgaaggagaatgggagaggacagtttttggtggatttccatgggcgactatcagcattacaggcattttcagtttgcatctctctgctgcactgttctgaagcttcgatcgccatcagtctcgagaaggggaagcagaaactgtattccagctcacttaagttgctccttgaggaggatgtgaggcacctaatcgaggccgttacagctgaagagaagaagcagcagaagaagaagaggagagaaaaggcacctccatctgttctgcttgacccacctttttctcccattggaagagtatagca

SEQ ID NO: 6083 - DNA, 973 bp, Sorghum bicolor
tccaccatgaagcacctcgtcctcccctcccctctccctctcctcctccaccgccccaccaagccccatctcctccaccctcgccgccgcctcgtctccatccggaacgccgcatccggcggcagctccggcgaacccacccctgccgcggatacggccaccgggacgtctccgccggccggtgccactgccaagcccgccggcgtcaaggaccgcctgaaggcgaggaaccagtcccgccgggtccagctggactccccaccgccggaggtggtggtggtgccgaagaggaagcccgccgcgtcgtcgtcgtcgtcgtcgtcgtcccctgcgccgaagaggaaggagaggcggaaggagtgggaggagatgagcgtgggcgagaaggccgcggagctctatgtcggggagaagggccttctcttctggctcaacaagttcgcctacgcctccatcttcatcatggtcggcgcctggatcctgttccgcttcgtcggcccctcgatcggcctctaccagctcgacgccccgccgctgccgcccaccgccgtgttcggcggcggctccccgtgacggcaccagagcgtcggcgtcagagtcgtttctgagtggggtacactaggtagagctagcgtagcggactaataataaggcaaagattgaggaagaagaggacgcgaatttcggagccaaaaattggatcttttgctggcaatggcaatgtggagtgtagatgcgcagttcttggagcttcagagcatgacactgctgaattccgggtttatctgtgcaaacatgtttggttttgtataggcaagcaattcatttcggtatgctcttcaattgagtttgagaagctgagattaagaggccatgctgcagccgtttcttgtaatgaagacagaaattttcagaacagaatttgagttcaaaagaccattgggcaggaaatggacaacaagatgtaatttct

SEQ ID NO: 6084 - DNA, 974 bp, Sorghum bicolor
ctccaccatgaagcacctcgtcctcccctcccctctccctctcctcctccaccgccccaccaagccccatctcctccaccctcgccgccgcctcgtctccatccggaacgccgcatccggcggcagctccggcgaacccacccctgccgcggatacggccaccgggacgtctccgccggccggtgccactgccaagcccgccggcgtcaaggaccgcctgaaggcgaggaaccagtcccgccgggtccagctggactccccaccgccggaggtggtggtggtgccgaagaggaagcccgccgcgtcgtcgtcgtcgtcgtcgtcgtcccctgcgccgaagaggaaggagaggcggaaggagtgggaggagatgagcgtgggcgagaaggccgcggagctctatgtcggggagaagggccttctcttctggctcaacaagttcgcctacgcctccatcttcatcatggtcggcgcctggatcctgttccgcttcgtcggcccctcgatcggcctctaccagctcgacgccccgccgctgccgcccaccgccgtgttcggcggcggctccccgtgacggcaccagagcgtcggcgtcagagtcgtttctgagtggggtacactaggtagagctagcgtagcggactaataataaggcaaagattgaggaagaagaggacgcgaatttcggagccaaaaattggatcttttgctggcaatggcaatgtggagtgtagatgcgcagttcttggagcttcagagcatgacactgctgaattccgggtttatctgtgcaaacatgtttggttttgtataggcaagcaattcatttcggtatgctcttcaattgagtttgagaagctgagattaagaggccatgctgcagccgtttcttgtaatgaagacagaaattttcagaacagaatttgagttcaaaagaccattgggcaggaaatggacaacaagatgtaatttct

SEQ ID NO: 6085 - DNA, 727 bp, Saccharum officinarum
  misc_feature (536)..(536): n is a, c, g, or t
  misc_feature (589)..(589): n is a, c, g, or t
caaaccccatcaacaaaccggcgccaactccagacttgcagaggccagtgaccacgacgatctccgccatgaagcacctcctcctcccctcccctctcccgctcctcctccaccgccctagcaggccccatctcctccaccctcgccgcggcctcgtctccatccgcaacgccgcatctggcggcagttccggcgaacccacccccgccgccgaaacagccaccgggacctctccgccggccgctgccactgccaagcccgccggcgtcaaggaccgcctgaaggcgaggaaccaggcccgccgggtccagctggattccccaccgccggaggtggtggtggcgccgaagaggaagcccgccgcgtcgtcgtcgtctcctgcgccgaagaagaaggagaggcggaaggagtgggaggagatgagcgtgggcgagaaggccgcggagctgtacgtcggcgagaagggcctgctcttctggctcaacaagttcgcctacgcctccatcttcatcatggtcggcgcctggatcctggtncgcttcgtcggcccctcgctcggcctctaccaactcgacgccccggcggtggncgccaccggcgtggtcggcggctcgtcgtgacggcgcccgagcggcggcgtcgaggccgttccgagtgggcgtacactaggtagagctagcggaacagactatagcggactaaaaataagggaatattgcaaaaatgg

SEQ ID NO: 6086 - DNA, 1670 bp, Sorghum bicolor
tgtagactgcctgcctggacccagccggtgatcgtccgacaggtgggcccggttcgtcatctgctccggcaaaaaggtgactacggcaaaaagcctgccttccagcgatctccggcggcgaggcgccgcgccgggggatgggccaggatgtggtcgcgcacgtctacgacgtcgccaccgccggctccgacaccaccgtgctccacatcaaccgcttcttcaaggacggcctcggcctcggcggcatcttccacaccgccatccaggtctacggtgatgaagaatggtcctttggctactgcgagcgtggcactggggtttttagctgccccccatgcaaaaatcccatgtacacttatcgcgagtccatagtgctggggaagactaactgctgtatcctcaaggtaaatcagatactcagggaactgagctgggagtggcctggacagtcatatgaactcctgtcaagaaactgcaatcacttctgtaataccttctgcgaaaaacttgaagtgccgaaacttccaggttgggtcaatcgctttgcaaatgcgggtgatgctgctctagatgtcgctgaaactacagcagtaaagctgaaacaagcgaaaaaagagatcgtgactgcatgcaaagcagcctcaacatttttgactggcacatcgtcaagcagctcatcaaatgcggaggatatgggtgggtcaacatcgtcaggaaattctctttttgagggggcatggatcagaagtatcgtcggtatgactataaagccgtcaaagagtctagtctgtgtagatagttcagatagtgacagctctgagagtgaatccgtatcagatggcgatcggcctaacagcgatgacaacgctgagcaacaagctaaaggcgcaacacaggagccaggcaccaaaaatgagaataacaaaccacagggccattcatgaagctcactcacaccaatactgcagagagaggaaagacctctaccatactgccgttttctgataaacagattacacagggaggaaaacctagagcagaaactaactttacaattttgtcacgttcatttctgattgagagctgggagcggcgaaagggccctgaggagtgcggaagcaatggagcgcaccacaatgtgtgcaatcttgagcttaatctctccgcgccgtgggagcgggcgaactctcctttgcctttcagccctgtaaactctgatgagacgagtcgcgctcgctttctctgccatctttgtcaaacgaaggagatgtttcttcgtagagagtagtaggaagcagacggtgaaggaagagatgtatgtttgggagctggttgcacttatgcttaatttcgtgctactgtggtctatttatagatgtcgaggagtttatctgaacataagacatgacagctaaattcttgtttctgtgtagtatcaacagaatgctgttccttataataaccctgcagtgtctgtaggtatgagaaacctctgctggcgtgtgtgtttcagtcatgattggtatgtttgtccgtgtgcccgaatctgcaaatctttgacttgttgctgtccatacgcgtctctttggagcagacacgtatgcatcctatgaggaacaaatgattggcttgaaaggtagtagtatgacatttggcccctcacctctgat

SEQ ID NO: 6087 - DNA, 1624 bp, Sorghum bicolor
tgcctggacccagccggtgatcgtccgacaggtgggcccggttcgtcatctgctccggcaaaaaggtgactacggcaaaaagcctgccttccagcgatctccggcggcgaggcgccgcgccgggggatgggccaggatgtggtcgcgcacgtctacgacgtcgccaccgccggctccgacaccaccgtgctccacatcaaccgcttcttcaaggacggcctcggcctcggcggcatcttccacaccgccatccaggtctacggtgatgaagaatggtcctttggctactgcgagcgtggcactggggtttttagctgccccccatgcaaaaatcccatgtacacttatcgcgagtccatagtgctggggaagactaactgctgtatcctcaaggtaaatcagatactcagggaactgagctgggagtggcctggacagtcatatgaactcctgtcaagaaactgcaatcacttctgtaataccttctgcgaaaaacttgaagtgccgaaacttccaggttgggtcaatcgctttgcaaatgcgggtgatgctgctctagatgtcgctgaaactacagcagtaaagctgaaacaagcgaaaaaagagatcgtgactgcatgcaaagcagcctcaacatttttgactggcacatcgtcaagcagctcatcaaatgcggaggatatgggtgggtcaacatcgtcaggaaattctctttttgagggggcatggatcagaagtatcgtcggtatgactataaagccgtcaaagagtctagtctgtgtagatagttcagatagtgacagctctgagagtgaatccgtatcagatggcgatcggcctaacagcgatgacaacgctgagcaacaagctaaaggcgcaacacaggagccaggcaccaaaaatgagaataacaaaccacagggccattcatgaagctcactcacaccaatactgcagagagaggaaagacctctaccatactgccggaggaaaacctagagcagaaactaactttacaattttgtcacgttcatttctgattgagagctgggagcggcgaaagggccctgaggagtgcggaagcaatggagcgcaccacaatgtgtgcaatcttgagcttaatctctccgcgccgtgggagcgggcgaactctcctttgcctttcagccctgtaaactctgatgagacgagtcgcgctcgctttctctgccatctttgtcaaacgaaggagatgtttcttcgtagagagtagtaggaagcagacggtgaaggaagagatgtatgtttgggagctggttgcacttatgcttaatttcgtgctactgtggtctatttatagatgtcgaggagtttatctgaacataagacatgacagctaaattcttgtttctgtgtagtatcaacagaatgctgttccttataataaccctgcagtgtctgtaggtatgagaaacctctgctggcgtgtgtgtttcagtcatgattggtatgtttgtccgtgtgcccgaatctgcaaatctttgacttgttgctgtccatacgcgtctctttggagcagacacgtatgcatcctatgaggaacaaatgattggcttgaaaggtagtagtatgacatttggcccct

SEQ ID NO: 6088 - DNA, 1557 bp, Setaria italica
tcgtcagacagcaggcgggcccggtccgtcatccgctccggcacaagggaggggcgatctccggcggcgcaccggggatgggccaggaggtggtcgcgcacgtctacgacgtcgccaacgccggcaccgacaacaccgtgctccacatcaaccgcttcttcaaggacgccatcggcctcggcggcatcttccacaccgccatccaggtctacggggatgaagaatggtcatttggctactgcgaacgtggcactggggtttttagctgccccccatgcaaaaatccgatgtacacttatcgtgagtccatagttcttgggaagaccaactgctgtattctgaaggtgaaccaaatactaagggaattgagctgggagtggcctggacagtcatatgaactcctgtcgagaaactgcaatcacttctgtaataccttctgcgaaaagcttgaagtgcccaaacttccaggttgggtcaatcgctttgcaaatgcgggtgatgctgctctagaggttgctgaaactacagcggtgaagctgaaacaagcaaaaaaggaaattgtgactgcatgcaaagtggcctcaacatttttgactggcacatcatcaagcggctcatcaaacgtggaggatacgggtggctcaacctcaacaagaaatcctcttttcgaggggacatggatcagaagtatcgtcggtatgagtatgaagccaccaaagagtctagtctgtgtagatagttcagatagcgaatgctctgatactgaatcagaatcagacaatgctgaccaacaagttaaagacgcaaaacaggagcaacacatggaaagtgacaataatggaccacgggatcattcatgaagttcgcaccattacatgcagagagaggagcaacctctacatgctgctgttttctgataaacagattacacagggagcaacctacagtggaaactaactttacaatttgtcacattcatttctgatcgagaactgggagctgtgaaaaggtcctgagaagcgcagatgcgatggagtgcgccacagtgtgcgctatcttgagcttgatctgtccacgtcgcggcagcgggcgaactctcctttgcctctcagccctgtaaactgtgatgagatgagtggcgcttgcttcatcagccatcttggtgaagtgaacgagacgtttcttttgctggagatagaagcagatagtgtagggtgaggtattagagagcttggttgcactatgcttgatctttgttcctgtgatctatttatagacgtggaggagtttatctgaatgcaagacatgacagctaaattcttgtttctgtgtagcatcaacagaacgctgttccttataataatcttgcaatgtctgtaggtatgatgaaactctgccggtaatgtatgtttgagtcatgattgggctgtttgtctgtgtatgtgcgaatctggaaatctttgacttggcgttgtccatacgtgtcccttggagcagacacgtctgcatcttgtgcagggcagatgattgacctgtcagttacgccatttggcacct

SEQ ID NO: 6089 - DNA, 1524 bp, Sorghum bicolor
cccacacatcagtaaccaactcagcaggctcccgtcccgaccaccagataagctgcaagctgcttatcttctcccgtcccctgcaactggaaggaaggaacacgtccgcgccagccaagcagagaggggatcccgcatccatggaggtggtgggcggcgtttcgctgaggccgtcgccagcgccggcgcgtatccgacggaccaccctgtcatgcgtcgacgtaggccgacgcctcgttctcaggcccgcaggggcgccgctgggccagctgccggcgaggcgcgcgctggtagtggaggcccgggggaggagctggtcggaacggcagatgcagcagcagcggcgcatgccgcagctgcccaagatcgaggacgacggcaacccgcgattcgtcatcttcatccgcaccgccaatgtctacttctggtacccgctcaacatcatcacgggcgggacgacggcgaagatcatgcttgctgctaaggacaacttcctcggcaagtacatctacaaggacacgctcgccaggaacctcgctgccgtcatttacaaagatgaggatgagattatagacacagcaaaagagcagtaccgtgtgctcaagaccgaaaatgagtttcggtatggctacaaagttgtggagaaagggaacataaggtctgctctgacgacaagcaatgtgattgaacttccaaagaaagacgagctcaaaactgtggttgacaaggtgaaggacttctttggcgatgtaactgctggcgccaaagaatcctttgcgcagataaccgggtctgctgtcagcaaagaggaagaggaagcagaaaacaaagagaagttccgctccaagaggcgaaagaagcagcggaagtcgaaggagggcctcagtaagtacgctgagactaacgcagtgtcactagctagtttgaaccctatcttcacccttcctgtagccagtctaatcacatcacataatctcccgtttacatctttcagagacggagaaatgattcagtcactcagcacattgtcagacaagtaaagcatcgatcggctgtagtttcgctatccatgtcccagagctgctctgtaatttgtccagcttctaaatttttgcaaagagacaacgtgtaacttccttgcgactaacatgtgttttgccttctcactaaatttcacaaaatccggtgaaggggttaaggttactttctcattccaattatatgttgttttgtcttttctagtgtatatatatagcttttgttatatacttatacaaaaaaaaaggaactaaaacaaactataattgaaatagagggagtataactatatgttgatttgatttcttggaggtttgaaagttagtgttttttttttggttgtgtgtgtgcgcgcgtgctgttgtacggtgcatgaatcacatcgtattcaactactgaactctctttacgtgttctgtaccccgcgcgcacgcgggtgctgttgtacagtgcagatatggatcacatcacattcaactactgaac

SEQ ID NO: 6090 - DNA, 1223 bp, Zea mays
accctgccatcctctcatcacaagcaaaagcaacaaggcagcagcacaagcaagaaccacacctcctcccttcgcctgtgatcatgtcgtcttgctgcggcggcaagtgcgggtgcggctccagctgctcctgcggcagcggatgcaacggctgcggtatgtaccctgacgtggagaccgccgccaccagcagcgtcaagaccacggtcctcgccgcgccgaccaccaaggccagcgccggcggcttcgaggcggccaccgagggcggcggctgcgactgcaacacctgcaagtgcggcaccagctgcggctgctcctgctgcagctgcaactgagctggcccggcccggcgatggcgcacgagagtcgagaggaggaggacgacgacgaggcgtataaatataatagcggcgtccagtaaataagatcctgtcaactgcacccgccattatccatggtcgctcgctcctcgcctgcgtctcctggtcctggggttcgtctgaacgtcctcgcggcttcacgacggcgatgccgccgccgtcgatcctgtccgtctcgtgccggatttaatattagatctatatgcgtgtttttctgcgttattactacatctacatgtgtctgtctgtggtgtgtctctctgacggccccatgcgtcagcgtcactgcttgcttcagttctgcatctcactctgttgaggtgaaaaactgataacatctttgcagtgctagaaaacctgagaacctcatgatatctaagtaactgagccaagagagagagagagagagagagtatctaagtaccttgatccacttggacagcacagttagactctgaaacgatcgttgcataatgcagagtaccctgaaattcgaagcatcgacatgaccagctacagttccggctactgttatgggtttttctcttcgcccctttagataacagaatatcgatatctttataaaggaaataatggaatagtaatgggcaatgctacggcaatttccctactagaacgcaatttcttaaataaatttgaacagttattttttttagtttttaaattgattatttcattaacctacaaaataaaaaaaaacacagcaaagccctgtagtgatatctaactagcccaaaaagaacaaatgtatgagtatcttaatgtgcttggaaatatttttcggcgagagagagagtgagagagctcttaatgtgattttaa

SEQ ID NO: 6091 - DNA, 1820 bp, Zea mays
gtcggatcgcgcttgcggcttgccgcagtcgatccgaatcgcaacgcccgaatataccactcctccctgcttgcctcccgctgatatgatatccgtccattccaatccccctcttccgctccgcctccctctagctcctctccctctcgcagccatcctcgtccccccaagaatccggacgtcgtttgtcccctccttttctgggcgtttacatctttaagctcaaagagaaaggattatgaaaatggcgcacttgatcactaattgcagctttcagacattctcgagttctcctaattactgccgcaatattgggcaactacagaactcaaaatcttcaaatctgtccctcaaatcttgttccaggagacaaaagaagtcatatgttacctgtgctagcgctgccgtacaaggacagacacaaacacctcttactggtagccagcaagcttatgagcattcatcctccaaacctaaaaaggtaatggttattggtggagatggatactgtgggtgggcaacagcacttcatctctcaaacaaaggttatgaggttgcgattgttgataatcttgtccgccgtgcttttgataaccaactcggtcttgattcccttacccccataacctccatccagaatcgtgtccgtagatggaagtctctcactgctaagacaatccagctctttatcggtgacatatgtgattttgaattcctctcagaagccttcaagtcttttgagccggatgccgctgtccactttggcgagcaaagatccgcgccatactctatgattgatcgttcgcgggcagtctacacacagcataacaatgtcattgggacacttaatgtcttgtttgccataaaggaatacagtgaagagtgccatcttgttaagctaggaactatgggtgagtatggaacaccaaacattgacatcgaagaggggtttatcactattactcacaatggaagaacagacaccttgccttatccaaaacaagccagctctttctatcatctgagcaaagtgcatgattcccacaacatagcatttacatgcaaggcttggggtataagggccactgatcttaaccaaggtgtggtctatggtgtcagaacagatgaaactgcaatgcacgaagagctatctaacagatttgattacgatggggtctttgggaccgcactaaataggttctgtgttcaggctgctgttgggcatccacttacagtttatggaaaaggtggtcagacccggggatatctggacatcagagacactgtacagtgcgtggagctagcaatagccaacccagccaaacctggcgagttcagagtcttcaaccagttcaccgagcagttctctgtcaatgagctagccaaactggtgactgcggcaggagcgaagcttgggctagaagtggagaccaaatcgatacccaacccacgagtcgaggctgaggagcactactacaacgccaagcacacgaagcttattgagctcggcctggtgccccacctgctctcggactccctgctcgactcgcttctcaattttgccattcaatacaaggatcgggtcgacacggcacagatcatgcccagtgtgtcgtggaagaagatgggtgccaagccacggacagtctctgtttagagggtgattcaacttcccctgggttataatatcaaccatggcattgacattattgacatatgtaatgtaataattatgcacgttagtatgatttgctaggtagtgaggtgtttattacgatattaaattatattgttgcccgtgcaactcaagagttcatgtc

SEQ ID NO: 6092 - DNA, 1553 bp, Saccharum officinarum
cctaattattaccgctgtgttggccaactacagaactcaaaatcttcaaacctgtccctcaaatcttgttccaggagacaaaagaagtcatatgttacctgtgctagtgcagccgtacaaggacagacacaaacacctcttactggtagccagcaagcttatgagcattcatcctccaaacctaaaaaggtaatggttattggtggagatggatactgtgggtgggcaacagctcttcatctctcaaacaaaggttatgaggttgctattgttgataatcttgttcgccgtctttttgatcaccaacttggtcttgattcccttaccccgataacttccatccaaaatcgtgtccgtcgatggaagtctctcactggtaagacaattcagctctttatcggtgacatatgtgattttgaattcctctcggaagccttcaagtcttttgagcctgatgctgctgttcactttggtgagcaaagatccgcaccttactctatgattgatcgttcgcgagcagtctacacacagcataataatgtcattgggacacttaatgtcttgtttgccatgaaggaatacagtgaagagtgccatctggttaagctaggaactatgggtgagtatggaacaccaaacattgacattgaagaggggtttatcactattactcacaatggaagaacagacaccttgccttatccaaaacaagcgagctctttctaccatctaagcaaagtgcatgactcccacaacatagcatttacctgcaaggcttggggtataagggccacagatcttaaccaaggtgtggtctatggggtcagaacagatgaaactgcaatgcatgaagagctatctaacagatttgactatgatggtgtctttgggacagcactaaataggttctgtgttcaggctgctgtagggcatccacttacagtttatggaaaaggtggtcagacccggggatatctggacatcagagacactgtacagtgcgttgagctagcaatagccaacccagccaaacctggcgagttcagagtcttcaaccagttcactgagcagttctctgtcaatgagctggccaaactggtgacagccgcaggagcgaagcttggtctggaagtgcagaccaaatcggtgcccaacccacgagtcgaggctgaggagcactactacaacgccaagcacacaaaactcattgagctcggcctggtgccccacctgctctcagactccctgctcgactcgcttctcaactttgccatccaatacaaggatcgggtcgacacagcacagatcatgcccagcgtgtcgtggaagaagatgggtgccaagccacggacagtctctgtttaaagggtgattcaactcccctggctaataatgtcaaccatgacattgacattattgacatatgtaatgtaataattatgcgcattagtatgatgtgctacgtactgaggtgtttattacgatattaaatttcaattttgttgcccgtgcaactgaagagttcttgtttaattgattctggtgctcactcg

SEQ ID NO: 6093 - DNA, 1885 bp, Solanum phureja
agaatatccgtttgggcaaaactctgatgcttgcttgcccagataaatgaaaatcttagccccaatacttagctgagatacctttctcactctcttctaaggattttatctctaacaagcatcgccaggtttaagaaagtttagattcatatcgaggcggctatcatggcacatttactttctactacgtgttctttagatgtctcttccagcaacaagctgcatttcaagtcaattaaccaatgctctactcctattccaacatcttttaatatgggaatttctttctcacccttgaaaaagctaagtttgcaaagcaaaaggtctgcaaaatatgtggtcagagcttcagctgtttccatgagccaagaagccagaacccagaatgactctggttctcaacagaccactgatggagcctccactaggaagaaggtcatggtcattggtggggatggctattgtggctgggctactgctctccacctatccaacaagggatatgaagttgccattgttgacaaccttatccgtcgcctatttgacgaccagcttggtctagattctctaacacccatctcatcaatccataaccgcataaggcgttggaaatctctcacaggaaaagacattcaactgtttgttggtgatatatgtgagtttgagttcttggcagaagccttcaaatcctttgaacctgatgctgtagtccattttggagagcagaggtctgccccttattctatgattgataggtcaagagctatttatacccaacataataatgtgatagggacacttaatgtactatttgccataaaggagtttagggaagagtgtcatttggtcaaactcgggacaatgggggaatatgggacccctaacatagatattgaagaaggttatataactattactcataatggaagaacagatactcttccttatcccaaacaagcaagctctttctatcatttgagtaaagtccatgattcccacaacatagcctttacttgcaaggcgtggggaataagagctaccgacctgaatcagggagttgtatatggggtgaggactgatgaaactgcaatgcatgaggagctggttaacagacttgattatgatggagtatttggaactgcactaaatcggttctgtgttcaggctgctgttggacatccacttacggtgtatggtaaaggagggcagaccaggggatatttggatattagagatacagttcaatgtgttgaaattgcaattgccaatccagcaaaaccaggagagttccgggttttcaaccaattcacagagcagttttcagtaaatgagcttgcagcccttgtcaccaaggcaggggaaaaacttggacttgaggtgaaggccatatcagtgcccaatccaagagtagaagcagaggaacactactacaatgccaaacatactaaacttattgagctgggactacagcctcaccttctttctgattctcttctagactctctattgaactttgctgttcaatataaggatcgtgtcgacacaaagcagataatgcctagtgtttcctggaaaaaaattggcgcgaagccaaagactgttgcagcataaatcacttagacaagctatagagacttaagactgggagttcttgtatgtcattttaaataggagttatagtacttttacaatgccttgcacaattttatgttgtaactttgggaagtatttgttgtattcggaagcttgtgaaggttgtggatgtagattttgttggaggaaatactcgaggtagtcgtgacctgtttcaagcctgaaacttatgtgatttacttatcaatttagttttggctacatagacctgttcccggatatcctcctcatt

SEQ ID NO: 6094 - DNA, 1992 bp, Solanum lycopersicum
aggcacaagattgaagttgacaagggttaaggagggagaaagttgtaattttgtcgtcaacaaggttgggatgtagagaatatccgtttgggcaaagagatctcttgggcaaaaattttaatatcagataaatgaaaacctttctcactctcttgtaaggattttatgtctaacaagcatcaccaggtttaagaaaattggtaggctcatatcgaggcggctatcatggcacatttactttctactacatgttctttagatgtctcttccagcaaaaagctgcatttcaagtcaattaaccaatgctctactcctaatccaacatgttttaatatgggaatttctttctcacccttgaagctaagtttgcaaagcaaaaggtctgcaaaatatgtgatcagagcttcagctgtttccatgagccaagaagccagaacacagaatgactctggttctcaacagaccactgatggagcatccactaggaagaaggtcatggtcattggtggtgatggctattgtggctgggctactgctctccacctatccaacaagggatatgaagttgccattgttgacaaccttatccgtcgattatttgacgaccagcttggtctagattctctaacacccatctcatctattcataaccgcataaggcgttggaaatctctcacaggaaaagatattcaactgtttgttggtgatatatgtgagtttgagttcttggcagaagccttcaaatcctttgaacctgatgctgtagtccattttggagagcagaggtctgccccttattctatgattgataggtcaagagctatttatacccaacataataatgtgatagggacacttaatgtactatttgccataaaggagtttagggaagagtgtcatttggtcaaactcgggaccatgggggaatatggaacccctaatatagatattgaagaaggttatataactattactcataacggaagaacagatactcttccttatcccaaacaagcaagctctttctatcatttgagtaaagtccatgattcccacaacatagccttcacttgcaaggcgtggggaatcagagctaccgacctgaaccagggagttgtatatggggtgaggactgatgaaactgcaatgcatgaggagctggttaacagacttgattatgatggtgtatttggaactgcactaaatcgtttctgtgttcaggctgctgttggacatccactaacggtgtatggtaaaggagggcagaccaggggatatttggatatcagagatacagttcaatgtgttgaaattgcaattgccaatccagcaaaaccaggagagttccgggttttcaaccaattcacagagcagttttcagtaaatgagcttgcagcccttgtcaccaaggcagggcaaaaacttggccttgaggtgaaggccatatcagtgcccaatccaagagtagaagcagaggaacactactacaatgccaaacatactaaacttattgagctgggactacaacctcaccttctttctgattctcttctcgactctctattgaactttgctgttcaatataaggatcgtgtcgacacaaagcagataatgcctagtgtttcctggaaaaaaattggcgcgaagccaaagactgttgcagcataaatcacttagacaagctatagagacttaagactgggagttcttgtatgtcatttttatataggagctatagtattttacaatgccttgcacaattttatgttgtaactttgggaagtatttgttgtattccgaagcttgtgaaggttgtggatgtagattttgttggagaaaatactcgaggtagtcgtgacctgtctcaagcctgaaacttgtgtgatttacttgtcaatttagttttggctacacagaactgttcccggatatcttcctcattggacagatgaatttttgcttatattggagatccacaaccttcttattggg

SEQ ID NO: 6095 - DNA, 1893 bp, Musa acuminata
cctctccctatcttttagtttctcaaagctctcagaccgtctcctgctcacttctgatccgtgaaatttctttacatttattgtcttttcccttctgacggaaccgtaggcgagatcgactgcacgaggaaaaaggttttctggttacaaaatcttctccatactaggaagaaagcagtggcattcccatggcacattctatcttaccctgttgcagcataaattcctgtctcacaaccaaaacctatcttaaaaacaataatacatgttcggccgtcttctacaattctgttccattacaaacctgcaaatatccagggacagtccttcggccatgtaagctgagaccacggagacagtcaattatttatgctactgctacccctatgagccaagaaattgagaaaagtacgttgactgggtcaccccaaagttctagtgaatcatccgccaaatccaagaaggtaatgattattggtggtgatggctattgtggttgggcaaccgctcttcacctctccaacaaaggttatgaggtggctatagttgataaccttgtccgtcgcctatttgatcaccagcttgggattgactcccttaccccaatatcttccatccagaatcgtgttcggcgttggaaatctgtcactggaaaatcaatccagctctttattggtgacatatgtgactttgaattcctctccgaagcctttaaatcttttgaacctgattctgtagtccattttggtgagcaacgatctgcaccttattccatgatagatcggtcaagagctgtgtatacacagcataacaatgtgattggtacactcaatgtcctctttgctattaaggaatttagccaggagtgtcacctagtgaagcttgggacaatgggagagtatggaactccaaatattgatatcgaggaaggttacataaccataacacacaatggaagaacagatacattaccttatccgaagcaagcaagctccttttaccacctgagtaaggtgcatgattcacataatattgcttttacatgcaaggcttgggggatcagggctacagatttaaaccagggtgttgtttatggagttaggacagatgaaactgacatgcatgaagagctttgcaacaggtttgactatgatggtgtgtttgggacagcactgaataggttttgtgtgcaggcagcagttggacacccacttactgtatatggcaagggtggtcagacacggggatatctagatatcagggacacagtgcagtgtgttgagttggctgtcgctaatccagccaagccaggtgaattccgggtgtttaaccagttcacggagcaattttctgttaatgaccttgccaggttggtcacgaccgccgggaagaagctaggactggatgtgcagaccatatccgtgccaaacccgcgtgtggaagcagaagagcactactacaatgccaaacacaccaaactcattgaactgggtctccgaccacacctgctctccgaatcgctcttggattcactacttaatttcgccatcaaattcaaggaccaggttgatccagcacagataatgcccaccgtttcgtggaagaaaattggtgtgaaaactcggactgtttcggtgtagatggtgggtttgcttgaataagaacctaatgtcaacatctgaaagttgacattattctttgtaaatatcatccttgctagatattgtgttgagataacaaacactatatgcccgaaaagaatgatgtagcgtatccgattctctatctattttgaggtgcttaagagtagcatattcaatgtttggattccattctcattttatgttcagtaatgattgttcagaggatttcttttttcttttcataattatc

SEQ ID NO: 6096 - DNA, 1721 bp, Solanum tuberosum
ttctcactctattctaaggattttatctctaacaagcatcgccaggtttaagaaagtttaggctcatatcaaggcggctatcatggcacatttactttctactacgtgttctttagatgtctcttccagcaacaagctgcatttcaagtcaattaaccaatgctctactcctattccaacatcttttaatatgggaatttctttctcacccttgaaaaagctaagtttgcaaagcaaaaggtctgcaaaatatgtgatcagagcttcagctgtttccatgagccaagaagccagaacccagaatgactctagttctcaacagaccactgatggagcctccactaggaagaaggtcatggtcattggtggggatggctattgtggctgggctactgctctccacctatccaacaagggatatgaagttgccattgttgacaaccttatccgtcgcctatttgacgaccagcttggtctagattctctaacacccatctcatctatccataaccgcataaggcgttggaaatctctcacaggaaaagacattcaactgtttgttggtgatatatgtgagtttgagttcttggcagaagccttcaaatcctttgaacctgattctgtagtccattttggagagcagaggtctgccccttattctatgattgataggtcaagagctatttatacccaacataataatgtgatagggacacttaatgtactatttgccataaaggagtttagggaagagtgtcatttggtcaaactcgggacaatgggggaatatgggacccctaacatagatattgaagaaggttatataactattactcataatggaagaacagatactcttccttatcccaaacaagcaagctctttctatcatttgagtaaagtccatgattcccacaacatagcctttacttgcaaggcgtggggaatcagagctaccgacctgaatcagggagttgtatatggggtgaggactgatgaaactgcaatgcatgaggagctggttaacagatttgattatgatggagtatttggaactgcactaaatcggttctgtgttcaggctgctgttggacatccacttacggtgtatggtaaaggagggcagaccaggggatatttggatattagagatacggttcaatgtgttgaaattgcaattgccaatccagcaaaaccaggagagttccgggttttcaaccaattcacagagcagttttcagtaaatgagcttgcagcccttgtcaccaaggcaggggaaaaccttggacttgaggtgaaggccatatcagtgcccaatccaagagtagaagcagaggaacactactacaatgccaaacatactaaacttattgagttgggactacaacctcaccttctttctgattctcttctagactctctattgaactttgctgttcaatataaggatcgtgtcgacacaaagcagataatgcctagtgtttcctggaaaaaaattggcgcgaagccaaagactgttgcagcataaatcacttagacaagctatagagacttaagactgggagttcttgtatgtcattttaaataggagttatagtatatttacaatgccttgcacaattttatgttgtaactttgggaagtatttgttgtattcagaagtttgtggatgtagattttgttggaggaaatactcgaggtagtcgtgacctgtttcaagc

SEQ ID NO: 6097 - DNA, 1277 bp, Saccharum officinarum
ctcagcctcaggccaaagagcacgggagagcagaggaagcagagcagagctttgcgggaggcgtcaatggcaggaacctgggtgaagatggagcagaagggtgctggtccgggagcacgaagctcccacgccatcaccctggtcggccacacagcctacgcgttcggcggcgagttcaccccgcgcgtgccggtggacaacaccatgtacgcgttcgacctcaccacgcagacctggtccgccctcgacgacgccacgggcgacgtgcccccgccgcgcgtgggggtgaccatggcggccgtgggcggcacggtgtacacgttcggcgggcgcgacctggagcacaaggagctgaacgagctgtacgccttcgacacggcgacgcgggcgtggacgctgctctcctccggcgccgacgacgggccgccgcaccggagctaccactccatggtggcggacgcggagtgcggccgggtgtacgtgttcggcgggtgcggcgacgccgggcgcctgaatgacctgtgggcgtacgacgtggcggcggggacgtgggaggagctgccgtcgccgggggaggcctgccgcccgcgcggcgggcccgggctcgcccgtcgccggcgggaaggtgtgggtggtgtacgggttctccggcgaggagctcgacgacgtgcactgctacgacccggcgacccgggcgtgggctgtggtcgagaccacgggcgacaagcccagtcctcggagcgtgttctgcgcggccgggatcgggaggcacgttgtggtgtttggcggcgaggtggaccccagtgatcttggacacctcggcgccggcaagttctctgccgaggcgttcgccctcgacacggagacccgcgcgtggacgcggctggtggacgacgacaaggcggaggcggaggccgagcagcaccacccggggcctcgcgggtggtgcgcgttcgcggcgggggagaaggacggccggcaagggatgatggtgtatggaggcaactcgccgaccaacgaccggctcgacgacatctacttcttcgcgcccgttcttgaggttgaggccgcaagctagcgcgcgcgtgtgggcaactggcagtggcagtggtgcatggataatgtttggtgtgtagcagtgcaatctgcagggcttggatgttttttgtgaattgtgagtttgtgaccatcatcttgtgtgtggtcatctaaaattctggctgtttttttttctccggtctatggttttatgctgggtgattggataataataatgg

SEQ ID NO: 6098 - DNA, 1517 bp, Oryza sativa
attggggttcagaaaaatgtcgtcagcaggcccctcgaccagctacaattgtatatcacttggcctctggccagattggtggagaaaggcaagttctcaggctgcagaggaagcagagctccaatctgttcatgccaatggctgctggcacctgggtgaagctagagcagaagggagatgggccgggagcaagaagctcccacgccatcaccctcgtcggcggcacggcgtacgcgttcggcggcgagttcacgccgcgcgtgccggtggacaacgccatgtacgccttcgacctcaagtcgcagtgctggtcggcgctggacgcctccggcgacgtgccgccgccgcgcgtcggcgtcaccatggcgtccgtcggcgccaccgtctacatgttcggcggtcgcgaccaggagcacaaggagctgaacgagctctactcgtttgacacggcgaccaacagatggacgctgctgtcctccggcgccggcgacggcccgccgcaccggagctaccactccatggtggccgacgccgcggggggcgggaaggtgtacgtgttcggcgggtgcggcgacgccggccgcctcaacgacctgtgggcctacgacgtcgccgccgggcggtgggaggcgctgccgtcgccgggcgaggcgtgcaagccgcggggaggccccgggctggccgtcgccggcgggaaggtgtgggtggtgtacggcttctccggcgaggagctggacgacgtgcactgctacgacccgggcacgggcgcgtggtccacggtcgagaccaccggcggcggcggcggcggcgacaagccgtccccgcgcagcgtgttctgtgccgcggggatcgggaagcacgtggtggtgttcggcggcgaggtggacccgagcgacctggggcacctcggcgccggcaaattctccgccgaggcgttcgcgctggacacggagacgggcgcgtgggcgaggctggacgacgcgggcgagcaccacccggggccgaggggatggtgcgcgttctcggcgggggaggtggacggccggcgagggctgctggtgtacggcggcaactcgccgacgaacgatcgcctcggcgacatctacttcttcactccgccgctggcttaataattcctgaaccggcgagcgaccttgtcgacctccgtcatgcaggtgtccgcgtgcttcccttctgagcgttgggtagttgtgtggtttgtcactgtgtttgatgttggtgttggtatcatgttatcctgtgttgtgtagctgatgaaataaatgtgatgcattggtcattggtgctgcaagaggcttcaaatgcctgttttccaaacaaaatgtcgcctaagtaactaagttcatagggtacttaagggctgggctaagatagcttgaaattttgaagtattatttcatttcctttcggtcgttcaaatttggttagaatcagtataaatccaacgtaaatctatatctttacctacttggaaaacaaagtatgcctctaagccc

SEQ ID NO: 6099 - DNA, 889 bp, Saccharum officinarum
ccccgttctgtctccgaggtgaacgcggatcagcggcggcggcggcgcgaggcgagggaaggcgagcaagatgagcgggaacggggtggtgaagaaggtggccgacgcggcgacgaaggccggcaaggcgatcgactgggacggcctggccaaaatgcttgtctccgaggaggcccgcaaggagttcgccaacctccgccgcaccttcgacgacgtcaaccaccagctccagaccaagttctcgcaggaaccccagccaattgattgggagtactacaaaaagggaattggatcaaaagttgtcgaaatgtacaaggaggcctacgaaagcatagagatccccaagtatgttgacactgtcactcctcaatacaagccaaagtttgatgctctgttggtcgaaatgaaggaagccgaaaaagcatcactaaaggaatcagagaggatagagaaggagattgctgaaatgaaggagatgaagaaaaagatcagcacgatgactgcagatgagtactttgcgaagcaccctgaactgaaacagaagtttgacgatgagatccgcaacgattattggggatactaaggcgcagtgtcacctttctttggaacatccaataatacatttcgccccctaaatgtgcttatgagttaaccatccaaacctgacgaattgtgtaacgcgtggatggaggcatgccaaagttccaagaaactcggcggtccttgcaccatgaccagacctcacatttttattgtcataagggtcttatgataatttttgtttttgctccttgggttcctccacacatttatggaacattactcacgttttggttgcacggtttgtttgtttttttactagaaaaggagttactggtttggttggaat

SEQ ID NO: 6100 - DNA, 1061 bp, Setaria italica
atggcaagacgattagtattgtctggggacgaatcttgtatcttccactcatatcaaggatggcctgtcaagtcaatagttaggaattcaaacaagagagtcgatcgattacatcccaagcctagattgatggaaatagacggctgtcccccgctccatcaccgaggcgagcgtagatcggcggtggcggcggcgcgaggaggagagagaggggaggcgagcaagatgagcgggaacgccgtggtgaagaaggtggcggacgccgcggcgaaggctggcaaggcgatcgactgggacggcctggcgaagatgctcgtctccgaggaggcccgcaaggagttcgccaccctccgccgcaccttcgaggacgtcaaccaccagctccagaccaagttctctcaggaaccccagccaattgactgggagtactacagaaaaggaatcggatcaaaagttgtcgatatgtacaaggaggcgtacgaaagcatagagatccccaagtatgttgacactgtcactccacagtacaagccaaagtttgatgctctgttggtcgaaatgaaggaagcggaaaaggcatcactaaaggaatcagagaggatagagaaagagattgctgaaatgaaggagatgaagaaaaagatcagcacgatgacagctgacgagtactttgcgaagcaccctgaactcaaacagaagtttgacgacgagatccgcaacgattactggggatactaaggcacatctaatcttcagcttcacccttctttggaacatccaataatacatctttttcacctaaatgcttatggaagctgaccatccaaacttgaatcgcatagcgcatggatggggcgtgccagagttccaactaacttggctgttcttgtaccatggtcaaaccttgtcattttgagggtcatcagcttctatcatatgaaaattttgtttttgttcctgagttcctccaacggataggaatttttttggttcctcggtgtactcatccttcttggccaagcaccaagactggtctctcccatcttatactggaatttact

SEQ ID NO: 6101 - DNA, 864 bp, Panicum virgatum
gataaatagcttgcggaagatatataggagccccctgtccgccggctccatcaccgaggcgaacgtagatcggcggcggcggcgcgaggagcagagggaggggggaggcgggcaagatgagcgggaacggcgtggtgaagaaggtggcggatgccgcggcgaaggccggcaaggcgatcgactgggacggcctgggcaagatgctcgtctccgaggaggcccgcaaggagttcgccaccctccgctgcaccttcgaggacgtcaaccaccagctccagaccaagttctcgcaggaacccaagccaattgactgggagtactacagaaaaggaattggatcaaaagttgtcgatatgtacaaggaggcctacgaaagcatagagatccccaagtatgttgacactgtcactcctcagtacaagccaaagtttgatgctctgttggtagagatgaaggaatcggaaaaggtatcactgaaggaatcagagaggatagagaaggagattgctgaaatgaaggagatgaagaaaaagatcagcacgatgaccgcagacgagtactttgccaagcaccctgaactcaaacagaaatttgatgatgagatccgcaatgattactggggatactaagacgcagcaggtcttccatgtcacccttctttcgaacatctaataatacatccttttcacctaaatgcgcatggaagttgaccatccaaactttaatcgcatagctagtggatgggaggcgccaaagtttcaactaactcggctattcttgtaccatggtcagacctcatcattttaaggttcaacagacaacagcttctatcataagaaaaattagtttttgcttctgggttcg

SEQ ID NO: 6102 - DNA, 853 bp, Cenchrus ciliaris
  misc_feature (205)..(205): n is a, c, g, or t
  misc_feature (368)..(368): n is a, c, g, or t
  misc_feature (370)..(370): n is a, c, g, or t
  misc_feature (497)..(497): n is a, c, g, or t
  misc_feature (558)..(558): n is a, c, g, or t
  misc_feature (574)..(574): n is a, c, g, or t
  misc_feature (591)..(591): n is a, c, g, or t
  misc_feature (673)..(673): n is a, c, g, or t
  misc_feature (707)..(707): n is a, c, g, or t
ctagatcggcggcggcggcggcgcgaggagagcagggaggcgagcaagatgagcgggaatggcgtggtgaagaaggtggccgacgccgcggcgaaggccggcaaggcgatcgactgggacggcctggcgaagatgctcgtctccgaggaggcccgcaaggagttcgccaccctccgccgcaccttcgaggacgtcaaccaccagntccggaccaagttctcgcaggaaccccagccaattgattgggagtactacagaaaaggaatcggatcaaaagttgttgatatgtacaaggaggcgtacgaaagcatagagatccccaagtatgttgacactgtcactcctcagtacaagccaaagtttgatgntntgttggtcgaaatgaaggaagcagaaaaagcatcagtaaaggaatcagagaggatagagaaagagattgctgaaatgaaggcgatgaagaaaaagatcagcacgatgacagcagacgagtactttgngaagcaccctgaactcaaacagaagtttgatgacgagatccgcaacgattactggggatantaaggcgcaacaagtnttcagcatgtccctttnttcggattatcaaataaaacatcgtatctttcccccatatgcgctaggaagttgagcatccaaacttgatgaatcgcattgngagtggatggggtgcatcaaagttacaaactaantccgctgttccattaccttggtcagacctcatcatttgagggtcaccagcttttgtcatatgaaaattttgtttttgctactggattttttcaacgggcatgaaaattaattgctgccatataatttatggtttgtcggtgtacta

SEQ ID NO: 6103 - DNA, 554 bp, Pennisetum glaucum
agagagagaggggaggcgagcaagatgagcgggagtggcgtggtgaagaaggtggccgacgccgcggagaaggccggcaaggcgattgactgggacggcctggcgaagatgcttgtctcggaggaggcccgcaaggagtacgccaccctccgccgcaccttcgaggacgtcaaccaccagctccataccaagttctcgcaggaaccccagccaatcgactgggagtactacagaaaaggaattgggtcaaaagttgttgatatgtacaaggtggcatatgaaagcatagagatccccaagtatgttggcactgtcactcctcagtacaagccaaagtttgatgctctgctggtcgaaatgaaggaagcggaaaaggcatcactgaaggaatcagagaggatagagaaagagattgctgaaatgaaggagatgaagaaaaagatcagcacgatgacagcagacgagtactttgtgaagcaccctgaactcaaacagaaatttgatgacgagatccgcaacgattactggggatactaaggcacaacaattgttca

SEQ ID NO: 6104 - DNA, 874 bp, Triticum aestivum
ggcgagtagaaaatgtagataacagggacatattactctggagtctggacagaactcctgaaacaatcaagagtcacacagccctagcaagtttagcagatccagagccgaagatgagcggggtgaagaaggtgacggacgttgcggccaaggccgggaaggcgatcgactgggacggcctggccaagatgctcgtctccgacgaggcccggaaggagttcgccaacctccgccgcaccttcgaggacgtcaaccaccagctccagaccaagttctcccaggaaccaaagccaattgactgggaatactacaaaaagggaatcggatcgaaagttgtggatatgtacaaggaggcttatgatagcattgagatcccaaagtatgttgacactgtcactcctgagtacaagccaaagtttgatgctctgttaatcgaaatgaaggaagcagagaagacatctctgaaggaatcagagaggatagagaaggagattgctgaattgaaagagatgaagaaaaagatcagcacaatgacagcagacgagtactttgcgaagcaccctgaactcaagaagaagtttgatgatgagatccgtaacgattactggggatactagataacggcgaaagtccaagttcttttactagaacattcaataatacttatttgtccctctggaatctcatcatccatacttgggtgaattccataacatgtggactgggcttgttgaaattccaacataactcttatctttgtgctttctgttggacctcatcattttaagggttgccagcttatttcaatgaaattttgtcttgtgtttaacttctgctcctttgtacaagaggatttctgctatggctcgattcc

SEQ ID NO: 6105 - DNA, 1014 bp, Triticum aestivum
ttactctggagcctggaccgaactcccgaaacaatcaagagtcacacagccctagcaagtctagcagatccagagccgaagatgagcggggtgaagaaggtgacggacgttgcggccaaggccgggaaggcgatcgactgggacggcctggccaagatgctcgtctccgacgaggcccggaaggagttcgccaacctccgccgcaccttcgaggacgtcaaccaccagctccagaccaagttctcccaggaaccaaagccaattgactgggaatactacaaaaagggaatcggatcgaaagttgtggatatgtacaaggaggcttatgatagcattgagatcccaaagtatgttgacactgtcactcctgagtacaagccaaagtttgatgctctgttaatcgaaatgaaggaagcagagaagacatctctgaaggaatcagagaggatagagaaggagattgctgaattgaaagagatgaagaaaaagatcagcacaatgacagcagacgagtactttgcgaagcaccctgaactcaagaagaagtttgatgatgagatccgtaacgattactggggatactagataacggcgaaagtccaagttcttttactagaacattcaataatacttatttgtccctctggaatctcatcatccatacttgggtgaattccataacatgtggactgggcttgttgaaattccaacataactcttatctttgtgctttctgttggacctcatcattttaagggtcgccagcttatttcattgaaattttgtcttgtgtttaactttgctcctttgtacaagaggatttctgctatggcttgattcctccatgtaccttgtcgtttgtcaatgtgctcatccttgatagacaccgatctttaggctgggagagaggagttaacctaacatgtgacatgtctgtaacaacattgtgcatttctgatgactgaagctttcttaaattcgtgaactgcaatgatgcatactagtacgtcccaa

SEQ ID NO: 6106 - DNA, 1011 bp, Secale cereale
aggccacattaacagtcatcaccagagaaatattccacagcccagggtaacagaaagccttgctccacagccccaaatggctgagatcgtttcgagtgaggatctggcggctgaaattgcccgggagccctgagtgctcgtcatttttttttctggaacaaggtgctcgcccatttgagcgccgcataaacttggaaggagataacagggacatataactccggaccgaactcctgaaacaatcaagagtcacacagccctagcaagtttagcagatccagaggcgaagatgagcggggtgaagaaggtgaccgacgtcgcggccaaggccggcaaggcgatcgactgggacggcctggcgaagatgctcgtctccgaggaggcccggaaggagttcgccaacctccgccgcaccttcgaggacgtcaaccaccagctccagaccaagttctcccaggaaccaaagccaattgactgggaatactacagaaaaggaatcggatcgaaagttgtggatatgtacaaggaggcttatgatagcattgagatcccaaagtatgttgacactgtcactcctgagtacaagccaaagtttgatgctctgttaatcgaaatgaaggaagcagagaagacatctctgaaggaatcagagaggatagagaaggagattgctgaaatgaaagagatgaagaaaaagatcagcacaatgacagcagacgagtactttgcgaagcaccctgaactcaagaagaagtttgatgatgagatccgtaacgattactggggatactagataacggcgaaagtccaagttcttttactagaacattcaataatacttctttgtccctctggaatctcatcatccaaacttgggtgaattccataacatgtggactgggcttgttgaaattccaacataactctggtctttgtgctttctgttggacctcatcattttaagggttgccagcttatttcaatgaaattttgtcttgtgtttaacttccg

SEQ ID NO: 6107 - DNA, 873 bp, Secale cereale
gagcgccgcataaacttggaaggagataacagggacatataactccggaccgaactcctgaaacaatcaagagtcacacagccctagcaagtttagcagatccagaggcgaagatgagcggggtgaagaaggtgacggacgtcgcggccaaggccggcaaggcgatcgactgggacggcctggcgaagatgctcgtctccgaggaggcccggaaggagttcgccaacctccgccgcaccttcgaggacgtcaaccaccagctccagaccaagttctcccaggaaccaaagccaattgactgggaatactacagaaaaggaatcggatcgaaagttgtggatatgtacaaggaggcttatgatagcattgagatcccaaagtatgttgacactgtcactcctgagtacaagccaaagtttgatgctctgttaatcgaaatgaaggaagcagagaagacatctctgaaggaatcagagaggatagagaaggagattgctgaaatgaaagagatgaagaaaaagatcagcacaatgacagcagacgagtactttgcgaagcaccctgaactcaagaagaagtttgatgatgagatccgtaacgattactggggatactagataacggcgaaagtcaaagttcttttactagaacattcaataatacttctttgtccctctggaatcgcatcatccaaacttgggtgaattccataacatgtggactgggcttgttgaaattccaacataactctggtctttgtgctttctgttggacctcatcattttaagggttgccagcttatttcaatgaaattttgtcttgtgtttaactccgctcttttgtacaagaggatttctgctaaaaaaagtcgta

SEQ ID NO: 6108 - DNA, 832 bp, Secale cereale
agcgccacataaacttggaaggagataacagggacatataactccggaccgaactcctgaaacaatcaagagtcacacagccctagcaagtttagcagatccagaggcgaagatgagcggggtgaaaaaggtgaccgacgtcgcggccaaggccggcaaggcgatcgactgggacggcctggcgaagatgctcgtctccgaggaggcccggaaggagttcgccaacctccgccgcaccttcgaggacgtcaaccaccagctccagaccaagttctcccaggaaccaaagccaattgactgggaatactacagaaaaggaatcggatcgaaagttgtggatatgtacaaggaggcttatgatagcattgagatcccaaagtatgttgacactgtcactcctgagtacaagccaaagtttgatgctctgttaatcgaaatgaaggaagcagagaagacatctctgaaggaatcagagcggatagagaaggagattgctgaaatgaaagagatgaagaaaaagatcagcacaatgacagcagacgagtactttgcgaagcaccctgaactcaagaagaagtttgatgatgagatccgtaacgattactggggatactagataacggcgaaagtccaagttcttttactagaacattcaataatacttctttgtccctctggaatctcatcatccaaacttgggtgaattccataacatgtggactgggcttgttgaaattccaacataactctggtctttgtgctttctgttggacctcatcattttaagggttgccagcttatttcaatgaaattttgtcttgtgtttaacttc

SEQ ID NO: 6109 - DNA, 973 bp, Hordeum vulgare
cggcacgaggatcgtttagagtgaagatctagcggctgaaattgcctggagcggggaaagcgctcgtcattctagcgccgcataaacttgggacttgggaggagataacagggacatataactctggaccgatctcaactcctgaaacaatcaagagttacacagacacaggtctagcaaggttagcagatccagagccgaagatgagcggggtgaagaaggtggcggacgttgcggccaaggccgggaaggcgatcgactgggacggcatggcgaagatgctcgtctccgaggaggcccggaaggagttcgccaacctccgccgcaccttcgaggacgtcaaccaccagctccagaccaagttctcccaggaaccacagccaattgactgggaatactacagaaaaggaatcggatcaaaagttgtggatatgtacaaggaggcttatgatagcattgagatcccgaagtatgttgacactgtcactcctcagtataagccaaagtttgatgctctgttagtcgaattgaaggaggcagagaagacatctctgaaggaatcagagaggatagagaaggagattgctgaaatgaaggagatgaagaaaaagatcagcacaatgacagcagacgagtactttgcgaagcaccctgaactcaagaagaagtttgatgatgagatgcgtaacgattactggggatactagataacgatggaagtccaagttcctttaccagagcattcaataatacttctttgtccctctggaatttcatcatccaaacttgtgtgaattccataacatatggactgggcttgttgaaattccaacataactctgatctttttactttctgttggaccttgccattttaagtttcaccagcttatttcaatgaaattttgtcttgtgtttagcttctgcccctttgtagaggaggatatctgctatggattgattcctccatgtag

SEQ ID NO: 6110 - DNA, 1142 bp, Hordeum vulgare
ggctgagatcgtttagagtgaagatctagcggctgaaattgcctggagcggggaaagcgctcgtcattctagcgccgcataaacttgggacttgggaggagataacagggacatataactctggaccgatctcaactcctgaaacaatcaagagttacacagacacaggtctagcaaggttagcagatccagagccgaagatgagcggggtgaagaaggtggcggacgttgcggccaaggccgggaaggcgatcgactgggacggcatggcgaagatgctcgtctccgaggaggcccggaaggagttcgccaacctccgccgcaccttcgaggacgtcaaccaccagctccagaccaagttctcccaggaaccacagccaattgactgggaatactacagaaaaggaatcggatcaaaagttgtggatatgtacaaggaggcttatgatagcattgagatcccgaagtatgttgacactgtcactcctcagtataagccaaagtttgatgctctgttagtcgaattgaaggaggcagagaagacatctctgaaggaatcagagaggatagagaaggagattgctgaaatgaaggagatgaagaaaaagatcagcacaatgacagcagacgagtactttgcgaagcaccctgaactcaagaagaagtttgatgatgagatgcgtaacgattactggggatactagataacgatggaagtccaagttcctttaccagagcattcaataatacttctttgtccctctggaatttcatcatccaaacttgtgtgaattccataacatatggactgggcttgttgaaattccaacataactctgatctttttactttctgttggaccttgccattttaagtttcaccagcttatttcaatgaaattttgtcttgtgtttagcttctgcccctttgtagaggaggatatctgctatggattgattcctccatgtagcttgtcgtttgtcgatgtgctcatccttgataggcactgatctttagactgggagagaggagttaacctaacacgtgacatgtcagtaacaacattgtgcacttatgactgaaacattcttaaattcgtgaactgtgacgagcccctgttggttggctttctgaagaaaatg

SEQ ID NO: 6111 - DNA, 766 bp, Pseudoroegneria spicata
  misc_feature (734)..(734): n is a, c, g, or t
tcaagagtcacacaggtctagcaagtttagcagatccagagccgaagatgagcggggtgaagaaggtgacggacgttgcggccaaggccgggaaggcgatcgactgggacggcctggcgaagatgctcgtctccgacgaggcccgaaaggagttcgccaacctccgccgcaccttcgaggacgtcaaccaccagctccagaccaagttctcccaggaaccaaagccaattgactgggaatactacagaaaaggaatcggatcgaaagttgtggatatgtacaaggaggcttatgatagcattgagatcccaaagtatgttgacactgtcactcctgagtacaagccaaagtttgatgctctgttaatcgaaatgaaggaagcagagaagacatctctgaaggaatcagagaggatagagaaggagattgctgaaatgaaagagatgaagaaaaagatcagcacaatgacagcagacgagtactttgagaagcaccctgaactcaagaagaagtttgatgatgagatccgtaacgattactggggatactagataacggcgaaagtccaagttattttactagaacattcaataatacttctttgtccctctggaatctcatcatccaaacttgggtgaattccataacttgtggattgggcttgttgaaattccaacataattctgatctttgtgctttctgttggacttggacctcatcattttaagggtcancagcttatttcaatgaaattttgccttgtgtt

SEQ ID NO: 6112 - DNA, 850 bp, Triticum aestivum
agggacatattactctggagcctggaccgaactcccgaaacaatcaagagtcacacagccctagcaagtctagcagatccagagccgaagatgagcggggtgaagaaggtgacggacgtcgcggccaaggccgggaaggcgatcgattgggacggcctggcgaagatgctcgtctccgacgaggcccgaaaggagtttgccaacctccgccgcaccttcgaggacgtcaaccaccagctccagaccaagttctcccaggaaccaaagccaattgactgggaatactacaaaaaaggaattggatcgaaagttgtggatatgtacaaggaggcttatgatagcattgagatcccaaagtatgttgacactgtcactcctgagtataagccaaagtttgatgctctgttaatcgaaatgaaggaagcagagaagacatctctgaaggaatcagagaggatagagaaggagattgctgaattgaaagagttgaagaaaaagatcagcacaatgacagcagacgagtactttgcgaagcaccctgaactcaagaagaagtttgatgatgagatccgtaacgattactggggatactagataacggcgaaagtccaagttcttttactagaacattcaataatacttctttgtccctctggaatctcatcatccaaacttgggtgaattccataacatgtggactgggcttgttgaaattccgacataactcagatctttgtgctttctgttggacctcatcattttatgggtcgccagcttatttcattgaaattttgtcttgtgtttaactttgctcctttgtacaagaggatttctgctatggcttgattcc

SEQ ID NO: 6113 - DNA, 1233 bp, Sorghum bicolor
ttaaacccaccaaatactcctctctggactcttgccactccacgagcaccaccaggccatccccccgtatacccatttccttgttcggtcggaacgcggcggcggcggcggcggcgagagggagagagaggggagagtcggcaggccccgagggaggaggcagcggcgggccggacaatatgagcggcaacggcgcgaagaaggtggtggatgtggccgtgaaggccgccaaggcgatcgattgggacggcatggccaagatgctcgtctccgacgaggcgcgcaaggagttcgccacgctccgccgcacctttgaggacgtcaaccaccagctccagaccaagttctcccaggaaccccaaccgattgattgggagtactacagaaaaggaattggatcaaaagtggtggatatgtacaaagaggcttatgaaagcatcgagatcccgaagtacgtcgacacagttactcccgagtacaagccgaagtttgatgctctggttgttgaattgaaggaggctgagaaagcgtctctgaaggagtcagaaaggatagagaaggaaattgctgaactcaaggaaatgaagaaaaagatcagtacaatgacagcagatgagtactttgagaagcaccctgaactcaagaagaagtttgacgatgaaatccgtaatgattactggggatattgaagagattggagagaactcttatcttgccatttccatgtctgtgaagaaccaataatttttctgtgccccgatatgtataggggaaatctgcaatctcaaattggtggtttccatagcatgtgcacggggtttgggtggaatgcctacagaatcgactgtgtcaagctttcttgaaattccatcgaaacatgttttgtttgatctcatcattttgaagaggatccctgcttttgtcatacaaagattatgatatgatcttagcccctttctacttgaataagaggttttctgcagacccttttcctctactggccttctgtgacgcattggtctgaatccttgtaaatgttcggtgcaagtgtggcacttatcctaccttactattagaaagttgaaactgccgtcttggacatcaacagtcttcaaaacataatgtttatggattgaaatgttgatgtatgtacttgtgaaggaagaacctactattctttgttgaacttaaggcatgatgatttgtccttttttgaacgtaatgatttgtccc

SEQ ID NO: 6114 - DNA, 1385 bp, Sorghum bicolor
tttcagcccaaccaaaggggtgttcgttcttcacggcctgtttaaacccaccaaatactcctctctggactcttgccactccacgagcaccaccaggccatccccccgtatacccatttccttgttcggtcggaacgcggcggcggcggcggcggcgagagggagagagaggggagagtcggcaggccccgagggaggaggcagcggcgggccggacaatatgagcggcaacggcgcgaagaaggtggtggatgtggccgtgaaggccgccaaggcgatcgattgggacggcatggccaagatgctcgtctccgacgaggcgcgcaaggagttcgccacgctccgccgcacctttgaggacgtcaaccaccagctccagaccaagttctcccaggaaccccaaccgattgattgggagtactacagaaaaggaattggatcaaaagtggtggatatgtacaaagaggcttatgaaagcatcgagatcccgaagtacgtcgacacagttactcccgagtacaagccgaagtttgatgctctggttgttgaattgaaggaggctgagaaagcgtctctgaaggagtcagaaaggatagagaaggaaattgctgaactcaaggaaatgaagaaaaagatcagtacaatgacagcagatgagtactttgagaagcaccctgaactcaagaagaagtttgacgatgaaatccgtaatgattactggggatattgaagagattggagagaactcttatcttgccatttccatgtctgtgaagaaccaataatttttctgtgccccgatatgtataggggaaatctgcaatctcaaattggtggtttccatagcatgtgcacggggtttgggtggaatgcctacagaatcgactgtgtcaagctttcttgaaattccatcgaaacatgttttgtttgatctcatcattttgaagaggatccctgcttttgtcatacaaagattatgatatgatcttagcccctttctacttgaataagaggttttctgcagacccttttcctctactggccttctgtgacgcattggtctgaatccttgtaaatgttcggtgcaagtgtggcacttatcctaccttactattagaaagttgaaactgccgtcttggacatcaacagtcttcaaaacataatgtttatggattgaaatgttgatgtatgtacttgtgaaggaagaacctactattctttgttgaacttaaggcatgatgatttgtccttttttgaacgtaatgatttgtcccactaaatcatagtgaaaatgaaaagtgtctcaggttcatgtgggattggacatggactgtccaatgtccaactggaccttttcttggttccacagggaccggctagcttgc

SEQ ID NO: 6115 - DNA, 1104 bp, Saccharum officinarum
aaacccaccaaatactcttctctctcgactctggccactccacgagcaccaccaggccatccccatatacggtattacccatttcctagcgcggccggaacgcagcgcggcggcggcggcggcggcgagagggagagaggggagagtcggcaggccgagggaggaggcagcggcgggccggagaatatgagcggcaacggcgcgaagaaggtggtcgatgtggccgtgaaggccggcaaggcgatcgactgggacggcatggccaagatgctcgtctccgaggaggcgcgcaaggagttcgccaccctccgccgcaccttcgaggacgtcaaccaccagctccagaccaagttctcccaggaaccccaaccgattgattgggagtactacagaaagggaattggatcaaaagtggtggatatgtacaaagaggcttatgaaagcatcgagatcccgaagtacgtcgacacagttactcccgagtacaagccaaagtttgatgctctggtcgttgaattgaaggaggctgagaaagcgtctctgaaggagtcagaaaggatagagaaggaaattgctgaactcaaggaaatgaagaaaaagatcagtacaatgacagcagatgagtactttgagaagcaccctgaactcaagaagaagtttgacgatgaaatccgtaacgattactggggatattgaagagattggagagaactcttatcttgccatttccatgtctgtgaagaaccaataatttttctgtgccccgagatgtataggggaaatctgcaatctcaaattggtggtttccatagcatgtgcacggggtttgggtggaatgcctacagaatcgactgtgtcaagctttcttgaaattccatcgaaacatgttttgtttgacctcatcattttgaagaggatccccgcttttgtcttacaaagattatgatatgttcttagctcctttctacttgaataagaggatttctgcatgcccttttcctctcctgacattctgtgacgcattggtctgaatgtgcctgctcggtgcaagtgtggcacctgtattggacatcaacagtcttcaaaatcgattctttgttgaac

SEQ ID NO: 6116 - DNA, 1214 bp, Setaria italica
gttgaacccaccaaatactctcttctctgcccatcactccgcgagcacgaccaggccaaccccacatacctacccatttccttgtgcggtcggagcgcagcgcggcggcggcggcagcgagagaggggaggggagccggcgggacccaggaaggctcgagggaggagccagctgcggggcggtgaagatgagcggcaacgggaagaaggtggtcgatatggcggtcaaggccggcaaggcgatcgactgggacggcatggccaagatgctcgtctccgaggaggcgcgcaaggagttcgccaccctccgccgcaccttcgaggacgtcaaccaccagctccagaccaagttctcccaggaaccccaaccgattgattgggagtactacagaaaaggaattggatctaaagtggtggatatgtacaaggaggcttatgaaagcattgagatccccaagtatgttgacaccgttactcctgagtacaagccaaagtttgatgctctggttgttgaactgaaggaggctgagaaagcgtctctgaaggagtcagaaaggatcgagaaggaaattgctgaactcagggaaatgaagaaaaagatcagcacaatgacagcggatgagtactttgagaagcaccctgaagtcaagcagaagtttgatgatgaaatccgtaacgattactggggatattgaagagcagaagagaacttttagctgccatttccatgtttgtgaagaaccaataatttttccgtgccctgatatgtataggggaaaccagccgtctcaaatctggtggtttcggtaacatgtgcatggggcttggtggaatgccttcagaaccgactgtgttaagctttcttgaaattccatctaaacacattttgtttaacctcaccattttctcgaggattgtcggctgtcttgcgaagattatgttatgtccttagctcctttctacttgaataagaggattatgcagactttgtccccccacttgccttcagtgacagtctttagtccgaatgcttgaatgctgttcgatgcaagtgtaacactgatgctgcctaatgcccatttgaaacctttttgatgctttcggtgtcatcttgggcatcaaccgctttgaaacgtgatggatatattaataaatctcaaatgtagtatgcttatgaatgcaaagtattcatgtaggaaaagtctatattttagt

SEQ ID NO: 6117 - DNA, 917 bp, Pennisetum glaucum
gttgaacccaccaaatactctcttctctcccactccgagagcatcaccaggccaaccccagcataccccatttccttgtgcggttggagcgcagcgcggcggcggcggcggtgcgaaagaggggagccggcgggactcaggaaggtttgagggaggatccagcggcgggccgtggaagatgagcggcagcgggaagaaggtggttgatgtggcggtcaaggccggcaaggcaatcgactgggacggcatggccaagatgctcgtctccgaggaggcgcgcaaggagttcgccaccctccgccgcaccttcgaggacgtcaaccaccagctccagaccaagttctcccaggaaccccaaccaattgattgggagtactataggaaaggaattggatctaaggtggtggatatgtacaaggaggcttatgaaagcatcgagatccccaagtatgttgacactgttactcctgagtacaagccaaagtttgatgctctggttgttgaactgaaggaggctgagaaagcgtctctgaaggagtcagaaaggattgagaaggaaattgctgaactcaaggaaatgaagaaaaagatcagcacaatgacagcagatgagtactttgagaagcaccccgaagtcaagcagaagtttgacgatgaaatccgtaacgactactggggatattgaagagcagaagagaacttttagatgccatttccatgtttgtgaaggaccaataatttttccgtgccctgatatgtataggggaagccagccaatctcaaacttggtggtttccgtaacatttgaatggggcatagtggaatgcctacagaacagactgaagctttctagaaattccgtctaaacacattttgcttaacctcaccattttcttgaggattgtcggctgtctttc

SEQ ID NO: 6118 - DNA, 741 bp, Cynodon dactylon
cgggggaggcaacgcggatcggagcagctcatcggcggccggcggcgcggaggagagcggagggagcaagatgagcgggaaggtgaagaaggtggcggacgcggcggcgaaggccggcaggacgatcgactgggacggcatggccaagatgctcgtctccgatgaggcccgcaaggagttcgccacgctccgccgcaccttcgaggacgtcaaccaccagctccagaccaagtactcgcaggaacccgagccaattgactgggagtactacaaaaagggaattggatcaaaagttgttgatatgtacaaggaggcctatgaaagcatagagatccctaagtacgttgacactgtcactcctcagtacaaaccaaagtttgatgccctggtggtcgagctgaaggatgcggaaaaggcatcactaaaggaatcagagaggatagagaaggagattgctgaaatgaaggagatgaagcaaaagatcagcacgatgacagcggatgagtattttgagaagcatcctgaactcaaacagaagtttgatgatgagatccgcaatgactactgggggtactaaggattagcgaatcttccatgttgtcctttgaatcgctcaataatgtttcttttgtatgccatccaagcttgatgatgatgaaaatcgtagcatgtagacagggcatgccaaagttctaacggaccttcagtttaaaacttctataatcttttaaacttactatc

SEQ ID NO: 6119 - DNA, 844 bp, Leymus cinereus x Leymus triticoides
  misc_feature (121)..(122): n is a, c, g, or t
  misc_feature (125)..(125): n is a, c, g, or t
  misc_feature (151)..(151): n is a, c, g, or t
  misc_feature (161)..(162): n is a, c, g, or t
  misc_feature (167)..(167): n is a, c, g, or t
  misc_feature (170)..(170): n is a, c, g, or t
  misc_feature (173)..(173): n is a, c, g, or t
  misc_feature (229)..(229): n is a, c, g, or t
  misc_feature (244)..(244): n is a, c, g, or t
  misc_feature (319)..(319): n is a, c, g, or t
  misc_feature (361)..(361): n is a, c, g, or t
  misc_feature (391)..(391): n is a, c, g, or t
  misc_feature (558)..(558): n is a, c, g, or t
  misc_feature (717)..(717): n is a, c, g, or t
  misc_feature (721)..(721): n is a, c, g, or t
  misc_feature (738)..(738): n is a, c, g, or t
  misc_feature (755)..(755): n is a, c, g, or t
  misc_feature (759)..(759): n is a, c, g, or t
  misc_feature (764)..(764): n is a, c, g, or t
  misc_feature (778)..(780): n is a, c, g, or t
  misc_feature (790)..(791): n is a, c, g, or t
  misc_feature (794)..(795): n is a, c, g, or t
  misc_feature (798)..(798): n is a, c, g, or t
caccaaaaagaacaaaagaaatagaaattgtcaccgttacacagtagcctcccagtctgaggtagatcggaggagaaaagcttagcggcggcgcggcgttgcaagagagtgacctgacgtnnagnagatccgagcagaaccgaagatgagnggggtgaagnnggtgncgnacnttgcggccaaggccgggaaggcgatcgactgggacggcatggcgaagatgctcgtntccgaggaggcccgnaaggagttcgccaacctccgccgcaccttcgaggacgtcaaccaccagctccagaccaagttctcccaggaaccncagccaattgactgggaatactacagaaaaggaatcggatcnaaagttgtggatatgtacaaggaggcttangatagcattgagatcccaaagtatgttgacactgtcactcctcagtacaagccaaagtttgatgctctgttagtcgaattgaaggaagcagagaagacatctctgaaggaatcagagaggatagagaaggagattgctgaaatgaaggagatgaagaaaaagatcancacaatgacagcagacgagtactttgagaagcaccctgaactcaaaaagaagttcgatgatgagatccgtaacgattactggggatactagataacaacgaaagtccaagttcctttactggaacattcattaatacttctttgtcccgatatacatangaanttcatcatccaaacttnggtgaattccataacangtgnatggncttgttgaaattcnnncataactctnntcnntgnactttctgttggacctcatcattttaagtttcaccagcttatttca

SEQ ID NO: 6120 - DNA, 1021 bp, Oryza sativa
cacgcgagcggcagagaggccaggcaaatccccatcccgtggctcgatctccctatttctctctcccgtgtggtcggagctcactgcagcggcggcggcggcggcgaacgaggggggagagagagaggtcgaggtagagaggaaagggagaggagggcggaggaagatgagcgggaacggcgtgaagaaggtggcggaggtggccgcgaaggccgggaaggcgatcgactgggaggggatggccaagatgctcgtctccgacgaggcgcgcaaggagttcaacaccctccgccgcaccttcgaggacgtcaaccaccagctccagaccaagttctctcaggagccccaaccgattgactgggagtactacagaaaaggaattgggtctaaagttgtagatatgtacaaggaagcttatgaaagcattgaaatccccaagtacgttgacaccgtgactcctcagtacaagccaaagtttgatgcgctgcttgttgagctgaaagaagcagaaaaggagtctctgaaggagtcagagaggatagagaaggagcttgctgaattgcaggagatgaagaaaaatatcagcacaatgacagcagatgaatactttgcaaagcatcctgaggtcaagcagaagttcgatgatgaaatccgtaacgacaactggggctactgaagagtggaggaactctttgtttccctttcttggaagagttaataattttgtcttgtgtcccagagtgtatgtataggggaatccactatcgcaacaatggtggtttccataccatgtggatggggcctgtttaaactcccaaactgattctaccatgtcgtccgtgctgcagttccaactgaatttgcttgtgttggacctcttcattttctagagggttgacccttaagaagtttatgttttattgtttttgtgttcatctccgttctacatgaataaagatgatcaattgttgaaagattatgttgatctctataatgccgagataatttgtgtatttatgta

SEQ ID NO: 6121 - DNA, 977 bp, Panicum virgatum
accaccaccatacccatttcctcgtgcggtcggagcgcagcgcggcggcggcagcgggagaggggagcaggcggaagggaggaggcagcggcgggccggcgaagatgagcggcagcggcgcgaagaaggtggccgatgtggcggtgaaggccggcaaggcgatcgactgggacggcatggccaagatgctcgtctccgaggaggcgcgcaaggagttcgccacccttcgccgcaccttcgaggacgtcaaccaccagctccagaccaagttctcccaggaaccccaaccgattgattgggagtactacagaaaaggaattggatctaaagtggtcgatatgtacaaagaggcttatgaaagcatcgagatccccaagttcgttgacactgtgactcccgagtacaagccaaagtttgacgcactggttgttgaactgaaggaggctgagaaagcatctctgaaggagtcagaaaggatagagaaggaaattgctgaactcagggaaatgaagaaaaagatcagcaccatgacagcggatgaatactttgagaagcaccctgaagtcaagcagaagtttgacgatgaaatccgtaacgactactggggatattgaagagcagatcagaacacttatctggccatttccatgtctgtgaagaaccaataatttttccgtgccccgatatgtataggggaaatccaccatctcaaatctggtggtttccgtgacatgtgcatggggcctggtggaatgcctacagaatcgactgtttcaagctttcttgaaattccatctaaacacattttgtttgacctcatcattttcttgaggattgtcggttgtcttataaagattatgttatgccgttagcaccttttttctacttgaataagaggattctcaattctgcagactttttgttcctccactggccttcactgacttgttatcttattagttcgaatgcttgaatgc

SEQ ID NO: 6122 - DNA, 920 bp, Panicum virgatum
caccaccatacccatttcctcgtgcggtcggagcgcagcgcggcggcggcagcgggagaggggagccaccggcggaagggaggaggcagcggcggggccggcgaagatgagcggcagcggcgcgaagaaggtggccgatgtggcggtgaaggccggcaaggcgatcgactgggacggcatggccaagatgctcgtctccgaggaggcgcgcaaggagttcgccaccctccgccgcaccttcgaggacgtcaaccaccagctccagaccaagttctcccaggaaccccaaccgattgattgggagtactacagaaaaggaattggatctaaagtggtcgatatgtacaaagaggcttatgacagcatcgagatccccaagtacgttgacaccgtcactcccgagtacaagccaaagtttgacgctctggttgttgaactgaaggaggctgagaaagcatctctgaaggagtcagaaaggttagagaaggaaattgctgaactcagggaaatgaagaaaaagatcagcaccatgacagcggatgaatactttgagaagcaccctgaagtcaagcagaagtttgatgatgaaatccgtaatgactactggggatattgaagagcagaacagaactcttatctgtccatttccttgtctgtgaagaaccaataatttttccgtgccccgatatgtataggggaaatcaaccatctcaaatctggtggtttccgtgacatgtgcatggggcttggtggaatgcctacagaatcgactgtgtcaagctttcttgaaattccatctaaacacattttgtttgaccttcatcattttcttgaggactgtcggttgtcttataaagattatgttatgtccttagctcctttttttttcctacttgaataagagggttctcaattatgca

SEQ ID NO: 6123 - DNA, 1006 bp, Brachypodium distachyon
aaaaaaaagttgcaaaaaacaagagcaaaccctcctaggcacacacgaccctccgttccgtttccccatttcgtttgtgcggtcggagcgcggcgccggcgaaagcgaggtgagagatcagagagcgacagagcggaaggctgcacggcgtgggggagacgacaggtcggcgaagatgagcgggagtgggaagaaggtcgctgatttggccgtgaaggccgggaaggccatcgactgggacggcatggccaagatgctcgtctccgaggaggcgcgcaaggagtttgccaccctccgccgcaccttcgaggacgtcaacaaccagctccagaccaagttctcgcaggaacccaaaccgattgactgggagtactacagaaaaggaattggagctaaagtggttgacatgtacaaggaggcttatgacagcattgagatccccaagtatgttgacactgtgactcctgaatacaaaccaaagtttgatgctctactggttgaactaaaagaagcagagcaaatgtctctgaaggagtcagagaggatagagaaggagattgctgaacttagggagatgaagaaaaagatcagcacaatgacagccgatgaatactttgcaaagcatcctgaactcaagcagaagttcgacgatgaaatccgtaatgataactggggatactgaagcaccagactccagtttccttttcttggaagaaccaataatttgctgtgtcccagtgtgtacagatgaatttcactttccaaatgtcggtggttccatgacatgtgagatggctcctgttgaaattccagctagctatggtgtttttttgttgttgcaattcaaatgcaaatcggctgctttggacctcactgttttggaggctgttgttttgtcaggcaaagaacatgctttctgatctttctactttcaataaaaggatttctgctgacttattaaccctcctgtacattttgggtgcgtttggttgtctgcctaggggtg

SEQ ID NO: 6124 - DNA, 917 bp, Brachypodium distachyon
acacacgaccctccgttccgtttccccatttcgtttgtgcggtcggagcgcggcgccggcgaaagcgaggtgagagatcagagagcgacagagcggaaggctgcacggcgtgggggagacgacaggtcggcgaagatgagcgggagtgggaagaaggtcgctgatttggccgtgaaggccgggaaggccatcgactgggacggcatggccaagatgctcgtctccgaggaggcgcgcaaggagtttgccaccctccgccgcaccttcgaggacgtcaacaaccagctccagaccaagttctcgcaggaacccaaaccgattgactgggagtactacagaaaaggaattggagctaaagtggttgacatgtacaaggaggcttatgacagcattgagatccccaagtatgttgacactgtgactcctgaatacaaaccaaagtttgatgctctactggttgaactaaaagaagcagagcaaatgtctctgaaggagtcagagaggatagagaaggagattgctgaacttagggagatgaagaaaaagatcagcacaatgacagccgatgaatactttgcaaagcatcctgaactcaagcagaagttcgacgatgaaatccgtaatgataactggggatactgaagcaccagactccagtttccttttcttggaagaaccaataatttgctgtgtcccagtgtgtacagatgaatttcactttccaaatgtcggtggttccatgacatgtgagatggctcctgttgaaattccagctagctatggtgtttttttgttgttgcaattcaaatgcaaatcggctgctttggacctcactgttttggaggctgttgttttgtcaggcaaagaacatgctttctgatctttctactttcaataaaaggatttctgctgactta

SEQ ID NO: 6125 - DNA, 822 bp, Avena sativa
ccactcgcttcctaatctgagtagtagatcggaggagaaggcttaacggcggcggcgcgacgttgcagagagagtgaccaggcgggaatagatccgagaagagccgaagatgagcggtgcgaagaaggtgacggaccttgcggccaaggccgggaaggcgatcgactgggacggcatggctaaggtgctcgtctccgaggaggcccggaaggaattcgccaacctccgccgcaccttcgaggacatcaaccaccagctccagaccaagtactcccaggagccacaaccaattgactgggagtactacagaaaaggaatcggagcgaaagttgtggatatgtacaaggaggcctatgatagtattgagatccccaagtatgttgacactgtcactcccgagtacaagccaaagtttgatgctctgttagttgaattgaaggaagcagagaaggcatccctgaaggaatcggagaggatagagaaagagattgctgaaatgaaggagatgaagaaaaggatcagcacaatgacagcagacgagtactttgagaagcaccctgaactgaggaagaagttcgatgatgagatccgtaacgattactggggatactagataacggcttaactccctgttcctttactggaacattcaataatacttatttgtcctgatatacgtacggaatttcagcatccgaacttcggtgaattccttaatatatatggacggggcttgttgaaacataactctgctcttttgtaccttttgttggacctcatcattttgaggcttcatcagcttgtttgaatgaaaatttatct

SEQ ID NO: 6126 - DNA, 711 bp, Avena sativa
gcggtgtgaagaaggtgacggaccttgcggccaaggccgggaaggcgatcgactgggatggcatggctaaggtgctcgtctccgaggaggcccggaaggagttcgccaacctccgccgcaccttcgaagacatcaaccaccagctccagaccaagtactcccaggagccacagccaattgactgggagtactacagaaaaggaatcggagcgaaagttgtggatatgtacaaggaggcttacgatagtattgagatccccaagtatgttgacactgtcactcctgagtacaagccaaagtttgatgctctgttagttgaattgaaggaagcagagaaggcatctctgaaggaatcagagaggatagagaaagagattgctgaaatgaaggagatgaagaaaaagatcagcacaatgacagcagacgagtactttgagaagcaccctgaactcaggaagaagttcgatgatgagatccgtaacgattactggggatactagataacagcgaaaccccctgttcctttactggaagattcaataatacttgtttgtcctgatatacgtacggaattacatcatccaaactttggtaaactccttgacatgtggacagggcttgttgaaacataactctgctcttttgtaccttttgttggacctgatcattttgaggcttcatcagcttgtttgaatgaaaatatatcttgtg

SEQ ID NO: 6127 - DNA, 994 bp, Brachypodium distachyon
caaaatcgaatcaccattacccattggcttcctaatctgaggtaagaacggaggagaaatcttagcggcggcggcgcggcctcgaagagagagtgaccagacgggaaggagatccgagcaaagccgaagatgagcgggacggtgaagaaggtggcggacgccgcgtccaaggccgggaaggcgatcgactgggacggcatggcgaagatgctcgtctccgaggaggcccgcaaggagttcgccaacctccgccgcaccttcgaggacgtcaacaaccagctccagaccaagttctcccaggagccaaagccaattgactgggacatgtacagaaaaggaatcggatcgaaagttgtggatatgtacaaggaggcttatgatagtatcgagatccccaagtatgttgacactgtcactcctgagtacaagcctaagttcgatgctctgttagtcgaattgaaggaagcagaacagacatctctgaaggaatcagagaggatagagaaggagattgctgaaatgaaggagatgaagaaaaagatcagcacaatgacagcagacgagtactttgagaagcaccctgaactcaggaagaagttcgatgatgagatccgtaacgataactggggatactagataatggcgaaactcccagctcctttactggaatatttaataatacttctttgtcctgatacacatcgaaggttcaccatcaaacttcggtgaattccataacatgcggacagggcttgttgaaattccaacattactctgctttttgtaccttccattactcgttttgaggctcatcagctcattcttatgaatttttgtctcgctgttggttctgccatggcttgattcctccatgtaccttgtgattggttgatgtgctcttactcccaggcacagatctttgagattggcctcacatttccctgctacatccatcttacctttaggaaaagcatccaaaggtttaagggtgact

SEQ ID NO: 6128 - DNA, 1016 bp, Brachypodium distachyon
caccagaaaaaacaaaagaaaacaaaatcgaatcaccattacccattggcttcctaatctgaggtaagaacggaggagaaatcttagcggcggcggcgcggcctcgaagagagagtgaccagacgggaaggagatccgagcaaagccgaagatgagcgggacggtgaagaaggtggcggacgccgcgtccaaggccgggaaggcgatcgactgggacggcatggcgaagatgctcgtctccgaggaggcccgcaaggagttcgccaacctccgccgcaccttcgaggacgtcaacaaccagctccagaccaagttctcccaggagccaaagccaattgactgggacatgtacagaaaaggaatcggatcgaaagttgtggatatgtacaaggaggcttatgatagtatcgagatccccaagtatgttgacactgtcactcctgagtacaagcctaagttcgatgctctgttagtcgaattgaaggaagcagaacagacatctctgaaggaatcagagaggatagagaaggagattgctgaaatgaaggagatgaagaaaaagatcagcacaatgacagcagacgagtactttgagaagcaccctgaactcaggaagaagttcgatgatgagatccgtaacgataactggggatactagataatggcgaaactcccagctcctttactggaatatttaataatacttctttgtcctgatacacatcgaaggttcaccatcaaacttcggtgaattccataacatgcggacagggcttgttgaaattccaacattactctgctttttgtaccttccattactcgttttgaggctcatcagctcattcttatgaatttttgtctcgctgttggttctgccatggcttgattcctccatgtaccttgtgattggttgatgtgctcttactcccaggcacagatctttgagattggcctcacatttccctgctacatccatcttacctttaggaaaagcatccaaaggtttaagggtgact

SEQ ID NO: 6129 - DNA, 970 bp, Cenchrus ciliaris
  misc_feature (316)..(316): n is a, c, g, or t
  misc_feature (318)..(318): n is a, c, g, or t
  misc_feature (507)..(507): n is a, c, g, or t
  misc_feature (542)..(542): n is a, c, g, or t
  misc_feature (622)..(622): n is a, c, g, or t
cccatttccttgtgtgcggtcggagcgcggcgcggcggcggcggcgacaagagagaggaggggagccggcgggacccaggaaggcttgaggggaggagcaagcggcgtgccggggaagatgagcggcaacgggaagaaggtggccgacgtggcggtcaaggccggcaaggcgatcgactgggacggcatggccaagatgctcgtctccgaggacgcgcgcagggagttcgccaccctccgccgcaccttcgaggacgtcaaccaccagctccagaccaagttctcccaggaaccccaaccgattgattgggagtantncaggaaaggaattggatctaaggtggtggatatgtacaaggaggcttatgaaagcatcgagatccccaagtatgttgacaccgttactcctgagtacaagccaaagtttgatgctctggttgttgaactgaaggaggctgagaaagcatctctgaaggagtcagaaaggattgagaaggaaattgctgnactcagggaaatgaagaaaaagatcagcacaatgncagcagatgagtactttgagaagcaccctgaagtcaagcagaagtttgacgatgaaatccgtaacgactactggggatantgaagagcagaaaacttttagctgccatttccatgtttgtgaagaatcaataatttttccgtgccctgatatgtataggggaaaccagccgtctcaaacctggtggtttctgtaacatgtgcatggggcttggttgaatgcccgcagaacagactgtgtgaagctttcttgaaattccatctaaacacattttgtttaacctcaccattttcttgaggattgtcggctgttttgcaaagattatgtcatgtccttagctccttttttctacttgaataagaggattctacagactttgtttcccccacttgccttcagtgacagttttagttcgaattcttgaatgca

SEQ ID NO: 6130 - DNA, 1017 bp, Cynodon dactylon
gcgcacctggccactccccgtccgtccacggttcacccccattccattcctcgaccggtcggagcgcggcggcggcggctgaggcgagagagggcacccccgaaagcatttgcgctcgaggagagagaggccggcgaagatgagcgggagcggcgcgaagaaggtggccgacgtggcgatcaaggccggcaggacgatcgactgggacggcatggccaagatgctcgtctccgaggaggcgcgcaaggagttcgccacgctccgccgcgccttcgaggacgtcaaccaccagctgcagaccaagttctcccaggaacctgaaccaattgactgggagtactacagaaaagggattggatccaaagtggtggatatgtacaaagaggcatatgaaagcattgagatccccaagtatgttgacaccgttactcctcagtttaagccaaagttcgatgctctggttgttgaactgaaagatgcggagaaagcgtctcttaaggagtcagagaggatagagaaggagattgctgaactcagggaaatgaagaaaaagatcagcacgatgacagcagatgagtactttgagaagcaccctgaagtcaagcagaagttcgatgatgaaatccgtaatgactactggggatactgaagaccagaccagaacttttatctggccattttcctgtctgtcaagatccaataatttttctttgccccaatatgtataggggaagcccagtatctcaactttggtggtttccgaaacatgtggatggggcttgttgaaattccaacagaaccagctgccgagtgtattgagattccaaccaaacactttcttcgacttccgtcaatttcttgaggattttcagttttgtcttgtgaagatgttccgtccttttagctccttttgacttgaataagaggatttctgcatacttactccacggatcctgtggcttctattctaaatgcttgaatgttgatgtgtgtacgactgatggttgtgcttgtttg

SEQ ID NO: 6131 - DNA, 561 bp, Secale cereale
  misc_feature (17)..(18): n is a, c, g, or t
  misc_feature (20)..(20): n is a, c, g, or t
  misc_feature (40)..(40): n is a, c, g, or t
  misc_feature (82)..(82): n is a, c, g, or t
ccacgcgtccgctccgnncngaactcctgaaacaatcaanagtcacacagccctagcaagtttagcagatccagaggcgaanatgagcggggtgaagaaggtgaccgacgtcgcggccaaggccggcaaggcgatcgactgggacggcctggcgaagatgctcgtctccgaggaggcccggaaggagttcgccaacctccgccgcaccttcgaggacgtcaaccaccagctccagaccaagttctcccaggaaccaaagccaattgactgggaatactacagaaaaggaatcggatcgaaagttgtggatatgtacaaggaggcttatgatagcattgagatcccaaagtatgttgacactgtcactcctgagtacaagccaaagtttgatgctctgttaatcgaaatgaaggaagcagagaagacatctctgaaggaatcagagaggatagagaaggagattgctgaaatgaaagagatgaagaaaaagatcagcacaatgacagcagacgagtactttgcgaagcaccctgaactcaagaagaagtttgatgatgagat

SEQ ID NO: 6132 - DNA, 952 bp, Festuca arundinacea
  misc_feature (83)..(83): n is a, c, g, or t
  misc_feature (97)..(97): n is a, c, g, or t
ggcacgagggaggtagtagatcggaggagaagacttagcggcggcggcgcggcgttgcagagagaggtgaccaggcgaggagngggagatccgagcngagccgaagatgagcggtgtcaagaaggtgacggaccttgcggccaaggccggcaaggcgatcgactgggacggcatggctaagatgcttgtctccgaggaggcccggaaggagttcgccaacctccgccgcaccttcgaggacgtcaaccaccagctccagaccaagtactcccaggagccacaaccaattgactgggagtactacagaaaaggaatcggagcgaaagtggtggatatgtacaagcaggcttatgatagtattgagatccccaagtttgttgacactgtcactcctgagtacaagccaaagtttgatgccctggtagttgaattgaaggaagcagagaagacatctctgaaggaatcagagaggatagacaaagagattgctgaactgagggagatgaagaaaaagatcagcacaatgacagcagacgaatactttgagaagcaccctgaactcaagaagaagtttgatgatgagatccgtaacgattactggggatactagataacggcgaaactccctgttcctatactggaacattcaataatacttgtttgccctgatgtatggacggaatttcatcatccaagcttgggtgaattcctttttagcatgtgaacggggcttgttgaaactcaacataactctgctcttttgaaccttttgttgaacctcatcattttgaggctcatcagcttatttgaatgaagttttgttttgtgcttagcttttccttctccctctgttcctaataaggcctataactttttttggaagtcaaacactgtaaagcttgaccaagtttcaagaaaatactatcaacatatataatgctatataggtatc

SEQ ID NO: 6133 - DNA, 628 bp, Eragrostis curvula
agctggagctcacgcggtggcggccgcgggggcggcggcggcggcggacgagagagaggacgcttttcggatcgaggagataggaggccggcgaagatgagcgggagcggctcgaagaaggtggccgacgtggcgatcaaggccggcaaggcgatcgactgggacggcttgggcaagatgctcgtctccgaggaggcgcgcaaggagttcgccaccctccgccgcgccttcgaggacgtcaaccaccagttgcagaccaagttctcgcaggaacctcaaccaatcgactgggagtattacagaaaaggaattggatccaatgtggtggacatgtacaaagaggcatatggaagcattaagatccccaagtatgttgatactgttactcccgagtacaagccgaagtttgaagctctggttgctgaaatgaaagaggctaagaaagcatctctgaaggagtcagagaggatagagaaggagattgctgaactaagggaaatgaagaaaaagatcagcacaatgactgcggatgagtactttgagaagcaccctgaagtcaagaagaagtttgatgatgaaatccggaacgactactggggatactgaagagcagaacagaacttttatt

SEQ ID NO: 6134 - DNA, 1287 bp, Musa acuminata
atcatctaataggtaaacattctgggtgatcttattctcctatttttagagaaaggccgccgtctcattggcttccgcttccccatttgcgatcggtgtcaagggcgataaaggagagccggcgccgccttgggtgagagacagaggagaggcaaagaggagggcgaagatgagcggaaacggggtgaagaaggtggcggaagtggccgcaaaggcgactaagtcgatcgattgggacggcatggcgaaggccctcgtctccgacgaggcccgcaaggagttcgccaacctccgccgcgccttcgacgaggtcaacagccaactccagaccaaattctcccaggaacctgaacctattgactgggaatattacaggaaaggaattgggtcgcgcttggtggatatgtataaagaggcttatgaaagcatagagatccccaagtatgttgacacggtgactcctgaatacaagcccaaatttgatgccttgctggttgagttaaaagaagcagaaaaacaatcattgaaggaatcagcacgattggagaaagaaattgctgaagttcaggagatgaagaaaaaaataagcacaatgacagctgatgagtattttgagaaccatcctgagctcaagcagaagtttgatgatgaaattcgaaatgataattggggatattgatgtcagggaggtttccttcagttgctgggaacgtcatgggaattttaataaatatatcttggtgccctgtacattggaatggaaccaatgtgagcaggtgatatgttttttgtccttgaaattggaaatttctcattgatgttgtactttcatcctactctttggggtctcggtttaataattgccttcattttgttggtcattagccaataactttgttcgatggttctctttagacaaatgggatcatctgcccacaagcatggtgagctattattctctcttgtctaatatttggccaccttgatgaacaaaaaaagttcatatacttgcatgggtagacaaaccatcgtagggtgtttgctgtgttgggtcttttagaaactgcagttatgataccaaattctcgcagattgcctcaagtgctcgaatggacatcaattctttagggtgccaacttaccgtgttttcaaagttgttatttttagttttatattgttagctctctcttgttttatatatctgcaatcaagttttcatgctctgcaacaatatcagaaaaattggtttgcgttcaggtttttgacactgattgatcgaaacggggt

SEQ ID NO: 6135 - DNA, 831 bp, Musa acuminata
ggggtgagagacagaggagaggcaaagaagagggcgaagatgagcggaaacggggtgaagaaggtggcggaagtggccgcaaaggcgaccaagtcgatcgattgggacggcatggcgaagctcatcgtctccgacgaggcccgcaaggagttcgccaacctccgccgcgccttcgacgaggtcaacagccaactccagaccaaattctcccaggaacctgaacctattgactgggaatattacaggaaaggaattgggtcgcgcttggtggatatgtataaacaggcttatgaaagcatagagatccccaagtatgttgacaccgtgactcctgaatacaagcccaaatttgatgccttgctggttgagttaaaagaagcagaaaaacaatcattgaaggaatcagcacgattggagaaagaaattgctgaagttcgggagatgaagaaaaaaataagcacaatgacagctgatgagtattttgagaagcatcctgagctcaagcagaagtttgatgatgaaattcgaaatgataattggggatattgatgtcagagaggtttccttcagttgctgggaacgtcatgggaattttaataaatatatcttggtgccctgtacattggaatggtaccaatgtgagcaggtgatatgttttttgtccttgaaattggaaatttctcattgatgttgtactttcatcctactctttgggatctcggtttaataattgccttcattttgttggtcattagccaataactttgttcgatggttctctttagacaaatgggatcatctgcccacaagcatggtgagctattattctct

SEQ ID NO: 6136 - DNA, 733 bp, Musa acuminata
gacgaagagcgagggaagagacaggagaggtgctttcgcctttggaaagaggagagtcggtggaggagcacgaggatgagcgggaacggggtgaagaaggtggcggaggtggccgcgaaggcgaccaagtcgatcgattgggacggcatggctaagctcctcgtctccgatgaggcccgcaaagagttcgctaaccttcgccgctccttcgacgacgtcaatcaccaactgcagactaagttctcccaggaacctgaacctattgactgggaatattaccgaaaaggaattgggtcgcgcttggtggatatgtacaaacaggcttatgaaagtgtagaaatccccaagtatgttgacactgtgactccagaatacaaacccaaatttgatgccctgctggttgagttaaaagaagcagaaaagcaatctttggcggaatcagcacggctggagaaagaaatagctgaagttcaggagatgaagcaaaaaataagcacaatgacagcggatgaatattttgagaggcatcccgagctgaagcagaagtttgatgatgagattcgaaatgattactggggatattgagtatccggtatctttctttcagtgactggggcacgtcttgggatttctaataaatctatccatcctcggttttcctgtacattggaaaggtaccaatttgagcagtgatatgccaactgtcatcgatgttgtgcttcatcgttcagtt

SEQ ID NO: 6137 - DNA, 921 bp, Avena sativa
gaatttatttctcttgtgcggtccgagtacagcgcggcggtggcggcgaagcgagcggacagagacaggcagaaggtaggggaacggtgctgaggccacagatcggcgaagatgagcgggaagaaggtcgccgaggtggccgtgaaagctgggagggcgatcgactgggacggcatggccaagatgctcgtctccgaggagtcgcgcaaggagttcgccaccctccgccgcactttcgaggacctcaaccaccagctccagaccaagtactcgcaggaacctcaaccaattgactgggagtactacagaaaagggattggatctaaagtggttgatatgtacaaagaagcttgtgacagcattgagatccccaagtttgtcgacactgtgactcctgaatacaagccaaagtttgatgctctagtggctgaactgaaagaggcagagcaaatctctctgaaagagtctgagaggatagagaaggagatcgctgaactcaaggaaatgaagaaaaagattagcacaatgacagccgatgaatactttgagaagcatcctgagctcaggcagaagtttgatgatgaaatccgtaacgattactggggatattgaaacacaccccaactttctttttctttgaagaaccaataatttgctgtgtctcagtatgtaaaaatgaatttcagtttctgaaagttgctggttggtcccatgacatgtagatgagacgcactgtaatctgagctggtttgaactgaatcggctgtgctggacatcgccattttgaaggctgtcattatacctggcaacaatgttctctgtttagttcctttcaacttgcataagaggacttccacagatttattacctcattctgtagttccacagcttattattttctgggtattgatgttttcctct

SEQ ID NO: 6138 - DNA, 1004 bp, Musa acuminata
ccatttctgaccgttcgatcatcagatagccaacgttcagggtgatcccttgtggtcgagaaggccgccatcccattgtcttccgccttgccccatcggtgatcggtacgaagagcgagggaagagacaggagaggcgctttcgcctttggaaagaggagagtcggtggaggagtacgaggatgagcgggaacggggtgaagaaggtggcggaggtggccgcgaaggcgaccaagtcgatcgattgggacggcatggctaaggtcctcgtctccgatgaggcccgtaaagagttcgctaaccttcgccgctccttcgacgaggtcaatcaccaactgcagaccaagttctcccaggaacctgaacctattgactgggaatattaccgaaaaggaattgggtcgcgcttggtggatatgtacaaacaggcttatgaaagtgtagaaatccccaagtatgttgacactgtgactccagaatacaaacccaaatttgatgccctgctggttgagttaaaagaagcagaaaagaaatctttggcggaatcagcacggctggagaaagaaatagctgaaattcaggagatgaagcaaaaaataagcacaatgacagcggatgaatattttgagagccatcccgaggtgaagcagaagtttgatgatgagattcgaaatgattactggggatattgagtatccggcatctttctttcagtgactgggcacgtcttgggatttctaataaatctatctgtcctcagtttccctgtacattggaaaggtaccaatttgagcaggtgatttgccaaactgtcatcgatgttgtgcttcatcgttctgtttaatttttgcccttgtttcttttccttactattagccaataaccttgttctgtggctctctttagacaaacgagatctacatgcaagcagttttttatgcaccgatcaaccaaatttcccatgattcactgtcatttccagttccatatccataattttttatt

SEQ ID NO: 6139 - DNA, 943 bp, Elaeis guineensis
cgtttctccggctcgcccctgccctcaagtttggaagagtttgcggaagagaagaagcgacgccgccttcgagagtagagcgtgatcctaaccctaaccacctccctcaaaaaaaaggaagagaggatgagcgggagcgggacgaagaaggtggtggaggcggcagcgaaggccaccaagtcgatcgattgggacggcatggcgaagctcctcgtctccgaggaggcccgcaaggagttcgtcaacctccggcgcgcctttgacgacgtcaaccacaccctccagaccaagttcagccaggagcctgaacccattgactgggaatattatagaaaaggaatcgggtctcgcttggtggatatgtataaagaggcttatgagggcatagagatccccaagtatgttgacactgtgactccagaatataaacccaagtttgatgctctgttggtggagttgaaagaagctgaggagaagtctgtaaaggagtcagaaaggttggagaaggaaattgctgaggttcaagagatgaagaagaagattagcaccatgacagcagacgagtatttcgagaagcaccctgagctgaagaagaagtttgatgacgaaatccgtaatgactactggggatattgaacatcaaaggtcatttagcagttaaatgcctttctcgtgattgccaattaaataatattgtctttccttgtatctggaaagctaccaatctttgctggtggtttattaaatttatcattgtttaagagttggaatttaacattatcatccatttacatctgtatctgttccgagagaccttatttttgcttctgaatgcaagccaactttcctatgccataggcccgtttggtctgataggcttatttgcatggttgcaaccttttcctgtatattattttattctcagagcattatgaacaatcat

SEQ ID NO: 6140 - DNA, 1213 bp, Zea mays
atggcaaacatcgctacttgcagcccacgagcgcaaccgggctacagggccaccctcacaaacacgccctttatttctctgctttccgtggaaggaatgctccgtccgacccattgcttgctttcacggctttctagcagacttgagatttctgtcgccgaaagaacaaaacaggcttcaggcgtggcatacagcccaacccaacaatcttcagacgcggactgtttcagcccatcgaacaaggtgtccttccttcttcacgggccacggcctgttctaactcaccaaatactcctctctccacttaacgagcaccaccagttccttgttcggtcggaacgcagcgcagcggcggcggcgatagggagagaggagagagtctgcaggatccagcaggccgagggaggagtcagcggcgggccggagaatatgagcggcaacggcgcgaagaaggtggtcgatgcggcggtgaaggccggcaggacgatcatcgactgggacggcatggccaagttgctcgtcaccgacgaggcgcgcaaggagttcgccgccctccgccgcgctttcgatgacgtcaaccaccagctccagaccaagttctcccaggaaccccagccgattgattgggagtactacagaaaaggaattggatcaaaagtggtggatatgtacaaagaggcttttgaaagcatcgagatcccgaagtacgtcgacacagttactccccagtacaagccaaagtttgatgctgtgattgctgaattaaaggaggctgagaaagagcatcagaaggagtcagaaaggatagagaaggaacttgctgaaatggaggaaatgaggaaaaagatcagtacaatgacagcagatgattactttgagaagtaccctgaactcaggaagaagtttgacgatgaaatccgtaacgataactggggatattgaagagattggagagaactcttatgatgccatttccatgtccgtgaagaaccaataattttcctgtgccctgaattgggtggtttccatagcatgtgcacggggtttgggtggaatgcctacagaatcgactgtgtcaagctttcttgattccgtagaaacatgttttgtttgacctcatcatagaggatctccgcttttatcgtacaaagattgtgatatgttcttagcttctttctacctgaataagaggatttctgcagacccttttcca

SEQ ID NO: 6141 - DNA, 904 bp, Elaeis guineensis
aaaagcgacgccgccttcgggaagagggatagagtgagaaccctaacccccagaaaaaggaagcgacgatgagcgggagcgggacgaagaaggtggtggaggcggccgcgaaggccaccaagtcgatcgattgggacggcatggcgaagctcctcgtctccgaggaggcccgcaaggagttcgccaacctccgccgctctttcgacgaagtcaaccacgccctacagactaagttcagccaggaacccgaacccattgactgggaatattacagaaaaggaattggatctcgcttggtggatatgtataaagaggcttatgagagcatagaggtccctaagtacgttgacaatgtgactccagagtacaagcccaagtttgatgctttgttggtggagttgaaagaagcagaacagaagtctctgaaggattcagaaaggttggagaaggaaattgctgaggttcaagagatgaagaagaagattagcaccatgaccgcagatgagtatttcgagaagcaccctgagctcaagaaaaagtttgacgacgaaatccgtaatgactactggggatactgaacgatagatcatttggctgttcaatgctttcttgtgactgaacaataaagaacaagcaccctgagctcaaggataatgcggtttttccttgtactttagcaggtatcagtatttgctggtgttttgttaaatttatcgttgttgagagttggaactaggtgttatcacctgattacactacgtcttctgaggggggccttgctgttgaaccgttacaccttgtcgattgtggcaaggccgcaaggtgcaggtttcgtgtaaagagcattacgccaataaatatgaaatctcggttcggcaaaaaaaaactaaacgtagacgtacgt

SEQ ID NO: 6142 - DNA, 776 bp, Eragrostis curvula
  misc_feature (775)..(776): n is a, c, g, or t
aaaaaaggagaaaaaaagaaggaaaaggaaagagaaaagggtaaggaacactgacaggcatccgtctaggtttacccccattcctcgagcggtcggagcgcggcggcggcggcggacgagagagaggacccgggaggctcgaggagagaggaggccggcgaagatgagtggaaatggcaagaaggtggctgacgtggcgatcaaggccggcaaggcgatcgactgggacggcctggccaagatgctcgtctccgaggaggcgcgcaaggagttcgccaccctccgccgcaccttcgaagacgtcaaccaccagctgcagaccaaattctcgcaggagccacaaccgattgactgggagtactacaaaaaaggaattggatccaaagtggtggatatgtacaaagaggcctatgaaagcattgagatccccaaagtatgtcgatactgttactcccgagtacaagccgaagtttgatgctctggttgttgaaatgaaagaggaagagaacgcatctctgaaggagtcagagaggatagagaaagagattgctgaactaagggaagtgaagaaaaagatcagaacaatgaccgttgacaagacttgaaaaagaccatgagtcagaaaacgttgacaatgaatcaggaacaatactggggctactgaccacccgaaccaaagccttaatgagcaataccatggcctcacatagcacaaaataacctgtacacccaacagataaggaagacctgagaaacaaagtcacgcgattcccgnn

SEQ ID NO: 6143 - DNA, 928 bp, Phalaenopsis aphrodite
catggaagccctagttcatttctgtatatcggaaaacccactcgccgagataggagagagatcggagcagaaccttagataaagcgcgaggatgagcgggagcggggcgaagaaggtggtggagacggcagtgaaggcaactaaggcgatagactgggatggcatggcgaagttgctcgtctcggacgaggcgcggaaggagttcgccaatctccgccgtgccttcgacgacgtcaaccaacagctgcaaaccaagtttagtcaggagccggagcccattgattgggattattacagaaaaggaattggacctcgtgtggtcgatatgtataaggaagcttatgacagcgtagagatacccaagtttgttgacactgtgactccacaatacaaacccaagtttgatgctctgttggtagagctgaaagaagcagaacaggcatccctgaaggagagcgaaaggttggaaaaggaaatcgacgaggttcgagagttgaagcaaaaaatatcgaccatgactgctgaggaatacttccagaagcatccagaactcaagcaaaagttcgacgatgaaatccgtaatgactactgggggtatggcccaccacagtaaatttttattctccgtctcattttaccgattccatttacttcaataaaaatatctgtcgccatatgaaatgccttcagagtgttcttacttttattatctgattgtgcctatttgaacttaattgcaaaataattcctaaaacaattttttattttggcactagcagtagctgtttaatttttacatagaacgggctattttcttaatttcttcaacattgagcctattaagtgtttgggagaaaggaggtagggtttcaatgttttctcgacttcaactgggtgctttgggtttgttctttttattcaagtttag

SEQ ID NO: 6144 - DNA, 915 bp, Eucalyptus grandis
gagagagagagagagaagagccagcaagcggagaggagaggagagaggaggacgaagggtagagcctgcaacaacacattagaatccctaaaatctccgcatcttgccatcggcgggcgaaaccctaggagagagaaaggatgagcggtacggcgaagaaggtgaccgacgtggcgttcaaggcgtcgaagaaaatcgactgggacggcatggcgaagctgctcgtctccgacgaggcccgcaaggagttcgccaacctccgccgcgccttcagcgaggttaactcccagctcgagaccaagttcagtcaggaacctgaacctattgactgggaatattacagaaaaggaattgggcctcgcttggtggatatgtacaaagaagcttatgacagcatagagatccccaagtacgtggacacagtcacccctcaatacaagccaaagtttgatgcgctgttggtggaactgaaagaggcagaggggatgtccctcaaggagtccgagcgattggaaaaggaaattgcagatgtgcaagagttgaagaaaaagatcagcaccatgactgccgatgaatactttgaaaagcatcctgaactcaagaagaagttcgatgatgagattcgcaatgactactggggatattgatgaaaaaatgagcagatcagtgccagttggccagagttattgaagattgtgttctgcttgtttgatttaaaataaaattgagagaactctcttcttctgtacttcttgctttgggcttgaggaattatgacctctcattgacttcaatgtcggaaacttgaattttcatgtgaatcaatagatgttcgtttttcccaaaaaaaaacacacaaaaaaaaaaagaaaaaaggcgatatcatttcttatttctatccacggttcattgagt

SEQ ID NO: 6145 - DNA, 847 bp, Coffea canephora
gatagccatcattcttttgttagccgaggcgaaagggttatagacatcggcattgccgggtagaacaacatttccaatctctgcatttttttgtggctgaatcggagagaatcagtgagttatagtccgcgtcggtagtgtgtgaaagtgtgaaaaatgagcggagtggcgaagaagatagccgatgtgactttcaaggccgggaagacgatcgattgggaaggcatggcgaagctcgtcgtctccgatgaggctcgcaaggagttcgccaatctccgccgtacatttgacgaagtcaattcccagctgcaaactaaattcagccaggaaccagagcccatagactgggaattttacagaaaggggattggatctaaattggttgatatgtacaaagaggcatatgagagcgttgagattccaaaatacgttgatacggttacaccggagtacaagccgaaatttgatgctctgttggtggagctcaaagaagctgagcaacaatcactcaaagagtctgaaagactggagaaggaaattgctgaagttcaagagctgaagaagaaactcagtaccatgacagcagacgagtactttgagaagcacccagaactcaggaagaagtttgatgatgaaatccgcaacgactactggggatactagaattgattggagactcggcttctgcttaagctttttgacttcatccgtaggaataagaagaaaaacaaatgggcttattattacttgggcatttgaagaatgtctactgaagatgtattttgtactccaaaaagtggggttctccaactttagataatgcatctttcgtgcgattgctttctgg

SEQ ID NO: 6146 - DNA, 1054 bp, Gossypium hirsutum
caggcctattacaacacggatgtattcctcattttctctgcttcaacaacgattagccattccgtttcaaaagtaacgattagctaatcgtttccgttttatcctccccagccaaaatctgctgctccaccccaccctctccctcccaacatcaacagcagttttcttcgaaccaaatctccaccgtctcgcgtttgggaagcgagaaagtgcgagaaaaatgagcggaccggggaagaaagtcgttgatgtcgcgttcaaagcatcaaagaacattgattgggaagggatggctaagcttttggtctccgatgaggctcgcaaagagttcgctacttttcgtcgcacttttgatgaagttaactctactttacaaaccaaattcagccaggaacctgaacccattgactgggagtactatagaaaaggaattggctctcgcctggtagatatgtacaaagaggcatatgagagtgtagagatccccaagtttgttgacaccgtcactcctcaatacaaaccaaaatttgatgcattgcttgtagaattgaaagaggcagaggagaaatccttgaaagagtctgagcgattggagaaagaaattgccgaggttcaagaacttaagcaaaagatcagcaccatgaccgcagacgagtactttgagaaacatccagagcttaaaaagaaattcgatgatgagatccggaatgactactggggctattgacatctttgtgaatttaatggccaagcttttggtctcgactagaatttctgaaccgtttctgttgttttaacccctttttctcttgtgcggtgatctgggtcggaaaaattaggctgtaatgataagaaaataattgtgtgagaaaaatttatccaatcatttgagaaataaggtggatcttgtaagacatgcattctatttaccaggcatccgcagtcatactttcatggcaaaatttttactgcctgccctcttcattccattctgttttatgtttattatttgaatattatctagatacaattgaatttggacacctatttatct

SEQ ID NO: 6147 - DNA, 1149 bp, Gossypium raimondii
agagcgtgtttggttgggtgtattggattagccaatacacccctaatccgtgggccccactaatccccacttaatcccgtgtttggtttgatgtattgcctattacaggcctattacaacacggatgtattcctcattttctctgcttcaacaacgattagccattccgtttcaaaagtaaggattagctaatcgtttctgttttaccctccccagccaaaatctgctgctccaccccaccctctccctcccaacatcaacagcagttttcttcgaaccaaatctccaccgtctcgcgtttgggaagcgagaaagtgcgagaaaaatgagcggaccggggaagaaagtcgttgatgtcgcgttcaaagcatcaaagaacattgattgggaagggatggctaagcttttggtctccgatgaggctcgcaaagagttcgctactcttcgtcgcacttttgatgaagttaactctactttacaaaccaaattcagccaggaacctgaacccattgactgggagtactatagaaaaggaattggctctcgcctggtagatatgtacaaagaggcatatgagagtgtagagatccccaagtttgttgacaccgtcactcctcaatacaaaccaaaatttgatgcattgcttgtagaattgaaagaggcagaggagaaatccttgaaagagtctgagcgattggagaaagaaattgctgaggttcaagaacttaagcaaaagatcagcaccatgaccgcagatgagtactttgagaaacatcccgagcttaaaaagaaattcgatgatgagatgcggaatgactactggggctattgacatctttgtgaatttaatggccaagcttttggtctcgactagaatttctgaaccgtttctgttgttttaaccccttttctcttgtgcggtgatctgggttggaaagattaggctgtaatgataagaaaataattgtgtgagaaaaaattatccaatcatttgagaaacaaggtggatcttgtaagacatgcattctatttagcaggcatccgcagtcatactttcatggcaaaatttttactgtctgccctcttcattccattctgttttatgtttattatttgaatattatctagatacaattgaatttggacacc

SEQ ID NO: 6148 - DNA, 620 bp, Platanus occidentalis
acaaacaactaggagagcaacagcaggaaaaagagaaatgagcggggcggggaagaagatggcagatgtggccgtgaaggcatccaagggcatagattgggatggcatggccaagcttctcgtctctgaggaggcgcgcaaggagttctcttctctccgtcgagccttcgacgaagttaactccaccctccagaccaagttcagtcaggaaccagaaccaatagattgggaatattatagaaaaggaattggctctcgcttggtggatatgtacaaagaggcttatgacagcattgagatccccaagtatgtagacactgtgactcctcagtacaaacccaagtttgatgcactgttggtggagttgaaagaagctgaagagaaatccctgaaggaatctgagagattggaaaaagaaattgctgaagttcaagagatgaagaaaaagatcagcacaatgactgcaaatgagtattttgagaagcatccagagctgaaaaagaagtttgatgatgaaatccggaatgactattggggttattgattctcttcatatatcaccaagcagattggccatgggccagagataagatgtctgtgttttttttctctccattatt

SEQ ID NO: 6149 - DNA, 889 bp, Tabernaemontana elegans
gaaaagccctcctctcctatgcgttggttagccgacggcattttttctcgctgtgctctggaatcgagggctttcattgtagaattgagactccgacgcagagagaagaagtttgagtgtgtgctttgtttgccaaaatgagcggagcggggaagaagatagccgacgtgaccttcaaagctggaaggaccattgattgggatggcatggccaaactcattgtctcggaggaggctcgaaaggagttcgctaatctccgccgcaccttcgatgacgtcaattcccagctccaaaccaagttcagccaggaaccagaacctattgattgggaatattacagaaaaggaatcggacctaaattggttgatatgtataaagaggcatatgagagcattgaaattcccaagtacgtggacacagtcactcctcagtataagcccaaatttgatgcattggttgaggagctgaaagtagctgagcagcaatcactgaaagagtctgaaagattagaaaaggagattgcggaagttcaagagttgaagaaaaagctgagtaccatgacagcagatgaatactttgagaagcatccagagcttaagaagaagtttgatgatgaaattcgaaacgactactgggggtattagcgtcaatttcatgttagcaatcgcttgaagaatgactctcaggtgaacctttttgtgttcatcttcatttaggaataaagagaacaaattggtttgtcattttatttctcaaccattttggggaatgtgaaccataatacaccttgttctaagagggcttaatgcagcctctttgatggaggaacaaaagaaatttaatggtggagtgagtttatcctatattgaatcaagtttgtatttttact

SEQ ID NO: 6150 - DNA, 1710 bp, Zea mays
cgaacctcgagatagctggtggcgtcggagggaggcgcgagctcgcagaaggagacgaggcccgagatgagatccgagtcgaactccagcgagctgcccttacgctcccgaagttcctgcagcgcgcccttgagccactcgccggacgtgctcgccgacgtcgccatcgccgccgccaacacaagcggacaagaaggcctaacttctcttttgctatgcggaccctcaatctataggatatttcacgagtacctttacaacttctgttttcacctggtagtgtgcatgattttctaaagactcctcatcttatccccgctaagccgcgagacagcagagcagagggggcagtgcagaaggcatgtttccgatggcgtcttcctcactgtcgtcgccgccgctatcacttatcctcctccggccgctcccgtgcatacccgtcctcctcttgagacaaaggaagccattcccagctgtccgcgtagaagcaaggtctcagcagcggttgcagcggaggccggtgactggccagtggaggaggagctgcagaaggggcggaggctacgcgtgtttctcctacaatgccaagaacaagacgcccccgccttcagataagagttcagacgagtgggcgatcgttcgccgatgggatgtgccatgggaatggcaaactgttgtgctcagcatggtaggctgtggagtaagctttgttctgacaggattggttgagcaattggctttgcaagaactgggatttaaagctgtggaggcaactatagatgagaaggcagaaatactcttctttgggcagctgagtgtgacagtagtagtgcttggtgttatatttggcatcaccaacacttttcgaccattcccagatgatgtgtttcgttatgatattaaagaaccgttcaagctgcaaaatggatggcttttgtgggctggaattggtctctttggagcagtaatttctattgccttagccggagctgctatgacttatctgaatggtgaaactccagcgagagagactgattcactagtccttttgttgccgctgattggctcatccactaccagtactgcctttttggtgggaatcactggagttctagcaccacttctcgaggagacactgtttcgaggatttctaatggtgtccttgactaagtggtttcctactccagcttgtgtacttgtcagtgctgctgtatttgcccttgctcatctgactcctggacaatttccgcagctgtttatacttggtgttgcattgggattttcatatgctcagacccgcaatcttctaactccgatcacaattcatgcattttggaactcaggagtaatacttctgctaacctttcttcagctgcaaggatatgatctcaaggagctcttgggagcatcgtgaaggtttgaacgaaccaggcacatataatttgtgcataatatatatggtatcaaggagatccgttgggtatgtgctcttgtacacctgatgccaacaaaactacgtgaaaggaaatatgagtcttcaagttagctgatggttgcgtttccagaagtgttacgaggcatcactagtctgtaaagctgtttatacagtataagatggcagattgaacttaacgtaagaacagctgcccttttgagagtgtttcttacaactggagtactcgattaaattgtgctgatattgtttgttaa

SEQ ID NO: 6151 - DNA, 2835 bp, Zea mays
acgccggcgatggcgtcgccggccggcggcgagtctccggcgaagcccgtcctcctgcacggcgacctcgacctctggatcctcgaggcgcgcctgctgcccaacatggacatgttctccgagcacgtgcgccgctgcttcgccgcatgccgcccgccctcctcctgcgggaccaagcacccgccgcccgccgccgctggccgccgccaccaccaccaccaccggaacatcatcaccagcgatccctacgtcacgctgtccgtgtccggcgccgtcgtggcgcgcaccgccgtcatccccaactcccaggaccccgtctgggaggagcgcttcgccgtgccgctcgcgcaccgcgccgccgacctcgagttccaggtcaaggacaacgacaccttcggcgcgcagctcatcggcaccgtcgccgtccccgccgaccgcgttgtctcgggcgacgaggtcgaggactggttccccgtcataggcaccaacggcaagccgtacaagcccgacaccgcgctgcgcctccgcttcaagttccagcccatcgccgacaacccggcctaccgccacggcatcgccggcgaccccgaccacaggggcatccaggactcctacttcccgctccgccacggcggccaactcacgctgtaccaggacgcgcacgtcagggaaggggacctgccagagattgagctcgacaacggcaagacgttccagcacaacgcgtgctgggaggacatctgccacgccatcctagaggcgcaccacatgatatatatcgtcggctggtcggtgtacgacaaggtgcgcctcgtgcgcgaaccatctccgtcgcggccattgcccgagggtggagaccttacgcttggggacctgctcaagttcaagtcgcaggagggtgtcagagtgtgcctgcttgtgtgggatgataagacttcacatgacaagttcttcatcaagacgggtggggttatggcaactcatgatgaagaaactcggaagtttttcaaacattcctcagtcatctgtgttctctctcctcgatatgctagcaataagctcagcattttcaaacagcaggcaagttttgggcagaaatttatggttgttgggactttgtttacacaccatcaaaagtgtgtgctggttgatacacaagccaggggaaacaagcggaaaattacagctttcattgggggcctagatctttgtgatggccgctatgacacacctgaacacaggcttttcaaagatcttgacacagtattccaaaatgattaccataaccctacattttcggcaggtgcaaagggtcccaggcaaccatggcatgatttacattgcaggattgatggccctgctgcctatgatgtcttgacaaattttgagcaaaggtggcgaaaggcaacaaaatggcgtgaccggtttagaagagtatctcattggaaagacgatgctttaattaaactggagcgtatctcatggattttaagcccttcacccaatgttccaaataatcatcctagtttgtgggtttcaaaagaagaggatcatgaaaattggcacgttcaggtattcaggtcaattgactctggttccctaaaaggatttcctagtgattgcaaagcagcttcaaagctgaatcttgtgtgccgaaagaacctggtaattgataagagcatccacactgcatatgtccgagcaatcagatctgcacaacatttcatttatattgagaaccagtactttcttggttcttcatatgcttggccatcctatgtgaattcaggtgctgataatctggtaccaatagaattggccctcaaaattgcaagtaagattaaagcgggagaacgctttgcagtgtatgtagtgataccaatgtggccggaaggagtccctactgcagcatctgtgcaagaaatccttttctttcaggcccagacaatggagatgatgtataaaataattgcagatgagctcaaggcaacggacaataaggatatgcaccctgaagattacttgaacttcttttgtcttggaaatcgggaagaaccaccatctaatggtagtccagaatcagagaaatctacagataaaagtgcagcggccttagcttcgaaatatcgacggttcatgatctatgttcacgcaaaagggatgattgtggatgatgaatatgtcattctgggttcagcaaacatcaaccagagatccctggctggttctagagatactgagatcgcaatgggtgcataccagcctcattatgcatggtctacaaagaatggacatcctcacggccaggtatatgggtacagaacgtctctgtgggcagagcaccttggaacggttgatgatcgcttcaaggatccttcgagtttggagtgtgtaaggtttgtgaatcaaatagctgtagagaactggcaaaggtttacagcagaagaaatgagtacgttacaagggcacctcctcaagtacccagttaaggtggaggctgatggtaagatcagcccactgtcagaccaggagtgctttcctgatgttgggggcaagattctgggagctccaacttcacttcctgattcactgactatgtagtgttattacataaaaaaacttctttcagagttgaactttgtaattgtctaaaattggcgggtttatcgcagaacttgtactatatctgtaatcatcgatagttggcgcagggaaagttcaagatgttagtggtgctaagttttcccagcgtttgtaaatgaaccatatgataggatcctagacaatgcttccatttccattatgattatacaacagttttcaacatttttgctc

SEQ ID NO: 6152 - DNA, 3019 bp, Zea mays
ctatttcgggctaaattgccaaatctcgagatccatgatccatccgaaaccccgcctcgccgcctcctctcgctttgccgtttccgaccgccaatgctgaggcgagccgacgctaccgcccacccgaatcctcgccgctgagggtgctctaggattggagtgctctggttggttgcatagacgctcgccgccgcctctcccgtgccccggcggccggcaccggccccgaccgcgaggctccgtcgccggcgatggcgtcgccggccggcggcgagtctccagcgaagcccgtcctcctgcatggcgacctcgacctctggatcctagaggcgcgcctgctccccaacatggacatgttctccgagcaggtccgccgctgcctcgccgtatgccgcccgcccacctcctgcgggaccaaccacccgcctgccgccgcgcgcggcggcggcggccgccaacaccaccaccggaagatcatcaccagaggcccctacgtcacgctgtccgtctccggcgccgtcgtggcgcgcaccgccgtcatccccaactcccaggaccccgtctgggaggagcgttttgccgtgccgctcgcgcaccgcgccgccgagctcgagttccaggtcaaggataacgataccttcggcgcgcagctcatcggcaccgtcaccgtccccgccgactgcgttgtgtcgggcaccgaggccgaggattggttccccgtcaaaggcaccaacggcaagccgtacaaacccgacaccgcgctgcgcctccgcttcacattccaccccatcgccaacaacccggcctaccgccacggcatccctggcgaccctggccacaggggcatcggggagtcctactacccgctccgccacggtggccaagtgacgctgtaccaggacgcgcacatcagggaaggggacctgccagagattgagctcgacgacggcaagacgttccagcacaactcgtgctgggaggacatctgccacgccatcctggaggcgcaccacatgatatatatcgtcggctggtcggtgtatgataaggtgcgactcgtgcgcgaaccatcgccgtcgcggccattgcccgatggtggcgaccttacgcttggagacctgctcaagttcaagtcacaggaaggtgtcagagtgtgcctgctggtgtgggatgataaaacttcgcatgacaagttcttcatcaagacgggtggagttatggcaactcatgatgaagaaactcggaaattttttaaacattcctcagtcatctgtgttctctctcctcgatatgctagcaataagctgagcattttcaaacagcaggcaagttttgttgttgggactttgtttacacaccatcaaaagtgtgtgctggttgatacacaagccaggggaaacaagcgaaaagttacagctttcattgggggcctagatctttgtgatggtcgctatgacacacctaaacacaggcttttcaaagatcttgacacagtattccaaaatgattaccataaccctacattttcgtcaggtgcaaagggacccaggcaaccatggcatgatttacattgcaggattgatggccctgctgcctatgatgtcttgacaaattttgagcaaaggtggcgaaaggcaacaaaatggcgtggccgatttagaagagtatctcattggaaagacgacgctttaattaagctggaacgtatctcatggataataagcccttcacccaatgttccaaatgatcatcctagtctgtgggtttcaaaagaagaagatcgtgaaaattggcatgttcaggtattccgatcaattgactctggttccctaaaaggatttcctagtgattgcaaagaagcttcaaagcttaatcttgtgtgccgaaagaatctggtaattgataagagcatccacactgcatatgtccgagcaatcagatctgcacagcatttcatttatattgagaaccagtactttcttggctcttcatatgcttggccatcctatgtgaattcaggtgctgataatctgataccaatagaactggccctcaaaattgcaagtaagattagagcacaagaacgctttgcagtgtatgtagtgataccaatgtggcctgaaggagtccctactgcagcatctgttcaagaaattcttttctttcaggcccagacaatggagatgatgtatacaataattgcagatgagctcaagtcaatggacaataaggacatgcgccctgaagattacttgagcttcttttgtcttggaaaccgggaagaaccaccatctaatggcagcccagaatcagagaaatctacagataaaagtgcagtgggcttagctacaaaatatcgacggttcatgatctatgttcatgcaaaaggaatgattgtggatgatgaatatgtcattctgggttcagcaaacatcaaccagagatccctggctggttctagagatactgaaattgcaatgggtgcataccagcctcattatgcatggtctacaaagaatggacatcctgacggccaggtatacgggtacagaacgtccctgtgggcagagcaccttggaacgatcgatgaccgcttcaaggatccttcgagtttggagtgtgtaaggtttgtgaatcaaatcgctgtagagaactggcgaaggtatactgcagaagaaatgagtacattacaagggcacctcctcaagtacccagttaaggtggaggctgatggtaagatcagcccactgccagaccaagaatgctttcctgatgttggcggcaagattctgggagcttcaacttcacttcctgattcgctgaccatgtagcgtcattacataatttttttttcagagttgaactctgtaattgtctagatttggtgggattgtcgcagaacttatactactagtgaagtgcgcgcgccctgcgcgcgtgtagtgtaggctcatggagatccaaccacacaactaatataactatataaatttacatatataataagtgtaccaaccta

SEQ ID NO: 6153 - DNA, 3180 bp, Setaria italica
gatgagggaaaacttaaagccgcatactatttcaggctaagttgccaaatcctgagatccaccccaagcccccgccccgcgtcgccgccgcggcgcctcctcccgcaaactccgccgttttgcgggccgccccgccggaatccccgccacgggggcctgcggtataagacggccctctgggattggagggctccggttggtcggttagacgctcgccgctgccgcctcccctcgaccgcgaggctccgtcgccggcgatggcgtcgtcagccggcggcgagtctccggcgaagcccaagaccgtgctcctgcacggcgacctcgacctctggatcaaagaggcgcgcctgctgcccaacatggacctcttctccgagcaggtccgccggtgcttcgccgcctgccgaccgcccacctcctgcgggcccaagcacccacccgccgccgccgtcccccgcggcggctccggcggccgccaccaccaccaccggaagatcatcaccagcgacccctacgtcacgctctccgtctccggcgccgtggtggcgcgcaccgccgtcattcccaacaaccaggaccccgtctgggaggagcgcttcgccgtgccgctcgcgcaccgcgccgccgcgctcgagttccaggtcaaggacaacgacaccttcggcgcgcagctcatcggcaccgtcaccgtcccagccgacatcgtcgccagcggcgaggaggtcgaggactggtaccccatcatcggcaccaacggtaagccgtacaagcccgacaccgcgctgtgcctccgcttccggttccagcccatcgccgagaacccggcttaccggcgcggcatccccggcgaccccgagcgcaagggcatcaaggactcctacttcccgctccgccacggcggtcaggtgacgctgtaccaggacgcgcacgtcagggaaggggacctgccggagattgagctcgaggacggcaagatgttcgagcacaacgcgtgctgggaggacatctgccacgccatcctagaggcacaccacatgatatacatcgtcggctggtcggtgtatgacaaggtgcggcttgtgcgtgagcggtcgccgtcgcggccattgcctgagggtggcgaccttacccttggagagctgctcaagttcaagtcgcaggagggcgtcagagtgtgcctgctcgtgtgggatgacaaaacttcgcatgacaagtttttattcaagacgggtggagttatggcaactcatgatgaggatactcgaaagtttttcaagcattcctcagtcatctgtgttctttctcctcgatatgctagcaataagctgagcattttcaaacagcaggttgttgggactttgtttacacaccatcaaaaatgcgtgcttgttgatacacaagcatggggaaacaagcggaaggttacagctttcatcgggggcctagatctttgtgatggccgctatgacacacccgaacacaggcttttcaaagatcttgacacagtatttcataatgattatcataaccctacattttcggcaggtgcaaaaggacctagacaaccatggcatgatttacattgcaggattgatggtcctgctgcatacgatgtcttgacaaattttgaacagcggtggcgaaaggcaacaaaatggcgtgaccgttttagaagagtatctcattggaaagatgatgctttaattaagctggagcgtatctcatggatactaagcccttcacgtaatgttccaaatgatcatcctagtttgtgggtttcaaaagaagaagatcgtgaaaattggcatgttcaggtattccggtcaatcgattctggttctttaaaaggatttcctagtgattgcaaagaggcatcaaagctgaatcttgtgtgccgtaagaacctggtaattgataagagcatccacactgcatatgtccgggcaatcagatctgcacagcattttatttatatcgagaaccaatactttcttggttcttcatatgcttggccatcctatgtgaattcaggtgctgataatctgataccaatagaattggccctcaaaattgcaagtaagattagagcaggagaacgctttgcagtgtatgtagtgataccaatgtggcctgaaggagtccctactgcagcatctgtgcaagaaatccttttctttcaggcccagacaatggagatgatgtataaaataattgcagatgaactcaaggccatggacattaaggatatgcaccctcaagattacttgaacttcttttgtcttggaaaccgggaagaaccatcatcaaacggcagcccggaatcagagaagtctacagataaaagtgcagcggccttagctacaaaatatcgacggttcatgatctacgttcatgccaaagggatgattgtggatgatgagtacgtcattctgggttcagcaaacatcaaccagagatccctggccggttctagagatactgaaattgcaatgggggcataccagcctcatcacgcatggtctacaaagaatagacatcctcacggccaggtatatggatacagaacatctctctgggcagagcaccttggaatggttgatgatcgcttcaaggatccttcaagtttggattgtgtaaggtttgtgaatcaaatagctgtagagaactggcaaaggtttacagccgaagaaattagaacattacaagggcacctcctcaagtacccagtcaatgtggaggatgatggtaagatcggcccgcttccagaccaagaaaactttcctgatgttggcggcaagattctcggagctccaacttcacttcctgattcgctgaccatgtagatttacattaaaaagttgacctttttcagagttgaagcttgatcatatccacttgtgaactttgtaattgtctaaatttggcgggattgtcgcagaatttgtaccatatctgcaatcatccatagttggcgcagggaaagctcaagtgttaatggtgttggtgtttgtagagttgtgtttctgtaagttctcccagcgtctgtaaatgaatcatatgataggatccttgacagagcttccattttcattggataataccacgctttttgaacattttgtccaagcctagtgtttaccctgtttctgttcgatcgtctactctgcactctgcatggtc

SEQ ID NO: 6154 - DNA, 3356 bp, Oryza sativa
cgacgaccgatctgttcatgcgttttccgatcggatcgcgtcgcgcccccagctcagccgcgtggtcgtgctgggccccgcgtgccagcgaccgagtggccgggagccatacaggcgaccgttacgtcccaccaccatcacgctcaccgcttcgcgatctcttttacgattaacccctcgcagaattagatatagcggcgcggcgagagagagagactatttttgggcgtaatccagcgcggccgtccgcccgagatctccctctcccaccgcgcgtttcgccgccggaatccgcgccgcagagagcggggggtataaagaggtgagacggtggtctcccggattcggtgggtggtgggtcccgctgctgtgtgcgtgtgcgtgccgagggagggagggaggcctcgtcgccgccgatggagtcgtcggccggcggcggcggcggcgagtctccgcctccggcgaagcccgtgctgctccacggggacctcgacctgtgggtggtcgaggcgcgcctgctcccaaacatggacatgttctccgagcacgtacggcggtgcttcgccgcctgcaagccgcccacctcctgcgccaccgccaggcagccgcgccacgcccgcggccaccaccgccggaagatcatcaccagcgacccctacgtcacgctctccgtcgccggcgccgtggtggcgcgcacccgcgtcatccccaacgaccaggaccccgtctgggacgagcgcttcgccgtgcccctcgcccactacgccgccgcgctcgagttccacgtcaaggacaacgacacgttcggcgcgcagctcatcggcaccgtcaccatccccgccgacagggtcgcctcgtgccaggaggtggaggactggttccccatcatcggcaacaacggcaggccgtacaagcccgacacggcgctccgcctccgcctccgcttcaaccccgcggccgacaacccgctctaccgccgcggcatccccggcgaccccgaccaccaggggatcaaggactcctacttcccgctccgccacggcggccgcgtcacgctgtaccaggacgcccactacagggaaggggacctgccggagatcgagctcgacgaggggggcaaggtgttcgaccacaacgcgtgctgggaggacatctgccacgccatcctcgaggcgcaccacatgatatacatcgtcggctggtcggtgtacgacaaggtgcgcctcgtccgggagccgtcgccgtcgaggccgctgccggaaggcggcgacctcaatctcggggagctgctcaagttcaagtcgcaggagggcgtgagggtgtgcctgctcgtgtgggacgacaagacgtcgcacgacaagttgttcatcaaaacgggtggagtgatggcgacacatgatgaagaaactagaaaattcttcaagcattcctcagtcatttgtgttctttcacctcggtatgccagcagtaagctgagcattttcaaacaacaggttgttgggactttgtttacccatcatcaaaaatgcgtgctggttgatacacaagcttggggaaacaagcggaagattactgcttttatcggtggcctggatctttgtgatgggcgttatgatacacccgaacataggctttttaaggatcttgacacagtattcgataatgattatcataaccctacatttccgtcaggtgcaaagggggggcctagacaaccatggcatgaccttcactgtaggattgatggtccagctgcgtatgatgtcttgaaaaattttgagcaacgctggagaaaggcaacgaaatggcgtgaacgatttagaaaagtgtctcattggaaagatgatgccctgataaagttggaacgtatctcatggatacttagcccttcgcctactattccaaatgatgatattagtttgcgggtttcaaaagaagaagatcctgaaaattggcatgttcaggtattccggtcaatagactctggttcgcttaaagggtttcctagtgattgcaaagaagcttcaaagcagaatcttatttgccggaaggacctgataattgataagagcatccacactgcttatgtccgggcaatcagatccgcccagcatttcatttatattgaaaatcaatatttccttgggtcatcatatgcttggccgtcctatgttaattcaggtgctgacaatctggtacctattgaattggccctcaaaattgcaagcaagattagggctggtgaacggtttgcagtttatgtagtcataccgatgtggcctgaaggagtccctacagcagcttctgtacaagaaattcttttctttcaggcacagacaatggagatgatgtatcgtataattgcacaagagctcaaggccatgaatattaagaatgcacaccctcaagattacttgaacttctattgtctgggcaatcgagaagaatcatcatcatcaaatggcagccctgaatctaacgataaaagtgcagcggccttggctagaaaataccggcgttttatgatctatgttcatgcaaaggggatgattgtagatgatgaatatgttattctggggtcagcaaacatcaaccaaagatctttggctggttccagagatactgaaattgccatgggcgcataccagcctcaccacacatggtctacaaaggggggtcatcctcgcggtcaggtatacgggtatagaacttccctctgggcagagcatcttgggatggttgatgacctcttcaaggatccatcaagtttggagtgtgtaaattatgtcaatgaaatagcagaagagaactggagaaggttcaccgcagaacaacttataacgttacaagggcacctcctcaaatacccagtcaaggtagaggctgacggtaaggttggtccattgccagaacacgaatgctttcctgacgttggtggcaagattcttggagctccaacttcactccctgatacgctaacaatgtaacacggttcaagcaaaatattgacatgttttccagaattgaagcccttttttgttcatattttaaactttgtgattgcttgaagatggtatcggagaggaatttgtatcatgtctgtataatcatccagagagggggtatagggagagctcaagctgctaatggtgtctgtaaagtttgtggctatgtgagaaatttttcagccgttgtaaatgaaacacacgacagtacgatagactacagtgttgtctcatttccattgcaatcatacacgcacaactgttttaattcatgattagctgctgttacagtcatacattcagtggtgtgttcgagagaaggaaaagagagatacataaaatgagatgagc

SEQ ID NO: 6155 - DNA, 3412 bp, Brachypodium distachyon
ccttcaaatctaagtatgcatatagatattccgtaactttttttttacagatttcccactatctaaatatgttgtgaaaaccacttgagtgtgcgacatgcggtaaaataagatggcactgaggagaagtataaaacccacggttttcatttaagcaaaacccattactattttaggctagattgccaactccgagatcctccaccacctcacccaaatctcttccagctttgccgtttgcgtccgcgaggttggagagggcgttgcctcgcctgcgccccaccggaatccccgccgggtagcgggggtcgtcgcggttgccaggtataagaggaggcctcccgggattggaggcccgactccaattggaccctggccgccgccgccgccgcccccgaccgcgaggcctcgtcgccgccgatggcgtcgccggcggacggcgagtctccggccaagcccatcctcctccacggggacctcgacctgtggatcattgaggcgcggctgctccccaatatggacatgttctccgagcatatccgccgctgcttcgccacctgcggcaccgcctcctcctgcgcgcccaagcagccgccccgcacccggggcggggaagggccgaaccgccgccaccaccggaagatcatcaccagcgacccttacgtgacgctgtccgtggccggcgcggtggtggcgcgcacggcagtgattcccaacagcgaggagccgcgctggggggagcaattcttcgtgccgctcgcgcaccgggccgccatgctcgagttccaggtcaaggacaacgacaccttcggcgcgcagctcatcggcacggcttccatccccgccgaccgagtcacctccgcgtgcgaggaggaggtcgacgagtggttccccatcgtcggccccagtggcaggccgtacaagccccgcaccgcgctccacctccgtttccggttccgaccgctcgacaccaacccgatgtacaagcacggcatcccgggcgaccccgagaagcagggcgtccaggactcctacttcccgctccgccatggcggccgcgtgacgctgtaccaggacgcgcatgtcaacgaaggggacctgccgggtatcgagctcgagcgagggaagcagttcgagcacaacaactgctgggaggacatctgccacgccatactcgaggcgcaccatatgatatacattgtcggctggtccgtgtacgacaaggtgaagcttgtgcgcgagccgtcgccgtcgaggccgttgcctgagggtggcgacctcacgctcggggacctgctcaagttcaagtcgcaggagggtgtgagagtttgcctgctcgtgtgggacgacaagacttctcatgacaagttgttcatcaaaacgggtggtgtgatgggaacacatgatgaagaaactagaaagtttttcaagcactcctccgtcatttgtgttctttcaccgcgatatgccagcagtaagctgagcattttcaaacaacaggttgttgggacattgtttactcatcatcaaaaatgtgtgctggttgacacacaagcctcggggaacaagcggaaagttactgcttttgttgggggcctagatctttgtgatgggcgttatgatactcctcaacatagactttttaaagatctagacacagtatttgaaaatgactatcataatcctacgttttcggcaggcgcaaaaggaccgagacaaccatggcatgatttgcactgtaagattgatggaccagctgcctatgatgtcttaaagaattttgagcaacgctggagaaaagcatcaaaattccgtgaacgatttaggaaaatatctcattggaaagatgatgctctaataaagctggagcgtatctcatggatacttagcccttcacctaatattccgaatgatcatgctagtttgcgagtttcaaaagaagaagatcctgaaaattggcacgttcaggtattccgatcaatagactctggctctctaaaaggatttcctagtgattgcaaagaagcttcaaagcagaatcttgtgtgccgaaagaacctcataatcgataagagcatccacacagcatatgtccgggcgatcagatcagcgcaacatttcatttatatagaaaatcagtattttcttggttcttcctacgggtggccatcctatgtgaattcaggtgctgacaatttgataccaatggaattggccctcaaaattgcaagcaagattagggctggcgaacgatttgcagtttatgtagtcataccaatgtggcctgaaggagttcctactgcagcctctgtacaagaaattctttactttcaggctcagacaatggagatgatgtatagagtggtcgcacaggagctaaagaccatgaatatcgagaatgcacatccccaagattacctgaacttctactgtcttggcaatcgagaagaatcatcaacaaacggcagccctgagtctgataaatctacagacaaaagtgcagcggccctggctagaaaatatcggcggttcatgatctatgttcatgcaaaagggatgattgtagacgatgaatacgtcattttgggttcagcaaacattaaccagcgatccctggctggatctagagatactgaaattgcaatgggcgcctaccagcctcatcattcatggtctaagaagggggctcatcctcacggccaggtatacggatataggagttctctttgggcagagcacctggggatggttgatgacaggttcaaggatccttccagcttggactgcgtacgttttgtgaaccaaatagctgaagagaactggaacagattcacagcagaagagatgaaaacgttgcaagggcacctcctcagatacccagtgaaggtagagccggatggcaacatcggcccgttgccagaccaagaatgcttccctgacgtcggtggcaagatatgcggagctccaacctcacttcctgattcgctgacgatgtaatgtcgtggcacaccaattccaaagttgaagcttgctctcttccctccgtgaaaaaactccttgattttcttgtgttggcgcgggaggagaattgaatttgtaccataatctgtcatcacccatagtgtggtgtagaaaagttaagctcgagttgccagtggtgtttgtagagttgtgcctttgtaaggttttatacaacctgtaaatggaacacgtacgacaggatcattgatagtgttggccatttgtactacgagttatacgtacgagtttacaactctgtttctcgcaatgtgttttgtgggactggaaccaactctttccataaaattatctaaaaaaacctagtcactgtcagcaaagaggtcggatctcattaaagtttttcattagaattatttttggctgaatcttt

SEQ ID NO: 6156 - DNA, 3353 bp, Brachypodium distachyon
ccttcaaatctaagtatgcatatagatattccgtaactttttttttacagatttcccactatctaaatatgttgtgaaaaccacttgagtgtgcgacatgcggtaaaataagatggcactgaggagaagtataaaacccacggttttcatttaagcaaaacccattactattttaggctagattgccaactccgagatcctccaccacctcacccaaatctcttccagctttgccgtttgcgtccgcgaggttggagagggcgttgcctcgcctgcgccccaccggaatccccgccgggtagcgggggtcgtcgcggttgccaggtataagaggaggcctcccgggattggaggcccgactccaattggaccctggccgccgccgccgccgcccccgaccgcgaggcctcgtcgccgccgatggcgtcgccggcggacggcgagtctccggccaagcccatcctcctccacggggacctcgacctgtggatcattgaggcgcggctgctccccaatatggacatgttctccgagcatatccgccgctgcttcgccacctgcggcaccgcctcctcctgcgcgcccaagcagccgccccgcacccggggcggggaagggccgaaccgccgccaccaccggaagatcatcaccagcgacccttacgtgacgctgtccgtggccggcgcggtggtggcgcgcacggcagtgattcccaacagcgaggagccgcgctggggggagcaattcttcgtgccgctcgcgcaccgggccgccatgctcgagttccaggtcaaggacaacgacaccttcggcgcgcagctcatcggcacggcttccatccccgccgaccgagtcacctccgcgtgcgaggaggaggtcgacgagtggttccccatcgtcggccccagtggcaggccgtacaagccccgcaccgcgctccacctccgtttccggttccgaccgctcgacaccaacccgatgtacaagcacggcatcccgggcgaccccgagaagcagggcgtccaggactcctacttcccgctccgccatggcggccgcgtgacgctgtaccaggacgcgcatgtcaacgaaggggacctgccgggtatcgagctcgagcgagggaagcagttcgagcacaacaactgctgggaggacatctgccacgccatactcgaggcgcaccatatgatatacattgtcggctggtccgtgtacgacaaggtgaagcttgtgcgcgagccgtcgccgtcgaggccgttgcctgagggtggcgacctcacgctcggggacctgctcaagttcaagtcgcaggagggtgtgagagtttgcctgctcgtgtgggacgacaagacttctcatgacaagttgttcatcaaaacgggtggtgtgatgggaacacatgatgaagaaactagaaagtttttcaagcactcctccgtcatttgtgttctttcaccgcgatatgccagcagtaagctgagcattttcaaacaacaggcaagttgttgggacattgtttactcatcatcaaaaatgtgtgctggttgacacacaagcctcggggaacaagcggaaagttactgcttttgttgggggcctagatctttgtgatgggcgttatgatactcctcaacatagactttttaaagatctagacacagtatttgaaaatgactatcataatcctacgttttcggcaggcgcaaaaggaccgagacaaccatggcatgatttgcactgtaagattgatggaccagctgcctatgatgtcttaaagaattttgagcaacgctggagaaaagcatcaaaattccgtgaacgatttaggaaaatatctcattggaaagatgatgctctaataaagctggagcgtatctcatggatacttagcccttcacctaatattccgaatgatcatgctagtttgcgagtttcaaaagaagaagatcctgaaaattggcacgttcaggtattccgatcaatagactctggctctctaaaaggatttcctagtgattgcaaagaagcttcaaagcagaatcttgtgtgccgaaagaacctcataatcgataagagcatccacacagcatatgtccgggcgatcagatcagcgcaacatttcatttatatagaaaatcagtattttcttggttcttcctacgggtggccatcctatgtgaattcaggtgctgacaatttgataccaatggaattggccctcaaaattgcaagcaagattagggctggcgaacgatttgcagtttatgtagtcataccaatgtggcctgaaggagttcctactgcagcctctgtacaagaaattctttactttcaggctcagacaatggagatgatgtatagagtggtcgcacaggagctaaagaccatgaatatcgagaatgcacatccccaagattacctgaacttctactgtcttggcaatcgagaagaatcatcaacaaacggcagccctgagtctgataaatctacagacaaaagtgcagcggccctggctagaaaatatcggcggttcatgatctatgttcatgcaaaagggatgattgtagacgatgaatacgtcattttgggttcagcaaacattaaccagcgatccctggctggatctagagatactgaaattgcaatgggcgcctaccagcctcatcattcatggtctaagaagggggctcatcctcacggccaggtatacggatataggagttctctttgggcagagcacctggggatggttgatgacaggttcaaggatccttccagcttggactgcgtacgttttgtgaaccaaatagctgaagagaactggaacagattcacagcagaagagatgaaaacgttgcaagggcacctcctcagatacccagtgaaggtagagccggatggcaacatcggcccgttgccagaccaagaatgcttccctgacgtcggtggcaagatatgcggagctccaacctcacttcctgattcgctgacgatgtaatgtcgtggcacaccaattccaaagttgaagcttgctctcttccctccgtgaaaaaactccttgattttcttgtgttggcgcgggaggagaattgaatttgtaccataatctgtcatcacccatagtgtggtgtagaaaagttaagctcgagttgccagtggtgtttgtagagttgtgcctttgtaaggttttatacaacctgtaaatggaacacgtacgacaggatcattgatagtgttggccatttgtactacgagttatacgtacgagtttacaactctgtttctcgcaatgtgttttgtgggactggaaccaactctttccataaaattatctaaaaaaacctagtcac

SEQ ID NO: 6157 - DNA, 3230 bp, Triticum aestivum
tcaggacccgagagagagtccatcccgcagcgcaggggatccagatcacgcggactcggccgacctgaacctgcccgcacgcaacgcagatccccacccaacccgaccccgaccacgcgcgcgcggacctgggacccgggcccggcctcccccaccggaatccccgccgggtacctgggggccgtcgccgcggttgcgcaacaggcaggaccgggggcccggctccgattccaagctggccgccgccgccgccaccgccccccgctccgcgtcgccgtccatggcgtcgtcgggcggggacgagtcgccgtcgccggccaagcccgtgctcctgcacggggacctcgacctctgggtcgtcgaggcgcggctgctgcccaacatggacatgttctccgagcacatccgccgctgcttcgcctcctgcggcaccgcctcctcctgcgcgccccggcagcccccgcccaacagccgcggcgtcggggaggccggcagccgccgccaccaccaccgcaggatcatcaccagcgacccctacgtcacgctctccgtcgccggcgccgtcgtcgcgcgcaccgccgtcatccccaacagccaggagccgcgctgggacgagcagttcttcgtgccgctcgcgcaccgcgccaccgtcctcgagttccaggtcaaggacaacgacaccttcggcgcgcagctcatcggcaccgcctccgtccccgccgaccgggtcgtcgccgccgccgacgagctcgaggagtgggtccccatcgtcggcaccagcggcaagacctacaagccccgcaccgcgctcttcatccgctaccgcttccgccccttcgccgccaacccggtctaccgccgcggcatccccggcgaccccgaccagcagggcgtcaaggactcctacttcccgctccgccacggcggaaaagtcacgctctaccaggacgcgcacgtcaacgagggggacctgccggacgtcgagctcgagcgggggaagaagttcgagcacaaccagtgctgggaggacatctgccacgccatactcgaggcgcaccatatgatctacatcgtcggctggtcgatctacgacaaggtgaagctggtgcgcgagccgtcctcgtccagggcgctcccggagggcggcgagctcacgctcggagagctgctcaagttcaagtcgcaggagggcgtgagagtgtgcctgctcgtctgggacgacaagacgtcccatgacaagctcttcatcaaaacgggtggtgtgatgggaacgcatgatgaagaaactagaaagtttttcaagcattcctcagtcatctgtgttctttcacctcgatatgccagcagtaagctgagcattttcaaacaacaggttgttgggacattgtttacacaccaccaaaaatgtgtgctggttgatacacaagcttcgggaaacaagcggaaagttactgctttcattgggggcctagatctttgtgatgggcgttatgatactcctcaacataggctttttaaagaccttgacacagtatttgaaaatgatttccataacccaacattttcggcaggcgcaaaaggaccgagacaaccatggcatgatttgcactgtaagattgatggaccagctgcctatgatgtcttgaagaattttgaacaacgctggagaaaggcatccaaattccgtgatcgatttaggaaagtatctcgctggaaagatgatgctctgataaagctggagcgtatctcgtggatacttagtccttcccctaatgttccaaatgatcatgttagtttgcgggtttcaaaagaagaagatcctgaaaattggcatgttcaggtattccggtcaattgactcgggctctctaaaaggatttcctagtgattgcaaagaggcttcaaagcagaatcttgtgtgccgaaagaacctcataattgataagagcattcacacagcatatgtccgggcaatcagatcagcgcaacatttcatttatatagaaaatcagtattttcttggttcttcgtacgagtggccatcctatgtgaattcaggtgctgacaatctgataccaatggaattggccctcaaaattgcaaccaagattagagctggcgaacggtttgcagtttatgtagtcataccaatgtggcctgaaggagtccctacctcggcctctgtgcaagaaattcttttctttcaggctcagacaatggagatgatgtatggagtaatcgcacgagagctcaaggccatgaatattgaggatgcaaaccttcaagattacttgaacttttactgtctgggcaatcgggaagaaccgtcaacagatggtagccctgagtcagataaatctacagataaaagtgcagcgggcctggctagaaaacatcggcggttcatgatctatgttcatgcaaaagggatgattgtagacgatgaatacgtcattttgggctcggcaaacatcaatcagagatccttggctggctcgagagataccgaaattgcaatgggtgcctaccagcctcatcatgcatggtcttcgaagaagggtcatcctcacggccaggtatatgggtataggaactccctctgggcagaacaccttggtatggttgatgaccacttcaaggaaccttctagtctggaatgtgtaagattagtgaaccaaatagccgaagaaaactgggaaagattcgcatcagaagagatgaaaacgttgcaagggcacctcctcagatacccagtgaaggtagagtccgatggtaagatcgtcccgctgcccgaccaagaatgcttccccgacgttggtggcaagatctgcggcgctccgacctcgcttcctgattcgctgacgatgtagcatcacagtactgacttctcttcagggtccaagctggttcttttgctcacctgtaaaacctctctgaatgtcttgccgacggatggtaatctgtgatcacacactgtgtggcgtatagggaaagcacgggctgttcacggtgtgttgtagagttgtgcctttgtaagattttttctacagtctgtacatgagacaggacagggtcattgatagttttggacatctctactgcgaactgttcacaaccattttcatttggtgccatgtgttttgtgctggcagctcttcccacagaaaaagtgtgttcaacatctgaggaaaaaccagctaaaaactgttgcgagatgttgaacagaaaagc

SEQ ID NO: 6158 - DNA, 3250 bp, Triticum aestivum
tttcaagctggccgccgccgccgccaccgcgccccgctccgcgtcgccgtcgatggcgtcgtcgggcggggacgagtcgccgtcgccggccaagccggtgctcctgcacggggacctcgacctctgggtcgtcgaggcgcggctgctgcccaacatggacatgttctccgagcacatccgccgctgcttcgcctcctgcggcaccgcctcctcctgcgcgcccaggcagcccccgcccaacagccgcggcgtcggggaggccggcagccgccgccaccaccaccgcaggatcatcaccagcgacccctacgtcacgctctccgtcgccggcgccgtcgtcgcgcgcaccgccgtcatccccaacagccaggagccgcgctgggacgagcagttcttcgtgccgctcgcgcaccgcgccaccctgctcgacttccaggtcaaggacaacgacaccttcggcgcgcagctcatcggcaccgcctccgtccccgccgaacgggtcgtcgccgccgtcgacgaggtcgaggagtgggtccccatcgtcggcaccagcggcaagacctacaagccccgcaccgcgctcttcatccgctaccgcttccgccccttcgccgccaacccggtgtaccgccgcggcatccccggggaccccgaccagcagggcgtcaaggactcctacttcccgctccgccacggcggaaaagtcacgctctaccaggacgcgcacgtcaacgagggggacctgccggacgtccagctcgagcgggggaagaagttcgagcacaaccagtgctgggaggacatctgccacgccatactcgaggcgcaccatatgatctacatcgtcggctggtcgatctacgacaaggtgaagctggtgcgcgagccgtcgtcgtccaggccgctcccggacggcggcgagctcacgctcggagagctgctcaagttcaagtcgcaggagggcgtcagagtgtgcctgctcgtctgggacgacaagacgtcccatgacaagctcttcatcaaaacgggtggtgtgatgggaacgcatgatgaagaaactagaaagtttttcaagcattcctcagtcatctgtgttctttcacctcgatatgccagcagtaagctgagcattttcaaacaacaggttgttgggacattgtttacacaccaccaaaaatgtgtgctggttgatacacaagcttcgggaaacaagcggaaagttactgctttcattgggggcctagatctttgtgatgggcgttatgatactcctcaacataggctttttaaagaccttgacacagtatttgaaaatgatttccataacccaacattttcggcaggcgcaaaaggaccgagacaaccatggcatgatttgcactgtaagattgatggaccagctgcctatgatgtcttgaagaattttgaacaacgctggagaaaggcatccaaattccgtgatcgatttaggaaagtatctcgctggaaagatgatgccctgataaagctggagcgtatctcgtggatacttagtccttcacctaatgttccaaatgatcatgttagtttgcgggtttcaaaagaagaagatcctgaaaattggcatgttcaggtattccggtcaattgactcgggctctctaaaaggatttcctagtgattgcaaagaggcttcaaagcagaatcttgtgtgccgaaagaacctcataattgataagagcattcacacagcatatgtccgggcaatcagatcagcgcaacatttcatttatatagaaaatcagtattttcttggttcttcgtacgagtggccatcctatgtgaattcaggtgctgacaatctgataccaatggaattggccctcaaaattgcaaccaagattagagctggcgaacggtttgcagtttatgtagtcataccaatgtggcctgaaggagtccctacctcggcctctgtgcaagaaattcttttctttcaggctcagacaatggagatgatgtatggagtaatcgcacgagagctcaaggccatgaatattgaggatgcacaccttcaagattacttgaacttttactgtctaggcaatcgggaagaaccgtcaacagatggtagccctgagtcagataaatctacagataaaagtgcagcgggcctggctagaaaacatcggcggttcatgatatatgttcatgcaaaagggatgattgtagacgatgaatacgtcattttgggctcggcaaacatcaatcagagatccttggctggctcgagagataccgaaatcgcaatgggtgcctaccagcctcatcatgcatggtcttcgaagaagggtcatcctcacggccaggtgtatgggtataggaactccctctgggcagaacaccttggtatggttgatgaccacttcaaggaaccttctagcctggactgtgtaagattagtgaaccaaatagccgaagaaaactgggaaagattcgcgtcagaagagatgaaaacgttgcaagggcacctcctcagatacccagtgaaggtagagcccgatggtaagattgtcccgctgcccgaccaagaatgcttccccgacgttggcggcaagatctgcggcgctccgacctcgcttcctgattcgctgacgatgtagcatcacagtactgacttctcttcagggtccaatctggttcgtttgctcacctgtaaaacctctctgaatgtcttgtctcgccgacggatggtaatctgtgatcacacattgtgtggcgtatagggaaagcacgggctgttcacggtgtgttgtagagttgtgcctttgtaagattttttctacagtctgtacatgagacagggcagggcagggtcattgatagttttggacatctctactgcgaactgttcacagccatttttcatttggtgtcatgtgttttgtgctgccagctcttcccacagaaaaaccaggcaaaaacgttgcaagggcccccgtgactctctgctcgtcgctccattgccgctccaccgcgtgagcagcatgacgttctggaaagctcctgcggaacctcatttcgaaatgcacctgccatgccatggttttttacctgtgtaaagtgtaggttattgattctaaagtcctaatgtcgttgggtggcaatggcatgcagtcagtatgcatgttgtgtttgaattagttacgtagctacgtacaaagtgaggattttcaccaaccccccagtttgacaagccggagtttcaactc

SEQ ID NO: 6159 - DNA, 2990 bp, Triticum aestivum
gtcgccgcggttgcgcaacaggcaggaccgggggcccggctccgattccaagctggccgccgccgccgccaccgccccccgctccgcgtcgccgtccatggcgtcgtcgggcggggacgagtcgccgtcgccggccaagcccgtgctcctgcacggggacctcgacctctgggtcgtcgaggcgcggctgctgcccaacatggacatgttctccgagcacatccgccgctgcttcgcctcctgcggcaccgcctcctcctgcgcgccccggcagcccccgcccaacagccgcggcgtcggggaggccggcagccgccgccaccaccaccgcaggatcatcaccagcgacccctacgtcacgctctccgtcgccggcgccgtcgtcgcgcgcaccgccgtcatccccaacagccaggagccgcgctgggacgagcagttcttcgtgccgctcgcgcaccgcgccaccgtcctcgagttccaggtcaaggacaacgacaccttcggcgcgcagctcatcggcaccgcctccgtccccgccgaccgggtcgtcgccgccgccgacgagctcgaggagtgggtccccatcgtcggcaccagcggcaagacctacaagccccgcaccgcgctcttcatccgctaccgcttccgccccttcgccgccaacccggtctaccgccgcggcatccccggggaccccgaccagcagggcgtcaaggactcctacttcccgctccgccacggcggaaaagtcacgctctaccaggacgcgcacgtcaacgagggggacctgccggacgtccagctcgagcgggggaagaagttcgagcacaaccagtgctgggaggacatctgccacgccatactcgaggcgcaccatatgatctacatcgtcggctggtcgatctacgacaaggtgaagctggtgcgcgagccgtcctcgtccagggcgctcccggagggcggcgagctcacgctcggagagctgctcaagttcaagtcgcaggagggcgtgagagtgtgcctgctcgtctgggacgacaagacgtcccatgacaagctcttcatcaaaacgggtggtgtgatgggaacgcatgatgaagaaactagaaagtttttcaagcattcctcagtcatctgtgttctttcacctcgatatgccagcagtaagctgagcattttcaaacaacaggttgttgggacattgtttacacaccaccaaaaatgtgtgctggttgatacacaagcttcgggaaacaagcggaaagttactgctttcattgggggcctagatctttgtgatgggcgttatgatactcctcaacataggctttttaaagaccttgacacagtatttgaaaatgatttccataacccaacattttcggcaggcgcaaaaggaccgagacaaccatggcatgatttgcactgtaagattgatggaccagctgcctatgatgtcttgaagaattttgaacaacgctggagaaaggcatccaaattccgtgatcgatttaggaaagtatctcgctggaaagatgatgccctgataaagctggagcgtatctcgtggatacttagtccttcacctaatgttccaaatgatcatgttagtttgcgggtttcaaaagaagaagatcctgaaaattggcatgttcaggtattccggtcaattgactcgggctctctaaaaggatttcctagtgattgcaaagaggcttcaaagcagaatcttgtgtgccgaaagaacctcataattgataagagcattcacacagcatatgtccgggcaatcagatcagcgcaacatttcatttatatagaaaatcagtattttcttggttcttcgtacgagtggccatcctatgtgaattcaggtgctgacaatctgataccaatggaattggccctcaaaattgcaaccaagattagagctggcgaacggtttgcagtttatgtagtcataccaatgtggcctgaaggagtccctacctcggcctctgtgcaagaaattcttttctttcaggctcagacaatggagatgatgtatggagtaatcgcacgagagctcaaggccatgaatattgaggatgcaaaccttcaagattacttgaacttttactgtctgggcaatcgggaagaaccgtcaacagatggtagccctgagtcagataaatctacagataaaagtgcagcgggcctggctagaaaacatcggcggttcatgatctatgttcatgcaaaagggatgattgtagacgatgaatacgtcattttgggctcggcaaacatcaatcagagatccttggctggctcgagagataccgaaatcgcaatgggtgcctaccagcctcatcatgcatggtcttcgaagaagggtcatcctcacggccaggtatatgggtataggaactccctctgggcagaacaccttggtatggttgatgaccacttcaaggaaccttctagcctggaatgtgtaagattagtgaaccaaatagccgaagaaaactgggaaagattcgcgtcagaagagatgaaaacgttgcaagggcacctcctcagatacccagtgaaggtagagcccgatggtaagatcgtcccgctgcccgaccaagaatgcttccccgacgttggcggcaagatctgcggcgctccgacctcgcttcctgattcgctgacgatgtagcatcacagtactgacttctcttcagggtccaagctggttcttttgctcacctgtaaaacctctctgaatgtcttgtcttgccgacggatggtaatctgtgatcacacattgtgtggcgtatagggaaagcacgggctgttcacggtgtgttgtagagttgtgcctttgtaagattttttctacagtctgtacatgagacaggacagggtcattgatagttttggacatctctactgcgaactgttcacaaccattttcatttggtgccatgtgttttgtgctggcagctcttcccacagaaaaa

SEQ ID NO: 6160 - DNA, 3041 bp, Secale cereale
gactacctcctctaccagctttgccgttcgggtccgcgtccgcgtccgccccgcgtgggtggcctcgcctccccccaccggaatccccgccgcctagcggggcccgtcgcggttgcgcaacaggagggcctcccggcaccgggggcccggctccgatttcaagctggccgccgccgccgccgccgccgctcccccgtccgcgtcgccgtcgatggcgtcgtcgggcggggacgagtcgccgtcgacggccaagcccgtgctcctgcacggggacctcgacctctgggtcgtcgaggcgcggctgctgcccaacatggacatgttctccgagcacatccgccgctgcttcgcctcctgcggcaccgcctcctcctgcgcgcccaggcagcccccgccaacagccgcggcgtcggggagccggcagccgccgccaccaccaccgcaggatcatcaccagcgacccctacgtcacgctctccgtcgccggcgccgtcgtcgcgcgcaccgccgtcatccccaacagccaggagccgcgctgggacgagcagttcttcgtgccgctcgcgcaccgcgctaccctcctcgagttccaggtcaaggacaacgacaccttcggcgcgcagctcatcggcaccgcctccgtccccgccgaccgggtcgtcgccgcggccgacgaggtcgaggagtgggtccccatcctcggcaccagcggcaagacctacaagccccgcaccgcgctcttcatccgctaccgcttccgccccttcgccgccaacccggtctaccgccgcggcatccccggcgacccggaccagcagggcgtcaaggactcctacttcccgctccgccacggcggaaaagtcacgctctaccaggacgcgcacgtcagcgagggggacctgccggacgtcgagctcgagcgggggaagaagttcgagcacaaccagtgctgggaggacatctgccacgccatactcgaggcgcaccatatgatttacatcgtcggctggtcgatctacgacaaggtgaagctggtgcgcgaggcgtcgtcgtccaggccgctcccggagggcggcgagctcacgctcggagagctgctcaagttcaagtcgcaggagggcgtgagagtgtgcctgctcgtctgggacgacaagacgtcccatgacaagctcttcatcaaaacgggtggtgtgatgggaacacatgatgaagaaactagaaagtttttcaagcattcctcggtcatctgtgttctttcacctcgatatgccagcagtaagctgagcattttcaaacaacaggttgttgggacattgtttacacaccaccaaaaatgtgtgctggttgatacacaagcttcggggaacaagcggaaagttactgctttcgttgggggcctagatctttgtgatgggcgttatgatactcctcaacataggctttttaaagaccttgacacagtatttgaaaatgatttccataacccaacattttcggcaggcacaaaaggaccgagacaaccatggcatgatttgcactgtaagattgatggaccagctgcctatgatgtcttgaagaattttgaacaacgctggaggaaggcatccaaattccgtgatcgatttaggaaagtatctcgctggaaagatgatgccctgataaagctggagcgtatctcgtggattcttagtccttcacctaatgttccaaatgatcatgttagtttgcgggtttcaaaagaagaagatcctgaaaattggcatgttcaggtgttccgatcaattgactcaggctctctaaaaggatttcctagtgattgcaaagaggcttcaaagcagaatcttgtgtgccgaaagaacctcataattgataagagcattcacacagcatatgtccgggcaatcagatcagcgcaacatttcatttatatagaaaatcagtattttcttggttcttcgtacgagtggccatcctatgtgaattcaggtgctgacaatctgataccaatggaattggcactcaaaattgcaaccaagattagagctggcgaacggtttgcagtttatatagtcataccaatgtggcctgaaggagtccctacctcggcctctgtgcaagaaattcttttctttcaggctcagacaatggagatgatgtatggagtaatcgcacgagagctcaaggccatgaatattgaggatgcacaccttcaagattacttgaacttctactgtctaggcaatcgggaagaaccgtcaacagatggtagccctgagtcagataaatctacagataaaagtgcagcgggcctggctagaaaacatcggcggttcatgatctatgttcatgcaaaagggatgattgtagacgatgaatatgtcattttgggctcggcaaacatcaatcagagatccttggctggcacgagagataccgaaatcgcaatgggtgcctaccagcctcatcatgcatggtcttcgaagaagggtcatcctcacggccaggtgtatgggtataggaactccctctgggctgaacacctcggtatggtcgatgaccacttcaaggaaccttctagtgtggactgtgtaagattagtgaaccaaatagccgaagaaaactgggaaagattcgcgtcagaagagatgaaaacgttgcaagggcacctcctcagatacccagtgaaggtagagcctgacggtaagatcgtcccgctgcccgaccaagaatgcttccccgacgttggcggcaagatctgcggcgctccgacctcgcttcctgattcgctgacgatgtagcatcacagcactgacttctcttcggactccaagctggttcttttgctcacctgtaaaacctctctgaatgtcttgtctcgccaacggatggtagtctgtaccgcgtaatctgtgatcacacattgtgtggcgtatagggaaagcacgggctgttcacggcgtgttgtagagttgtgcctttgtaagattttttttctacagtctgtacatgagacaggacagggtcattgatagttttggaca

SEQ ID NO: 6161 - DNA, 3903 bp, Hordeum vulgare
gacgtgccccgccgcacaccacctcatcaccaaccacccaccggccaccggcccgagaccgagagaggagggagagtcgatcccgccggggatccagatcacgaggactcggccgacctgaacctgggcgcacgcaacggaggatccccccgcgcgcgtgactgactcctgggagccgggcccggtcctcccgatcggatctcgcgggctccaccggtcagcgcccgttacgccgggcctggccgtacatgcgaccgttgtgcccgcgttcgttccatcagcacacggcaacgcccaggaaaaagccggtttctccccctctttgttacgcgtgcgcgccataaaaaaaaatccgcttgactccttcggttaaaatactactagtactccgtggtaccactccaaagttcgttcgagcttatattttccctcattgactgatctgcagtgcagagatttcttgggttatactaattccgttttgaatcttcttggactctcttttcttttttgacatgtaatgtagtaactgtcccggaatgaagagaaatgaatgatggcaaggagttgcattggcagtgggaatcacagttacgtatgttgtttttggccatgaagatgaggaaatcggcagtgggaacgtaaaccccatgcgttattagtactaggagtactattaatctgtggagaaaagtaaaacccatgctattttaggctaggctgccaacgccgagatcctccaccacctcaccacccacctcctctaccagctttgccgttcggggtccgcgtccgccgcgtgggtggcctcgcctcccccaccggaatccccgccgcgtcgcgggggccgtcgcggttgcaccacaggggggcctcccggcaccggcaccggcaccgattttaagatggccgccgcggcagcagctgccgcgtccgcgtcgccgtcgatggcgtcgtcgggcggggacgagtcgccgtcgccgcccaagccggtgctcctgcacggggacctcgacctctgggtcctcgaggcgcggctgctgcccaacatggacatgttctccgagcacatccgccgctgcttcgcctcctgcggcaccgcctcctcctgcgcgcccaggcagcccccgccctccagccgcggggttggggaggccggcagccgccgccaccaccaccgcaggatcatcaccagcgacccctacgtcacgctctccgtcgccggcgccgtcgtcgcgcgcaccgccgtcatccccaacagccaggagcccacctgggaggagcagttcttcgtgccgctcgcgcaccgcgccaccgtgctcgagttccaggtcaaggacaacgacaccttcggcgcccagctcatcggcaccgcctccgtccccgccgaccgggtcgtcgccgccgccgaggaggtcgaggagtgggtccccatcgtcgggcccagcggcaagacctacaagccccgcaccgcgctctgcatccgctaccgcttccgccccttcgccgccaacccggtctaccgccgcggcatccccggcgacccggaccagcagggtgtcaaggactcctacttcccgctccgccatggcgggaaggtcacgctctaccaggacgcgcacgtcaacgagggggacctgccggacgtccagctcgagcgggggaagaagttcgagcacaaccagtgctgggaggacatctgccacgccatactcgaggcgcaccatatgatttacatcgtcggctggtcgatctacgacaaggtgaagctggtgcgcgagccgtcctcgtccaggccgctcccagagggcggcaacctcacgctcggagacctgctcaagttcaagtcgcaggagggcgtcagagtatgcctgctcgtctgggacgacaagacgtcccatgacaagctcttcatcaaaacgggtggtgtcatgggcacacatgatgaagaaactagaaagtttttcaagcattcctcagtcatctgtgttctttcaccacgatatgccagcagtaagctgagcattttcaaacaacaggttgttgggacattgtttactcaccaccaaaaatgtgtgctggttgatacacaagcttcgggaaacaagaggaaagttactgctttcgttgggggcctagatctttgtgatgggcgttacgatactcctcaacataggctttttaaagaccttaacaccgtatttgaaaatgatttccacaacccaacattttcggcaggcacaaaaggaccaagacaaccttggcatgatttgcactgtaagattgatggaccagctgcatatgatgtcttgaagaattttgaacaacgctggagaaaggcatccaaattccgtgatcgatttaggaaagtatctcgctggaaagatgatgccttgataaagctggagcgtatctcgtggatacttagtccttcacctaatgttccaaatgatcatgttagtttgcgggtttcaaaagaagaagatcctgaaaattggcatgttcaggtattccggtcaattgactcgggctctctaaaaggatttcctagtgattgcaaagaggcttcaaagcagaatcttgtgtgccgaaagaacctcataattgataagagcattcacacagcatatgtacgggcaatcagatcggcacaacatttcatttatatagaaaatcagtattttcttggttcttcgtatgagtggccatcctatgtgaattcaggtgctgataatctgataccaatggaattggccctcaaaattgcaaccaagattagagctggcgaacgctttgcagtttatgtagtcataccaatgtggcctgaaggagtccctacctcggcctctgtgcaagaaattcttttctttcaggctcagacaatggagatgatgtatggagtaatcgcacgagagctcaaggccatgaacattgagaatgcacaccttcaggattacttgaacttttactgtcttggcaatcgggaagaaccgacaacagatggtagccccgagtcagataaatctacagataaaagtgcagcggccctggcaagaaaacatcggcggttcatgatctatgttcatgcaaaagggatgattgtagacgatgaatacgtcattttggggtcagcaaacataaatcagagatccttggctggttcgagagatactgaaatcgcaatgggtgcctaccagcctcatcatgcatggtcttcgaagaagggtcatcctcacggccaggtatatgggtataggaactccctctgggctgaacaccttggtatggttgatgagcgcttcaaggaaccttctagtctggagtgtgtacgattagtgaaccaaatagctgaagataactgggaaagattcgcatcagaagagatgaaaatgttgcaagggcacctcctcagatacccagtgaaggtagagcctgatggtaagatcgtcccgctgcccgaccaagaatgcttccccgacgtcggtggcaagatctgcggcgccccgacctcgcttcctgattcgctgacgatgtgacgtcacggtactgacttctcttcagagtccaagctggttattttgctctcctgtaaaacctctctgaatgtcttgtcttgccaacggatgatgataacctgcaccgtaatctgtggatcacacattgtgtggcgtatagggaaagcacgggctgttcacggtgtgttgtagagttgtgcgcctttgtaagatttttttttctacagtctgtacatgagacaggacagggtcaattgatagttttgacatttctactgcgaactgtgcacgtacaagttgggtcacgagtttctaaatacctaatgttgttgggtggaatgcagtcactaggcatgttatgtttgaaactgcctacatagctgcaaag

SEQ ID NO: 6162 - DNA, 1375 bp, Zea mays
gtagatatgataggggtggcttttgcatttgcacgcaaaaacactgaccagcggtagctagcttagctagctagtacgtagagttcttcatccacagtcgtccacaccccacccgcgggccagcacttcaatggcggcggcgcctcctgccgcagaggcagctcttcttctcctcctagcattactggcactcgccgcggtggctctgagacgcggcgatgcgctgagcctggatttgtacgacgtgacctgcccggaggtggaggcggcggtgacggcggccgtgcggcaggccatggccaacgaccgcacagtggcggccggactcctccgaatgcatttccacgactgcttcgtgaggggctgcgacggctccgttctcctggactccacggccaccgtgacggcggagaaggacggcccgcccaacgcgtcgctgcacgccttctacgtcatcgacaacgccaagcgtgccgtggaggccctctgccccggcgtcgtctcctgcgccgacatcctcgccctcgccgcaagggacgccgtcgcgctgtccggtggtccgtggtgggtggtgcccgtggggcggcgggacgggcgcgtgtccctggccaacgagaccacggcggcgctgccggggccgacggccagcttcgaccagctgaagcaggcgttccacggccgcgggctgtccaccaaggacctggtggcgctgtcgggcgcccacacgctgggcttcgcgcactgctcctccttccagaaccgcatcctccgagcccagcagggcgtcgccgccgccgacgacccttccctcagcccctccttcgccgccgcccttcgccgtgcgtgccccgccaacaacaccgtccgcgccgccggctccgccctggacgccacctccgcggccttcgacaacacctactaccggatgctgcaggccggccggggcctgctctcctccgacgaggcgctgctcacgcaccccaagacgcgcgcctttgtcgcgctctacgccgcgtcgcaggaggcattcttcagggcctttacaaaatccatgctgcggatggccggcctcaacggaggccaagaggtgcgagccaactgcaggcgagttaacccatcatgatccatcctatccatgatgccatcatcattccattccattctcgtcctccgatcctcctcgtctatacactactactagtatattaattgtactattgtactgtacgtactgcctcctctgcctgtaccattatattatacagtattcgtcgtccgcacgtatttgcatcgcatccagtgccagtactcgatccggcgtgtgggggctgggctggctatatacatgcatataacatgctacctctattctcaa

SEQ ID NO: 6163 - DNA, 1310 bp, Setaria italica
gtattcttccttctcgggagtgatggcgacatcggtaatgtttgcaagcagcagctagtggtagtggatcgatccatcgagctggcctgccatccacgtagcaggaagcttttgcatttgcacgccactactgctagcagctagtagcttcattcttcgcttccgcgccggccggcgatggcaatggcatctcctactactacagtcatattaatggccgtcgcggcggcggcggcgctgctgggcggcgccgaggcgctgagcctggacctgtacgacgagacgtgcccggaggcggaggcggcggtgacggcggccgtgcggcaggccatggccaaggaccgcaccgtcgcggcggggctcctgcggatgcatttccacgactgcttcgtcagggggtgcgacgcgtccgttctcctcgactccacggccaacgtcacggccgagaaggacggcccgcccaacgcctctctccacgccttctatgtcatcgacaacgccaaggccgccgtggaggccctctgccccggcgtcgtctcctgcgccgacatcctagcgctcgccgccagagacgccgtcgccttgtccggtgggccgtcctgggtggttcccgtcggccgccgggacggccgtgtctccctggccagcgagacgtcgtcggcgctgccggggcccagggccagcttcgaccagctcaagcaggccttccacgcccggggcctctccaccaaggacctcgtcgtgctgtcgggcggccacacgctgggcttcgcgcactgctcctccttccaggaccgcatccgcagccccaacggcggcggcggcgctgaccctgccctcagcccctccttcgccgcctccctccgccgcgcctgccccgccaacaacaccgcccgcgccgccggctccggcctcgacgccaccgaggccgccttcgacaacacctactaccggatgctgcagaccgggcggggcctgctgggctccgacgacgccctgctcacgcaccccaagaccagggccttcgtcgcgctctacgccgcgtcgcaggaggccttcttcagggccttcgccaagtccatgctgcggatgggaggactcaacggaggggacgaggtgcgagcaaactgcaggcgcgtcaaccaccacctctccaactagtagagtagttgctgatgttgctgttgtagagacacagagctacctcagctcccctcttcttctatgagctgggccggatttttgaagagatgggatagggccaagcctcaatcactttaattctactcccttaaggcagtttcaatttc

SEQ ID NO: 6164 - DNA, 1350 bp, Saccharum officinarum
gcgcgcgagcgtcgcgctccaggccttcctcttcctcgtctgtcatcgcgaaccgccgcacgcccgcacccccacccggcacccgcccacggcccacccccttctccgtgtctctccgcggcggcgggcgcggttctccggccatcaccggccgctcccggaaaaactatgaggaggtacagccccccttatcgaagcccccccaggaggggatatggtggcagaggaagaagcccccctcctcctcctaggagggggtatggaggacgcaacaaagagggtagtggaagccttttggtccgcaatatcccattaagcgtcagagcggaggagcttcgagttccttttgaaaggtttggccctgtccgggatgtttacattccaaaggactattactctggggagcctcgaggatttgcctttgtggagtttgttgacccttatgatgcctctgaagcccagtatcacatgaatcgccaagttttcttcggtcgggagatagctgttgttcttgctgctgagtcgcgaaagaggccagaggaaatgcgcagcagagctagagtcagaggttactctggtcatgaaggtcgccgatcttcatattatgggcggtctcgttcccgttcccgctctcctcgttatcggggccgtcctcggtcgagatcatactctcctgcttcaaggcggcgagatgactactctgcctctccaaggagaaaggaagcacatcgagcatctcctcccaggcgcccgccaaaggagcatgatgaagataagaagcacaggtcctactctcctgccagtagagatgatgctgacaatggttatgagaagaggtcgcccctaccagacagcgatggatcccctccacaccgcaggtcccccaaggagtactcgggctcacctccaggatcccgctccaggtccgccgacgaatctcctgttcgcagtgactgaccgaccggtggatgctacaaaaatgatatgcacatgaccgtgtctcttcagcatggtcatgcggtcagtccaatgcctgtcagaccgagcttactaaaccttacccccttttgggggtgatgttgtattgctaagttccatttgtgcttagtattagcgcatactgctagactgccactgtcgtgtgtgctatgtacgtatgcttttaatcttgagtgaggtctgaggaaccagtgatgctgtcgctggtgctgaactttggaacctgtagtagcatgttgcttgcttgctgggccacggcccgttcactgggacctgttgcgcttgcctcttttgagtttggtttgaggactggacttggatgctgcaggtgctagtagtcctgtgctacta

SEQ ID NO: 6165 - DNA, 1222 bp, Setaria italica
gctttcctcttcctccactcgcatcgcgcgacatcgcttgcgcccaccacctctcggctctcgctctcgttctccgccgccgcggcggcggcggctccccggctctcaccggacgcacctgacaactatgaggaggtacagccccccgtatcgcagtccccctaggaggggatatggtggcagaggaagaagcccccctcctaggaggggatatggaggagggcggaaggagggttctgggagtcttttggtccgcaatattccattaagtgtcagagcggaggatcttcgagttccttttgaaaggtttggtcctgtccgggatgtctacattccaaaggattattatagtggggagcctcgaggatttgcatttgtggagtttgttgacccttatgatgcctctgaggcccagtatcacatgaatcgccaggttttcttcggtcgggagataactgttgttcttgctgctgagtcacgaaaaaggccagaagaaatgcgtagcagggctagagtcaggggctactctggtcatgaaggtcgccgctcttcttattatgggcggtctcgttcccgttcccgctctcctcgctaccggggtcgccctcggtcaagatcgtactcccctgctccaagacgccgagatgactactctgcttctccaaggagaaaggaggcacatcgcgcgtctcctcccaggcgcccgccaaaggagcttgatgaagataagaagcggagatcctattcccctgccagtagagatgatgctgaaaatggttatgagaagaggtcgcccccacctgacagcgatggatcccctccgcatcgaaggtctcccaaggagtactcaggctcgcctcctggatcccgctccaggtccgccgagtcccctgcccgcagtgactgattgcgcatcatctggtttgcatctattggatggatgcagtcagtccgtgcctacattgtactggctctgtttgctggaccaaacttattgaacttagttagcccttcggggcagtgttgtattgctagaaagtgtgtgtccagcttactgatagtgtgtgctgctagtgtcatctgacgcgaagaacccctgtcccgtgtacgctcggtgttggaagcttgtttcagtctgttgaaaccctgaacttgtagcatgatgctttgcttgcgtgctgggccacggcccgtttccagagaccttgagcatctacgttgc

SEQ ID NO: 6166 - DNA, 1353 bp, Zea mays
acggcccatcacccatcacgtatcgctccctccctcggccctcgatcgtacggcgcgagcgttgcgctccacgccttcctcttcctcgtctggcatcgcgaaccgccgcaccccacccacccgcccacaggccacagcccacccccttctccaggtctctccccggcggcggcgggtgcggttctccggccatcaccgtgcgcaccaggaaaaactatgaggaggtacagccccccttatcgcagcccccccaggaggggatatggtggcagaggaagaagcccccctcctcccaggaggggatatggaggacgcaaggagggtagtggaagccttttggtccgcaacatcccattaagtgtcagagcggaggatcttcgagttccttttgaaaggtttggccctgttcgggatgtttacattccaaaggactattactctggggagcctcgaggatttgcctttgtagagtttgttgatccttacgatgcctctgaagcccagtatcacatgaatcgccaagttttctttggtcgggaaatagctgttgttcttgctgctgagtcacgaaaaaggccagaagaaatgcgcagcagaactagagtaagaggttactctggtcatgaaggtcgccggtcttcttactatggtcggtctcgttctcgctctcctcgctatcggggccgtcctcggtcgagatcatactctcctgctccaaggcgggggaatgactactctgcctctccaaggagacaggaagcccatcgctcatctcctcccaggcgcctgccaaaggagcatgatgaagataagaagcggaggtcctactctcctgccagtagagatgatgctgacaatgtttatgagaagaggtcgcccccagcagacagcgatggatctcctctgcaccgcaggtcccccaaggagtactcgggctcacctcctggatcccgctccaggtccgccgacgattctcctgttgccagtgactgatcgaccgatggatgctacaatatgaatggtatgcgcatgcggtcatcagtcctatgtctttgtcagaccgagctcactaaacttacccccctttgggggtcgatgttgtattgctaagttccgtttgtgctaagtattagcgcatactgctagactgccactgtcgtctgtgctatgcatgcttttgatctcgagtgatgtttgaggaaccagtgatcgtgttgatggtgctgaacattggaacctgcagtacagtgtagcatgatgcttgcttgctgggccacggcccgttcactgggacctgttgcgtttccgtctttcgagtttgattgatgctgctgcgggtgcttttagccgtcc

SEQ ID NO: 6167 - DNA, 1364 bp, Panicum virgatum
cgcgacgtcgcgtccacccgggcacctcccctcgctctccgccctccgtctctccccgccgcggcggcggctgctccccggctgtcaccggacgcgccccgacaactatgaggagatacagtcccccatatcgcagcccccccaggaggggatatggtggcagaggaagaagccccccacctaggaggggatatggaggacggaaggagggttctggaagtcttttggtccgcaatatcccattaagcgtcagatcggaggatcttcgagttccttttgaaaggtttggtcctgtccgggatgtttacatcccaaaggactattatagtggggagcctcgaggatttgcatttgtggagtttgttgatccttatgatgcctcagaggcccagtatcacatgaaccgccaggttttctttggtcgggagataactgttgttcttgctgctgagtcacgaaaaaggccagatgaaatgcgcaacagagctagagtcaggggttactctggtcatgaaggtcgccgctcttcttattatgggcggtctcgttcccgttcccgctctccacgctatcggggccgtcctcggtcaagatcatactcacctgctccgaggcgacgagatgactactctgtttctccaaggagaaaggaagcacagcacacctctcctcctagacgcccaccaaaggagcttgatgaagataagaggaggagatcctattctcctgccagtagagatgatgctgataatggttatgagaagaggtcgcccccacctgacagcgatggatcccctccgcgccggaggtctcccagggcgtactcagcctcgcctcctggatctcgttccaggtctgcggatgagtctcctgcccgcagcgactgattgcatggtcgcattactcgcggtccggtgcatgcagccagtcggtgcctacattgtaccatctcactttgccgtctcacttgccagactgaactcattgaacttagcccttcgggggcagtgttgtattgctaggaagtgtctatcgtgcttagtactttgtcctgtgctatgtgcgtttggtgttggcagcttgtactagtcactgttgttataaccttgaacctgtagcgtgatggttgagtgctgggccagggcccatatcctttgacactttatgcatctgcgttgcatgcgttcccattctgtccgggcctggatctagcatacaggcaaggcgatgggcctctcgtttgtgtttgcggtgcacttgggcgtggcgttctgggtattggttggttgattggacttgtgaatgaaagtgctggtatccttcgcctgccaggtgatgctcgtgataccagttggatttgcttc

SEQ ID NO: 6168 - DNA, 1213 bp, Pennisetum glaucum
ctctcctactctctctttcctccgctcgcatcgcgcggcatcgcatcgcgtgcacccaccacccgctcgctcgctttccgccgtctccctccgccgccgcggcggatctccggctaccaccggcgcacccgacaaaactatgaggaggtacagccccccgtatcgcagtccccctaggaggggatatggtggcagaggaagaagcccccctcctaggaggggatatggaggagggcggaaggagagttccgggagccttttggtccgcaatattccattaagcgtcagagcggaggatcttcgagttccttttgaaaggtttggtcctgtccgggatgtctacattccaaaggattattatagtggggagcctcgaggatttgcatttgtggagtttgttgacccttatgatgcctctgaggcccagtatcacatgaatcgccaggttttcttcggtcgggagataactgtcgttcttgctgctgagtcacgcaaaaggccagaagaaatgcgtagcagggctagagtcaggggctactctggtcatgaaggtcggcgctcttcttattatgggcggtctcgctcccgttcccgctctcctcgctaccggggtcgccctcggtcgaggtcattctcccctggtccaaggcgccgggatgactactctgtttctccaaggagaaaggaggcacatcgcgcgtctcctcccaggcgcccgccaaaggatcttgatgaagataagaggcggagatcctattctcctgcaagtagggatgatgctgaaaacggtcatgagaagagatcacccccacctggcagcgacgggtcccctccgcaccgcaggtctcccagggagtactcaggctcgcctcctggatcccgctccaggtctcccgaggagtctcctgcccgcagtgactgatagcacatcatctggtctgcatctcctggattgggggatgcagtcagtgagttagccgggctctgtatgccgggccaaacttatgaacttttagttagccctgcgcggcagtgttgtattcctagaaaatgtgtacccagcttggtagtgtgtactgctagtgtcatcgtaagtcatccgagtatctgacttcgcgaaccccgtcccccttgtatgcttggaggtggaagccgcttgtttcagtccgttgaaaccgtgaacttagcttccgtgctgggtcacggcccgttt

SEQ ID NO: 6169 - DNA, 1289 bp, Oryza sativa
cctcgcggtcgcctcgctttctccctcgccaactcgcctaccctccccacccccgcgtcggcggcggcggcagcggcagcggcagcgacggagcctcgccggcggcaagcgtactcacccgacaaaacaatgaggaggtatagtccaccttatcgcagtccaccaaggaggggatatggtggcagaggaagaagtccccctaggaggggatatggaggacggaaggaacagggttctggcagtctcctggtccgcaacatccctttaagctgcagagcggaggatcttagagttccttttgaaaggtttggacctgttcgagatgtttacctgccaaaggattattataccggggaaccgcgagggtttgcattcgtggagtttgttgacccttatgatgcttctgaggcccaatatcatatgaatcgtcaggtggtttttggccgggagataactgttgttcttgctgctgagtcacggaaaaggccagaagagatgcgcagtagagccagagtcagagggtactctgaccatgaaggccgtcgttcatcccattacgggaggtctcgttcacgttcgcgttcccgctctccccgttatcgtggtcgtccacggtcaaggtcatactctcctgctccaagacgacgagatgactattccgcatccccacagagaaaagacacacatcgtgcaaaatctcctaggcgtcagccaaaagaacatgaagtagacaagaagcggagatcctattctcctgccaataaagatggggaccggcgtgatgctgataatggttatgaaaagaggtcgccgccagctgacagcgatggatcccctccgcaccggaggtcccccaggcaatcctcaggatcgcctccaggatcccgctccaggtctgccgacgggtctcctgcccgcagtgactaacagaagaacactgcgcacgctgtgctacatcctctctagcttcttgttggtcagaccggaccagtttaagtaaaaacccttttgggcttgttgtaaaacttgtaatgctagcatctgtcgtggtttggtagcggaggacttggatcgtcaccattgtgtgtgctcgcttctcagtggatggagacattttgagtcgtgtgtgatgaaaccttagacttgctgcatggcattgtattgtgttaaacttatccgtatgccttgtgtattcttgtgcttgccatgtgctcatgcgcttgaattgctgtgcacgcggagtcgaactatgccgtcgacttcttttggaactcttttcgccttaaaat

SEQ ID NO: 6170 - DNA, 2608 bp, Zea mays
aaacacgaggacctcgcgacgcgactccacccacacgcacagctccatgcctgcccacgcggacgcctgagcatcagaccagaggagagctatatctactccgctcgccaccaccaccaccccagtccagcccagcccaccacacccagctctctcccttctccaccagacacagccaggccttgtcttcttcttcctcccgattcgtgtttttttcctttctttttcgctgctgcaaaatatcgccgtttcctatctcttatcccccacgcatctcccgcctcgcctccgccacacgttccgcgcctccacacctctctcgatctcgcgcgtctggatttttccgacccgatcttttccccccgcatcagctgtcttctccttgcgccgggccaggccgcctctccctcctcccttcgtttgcgtctcaccacttatcattcatcactgctacttcgttcgagagggatacggataccccattgccggcccactggcgagagagattttggtgcgactacagagtcccaatcctataccccggccccaaaactcttctctgctaccagtgaccgttccttccgccggaatcgattttctgagggggcgagttccgccaccgtgggcgtatcaatatcggcgaacgctcgagttctcgtggcgaaaaacaacgcgttctgcgaggattccgtggtgaaagaccggggccttttttctgcggattccagctgccaaacagagatgtcggctctcctcgacctactgatggggatcttccgccagcagaccctcggcggcgccgccctggagctggccgcgctggcggcgcccctctggctcgccgctctcgtcggcctcctcatcgggtgggcgtggcgcccgaggtgggcgggggtcgtcgtcggcgaccacaacgctcagcaggcggcgcagctccctccgccgcccgccgctgccgcggtggtccctcgcaacgaggcgcccgccgtcgtaacgagaactgtggtggctcctgcggcgcccgaggacgagcagctggcggtgaacacccgtgacttgatgcacctctggcggctcgtccaggagaaggacggtggcccgtcgtggatccacatgatggaccgcaccttgccgaccatgaggtaccaagcctggcggagagacccaccgaatggtccaccacagtaccgcagtagcactatctttgaggatgcatcaccagaggttgtgagagatttcttctgggacgacgagttccgggtgaagaacagctgggatgacatgcttcttcagtacgagacactggaacagtgcgccaagactggaaccatggttgtccggtgggtcaggaagttcccgttcttctgcagcgacagggagtacatcataggccgcaggatatgggcatctgggaagacgttttactgtgtgaccaagggcgtgcctcgtccctctgttccaagacaaaacaaacctcgtcgtgtggacttgtactactcgagctggtgcatccgtccagttgaatcaagaaaaggcgacggtgcaatgactgcatgtgaggtgctcttattccaccatgaagatatggggatcccatgggagattgcgaagctcggtgtccggcaggggatgtggggctgcgtcaagaggatagagcctggccttcgggcataccaggttgcgaggaccgctggagagcctatctcaaaacatgccgccatggcgcatgttaccaccaggttcgatgccgacgagctcgtcacggaagacagcgcggaggccagttcatccagtgacaacaacaagaccgccgaggttgagaagccaaagcactggacaaacaacatacccaaggttctcatgatcggcggcgccgtcgccctggcttgcaccttcgacggtggattgatgaccaaggccgccatattcggcacggcgaggaggtttgcagggccaggaaggcggtaggtggatggagctggtcaccctagagcaatgccatgctaatcatgtgtagcaaagcgttggttggatggatgcctggaagtgccctaagcagtcctttttgtagcaatgcactgcagaggacagaatgccttgtctagttgctcagtctagacatcatcctcatgttgcagataaggtggtgtgctcttattacagatcagtatcagttgagaaaaatagatccctgcacatcccgagaaaggaaatggacgacaaagatccagcgacacagagaagtgtacgtaagcagaccgggcatgcttgtgctgctgctgcagccgcgccgccgggttagagccagctggataggttagaaatgtagcattattatgaggacaaagtgtacgatgaacaaggttcattctggcagctgtacgacgaacaaggttcattgtcgttagatgaaacgacaagaattcactgctgtttagtaacaagaattcttggtcttgtagctctggcatctatttgttctcccctatggaaactagatgttgacctttttggcagttggtgcaggatttttgcacgtacaagtttttacccaatgctgtgtccaatccagctacgctgtgtgtttggaataagaaattttttctct

SEQ ID NO: 6171 - DNA, 1189 bp, Saccharum officinarum
ccccgaccccctatctccagtccccaccggccaccgcgaaccgccggaggaatctctggcgatggcgccgccacccgctgcggttgccgccgtccgctaccaccgcccgcacctgctcctccgccgcggcggcgggggtctcctcccatcgcctccgggccccgccacgctccccttcgcctcgcggggcgcggcggcctccgcgcccgcgcgcctgcgcctgccgccgccgcggttctcgctctcccccgtcccgaagagcctctccgcctcctcccacgtccccgtacgctccctcttcaccggcatcgtcgaggaggtcggccgcgtgcgccgcctcggcccgccgctcgcgccgtcttttggcggcggcggcgaggctcccggcctcgacttggaggtcgagaccagggacctcctcgccgggacgcagctcggcgacagcgtggcggtcgacggcacctgcctcaccgtgggggggatcgaaccggccgcgtccacgctcaccttcggcgtggccccggagacgctccgccggacttccctgggagggcgggccccgggcgacggcgtcaacctcgagcgcgcgctcacgccgtcgtcccgcatgggggggcacttcgtgcagggccacgtcgacgggaccggggagatcgccgcgttccggccggacggggactcgctctgggtcaccgtgcgcgcgccgccggagatcctccgcctgctcgtgcccaagggcttcgtcgccgtcgacggcaccagcctcaccgttgtcagcgtggacgacgagggcgggtggtttgacttcatgctcgtcaggtacacgcaggacaacatcgtgctgcccaccaagaaggtcggagacaaggtgaacctggaggcggatattctggggaagtacgtcgagaagctcctcgccgggagggttgaggccatggcgaaggttgattcgtgatctaccattgctgagctgctgggttgctcgtcataggggtgaagaaaggcttggattcaatgcctatgcccggctcagctaggtcctatgatggagatgtcactgaacgaattttatgcatgagatttttgttatgacgtgggggagtgctcatttgcttgctgcaaggcctgcaactgtaatatggattcttcaagaatttttggtatgatatttgggatatgtctcaaaaat

SEQ ID NO: 6172 - DNA, 1324 bp, Zea mays
gtcgacgccgactccaactcagtagtctatccccaccgcgaaccgccgcaggaatctctgacgatggccccgccggccgctgcggttgccgccgtccgccaccacagcccgcacctgctcctccgccgcgggggcgggggtctcctatcatcgccttcgggccccgccacgctccctttcgcctcgcggggtgcggcctccgcgcccgcgcgcctgcgcctgccgccgccgcagttctctctctcccccgtcccgaagagcctctccgccgcctcctcctcccacgtcattgtacggtccctcttcaccggcattgtcgaggaggtcggccgcgtgcgccgcctcggcccgccgctcgcgccgtctgggggtggcggcggcgaggctcttggccttgacttggaggtcgagaccaaggacctcctcgccggtactcagctcggtgacagtgtggcggtcgacggcgcctgcctcaccgttgcggcgatcgacccggccgcgtccacgctcaccttcggagtggccccggagacgctccgccggacgtccctgggagagcgcgccccaggcgacggcgtcaacctcgagcgcgcactcactccgtcgtcccgcatgggcgggcacttcgtgcagggccacgtcgacgggaccggggagatcgttgcgttccggccggacggggactcgctctgggtcaccgtgcgcgccccgccggagatcctccggctgctcgtgcccaagggcttcgtcgccgttgacggcactagcctcactgttgtcagtgtggacgacgagggcggctggtttgacttcatgctcgtcaggtacacgcaggacaacatcgtgctgccgaccaagaaggtcggagacaaggtgaacctagaggcggatatactgggtaagtacgtcgagaagctcctcgctgggagggttgaggccatggcgaaggttgattcttgatctaccattgctgagctgctggatcaatggtcattctacaggtatttcagcaatgttatgttcatcaataatagcagttcattccattttgttgcaattggcttgttgtttttttatttcagactttcagtgagacagtaataaaacataagtgatcgaggaaatgacttatcatttcttttcatccgttgagataaatgtacaagtatccatactctaatatgcagccaaatttagaagtttgttttgttgctgatgaatattagcaaagggtgaacaagagcagcatagcagcatccagaaactaagtgactaatgttgctgccaaataaatgataaggccctccagaacaatcatatccaa

SEQ ID NO: 6173 - DNA, 1156 bp, Zea mays
ggaaaaaaaaaacctcccccacctgccaccgcgaactgccggaggaatctctggcgatggcgccgccagccgctgcggttgccgccgtccaccaccgcagcccgcacctgctcctccgccgcggcggcgggggtctcctcccatctccttcgggtcccgccacgcttcctttctcctcgcggggtgcggcctgcacgcccgcgcgcctgcgtttgccgccgccgcggttctctctctcccccgtcccgaagagcctctccgccgcctcctcctcccacgtccctgtacggtccctattcaccggcatcgtcgaggaggtcggccgcgtgcgccgtctcggcccgccgctcacgccgtctgggggcggcggtggcggcgaggctcctggccttgacttggaggtcgagaccaagaacctcctcgctggaacgcagctcggtgacagcgtggcggtcgacggcgcctgcctcaccgtggcggcgatcgacccggccgcgtccacgctcactttcggcgtggccccggagacgctccgccggacgtccctgggagggcgcgccccgggcgatggtgtcaacctcgagcgcgcgctcacgccgtcgtcccgcatgggcgggcacttcgtgcagggccacgtcgacggaaccggggagatcgctgcgttccggccggacggggactcgctctgggtcaccgtgcgcgccccgccggagatcctccggctgctcgtgcccaagggcttcgtcgccgtcgacggcactagcctcactgttgtcagtgtggacgacgagggcggctggtttgacttcatgctcgtcaggtacacgcaggacaacatcgtgctgccgaccaagaaggtcggagacaaggtgaacctggaggcggatatactggggaagtacgtcgagaagctcctcgctgggagggttgaggccatggcgaaggggtgaagaaaaggcttggattcaatgtctatgccgagctcagcctgcagctgcaacatggattcttcacggattttcgttattatgttttggagatgttcatttggttgctgcagccagcaaattagaaatgctattctggtgcacttacctctctactgtatgagacctgagctttgtgattggaacaatgtgaatacaaggcttagcac

SEQ ID NO: 6174 - DNA, 1292 bp, Setaria italica
cagcccaccaactgaccccatcctgaccccgagccgccgccgccgggggaatctctcgccatggcgccgccgcccgccaccgccgcagcggccgccgccgtccgccaccaccggccgcacctgctcctccgccgcggaggggggctcctcccctcgccgtcgggccccgctacgctccccttcgcctcgcggggcgcggccgcgcgcatccgcctcccgccgccgcggttctctctctcgcccgtccccaagagcctctcggccgcctcctccgcctcccacgtccccgtgcggtccctcttcaccggaatagtcgaggaggtcggccgcgtgcgccgcctcggcccgccgctcgcgccgtccggcggcggcggcggcggcggcgaggctccaggccttgacctggaggtagagacgaaggacctcctcgccgggacgcagctcggggacagcgtggccgtcgacggcacctgcctcaccgtggcggcgatcgacccggcggcctccacgctcaccttcggcgtggccccggagacgctccgccggacgtccctgggcgagcgcgccccgggcgacggcgtcaacctcgagcgcgcgctcacgccgtcgtcccggatgggagggcacttcgtgcagggccacgtggacgggaccggcgagatcgcggcgttccggcccgacggcgactcgctctgggtcaccgtgcgcgcgccgccggagatcctcaggctgctcgtgcccaagggcttcgtcgccgtcgacggcaccagcctcaccgtcgtcagcgtcgacgacgagggcgggtggttcgacttcatgctcgtgcgctacacgcaggacaacatcgtgctgcccaccaagaaggttggcgacaaggtgaacctggaggcagatatactgggaaagtacgttgagaagctccttgctgggagggtggaggcgatggcgaaggcggattcttgagatgccattgttgagctgctgaattgctcatcattctataggtaatcttcatcaataacagtaattcttttcgttttgtgtaattgggttgctgcctctttttctttgagagaaatagtaaagcatcaaattatcgtgggaattactcatcattttgagaaatgtagaattatccacactctattgcaacatatgcagccaaatgaagaagtttgttttgttgttgatttagatgaacattagcaagaggtaaacaagagcaagattgagaaaataagtgaacaatgattctgccaaagaaatgccgaaccacttcaacataatcatat

SEQ ID NO: 6175 - DNA, 1168 bp, Panicum virgatum
caccaactaaccccatcccgaccccgagccgccgccggaggaatcgcccgccatggcgccgccgcccgccaccgccaccgccgcggcgtccgccgccgtccggccgcacctgatcctccgccgcggcgggggcctcctcctcccctcgccgccgtgcgccgccacgctccccttcgcctcgcggcgcctccgcctcccgccgccgcggttctcgctctcgcccgtcccgaagagcctctccgccgcctcccacgtccccgtacggtctctattcaccggcatcgtcgaggaggtcggccgcgtgcgccgcctcggcccgccgctcgcgccgtccggcggcggcggaggcggcgaggctcccggcctggacctggaggtcgagacgaagagcctcctcgccgggacgcagctcggggacagcgtcgcggtcgacggcacctgcctcaccgtggcggcgatcgacccggccgcgtccacgctcaccttcggcgtcgcgccggagacgctccggcggacgtcgctgggcgagcgcgccccgggcgacggcgtcaacctcgagcgcgcgctcacgccgtcgtcccggatgggcgggcacttcgtgcagggccacgtcgacgggaccggcgagatcgctgcgttccggcccgacggggactcgctctgggtcaccgtgcgcgcgccgccggagatcctcaggctgctcgtgcccaagggcttcgtcgctgtcgacgggaccagcctcaccgtcgtcagcgtcgacgacgagggcgggtggttcgacttcatgctcgtgcggtacacgcaggacaacatcgtgctgccgaccaagaaggtcggcgacaaggtgaacctggaggcggatatactggggaagtacgtcgagaagctccttgctgggagggtggaggccatggcgaaggtggattcttgagtagccattgtggagctgctgaattgctcgtcactcaataggtattatggcaaggttatgttcatcaataagcatagttcattacattttgtgtaattgggctgtggtcttttttctttgaaaaaagtgttaaaacgtcaagttatctggggaattactcatcattttgagaaatgtagaattatctatactctattgcgacatttgcagccaaatgaagaagtttcttttggtgtc

SEQ ID NO: 6176 - DNA, 1392 bp, Setaria italica
gcggcgtgaacaaatatcacgccccaagaagcagaagtggattacgcacgcgaagcttagcaagaatcacctccaatcttactgcttgactcgagccctagattagaagagaggcgcactgcgtgagtgagcggtgggacagcacgatggcgctgcccgcgacctgttcgacgttttgcctgaaaggggcggagcagcgcggtccaccccgctggagcttccacaggttatctgcgcgcgcggcgagcctcataggcttcggttcttgcccacgccgcgggaggctcgtgctcgccggctgcgcgcgggcaggggcgggggcgagcgactccaaggccgtgcagctggtgctcggcggccgtgcgcgcgacgacgccggcgacaccgactccgagtccagcgatgacgagggcggcgaggacggcgaggtgcccatgacggacgaggagcggaggacgctgcgccggaagatacgggagatgatggaccgcgtcccggagacggcggagctcacggacccggaggagcggaaggccaagatgcgggagctgctgaccaaatacgagctggtggtggaggaagaggacccggactggcctgaggacgccgaggatgggatgggcttcagcctcggccagttcttcgacaagatcaccatcaaggccgagaagaaggatgacgccgacgaggaggatgacacggggaatcagggtgacaaggagattgtttgggaggatgacaattacatcaagccgattagggatgtcaagacacaggattgggatgcgtccgtgttcactgatttcggaccgatggttgtgcttgtgcataacagatataagagaccacaggagaatgagatggcaagggctgagcttactaaggcgatcgagttgttttgggaacacaatctgccgtcaccaaggtgtgtggcggtagatgcctgtgccgaggctgaccttgtggacgcgctgaaggtttctggtttccctgagattctcttcactaatgcagggaggataatacaccgtgagaaagttgttcggtcggcggaggcatggtcgaggatgatggcgttcttctactacaaagcagcaaggccacctttcttgtgtgaagcagatgggaagggtcaagaaaaggtccctttgatgtcatgagaacaacgtggaagcttagcctcgtattagttatagtaatctagtgcctcgaattgcatcagtgtacactattaggattctagtgttgaaactctcaactctttcgacaaatctccactaagcaacctctttgtggtgcggtgcaatgtctggaaatttctgtcacaaggattgaacattagactattagaatatagatataaagatcacaaggatggagatgtctatgaag

SEQ ID NO: 6177 - DNA, 1302 bp, Pennisetum glaucum
gcggcgtgaacaaatatctctccgaacccaagaagcagaagcggattacgcacgcgaagcttagcgagaatcgcctccttgccctgtagtagaagagaggcgcactacgcgagtaagcggcggggcagcacgatggcgctgcccgcaacctgttcgacgttttgcctgaaaggagcggagcagcgcggtctacccgccttgagcttgcacaggttacctgcgcgcgcggcgagcctcataagcttcgtttcttgcccacgccgcgggaggctcgtgctcgccggctgcgcgcgggcgggggcgggggcgaacgattccaaggccgtgcagctggtactcggcggccgtgcgcgcgatgatgccggcgacaccaactccgagtccagcgatgacgagggaggtgaggacgacgaggtgcccatgacggacgaggagcggaagacgctgcgccggaagatacgggagatgatggaccgcgtcccggagacggcggagctcacggacccggaggagcggaaggccaagatgcgggagctgctgaccaagtacgagctggtggtggaggaggaggacccggaatggcccgaggacgccgaggatggtatgggcttcaacctcggccagttcttcgacaaaatcaccattaaggccgagaagaaggatgacgccgaggaggaggatgacacggggaatcagagtggcaaggatattgtttgggaggatgaccattacatcacgccgattagggatgtcaagacacaggattgggatgcgtccgtgttcacagattttggacccatggttgtgcttgtgcataacagatataagagaccacaggagaatgagatggcgagggctgagcttactaaggcgattgagatgttttgggaacacaatctgccatcaccaaggtgtgtggcggtagatgcctgtgctgagcctgatctcgtgaacgcgctgaaggtttctggtttccctgagattctcttcactaatgcagggaggataatacaccgtgagaaagttgttcgatcggcggaggcgtggtcgaggatgatggcgttcttctactacaaagcagcaaggccactgttcttgtgtgaagcagatgggaagggtcaagaaaaggtccctttgatgtcatgagaacaacgtggaggcttagccttgtattagttatagtaatctagtgcctcaaattgcatcagtgtacactattaagattctagtgttgaaactgttaactgtttcgacaaatctccactaagcaactctttgtggtgcagtgcaatgtctggaaat

SEQ ID NO: 6178 - DNA, 1530 bp, Sorghum bicolor
caccgtgagcagagacccccgaaatctgtgttccgcatcaccgcctcttcctcgtgctcgtggagcaagaagcccaagagcggcagcaaggggtaggacaccaaggcgctggaccatccgttgcacgtagcatgagcggcagcaaggagatcgtcgcatgagccgccatggcttctctggccgaccggctctcgccccgccccgcgccgacgcctctccacgatcccgatctgtgtgcctgcctgcagcctgcgtgggatggagctggaggcggcgccgcggcagcagcagcagcagctggaggaggaggtggaggtggtggggtgcccatgcggcggcgggtccgaggccgcggaccagttcgagcggctccacgacgcggtgctgctcgacgtcctcaaccgcatcggcgacgtcaaggcgctgggccgctgcgccctcgtctcgcgccgcttccacgcgctcgtgccgctcgtcaactccgtcttcgtccgcgtcgactgcgtcatccccgacgacccgacgccctccgccgccgccgccgcaccgggctccccgacgcaccaggccccggccccggccgcgcgcgggcgcggcggcgcgctcgcgcacatggcgcgcgtcctgctcggcggcatcgccaagcccatccacgcgctcgcccagatcctctcccccgccgcggcggccgtctcccggcgctccgacccaccactgcccgcttccccgcccgcacccgtcgcggacgtctcccaccactcgccctccgaggtgctccgctccttcagggagctgcggcgcctccacatcgagctgcccacgggcgagctcggcattgacgacggtgtgctccttaagtggaaggccgacttcggctccaccctcggcagctgcgtcatcctcggcgcctcgtcggtcttgtccaagccgcccacagggtcgaccacccaggcggaacctgctgcggccgacagcacggccgccgctccggataccagtagggagactgaagagccggggagcctgcctgattctctctacacaaatggaggcctcaagcttcgcgttgtctggaccatcagctccctgattgctgcgtcggcgaggcattactcgctgcacccgattatctgtaatcacgaaacgctggagagcttggacctgacagatgccgacggccaaggggtgctcaccatggacaagaggcagctgcaggaactgcgggtgcggcccgtctctccgtcagagagctcgcaccgcacactcatgccggcactcagtatgcgtctgcactatgcaccgctcattgagctgcctgggggaaccctgctgaagggcgcgacactggttgcgatcagaccaagcgaggatgccttgagcgagggccaaggggctggggctgcaggtcctgttggtacatgctggatttcagaggcccttgaggagccatatcggactgctgcaaaggtgcttctcaagagaagggcatattgccttgaaatgaactcgttctgagcaccagggattcag

SEQ ID NO: 6179 - DNA, 1573 bp, Sorghum bicolor
cccctccccctttccaccgtgagcagagacccccgaaatctgtgttccgcatcaccgcctcttcctcgtgctcgtggagcaagaagcccaagagcggcagcaaggggtaggacaccaaggcgctggaccatccgttgcacgtagcatgagcggcagcaaggagatcgtcgcatgagccgccatggcttctctggccgaccggctctcgccccgccccgcgccgacgcctctccacgatcccgatctgtgtgcctgcctgcagcctgcgtgggatggagctggaggcggcgccgcggcagcagcagcagcagctggaggaggaggtggaggtggtggggtgcccatgcggcggcgggtccgaggccgcggaccagttcgagcggctccacgacgcggtgctgctcgacgtcctcaaccgcatcggcgacgtcaaggcgctgggccgctgcgccctcgtctcgcgccgcttccacgcgctcgtgccgctcgtcaactccgtcttcgtccgcgtcgactgcgtcatccccgacgacccgacgccctccgccgccgccgccgcaccgggctccccgacgcaccaggccccggccccggccgcgcgcgggcgcggcggcgcgctcgcgcacatggcgcgcgtcctgctcggcggcatcgccaagcccatccacgcgctcgcccagatcctctcccccgccgcggcggccgtctcccggcgctccgacccaccactgcccgcttccccgcccgcacccgtcgcggacgtctcccaccactcgccctccgaggtgctccgctccttcagggagctgcggcgcctccacatcgagctgcccacgggcgagctcggcattgacgacggtgtgctccttaagtggaaggccgacttcggctccaccctcggcagctgcgtcatcctcggcgcctcgtcggtcttgtccaagccgcccacagggtcgaccacccaggcggaacctgctgcggccgacagcacggccgccgctccggataccagtagggagactgaagagccggggagcctgcctgattctctctacacaaatggaggcctcaagcttcgcgttgtctggaccatcagctccctgattgctgcgtcggcgaggcattactcgctgcacccgattatctgtaatcacgaaacgctggagagcttggacctgacagatgccgacggccaaggggtgctcaccatggacaagaggcagctgcaggaactgcgggtgcggcccgtctctccgtcagagagctcgcaccgcacactcatgccggcactcagtatgcgtctgcactatgcaccgctcattgagctgcctgggggaaccctgctgaagggcgcgacactggttgcgatcagaccaagcgaggatgccttgagcgagggccaaggggctggggctgcaggtcctgttggtacatgctggatttcagaggcccttgaggagccatatcggactgctgcaaaggtgcttctcaagagaagggcatattgccttgaaatgaactcgttctgagcaccagggattcagttccacagagttctacccttctgacaggt

SEQ ID NO: 6180 - DNA, 977 bp, Hordeum vulgare
ccccccagccagcagcagcgccggcgagaggggcagaagagtagagggccggaggcgatggggctgggcgtgagggcggcgccgttcacgtacgtggcgcacgcgctggccgtggcggccgccgccatggtgctgtactggtgcatccacttccgcggcggcctcgccttcgaagccgacaacaagaacctcatcttcaacgttcatcctgttcttatgttgattggctttattattcttggcagtgaagctataatggtatacaaggtacttcctacggtgaaccatgatacaactaagttgatccatctagtactccatgctattgcgcttgtgctcggtgcggtcgggatatactgtgctttcaagaatcacaatgaaactggaattgcgaacttgtacagtctgcattcttggcttggaataggaacaatttctctatatggtattcagtggatatttggattcttgaccttcttcttccccaaggctgcgccaaatgtgaggaagggtgctcttccttggcacgtacttcttggaatcttcgtttacattttagccctggcaacggcagaacttgggtttctggagaagctcaccttcctccaaagctcaggcatcgacaaatatgggccagagtcatttctggtgaacttcacggcgttggttgttgtgctatttggtgcctcagttgttgtagctgctgttgccccagctcgccttgaagaaccacagggttacgctccaatcccagaaaactagtatgtgtgaagtgtactgcataaacagaaattcacaaagttagctgtcaccatagtgctgcgataacagtatctctccgattgaaaatgaatgatctgataacaaaatgtcatgcatcttccttgtgtatatgtaaatacatacaagcacatattgttcttcgatgtatcatgtataattgaaacatctatgtaagcagctattttataaattac

SEQ ID NO: 6181 - DNA, 1124 bp, Hordeum vulgare
aacacaccagaaaaaaagtttcatttataagagaggcgcggggacgccacgctcccgcattgtctccactcgctcgctccgtccgtcgggaaaccaccaccagccagcagcagcgccggcgagaggggcagaagagtagagggccggaggcgatggggctgggcgtgagggcggcgccgttcacgtacgtggcgcacgcgctggccgtggcggccgccgccatggtgctgtactggtgcatccacttccgcggcggcctcgccttcgaagccgacaacaagaacctcatcttcaacgttcatcctgttcttatgttgattggctttattattcttggcagtgaagctataatggtatacaaggtacttcctacggtgaaccatgatacaactaagttgatccatctagtactccatgctattgcgcttgtgctcggtgcggtcgggatatactgtgctttcaagaatcacaatgaaactggaattgcgaacttgtacagtctgcattcttggcttggaataggaacaatttctctatatggtattcagtggatatttggattcttgaccttcttcttccccaaggctgcgccaaatgtgaggaagggtgctcttccttggcacgtacttcttggaatcttcgtttacattttagccctggcaacggcagaacttgggtttctggagaagctcaccttcctccaaagctcaggcatcgacaaatatggaccagagtcatttctggtgaacttcacggcgttggttgttgtgctatttggtgcctcagttgttgtagctgctgttgccccagctcgccttgaagaaccacagggttacgctccaatcccagaaaactagtatgtgtgaagtgtactgcataaacagaaattcacaaagttagctgtcaccatagtgctgcgataacagtatctctccgattgaaaatgaatgatctgataacaaaatgtcatgcatcttccttgtgtatatgtaaatacatacaagcacatattgttcttcgatgtatcatgtataattgaaacatctatgtaagcagctattttataaattacgtatttgtcttgatctgatgagttttattgtgctctactattatttgtttgt

SEQ ID NO: 6182 - DNA, 972 bp, Triticum aestivum
cagcagcagcgccggcgagagaggagcaggggagaggggcagagggccggaggcgatggggctgggcgtgagggcggcgccgttcacgtacgtggcgcacgcgctggccgtggtggccgccgccatggtgctgtactggtgcatccacttccgcggcggcctcgccttcgaagccgacaacaagaacctcatcttcaacgttcatcctgttcttatgttgattggctttattattcttggcagtgaagctataatgatatacaaggtactacctacggtgaaccatgatacaactaagttgatccatctagtgctccatgctattgcgcttgtgctcggtgcggtcgggatatactgtgcttttaagaatcacaatgaaactggaattgcgaacctttacagtctgcattcttggcttggaataggaacaatttctctatatggtattcagtggatatttggattcttggccttcttcttccccaaggctgcgccaaatgtgaggaagggtgctcttccttggcacgtactacttgggatcttcgtttacattttagccctggcaacggcagaacttgggtttctggagaagctcaccttcctccaaagctcgggcatcgacaaatatggaccagagtcatttctggtgaacttcacggcattggttgttgtgctatttggtgcctcagttgttgtagctgctgttgccccagctcgccttgaagagccacaggattatgctccaatcccagaaaactagtacagtatgtgtgaagtgtactacgtaaacagaaattcactaagtttgttgtcaccatagtgctgtgataccagtatctctccgatttgaaaaatgaatgatctgataagaaatgttgtgcatcctccttgtgtatatgtaaatacatacaagtacatattgttcttccatgtatcaatgtataattgaaacatctatgtaagcagctattt

SEQ ID NO: 6183 - DNA, 1068 bp, Panicum virgatum
acaatcttccccctccactcattgcgtcgccgtcgccgttggcaagcagcagcgtcgcagggaaggaacaagggggccgagggccgcgaggcgaggaggaaggggaaggaaggaaggaaggaaggaaggaagaagagggtcggggagcgatggggctgggcgtgcgggcggcgcccttcacgtacgtggcgcacgcgctggccatcgcggcggcggtcatggtgctggtgtgggccatccacttccgcggagggctcgccatcgaggccaccgacaagaacctcatcttcaacgttcatcctgttcttatgctgattggatatattattatcggcagtgaagctataatggtatacaaggtatttccaacgttgaaacatgacacggctaagcttatccatctcattctacatggcatcgcgcttgtccttggtgcggttggaatatactttgctttcaaaaatcacaatgaaagtgggattgccaacctttacagtctgcattcttggcttgggatcggaacgattactttgtatggtattcagtggatatttggattcgttacattcttcttccctggtgctgcaccaaacttgaggaggagcctccttccttggcacatactgtttgggctattcgtctacatcttagcactggctaatgcagaactcggctttctggagaagctcacttttctcgagagctcaggcctcgacaaatatggtaccgaggcattcttggtgaacttcacagcattggttgtcgtgctatttggtgcttctgtcgtggtagctgctgtagctccggctcgcctggaagaaccacagggttatgctccaatcccagaaaactagtacaaatgaagtgtacagaatatatatagttgactggattggccgttaccataaggagataagatattcgtatctctttacttaaaagaaaaaaaaggtactggaattgtcacaataagaagataatgcatcttcattgtgtgtgtatgtacattctgtgatactcaaaatttcagtatgttaatatatgcaagactgatatcctgcttgataa

SEQ ID NO: 6184 - DNA, 1044 bp, Saccharum officinarum
ctctctctctccctccactcattgcgtcgccgttgagagcgttggtggcagcagcagcatcgcgggggggcaaacaggggacaagggcaaccgggccgacgaagaggaaaaggaagaaagcgtcgcggagcgatggcgcttggccttggcgtgcgggcggcgcccttcacgtacgcggcgcacgcgctggccgtcgcggcggcggccatggtgctggtctgggccatccagttccgcggcgggctcgccatcgaggccaccaacaagaacctcatcttcaacgttcaccctgttcttatgcttatcggttatattattatcggcagtgaagccataatggtatacagggtacttccaacaacgaaccatgacacaactaagctgatccatctaattctccacgggattgcacttgtccttggtgccgttggaatatactttgctttcaaaaatcacaatgagagtgggattgccaatctttacagtctgcactcttggattgggataggaacaattactttatatggtattcagtggataattggatttgttacattcttcttccctggtgctgcaccaaacgtgaagaagggtgttcttccttggcacatactctttgggctctttgtctacatcttagcattggctaatgcagaactcggctttcttgagaagctcactttcctcgagagcgggggggtggacgggatatggcacagaggcattcttggtgaacttcacagcattggttgtcgtgttatttggtgcctctgttgtggtggctgctatagctccagttcgcctcgaagaaccacagggttatgctccaattccggaaaactagtacaaatgaaatgtacagcatatgcagttgccaggattggctgttaccacatggagataagatattcatatctgtttattaaaggagaagaagatgatggaattatcacaataagaagatagtgcatcttcattgtgtgtgtatatacattctgtgatacttcaaatttcagtatatgcaaaactgaataccctgcttcc

SEQ ID NO: 6185 - DNA, 1267 bp, Sorghum bicolor
taaaaacaacaacaaaaaatcaacgaaatcagatcaccgccatttattattggagacggtacggggacaccacgctcccgcattctctccctccactcatcgcgtcgccgttggtcgttagcagcagcagcagaagcagcgcggggggcaaacagggggacaaggcaaccgggccgacgagacgaacaggaaaaggaagaaagcgtcgcggagcgatggcgcttggcggccttggcgtgcgagcggcgcccttcacgtacgcggcgcacgcgctggccgtcgcggcggcggccatggttctggtctgggccatccagttccgcggcgggctcgccatcgaggccaccaacaagaacctcatcttcaacgttcaccctgttcttatgcttatcggttatattattatcggcggtgaagctataatggtatacagggtacttccaacaacgaaccatgacacaactaagctgatccatctaattctccacgggattgcacttgtccttggtgccgttggaatatattttgctttcaaaaatcacaatgagagtgggattgccaatctttacagtctgcactcttggattgggatcggaacaattactttatatggtattcagtggataattggatttgttacattcttcttccctggtgctgcgccaaacgtgaagaagggcgttcttccttggcacatactctttgggctctttgtctacatcttagcactggctaatgcagaactcggctttcttgagaagctcactttcctcgagagctcaggtctcgacaaatatggcacagaggcattcttggtgaacttcacagcattggttgtcgtgttatttggtgcctctgttgtagtggctgctatagctccagttcgccttgaagaaccacagggttatgctccaattccagaaaactagtacaaatgaaatgtacagcatatgtagttgccaggattggctgttaccatatggagataagatattcatctctgtttattaaaggagaagaagatggtggaattatcacaataagaagatagtgcatcttcattgtgtgtatatacattctgtgatacttcaaaatttcagtatatgtataaaactgaatatcctgcttcataaatgtgtgtatttgctttcatgaatacctgcttgataaatgtgctatatttgttgcaaattgagctaatttgaaatgtcctggttcagaagcagctactgaaactgcttaacagaaagtgataagtgttatatgc

SEQ ID NO: 6186 - DNA, 1413 bp, Sorghum bicolor
aaccaccaatctagcatgcacaagttttaccccacctggtcacggcaatccaaacgccaaactattttcataaaaaaaagtcctttcaactgaaattaaaaacaacaacaaaaaatcaacgaaatcagatcaccgccatttattattggagacggtacggggacaccacgctcccgcattctctccctccactcatcgcgtcgccgttggtcgttagcagcagcagcagaagcagcgcggggggcaaacagggggacaaggcaaccgggccgacgagacgaacaggaaaaggaagaaagcgtcgcggagcgatggcgcttggcggccttggcgtgcgagcggcgcccttcacgtacgcggcgcacgcgctggccgtcgcggcggcggccatggttctggtctgggccatccagttccgcggcgggctcgccatcgaggccaccaacaagaacctcatcttcaacgttcaccctgttcttatgcttatcggttatattattatcggcggtgaagctataatggtatacagggtacttccaacaacgaaccatgacacaactaagctgatccatctaattctccacgggattgcacttgtccttggtgccgttggaatatattttgctttcaaaaatcacaatgagagtgggattgccaatctttacagtctgcactcttggattgggatcggaacaattactttatatggtattcagtggataattggatttgttacattcttcttccctggtgctgcgccaaacgtgaagaagggcgttcttccttggcacatactctttgggctctttgtctacatcttagcactggctaatgcagaactcggctttcttgagaagctcactttcctcgagagctcaggtctcgacaaatatggcacagaggcattcttggtgaacttcacagcattggttgtcgtgttatttggtgcctctgttgtagtggctgctatagctccagttcgccttgaagaaccacagggttatgctccaattccagaaaactagtacaaatgaaatgtacagcatatgtagttgccaggattggctgttaccatatggagataagatattcatctctgtttattaaaggagaagaagatggtggaattatcacaataagaagatagtgcatcttcattgtgtgtatatacattctgtgatacttcaaaatttcagtatatgtataaaactgaatatcctgcttcataaatgtgtgtatttgctttcatgaatacctgcttgataaatgtgctatatttgttgcaaattgagctaatttgaaatgtcctggttcagaagcagctactgaaactgcttaacagaaagtgataagtgttatatgcaagttcactatcataattgagttatctattgtctcagtgtccatttattt

SEQ ID NO: 6187 - DNA, 1167 bp, Zea mays
ctaaaaacaacaacaaatcgacgaaataaactgtcatctataggagacggtacggggacaccacacgctccccgcactctctctctctccctccctccaactcattggcagcagcagcagcagccgcagccgcgagggccaagcagtggggggacaaggaaaagggccgacgaagaggaaaaaggaagaacgcgtcgcggagccatggggcttggccttggcgtgcgggcggcgcccttcacgtacgcggcgcacgcactggccgtcgcggcggcggccatggttctcgtctggtccatccagttccgcggcgggctcgccatcgagtccaccaacaagaacctcatcttcaacgttcaccctgttcttatgcttatcggttatgttattatcggcggtgaagctataatggtgtacagggtacttccaacatcgaatcatgacacaactaagctgatccatctaattctccacgggattgcactcgtccttggtgcggttggaatatactttgctttcaaaaatcacaatgagagtgggattgccaatctttacagcctgcactcttggattgggataggaacaattactttgtatggtattcagtggataattggattcgtcacgttcttcttccctggtgctgcgccaaacgtgaagaagggtgttcttccttggcacgtactctttgggctctttgtctacatcttagcactggctaatgcagaactcggctttcttgagaagctcactttcctcgagagctcaggtctcgacaaatatggcacagaggcattcttagtgaacttcacagcattggttgtcgtgttatttggtgcctctgttgtggtggctgctatagctccagttcgccttgaagaaccacagggttatgatccaattccagaaaactagcgcaaatgaaatgtacagcgtatgcagttgccaagattggctgttaccacatggagataagatattcatgtctctttattgacgaagaaggtgatggaattatcacaataaagatgtagacataaatgtgtgtatatacattctgtgacacttcaaaatttcagtatatgcaaaactgaatatgctgcttcataaatgtgtgtatttgctttcatgaatatcctgcttcataatgtgctatctctattctct

SEQ ID NO: 6188 - DNA, 1176 bp, Zea mays
cttgagctctcggtagcacgagaatctacagatatgaaccaagttatataaggtactcgtacaccgaacatgttcgatagaatgctctagtgacagcgaaaaaaccaaacaacaaaaaccaacgaaatccctgccatttttataggagacgacgcgcgccgcgggaggcaagggaagggggcgacgaagaggaaagcgaagaaagcgtcatggggcttggccttggcgtgcgggcggcgcccttcacgtacgcggcgcacgcgctggccgtcgcggcggcggccatggtgttggtctgggccatctacttccgcggtgggctcgccatcgaggccaccaacaagaacctcatcttcaacgttcaccctgttcttatgcttatcggttatattatcatcggcggcgaagctataatggtatacagggtacttccaacatcgaaccacgagacaaataagctgatccatctagttctccacgggattgcacttgtccttggtgcggttggaatatatttcgccttcaaaaatcataatgagagtgggattgccaatctttacagtttgcactcttggattgggatagggacgattactttgtatggtattcagtggatagttggattcgttacattcttcttccctggtgctgcgccaaacgtgaagaagggtgttcttccttggcacatactctttgggctctttgtctacatcttagcactggctaatgcggaactcggctttcttgagaagctcactttcctcgagagctcgggtctcgacaaatacggcacagaggcattcttggtgaacttcacagcgttggttgtcgtgttgtttggtgcctctgttgtggtggctgctatagctccagttcgccttgaagaaccacagggttatgttccaattccagaaaactagtacaaatgaaatgtacatcatatgcagttgccaggattggctgttaccatatggagctaagatattcatctctctttattaaggagaagaagatcatggagttatcacgataagaagatagtgcatcttcattgtgtttgtatatgtctacactattgtcttaaggattagtagagatacattctgtgatacttcaaaatttcagtatatgcaaaattgaatatcctgcttcataaatgtctgtatttgctttcat

SEQ ID NO: 6189 - DNA, 1214 bp, Oryza sativa
ccaacaacaaaacagagtagtaaactctgcttcctctcctgcttccctccatccgtctccaataaagggacagttcgcgggagaccttggtacgcgactacgcgtacgccacgccacaacgcttctcgctctccctccactcgtagcagctcgagctgcctgtagcagatagcgcgacgctgcgaccttcgtgtgcccggccgctcgccgccccgcgcgcataagagggaggaggaaggaaggaggagagatcgtagcaagagcgaagcgagatggctgccgggctgggcgtgaaggcggcgccgttcacgtacgtggcgcacgcgctggccgtggcggcggcggtcatggtgctcgtctggtgcatcagcttccggggcggcctcgcgttcgaggcggacaacaagaacctcatcttcaacgttcaccctgttcttatgctgattgggtacattatcctcggcagtgaagccataatgatctacaagatattcccaaaactgaaccacgacacaaccaagctgatccacctgattctccacgcgatcgccattgttcttggcgccgtcgggatctactgcgccttcaagttccacaacgagagcgggatcgccaacctctacagcctgcattcctggctcggcatcggaacaatctcgctgtacggcattcagtggatatttggattcgtggcgttcttctaccccggcgcggcgccgcacgtgaggcgcggggcgctgccgtggcacgtgctgttcgggctgttcgtctacgtcctgacgctggcgacggcggagctcgggctcctggagaagctgaccttcctccagagctccggcctcgacaagtacggcgcggaggcgttcctggtgaacttcacggggctggtcgtcgcgctgttcggcgccgccgtcgtcgtggccgccgtcgcgccggctcacgtcgaggaacccgagggctatgctccaattccggtcaactagctatgtttcgcggttgctggaagtgatcattaataccacgaaatcaaaggtgtaacagcagaattcatataccgatttgtttgtattcggtggacgatactgtgcgataattcaacactatccaggtaatttacgtttactacagtgaatgcacatagttaccgaatccaataatggtttacctgcatgtcacactcaaatattgtcgtgcgattctgtctccgagaaaaa

SEQ ID NO: 6190 - DNA, 1279 bp, Hordeum vulgare
cacgggcttgtcagcatcttattgcttaggagtcaggaccaacggaagccatccacacatcacaacaagcacgaagcgaaagaggcgaaagcaaaagccaagactcggctttcctctcgctgcttctagcacgcaggcaggcagagagtgagctgcgcctgcccctaccggggaccagaggaagaagaagaaggaagaggacgctggtgtgcggggcgagatggcggtcgcgttgggcgtgaaggcgacgccgttcacctacgcggcgcacgcgctggccgcggcggcggcggccatggtgctcgtctggtgcatccacttccgcggcggcctcgccttcgaggcggccaacaagaacctcatcttcaacgtccaccctgttcttatgctgatcggtttcattatcctcggcagtgaagccataatggtctacaaggtatttccgggactgaaccacgatactgccaagctgacccacctgatcctccacgcgatcgccatcgtcctcggcgccgtcgggatctactgcgccttcaagttccacaacgacagcggcatcgcaaacctctacagcttgcactcctggctcgggatcggggccatttctctctacggaatccagtggatattcgggttcgtgaccttcttcttccccggcgcggcgccggacgtgaggcgcggggctctgccgtggcacgcgctgttcgggctcttcgtctacgtgctcacgctggcgacggcggagctcgggttcctggagaagatgaccttcctgcagagctccgggctcgacaagtacggcccggaggcgctcctggtcaacttcacggccctcgtcgtggtgctcctcggcgccgccgtggtcgtcgctgccgtcgctcccgcggctacggtggaggaaccggagggatatgctccgatcccagtcatcggttagtagcctagtaccgtacagagctacgtgctgctgattgttgaacgtctggtttgttccaagagagaccacgtgtgtgattggttccacgagatcgggggtgagcacagaattcacgtctggtttgtgtgtatcagctgaaccgtacgatttgattactgaaaactgcactggtacctttgaaagatcatgagatggcttgatgagttgattgccctgcgcattttcgcgttttgtatcggctcataatgtagcaagcatcaaagatacaaatacagtgatccaacaaccgacttatgtacccgcaaaaacaaaaagcaaccggcatatgtatgattaaccgac

SEQ ID NO: 6191 - DNA, 1350 bp, Hordeum vulgare
attgggattcaagagagcatttattgtttataaagaaagagttttttgggctgagaacccaacactttgtggacggttctctatgaccactatggaatcccccgggctgctttatggggccgagcacggaaaagacgcatcttattgcttagggagtcaggaccaacggaagccatccacacatcacaacaagcacgaagcgaaagaggcgaaagcaaaagccaagactcggctttcctctcgctgcttctagcacgcaggcaggcagagagtgtgctgcgcctgcccctaccggggaccagaggaagaagaagaaggaagaggacgctggtgtgcggggcgagatggcgatcgcgttgggcgtgaaggcgacgccgttcacctacgcggcgcacgcgctggccgcggcggcggcggccatggtgctcgtctggtgcatccacttccgcggcggcctcgccttcgaggcggccaacaagaacctcatcttcaacgtccaccctgttcttatgctgatcggtttcattatcctcggcagtgaagccataatggtctacaaggtatttccgggactgaaccacgatactgccaagctgacccacctgatcctccacgcgatcgccatcgtcctcggcgccgtcgggatctactgcgccttcaagttccacaacgacagcggcatcgcaaacctctacagcttgcactcctggctcgggatcggggccatttctctctacggaatccagtggatattcgggttcgtgaccttcttcttccccggcgcggcgccggacgtgaggcgcggggctctgccgtggcacgcgctgttcgggctcttcgtctacgtgctcacgctggcgacggcggagctcgggttcctggagaagatgaccttcctgcagagctccgggctcgacaagtacggcccggaggcgctcctggtcaacttcacggccctcgtcgtggtgctcctcggcgccgccgtggtcgtcgctgccgtcgctcccgcggctacggtggaggaaccggagggatatgctccgatcccagtcatcggttagtagcctagtaccgtacagagctacgtgctgctgattgttgaacgtctggtttgttccaagagagaccacgtgtgtgattggttccacgagatcgggggtgagcacagaattcacgtctggtttgtgtgtatcagctgaaccgtacgatttgattactgaaaactgcactggtacctttgaaagatcatgagatggcttgatgagttgattgccctgcgcattttcgcgttttgtatcggctcataatgtagcaagcatcaaagatacaaatacagtgatccaacaaccg

SEQ ID NO: 6192 - DNA, 1155 bp, Triticum aestivum
aagaggcgaaagcaaaagccaagactcggctttcctctcgctcgccgctcgctgctctctgctctctaggccgtgcgcagggcacacgcttccctcactcccccgcctttcgtcgtacctcgatcgaggcgagctgatagggagtgagctacccctacggaagaaggaagaaggaaggcacacaagttcgtgtgcagcagggcgagatggcgggcgcgctgggcgtgaaggcgacgccgttcacctacgcggcgcacgcgctgggcgcggcggcggcggccatggtgctcgtctggtgcatccacttccgcggcggcctcgccttcgaggcggtcaacaagaacctcatcttcaacgtccaccctgttcttatgctcatcggcttcattatccttggcagtgaagccatcatggtctacaaggtatttccgggactgagccacgacacggccaagctgacccacctgatcctccacgcgatcgccatcgtcctcggcgccgtcgggatctactgcgccttcaagttccacaacgagagcgggatcgccaacctctacagcctgcactcctggctcgggatcggagccatttctctctacggaatccagtggatatttgggttcgtgacgttcttctttcccggggcggcgccggacgtgaggcgcggggctctgccgtggcacgcgctgttcgggctcttcgtctacgtgctcacgctggcgacggcggagctcgggttcctggagaagatgacgttcctgcagagctccgggctcgacaagtacggcccggaggcgctcctcgtcaacttcacggccctcgtcgtcgtgctcttcggtgccgccgtggtcgtcgctgccgtcgctcccgcggctaaggtggaggagccggagggatatgctccgatcccagtcatcgggtaggagcatcctagtactacgtggctacgtgctactgatcgtcgaaagtccagaagcgagaccgcgtgtgcgattggttccacgagatcgggtgtaagcacagaactcacgtctgatttgtgtgtatcagctgaaccgtacgatttgattactgaaaactgcagtggtacctttgaaagatcatgagatggcttgataagttgattgtttttataaaggacgttttatatcgact

SEQ ID NO: 6193 - DNA, 1067 bp, Pseudoroegneria spicata
  misc_feature (513)..(513): n is a, c, g, or t
aaagccaagactcggctttcctctcgctgctctctgctctctgctctagtccgtgcgtaagacacgcgcttctcctcactcccccgcctttcgtgcctcgatcgagctgcttctagcaggccagggagagtgagccacacctaccggggacacgagttcgtgcgcagggcgagatggcgggcgcgttgggcgtgaaggcgacgccgttcacctacgcggcgcacgcgctggccgtggcggcggcggccatggtgctcgtctggtgcatccacttccgcggtggcctcgccctcgaggcggtcaacaagaacctcatcttcacgttcacccggttcttatgctcatcggcttcattatccttggcagtgaagccatcatggtctacaaggtatttccgggactgagccacgacacggccaagctgacccacctgatcctccacgcgatcgccatcgtcctcggcgccgtcgggatctactgcgccttcaagttccacaacgagagcgggatcgncaacctctacagcctgcactcctggctgggtatcggagccatttctctctacggaatccagtggatatttgggttcgtgacgttcttcttccccggcgcggcgccggacgtgaggcgcggggctctgccgtggcacgcgctgttcgggctcttcgtctacgtgctgacgctggcgacggcggagctcgggttcctggagaagatgacatttctgcagagctccgggctcgacaagtacggcccggaggcgctcctggtcaacttcacggccctcgtcgtcgtgctcttcggcgccgccgtggtggtagctgccgtcgctcccgcggctaaggtggacgaaccggagggatatgctccgatcccagccatcggttagtagcatcctagtacgtggctatgtgctactgtcgtcgaacgttcagaagagagaccgcgtgttcgattggttccatgagatcgggtgtaagcagcacagaattcacgtctgatttgtgtgtatcagctgaaccgtacgatttgattactgaaaactgcagtggtactgttgaaagata

SEQ ID NO: 6194 - DNA, 880 bp, Lolium multiflorum
gctttccttgtcgctgctctctgagaggaagccgtgcgcaggccacacgcttctcactcccccgcctctcgtagctcggacgagctctttctagcagccaaggcagatagagtgcctctgtaccggcgaccagaggaagaaggaagagcgagatggcaggcgcgttgggcgtgaaggcgacgccgttcacgtatgcggcgcacgtcctggccgcggcggcggcggtcatggtgctcgtctggtgcatccacttccgcggcggcctcgccttcgaggccgtcaacaagaacctcatcttcaacgttcaccctgttcttatgctgattgggtacattatccttggtagtgaagccataatgatctacaagtcgttcccgggactgaagcacgacacagccaagctgattcacctgaccctccacgccatcgccatcgttctcggcgccgtcgggatctactgcgccttcaagaaccacaacgagagcgggatcgccaacctctacagcctgcactcctggctcgggatcggagccatttcactctacggaatccagtggatattcgggttcgtgaccttcttcttccccggcgcggcgccggacgtgaggcgtggggctctgccgtggcatgctctgttcgggctcttcgtctacatcctgacgctggcgacggcgcagcttgggttcctggagaagctgacgttcctcgagagctccggcctcgacaagtacggcacggaggcgatcctggtcaactgcacggccctcgtcgtcgtgctgttcggtgccaccgtggttgtcgccgccgttgctcccgcggctaggtggaagaaccggagggttatgcgccgattccgtggtcggctagtaagcacgtgcta

SEQ ID NO: 6195 - DNA, 959 bp, Avena sativa
agaggaggagaagagggaggaggacgctcgtgtcgtgtgcgtggcgagatggcgggcgagctgggcgtgaaggcgacgccgttcacgtacgcggcgcactccctggcggcggcggcggcggccatggtgctcgtctggtgcatccacttccgcggcggcctcgccttcgacgccgtcaataagaacctcatcttcaacgttcacctgttctcatgttgattggttacattatccttggcagcgaagccataatggtgtacaaggtgtttccgggactgaagcacgacacggccaagctgacacactgaccctccacgcgatcgccatcgtgctcggcgccgtcgggatctactgcgccttcaagttccacaacgagagcggcatcgccaacctctacagcctgcactcctggctcgggatcggggccatttctctgtacgggatccagtggatatttgggttcgtgacgttcttcttccccggcgcggcgccggacgtgaggcgcggggcactgccgtggcacgcgctgttcgggctcttcgtctacgtgctcacgctggcgacggcggagctcgggttcctggagaagatgacgttcctgcagagctccgggctcgataagtacggcccggaggcgttcttggtgaacttcatggcgctcgtcgtcgtgctgttcggcgccgccgtggtcgtcgctgccgtcgctcccgcggctaaggtggaagaaccggagggatatgctccgattccagtgctcggttaattagtaggctagcagtacgagctactgatcgtccagcgtccagaggagagactgcgtgcgcgattggtaccacgagatcaggtgtaagcaaagagttcacgtctcagatttgtgtgtatcagcctagcatttttttcttttgaggggactaataagcgtgcacgtgcaatgcatgaataataaaatatttttagac

SEQ ID NO: 6196 - DNA, 1387 bp, Brachypodium distachyon
ccagtgacacctgttcgtttgggaattgggaattgggaattgggaattccatacttccatggaaggatgcaaaaatgcatatagtacaggttaaccttccggtcaaatcccgtctcattctccacccctctccggccggatcgcccaatggataaagacgccttcccggccttgtcatcggcagcttaaccagaaacctgtccgcaaaacaacaacaggaaacacagatagccaagactccgctttccttctcgttgctctcgctcgcgccccctccctctctcacacacacaagggcgaggagtccgtgcgcacaccacacgctctcctctcatagctcgagccgatttcggcagataggtaggtagagcgagataccaagcttacatatctgcccgtaccagggaccaggaagaagaaggcttgacaagatggccggtgggctggtgggcgtgaaggcggcgccgttcacgtacgcggcgcacgcgctgggcgcggcggcggcggtcatggtgctcgtctggtgcatccacttccgcggcgggctcgccttcgacgcggtcaacaagaacctcatcttcaacgttcacccagttcttatgctgatcggttacatcatccttggcagtgaagcgataatgatctacaagatatttccgaaagtaaaccacgacacggcgaagctgacccacctgatcctccacgcgatcgccatcgttctcggcgccgtcgggatctactgcgccttcaagttccacaacgagagcgggatcgccaacctctacagcctgcactcctggctcgggatcggagccatttctctgtacgggattcagtggatattcgggttcgtggcgttcttctacccgggggcggcgccgggcgtgaggcgcggggctctgccgtggcacgtgctgttcgggctcttcgtctacgtcctgacgctggcgacggcggagctcgggttcctggagaagctcaccttcctgcagagctccggcctcgacaagtacggcgccgaggcgttcctggtcaacttcacggccctcgtcgtcgtgctcttcggagctgcagtcgtcgttgccgcagtcgctcccaaggctcaggtgccagaaccagagggttacgctccgattcctgtcagctagtagtatgtacgtgccacagtgaacgtcctgaagatcgtactgtgtgcgcaattagtaccacgagatcagtgtaagcacagaacagaattcacttgttgatttgtgtgtatctggtgttcagatgagccatgcaggccaataataatttcacttgtttgtttttcctaaagcacttgcatctcaccccgcaaattttcgtttgaaccatttgctaagttgatctcagcctcttaggtagg

SEQ ID NO: 6197 - DNA, 1119 bp, Brachypodium distachyon
tgtccgcaaaacaacaacaggaaacacagatagccaagactccgctttccttctcgttgctctcgctcgcgccccctccctctctcacacacacaagggcgaggagtccgtgcgcacaccacacgctctcctctcatagctcgagccgatttcggcagataggtaggtagagcgagataccaagcttacatatctgcccgtaccagggaccaggaagaagaaggcttgacaagatggccggtgggctggtgggcgtgaaggcggcgccgttcacgtacgcggcgcacgcgctgggcgcggcggcggcggtcatggtgctcgtctggtgcatccacttccgcggcgggctcgccttcgacgcggtcaacaagaacctcatcttcaacgttcacccagttcttatgctgatcggttacatcatccttggcagtgaagcgataatgatctacaagatatttccgaaagtaaaccacgacacggcgaagctgacccacctgatcctccacgcgatcgccatcgttctcggcgccgtcgggatctactgcgccttcaagttccacaacgagagcgggatcgccaacctctacagcctgcactcctggctcgggatcggagccatttctctgtacgggattcagtggatattcgggttcgtggcgttcttctacccgggggcggcgccgggcgtgaggcgcggggctctgccgtggcacgtgctgttcgggctcttcgtctacgtcctgacgctggcgacggcggagctcgggttcctggagaagctcaccttcctgcagagctccggcctcgacaagtacggcgccgaggcgttcctggtcaacttcacggccctcgtcgtcgtgctcttcggagctgcagtcgtcgttgccgcagtcgctcccaaggctcaggtgccagaaccagagggttacgctccgattcctgtcagctagtagtatgtacgtgccacagtgaacgtcctgaagatcgtactgtgtgcgcaattagtaccacgagatcagtgtaagcacagaacagaattcacttgttgatttgtgtgtatctggtgttcagatgagccatgcaggccaataataatttcacttgtttgtttttcctaaa

SEQ ID NO: 6198 - DNA, 1147 bp, Triticum aestivum
gcaccaaacccgagtcgtccacacaccacatcaacaaaacacgaaccgaaagaggcgaaagcaaaagccaagactcggctttcctctcgctagctgctctctgctctaggccgtgcgcagggcacacgcttctcctcactcccccgtctttcgtcgtgccttgatcgaggccagctgcttctagccggcctgacagatagagagtgagccaagctacccctgccggggaccagaggaggaagaaggaaggcagggcgagatggcgggtgcgctgggcgtgaaggcgacgccgttcacctacgcggcgcacgcgctgggcgcggcggcggcggccatggtgctcgtctggtgcatccacttccgcggcggcctcgccctcgaggcggtcaacaagaacctcatcttcaacgtccaccctgttcttatgctcatcggcttcattatccttggcagtgaagccataatggtctacaaggtatttccgggcctgagccacgacacggccaagctgacccacctgatcctccacgcgatcgccatcgtcctcggcgccgtcgggatctactgcgccttcaagttccacaacgagagcgggatcgccaacctctacagcctgcactcctggctcgggatcggagccatttctctctacggaatccagtggatatttgggttcgtgacgttcttcttccccggggcggcgccggacgtgaggcgcggggctctgccgtggcacgcgttgttcgggctcttcgtctacgtgctcacgctggcaacggcggagctcgggttcctggagaagatgacgttcctgcagagctccgggctcgacaagtacggcccggaggcgctcctggtcaacttcacggccctcgtcgtcgtgctcttcggcgccgccgtggtcgtcgctgccgtcgctcctgcggctaaggtggacgaaccggagggatatgctccgatccctgtcatcggttagtagcatcctagtaggtggctacgtgctactgatcgtcgaacgtccagataacacaccgcgtgtgcgattggttccacgagatcgggtgtaagcacagaattcacgtctgattcgtgtgtatcagctgaaccgtacgatttgattactgaaaactgcactggtacctttgaa

SEQ ID NO: 6199 - DNA, 1234 bp, Triticum aestivum
gcaccaaacccgagtcgtccacacaccacatcaacaaaacacgaaccgaaagaggcgaaagcaaaagccaagactcggctttcctctcgctcgctgctcgctgctctctgctctaggccgcgcgcagggcacacgcttctcctcactcccccgtctttcgtcgtgcctcgatcgaggccagctgcttctagccggcctgacagacagagagtgagccaacccctgcccgggaccagaggagaaagaaggcaggcagggcgagatggcgggcgcgctgggcgtgaaggcgacgcccttcacctacgcggcgcacgcgctgggcgcggcagcggcggccatggtgctcgtctggtgcatccacttccgcggcggcctcgccctcgaggcggtcaacaagaacctcatcttcaacgtccaccctgttcttatgctcatcggcttcattatccttggcagtgaagccataatggtctacaaggtatttccgggactgagccacgacacggccaagctgacccacctgatcctccacgcgatcgccatcgtcctcggcgccgtcgggatctactgcgccttcaagttccacaacgagagcgggatcgccaacctctacagcctgcactcctggctcgggatcggagccatttctctctacggaatccagtggatatttgggttcgtgacgttcttcttccccggggcggcgccggacgtgaggcgcggggctctgccgtggcacgcgctgttcgggctcttcgtctacgtgctcacgctggcgacggcggagctcgggttcctggagaagatgacgttcctgcagagctccgggctcgacaagtacggcgcggaggcgctcctggtcaacttcacggccctcgtcgtcgtgctcttcggcgccgccgtggtcgtcgctgccgtcgctcccgcggctaaggtggaggagccggagggatatgctccgatcccagtcatcggttagtagcatcctagtacgtggctacgtgctactgatcgtcgaacgtccagaagcgagaccgcgtgtgcgattggttccacgagatcgggtgtaagcacagaactcacgtctgatttgtgtgtatcagctgaaccgtacgatttgattactgaaaactgcagtggtacctttgaaagatcatgagatggcttgataagttgattgtttttataaaggacgttttatatcgacccataatgtactactcccttcgttccg

SEQ ID NO: 6200 - DNA, 1239 bp, Secale cereale
gactcccgagtcgtccacacatcacaacaacaaaaacgaagcgaaagaggcgaaagcaaaagccaagactcggctttcctctcgctcgctgccctctgctctctgctctctgctctaggccgtgcgcagggcacacgcttctccgtctcactcccccgcctttcgtcgtacctcgatcgaggcgagctgcttctagccggcctggcagatagggagtgagccacccctgcccgggaccagaggaagaagaaggaaggtagggcgagatggcgggcgcgctgggcgtgaaggcgacgccgttcacgtacgcggcacatgccctgggcgcggcggcggcggccatggtgctcgtctggtgcatccacttccgcggcggcctcgccctcgaggcggtcaacaagaacctcatcttcaacgtccaccctgttcttatgctgatcggcttcattatccttggcagtgaagccatcatggtctacaaggtatttccgggactgagccacgacacggccaagctgacccacctgatcctccactcgatcgccatcgtcctcggcgcgatcgggatctactgcgccttcaagttccacaacgagagcgggatcgccaacctctacagcctgcactcctggctcgggatcggagccatttctctctatggaatccagtggatatttgggttcgtgacgttcttcttccccggagcggcgccggacgtgaggcgcggggctctgccgtggcacgcgctgttcgggctcttcgtctacgtgctcacgctggccacggcggagctcgggttcctggagaagatgacgttcctgcagagcggcgggctcgacaagtacggcccggaggcgctcctggtcaacttcacggcactcgtcgtcgtgctcttcggcgccgccgtggtcgtcgctgccgtcgctcccgcggccaaggtggatgaaccggagggatatgctccgatcccagtcatcggttagtagcatcctagtacctgggtacgtgctactgatcgtcgaacgtccagaaaacagaccgcgtgtgcgattggttccacgagatcgggtgtaagcacataattcacgtttgatttgtgtgtatttgcagaaccgtacgatttgattactgaaaactgcagtggtacctttgaaagatcatgctatttcttataccgtatctctatcccgtgaaattctcgagccaaaagatgtatgcatatgttgtagttttaaaacc

SEQ ID NO: 6201 - DNA, 1062 bp, Secale cereale
gactcgagaggaaagccgagtcttggctttcctctcgctcgctgctctctgctctctgctccaggccgcgcgcagggcacacgcttctcctcactcccccgcctttcgtcgtacctcgatcgaggcgagctgcttctagccggccaggcagatagagagtgagccacccctgcccgggaccagaggaagaagaaggaaggtagggcgagatggcgggcgcgctgggcgtgaaagcgacgccgttcacgtacgcggcgcacgcgctgggcgcggcagcggcggccatggtgctcgtctggtgcatccacttccgcggcggcctcgccctcgaggcggtcaacaagaacctcatcttcaacgtccaccctgttcttatgctgatcggattcattatccttggcagtgaagccatcatggtctacaaggtatttccgggactgagccacgacacggccaagctgacccacctgatcctccactcgatcgccatcgtcctcggcgcgatcgggatctactgcgccttcaagttccacaacgagagcgggatcgccaacctctacagcctgcactcctggctcgggatcggagccatttctctctatggaatccagtggatatttgggttcgtgacgttcttcttccccggagcggcgccggacgtgaggcgcggggctctgccgtggcacgcgctgttcgggctcttcgtctacgtgctcacgctggccacggcggagctcgggttcctggagaagatgacgttcctgcagagcggcgggctcgacaagtacggcccggaggcgctcctggtcaacttcacggccctcgtcgtcgtgctcttcggcgccgctgtggtcgtcgctgccgtcgctcccgcggccaaggtggatgaaccggagggatatgctccgatcccagtcatcggttagtagcatcctagtacctgggtacgtgctactgatcgtcgaacgtccagaaaacagaccgcgtgtgcgattggttccacgagatcgggtgtaagcacataattcacgtctgatttgtgtgtatttgcagaaccgtacg

SEQ ID NO: 6202 - DNA, 1013 bp, Secale cereale
ttcctctcgctcgctgctctctgctctctgctctaggccgtgcgcagggcacacgcttctcctcactcccccgccctgcttctagccggtcaggcagatagagagtgagccacccctgcccgggaccagaggaggaagaaggaaggcagggcgagatggcgggcgcgctgggcgtgaaggcgacgccgttcacgtacgcggcgcacgcgctgggcgcggcggcggcggccatggtgctcgtctggtgcatccacttccgcggcggcctcgccctcgaggcggtcaacaagaacctcatcttcaacgtccaccctgttcttatgctgatcggattcattatccttggcagtgaagccatcatggtctacaaggtatttccgggactgagccacgacacggccaagctgacccacctgatcctccactcgatcgccatcgtcctcggcgcgatcgggatctactgcgccttcaagttccacaacgagagcgggatcgccaacctctacagcctgcactcctggctcgggatcggagccatttctctctacggaatccagtggatatttgggttcgtgacgttcttcttccccggagcggcgccggacgtgaggcgcggggctctgccgtggcacgcgctgttcgggctcttcgtctacgtgctcacgctggccacggcggagctcgggttcctggagaagatgacgttcctgcagagcggcgggctcgacaagtacggcccggaggcgctcctggtcaacttcacggcactcgtcgtcgtgctcttcggcgctgccgtggtcgtcgctgccgtcgctcccgcggccaaggtggatgaaccggagggatatgctccgatcccagtcatcggttagtagcatcctagtacctgggtagtacgtgctactgatcgtcgaacgtccagaaaacagaccgcgtgtgcgattggttccacgagatcgggtgtaagcacataattcacgtctgatttgtgtgtatttgcagaaccgtacgat

SEQ ID NO: 6203 - DNA, 863 bp, Cynodon dactylon
ctgaagaagaagaaccggccgagagtgcagcgaggagatggccgcgtccgggctgggcgtgaaggcggcgccgttcacgtacgcggcgcacgcgctggccgcggcggcggcggtcatggtgctcgtctggtgcgtccacttccgcggcgggctcgcgctcgaggccgagaacaagaacctcatcttcaacgttcaccctgttcttatgctgattggctacattatcctcggcggtgaagccataatgatctacaaaatattcccaagttggaaccacgacacagccaagctgacgcatctggtcctccacgctgttgcaaccgttcttggcgccttcggcatctactgcgccttcaagtttcacaacgacagcgggatcgccaacctctacagtctgcactcgtggctcgggatcggaactatctctttgtacggcattcagtggatttttgggttggtgacgttcttcttccccggcgcggcgccaagcgtgaggcgcgccgcgctgccctggcacgcgctgttcggactcttcgtctacgtcctggcgctggcaacggcggagcttgggttcctggagaagctcaccttcctgcagagcggcggcctcagcaagtacggcgccgaggcgtttctggtgaacttcacggcactagtcgtcgtcctgttcggtgccaccgttgttgttgccgccgtggctccggctcaggtcaacgaggaagaaccgcagggttatgctccgattccggtcagctagagggtggtaaattgataattctcagaagggcacgtgtgtgtgtgcaatcttctaagcattgttcagttcttgagcatgtgaaggaaatgccatgccaaaactgcct

SEQ ID NO: 6204 - DNA, 1159 bp, Triticum aestivum
accgaaagaggagagagccatcagccatgggaggaggcgtcatgcgcaccgccgcgaaggtcggcctcgctgggggcgccgcggcggcggcgggacgcttccgcaacgtcgccccgtccttcgccacggcccccgccgccgaggccgccgcggcggcgccgctgctgtccgcggccggggagatccccgcggtggcgccggccgggtcgcagtgggcgtcctgggaggtggacgactgggagttcgcggactggaggtccgagtcggcgtccgaggcggacgtggcggtggtcggggggccgaggctggtgttcgccccgccgtcgcgggaggaggccgaggaggccaccgccgagctccgggaagctattgacagggtttattttaaagagactccagtagaagttgttaaggaacatgatcaagagcttagcaagctgggagccgatgcattaattcctgctatgccgggacatgtagtgcaggcttttacattgttaaaatcaagcccagaggctcagagcgttgttgcctcgcttgcatcagataaaaatgtgtgggacgcggtgttgaagaatgagagggttatggaattttacaagagtcaccagcaaactctggtcaatacttttcctgagggcactgactctactgactcagtagagtcaccggagaaatttgaagaggcatccccagaatatgcactacccactgcctcacctttgtcggactttgtggacaatgcgaagaagacgatgatggagatggttgacaacataaccaactttttccaagacctgttccacaacccggcagaagctgaggccggaccgggctcatcctctaaaaagccttcgttcgcggagatggcggctggtggatctttcatggctcttgccatggcggtcatcctagttgttctgttcaagagggcatgaacatatactacaagttcaaacgctcttggtgcctattgggccttaaatctgtcgaaaataactcgtgttatgaagaactatggatgtattgtacagcgtgtgtctcctgccgtactgtgtcagttaaaacttccgagtgttgagaccagtttaataaagacatgttatgctcctggctaattggtaatgctacgctgaagcatggatactttatctgtgtt

SEQ ID NO: 6205 - DNA, 1155 bp, Pseudoroegneria spicata
gacgccaccgaaagaggagagagccatggggggaggcgtcatgcgcaccgctgcgaaggtcggcctcgccgggggcgccgcggcggcggcgggccgcttccgcaacgtcgccccgtccttcgcgacggcccccgccgccgaggccgcggcggcggcgccgctgctgtccgcggccggagagatccccgcggtggcgccggccgggtcgcagtgggcgtcctgggaggtggacgactgggagtttgcggactggaggtccgagtcggcgtccgaggcagacgtggcggtggtcggggggccgaggctggtgttcgccccaccgtcgcgggaggaggccgaggaggccaccgccgagctcagggaagctattgacagggtttattttaaagagactccagtagaagttgttaaggaacatgatcaagagcttagcaagctgggagccgatgcattaattcctgctatgccgggacatgtagtgcaggcttttacattgttaaaatcaagcccggaggctcagagtgttgttgcctcgcttgcatcagataaaaatgtatgggacgcggtgttgaaaaacgagagggttatggaattttacaagagtcaccagcaaactctggtcaatactttccctgagggcactgactctactgactcagtagagtcaccggagaaatttgaagaggcatccccagaatatgcactacccactgcctcacctttgtcggactttgtggacaatgcgaagaaggcgatgatggagatggttgacaacataaccaactttttccaagacctgttccacaacccggcagaagctgaggctggaccgagctcatcctctaaaaagccttcgttcgcggagatggcggctggtggatctttcatggctcttgccatggcggtcatcctagttgttctgttcaagagggcatgaacatatactacaagttcaaacgctcatgatgcctattgggccttaaatctgtcgaaaataactcgtgttatcaagaactatggatgtattgtacagcgtgtgtctcctgccgtactgtgtcagtacttccgagtgggtttaataaagacatgttatgctcctggctaattggtaatgctacgctgaagcatggatatttttatctgtgttaaaaaaaa

SEQ ID NO: 6206 - DNA, 1116 bp, Secale cereale
agaggagagagagagccatcagccatgggaggaggcgtcatgcgcaccgctgcgaaggtcggcctcgccgggggcgcggcggcggcggcgggccgcttccgcaacgtcgccccgtccttcgccacggcctccgccgccgaggccgccggggcggcgccgctgctgtccgcggccggggagatccccgcggtggcgccggccgggtcgcagtgggcgtcctgggaggtggatgactgggagttcgcggactggaggtccgagtcggcgtccgaggcggacgtggcggtggtcggggggccgaggctggtgttcgccccgccgtcgcgggaggaggccgaggaggccaccgccgagctccgggaagctattgacagggtttaatttaaagagactccagtagaagttgttaaggaacatgatcaagagcttagcaagctgggagctgatgcattgattcctgctatgccgggacatgtagtgcaggcttttacattgctaaaatcaagcccagaggctcagagcgttgttgcctcgcttgcatccgataaaaatgtgtgggacgcggtgttgaagaacgagagggttatggaattttacaagagtcaccagcaaactcttgtcaatacttttcctgagggcaccgactctactgactcagtagagtcaccggagaaatttgaggaggcatccccagaatatgcactgcccactgcctcacctttgtcggattttgtggacaatgcgaagaaaacgatgatggagatggttgataacataaccaactttttccaagacctgttccacaacccagcagaagctgaggccggaccgggctcatcctctaaaaagccttcgttcgcggagatggcggctggtggatctttcatggctcttgccatggcggtcatcctagttgttctgttcaagagggcatgaacatatactacaagttcaaacgctcttgatgcctattgggccttaaatctgtcgaaaataactcgtattatgaagaactatggatgtaatgtacagcgtgtgtctcctgccgtactgtgtcagttaaaacttccgagtgttgagaccagtttaataaagacatgttatgctcctggctaa

SEQ ID NO: 6207 - DNA, 1089 bp, Secale cereale
agagagagagccatcagccatgggaggaggcgtcatgcgcaccgctgcgaaggtcggcctcgccgggggcgcggcggcggcggcgggccgcttccgcaacgtcgccccgtccttcgccacggcctccgccgccgaggccgccggggcggcgccgctgctgtccgcggccggggagatccccgcggtggcgccggccgggtcgcagtgggcgtcctgggaggtggatgactgggagttcgcggactggaggtccgagtcggcgtccgaggccgacgtggcggtggtcgggggccgaggctggtgttcgccccgccgtcgcgggaggaggccgaggaggctaccgccgagctccgggaagctattgacagggtttattttaaagagactccagtagaagttgttaaggaacatgatcaagagcttagcaagctgggagccgatgcattaattcctgctatgccgggacatgtagtgcaggcttttacattgttaaaatcaagcccggaggctcagagtgttgttgcctcgcttgcatcagataaaaatgtgtgggatgcggtgttgaagaatgagagggttatggaattttacaagagtcaccagcaaactcttgtcaatacttttcctgagggcaccgactctactgactcggtagagtcaccggagaaatttgaagaggcatccccagaatatgcactacccactgcctcacctttgtcggactttgtggacaatgcgaagaagacgatgatggagatggttgacaacataaccaactttttccaagacctgttccacaacccggcagaagctgaggccggaccgggctcgtcctctaaaaagccttcgtttgcggagatggcggctggtggatctttcatggctcttgccatggcggtcatcctagttgttctgttcaagagggcatgaacatatactacaagttcaaacgctcttgatgcctattgggccttaaatctgtcgaaaataactcgtattatgaagaactatggatgtaatgtacagcgtgtgtctcctgccgtactgtgtcagttaaaacttccgagtgttgagaccagtttaataaag

SEQ ID NO: 6208 - DNA, 1110 bp, Secale cereale
gagccatcagccatgggaggaggcgtcatgcgcaccgctgcgaaggtcggcctcgccgggggcgccgcggcggcggcgggccgcttccgcaacgtcgccccatccttcgcgacggcccccgccgccgaggccgccggggcggcgccgctgctgtccgcggccggggagatccccgcggtggcgccggccgggtcgcagtgggcgtcctgggaggtggatgactgggagttcgcggactggaggtccgagtcggcgtccgaggcggacgtggcggtggtcggggggccgaggctggtgttcgccccgccgtcgcgggaggaggccgaggaggccaccgccgagctccgggaagctattgacagggtttattttaaagagactccagtagaagttgttaaggaacatgatcaagagcttagcaagctgggagctgatgcattgattcctgctatgccgggacatgtagtgcaggcttttacattgctaaaatcaagcccagaggctcagagcgttgttgcctcgcttgcatccgataaaaatgtgtgggacgcggtgttgaagaacgagagggttatggaattttacaagagtcaccagcaaactcttgtcaatacttttcctgagggcaccgactctactgactcagtagagtcaccgagaaattgaagaggcatcccggaactatgtcacttacccacctgcctcacctttgttcggactttgtggacaatgcgaagaagacgatgatggagatggttgacaacataaccaactttttccaagacctgttccacaacccggcagaagctgaggctggaccgggctcgtcctctaaaaagccttcgttcgcggagatggcggctggtggatctttcatggctcttgccatggcggtcatcctagttgttctgttcaagagggcatgaacatatactacaagttcaaacgctcttgatgcctattgggccttaaatctgtcgaaaataactcgtattatgaagaactatggatgtaatgtacagcgtgtgtctcctgccgtactgtgtcagttaaaacttccgagtgttgagaccagtttaataaagacatgttatgctaccaaaaaaaaaa

SEQ ID NO: 6209 - DNA, 1132 bp, Hordeum vulgare
gagccatcagccatgggaggaggcgtcatgcgcaccgctgcgaaggtcggcctcgccgggggcgccgcggcggcggcgggccgcttccgcaacgtcgccccgtccttcgccacggcccccgccgccgaggccgccgcggcggcgccgctgctgtccgcggccggggaggtccccgcggtggccccggctgggtcgcagtgggcgtcctgggaggtggacgactgggaattcgcggactggaggtccgagtcggcgacgtccgaggcggacgtggcggtggtcgggggcccgaggctggtcttcgccccgccgtcgcgggaggaggccgaggaggccaccgccgagcttcgggaagctattgacagggtttattttccagagactccagtagaagctgttaaggaacatgatcaagagcttagcaagcttggagccgatgcattaattcctgctatgccaggacatgtagtgcaggcttttacattgttaaaatcaagcccggaggctcagagcgttgttgcatcgcttgcatcagataaaaatgtatgggatgcagtgttgaaaaacgagagggttatggaattttacaggagtcaccagcaaactctgatcaatactttccctgagggcaccgactctactgactcagtagagtcaccggagaaatttgaagaggcgtccacagaatatgcactgcccactgcctcacctttctcggacttcgtggacaatgcgaagaagacgatgatagagatggttgacaacataaccaactttttccaagacctgttccacaacccggcggaagctgaggctggaccgggctcatcctctaagaagcattcgtttgcggagatggcggctggtggatctttcatggctcttgccatggcggtcatcctagttgttctgttcaagagggcatgaacgtatactgcaagttcaaacgctcttcgtgcctattgggccttaaatctgtcgaaaataactcgtgttatgaagaactatggatgtaatgtacagtgtgtgtctcctgccgtaccgtgtcagttaaaacttccgagtgttgagaccagtataataaggacatgttatgctcctggttagttggtaatgctgcgctgaagcatgg

SEQ ID NO: 6210 - DNA, 1153 bp, Leymus cinereus x Leymus triticoides
gcagaggagaggagaggacagggagacgccaccgaaagaggagagagccatgggaggaggcgtcatgcgcaccgctgcgaaggtcggcctcgccgggggcgccgcggcggcggcggcgggccgcttccgcaacgtcgctccgtccttcgcgacggcccccgccgccgaggctgccgcggcggcgccgctggtgtccgcggccggagagatccccgcggtggcgccggccgggtcgcagtgggcgtcctgggaggtggatgactgggagttcgcggactggagggacgcggcggcgtccgaggcggacgtggcggtggtcgagaagccgagactggtgttcgctccgccgtcgcgggaggaagccgaggaggccaccgccgagctcagggaagctattgacagggtttatttttcagagactccagtagaagttgtgaaggaacatgatcaagagctgagcaagctaggagccgatgcattaattccttctatgccaggacatgtagtgcaggcttttacattgttaaaatcaagcccggaggctcagagcgttgttgcctcgcttgcatcagataaaaacgtatgggacgcagtgttgaaaaacgagagggttatggaattttataagagtcaccagcaaactctggttaatacttttcctgaggacactgactccgtagagtcaccggagaaatttgaagaggcgtccacagaatatgcactacccaccggctcgcctttgtcggactttgtggacagtgcgaagaagatgatgatggagatggttgacaacataaccaactttttccaagacatgttccacaacccggcggaagctgaggccgcaccgagctcatcctctaaaaagccttctttcgctgagatggcggctggtggatctttcatggctcttgctatggcggtcatcctagttgttctgttcaagagggcatgaacatatactacaagttcaaacgctcttggtgcctattgggccttaaatctgtcgaaaataactcgtgttatgaagaaaactatggatgtaatgtacagcgtgtatctcctgccggactgtcagttaaaacttccgagtgttgagaccagtataataaaggcatgttatgctcctggctaattgataatgctacgctga

SEQ ID NO: 6211 - DNA, 1323 bp, Avena sativa
tgtcccgagctcaaggatatacaacagccattcaatcgcggagagagagaggagaggcgacacgccaccgggagagggaagagggaagagggagagagccatgggagggggcgtcatgcgcaccgccgcgaaggtcggcatcgccgggggcgctgcagcggcggcggccggaggccgcttccgcaacgttgctccgtctttcgcgacggcccccgccgccgaggctgccgctgcggcctcgctggtgtccgcggccggggaaatccccgcggtcgcacctgccgggtcgcagtggacgtcctgggaggtggatgactgggagttcgcggactggagggacgcggcggtgtccgatgcggaggaggcggtggtcgggaggcccagactggtgttcgcgcctccgtcgctggaggaagccgaggaggccaccactgagcttagggacgctatagacagggtttatttcccagagactccagcacaagttgttaaggaacatgatcaagagcttaacaagctgggagccgatgcattaattcctgcaatgccgggacatgttgtgcaagcttttacattgctaaaatcaagctcagaggctcagagcgttgttgcctcacttgcatcagataaaaatgtatgggacgcagtgttgaaaaacgagaaggttatggaattttacaggagtcaccagcaaactctggttaatacatttcccgaggatagtggctccgtagagtcgccggagaaatttgaagacacgtccactgattatgcatcccctggggaactacctactagctcacctttactggactttgtggacaacgcgaagaagacaatgatggagatggtcgacaacataaccagctttttccaagacttgtttcacaccccggccgaaactgaggccggaccgagctcatccactaagaagggtagctccccttcttttgctgagatggcggcaggtggatcattcatggctcttgcgatggcggtcatcctggttgttctgttcaagagggcatgaggtccgcaatatcgaaccatcttggcgcctattgtggcttgaatctgtcgaaaataacttgtttgtcgcgttgttaagaactcggttgtaatgtacagcgtgtgtgcgccctgccgtactatgtcagtcgaagctttctgagtcttgagactagtataatacttaagagacatgttacagtatgtatcttgtgttcctagctaactggtaacgctacggtggagaatggatattttgccggtgttagatgtgtgatctaataaaattctggtagaaacaaacttgaggttgca

SEQ ID NO: 6212 - DNA, 1225 bp, Hordeum vulgare
gcggcgccgctgctgtccgcggccggggaggtccccgcggtggccccggctgggtcgcagtgggcgtcctgggaggtggacgactgggaattcgcggactggaggtccgagtcggcgacgtccgaggcggacgtggcggtggtcgggggcccgaggctggtcttcgccccgccgtcgcgggaggaggccgaggaggccaccgccgagcttcgggaagctattgacagggtttattttccagagactccagtagaagctgttaaggaacatgatcaagagcttagcaagcttggagccgatgcattaattcctgctatgccaggacatgtagtgcaggcttttacattgttaaaatcaagcccggaggctcagagcgttgttgcatcgcttgcatcagataaaaatgtatgggatgcagtgttgaaaaacgagagggttatggaattttacaggagtcaccagcaaactctgatcaatactttccctgagggcaccgactctactgactcagtagagtcaccggagaaatttgaagaggcgtccacagaatatgcactgcccactgcctcacctttctcggacttcgtggacaatgcgaagaagacgatgatagagatggttgacaacataaccaactttttccaagacctgttccacaacccggcggaagctgaggctggaccgggctcatcctctaagaagcattcgtttgcggagatggcggctggtggatctttcatggctcttgccatggcggtcatcctagttgttctgttcaagagggcatgaacgtatactgcaagttcaaacgctcttcgtgcctattgggccttaaatctgtcgaaaataactcgtgttatgaagaactatggatgtaatgtacagtgtgtgtctcctgccgtaccgtgtcagttaaaacttccgagtgttgagaccagtataataaggacatgttatgctcctggttagttggtaatgctgcgctgaagcatggatattttgcctgtgattttcttccaagaagggcatatgacatatagactaacttctaccaggaccaaaaacattatcccccacagagaccaatgatcctcctgaagcgaagttgacgggggggatgtcttaagaagaaaagattccataattggtagccttccaaatcaagtaggcatgtttttttctttctcaggaaaagctttctatctaattcatcgtcttccatggc

SEQ ID NO: 6213 - DNA, 1101 bp, Festuca arundinacea
  misc_feature (278)..(278): n is a, c, g, or t
  misc_feature (289)..(289): n is a, c, g, or t
  misc_feature (373)..(373): n is a, c, g, or t
  misc_feature (431)..(431): n is a, c, g, or t
  misc_feature (437)..(437): n is a, c, g, or t
  misc_feature (484)..(484): n is a, c, g, or t
  misc_feature (508)..(508): n is a, c, g, or t
  misc_feature (547)..(547): n is a, c, g, or t
  misc_feature (550)..(550): n is a, c, g, or t
  misc_feature (601)..(601): n is a, c, g, or t
  misc_feature (634)..(634): n is a, c, g, or t
  misc_feature (640)..(640): n is a, c, g, or t
  misc_feature (657)..(657): n is a, c, g, or t
  misc_feature (930)..(930): n is a, c, g, or t
agccatgggaggaggcgtcatgcgcaccgccgcgaaggtcggcatcgccgggggcgctgcggcggcggccgccggaggacgcttccgcaacgtcgccccggctttcgccacggcccccgccgccgaggctgccgcggcggcctcgctggtgtccgcggccggggagatccccgcggtcgcgccggccgggtcgcactgggcgtcctgggaggtggatgattgggagttcgcggactggagggaggcggcggcctccgatgcggaggagtcggtggtcnagaggccgagnctggtgttcgcgccgccctcgtttgaggaggccgaggaggccaccactgagctcaaggacgctatagacagggtttatttttcngagactccagtacaagttgttaaggaacatgatcaagagcttaacaagctgggagccnatgcgntaattcctgctatgcctgggcatgtagtgcaggcttttacattgttnaaatcaagctcagaggctcagagngttgttgcctcgcttgcatcagataaaaatgtatgggangcngtgctgagaaacgagaaggttatggaattttacaggagtcaccagcaaacnctggttaatacttttcctgaggatactggctcngtagantcgccggagaaatttgnagagacatccacagactatgcatcctctggggaactacctactggctcagctttactggactttgtggacaatgcaaagaagacaatgatggaggtggtcgagaacataaccaactttttccaagatctgttccacaacacagcagacgctgaggcgggaccgagctcatccgctaaaaagggtagctccccttctttcgccgagctggcggctggtggatcattcatggcccttgccatggcggtcatcctagttgttctgttcaagagggnctgagatacgaaagatcaagccatcttggtgcctattgtgccttaaatctgtcgaaaataacttgtctgtcgtgttgttaagaactacggttgtaatgtacagggtgtgtctcctgccatactgtgttagtcgaagctttcgagtcttgagaccagtataataaagacatg

SEQ ID NO: 6214 - DNA, 3456 bp, Triticum aestivum
cgggttggtgctggcgctggtgctcgcctagggtttggaagcttcggctggctcggaggcgtcaagtgtaatggccacacagagtgctgttcggttaattggaggggcaggggctggtggctggactaaggattttggagcattcgactctccactgggaaatcttccaggagaagggctggggtttgtggagaatggcagtgggatttatgggggctggggggaatctgtcccaaatcgaagtggaagcgcacctcctagcatggagggatctctggctgctcttggtaatcttataggtcagcggagtggaaacttcgacaccagtttaggtaacttggacaatgtgactggcagttccacggctgaggagcagttacgtgctgatcctgcatactttgactattatggttccaaggtgaatttgaacccaaggcttcctcctccactaatctcaagggagagccgccgcttcatgaaccgtgttggcaaggttaaagaatggagagtggtctcccaagatgacagcaataaaggctccttatttatacctcgatctactctatcaactcacaaggaagaacctgaagatgataagtctccaaggttggattcaagttctgcagatgatgaacagatgaatcttgtggattttgtgcaggagagcttccagcagaaccccgattcgttgtatgataactcttcacatctatcaagcagcagtattggtgatggcgtagctgtccattctaatattgactcatcaatgaatttgccacatgatgttgtcaagccgtcagggttgaattcgtggacacctgtacctttggccagtgtactgagaagtacacttagcaacaatctttcatctacatctgttcccagttcatcatgttctgataataaccctagtgtacaaatttctgagcaacagcaagaaaagcagagcatagacatgaagcctggaaatgatgtgcctgtcagtggggcagttgttactgaacttgatgttgtggactctagcatgaagaatttgaagttaagtttggatagcccgactacgtcacaagttaagcagcagtggcagggcaatttcttgcagcagtatggcttctcacctctagtccaaggcgaccatatgccaatgactcctcatggagcacatctgccccatgttccttttgttgacaacgtgtctcatactcagctaaaactacccactggtgacatgcagcaacttttacctcaacttggtatgccaacacccttttatacaccgaattcttttggaagcccatattatcagaatttgcatccagccagtgtattggcaaatccttatgtgactgctgggtatgctttgggtggttcaggtttcccacccgttatgactagctattctccccagagttctgctgcgacacctctagacagtcctatgactccaagctttagtggtaggccatctggttttccttcagcagggaatcttactgcaggaaccgagtttgttcagccatataaaatgtatgggcaactcggggttcccatgcagccacctattcccgacccgaacttttttcagttctttcagcatccctcttttccacagtatgctagtggaaatcaatacaatacattggctccaaggggtagtgtttttggaaatgttgctgataattttgatccacgtaagttatttcctcaagctcaatatccatctgatcagaggcttcaacttccaaaaactggaatttttaattctcctacaaccctaagaggaggaactgttccaaattatcatggcatttcaccctatgttggagcgccattgacttatccaacaagcccagtgtttcaggggcaacctttctctggaatttccccctctggtagaaatgattctgcgaggtttcagtccgcctcaagaagtatgactgctgtttctgggtttcaagggcagcgagaaagggagaaatttgataacccgaaggcatgcactttcctggaagaactgaagtccaacagagcacgtagggttgagctatctgatatcacaggtcgcatagtagatttcagcgctgaccaacatggtagccgtttcatccagcagaaattggaaaactgcactgctgaagagaaggcagccgtgtttgcagaagttcttcctcatgcttcatctttaatgactgatgtgttcgggaattatgtgatccaaaagttttttgaacatggaactcctgagcaaagaagggatcttgccgccaagcttgctggtcatgttgtacctttgagccttcagatgtatggatgccgagtaattcaaaaggctctggaagttatggaacttgaccagaaaatagatctggtccgcgagcttgatggaaatattatgcgatgtgttcgtgaccaaaatgggaatcatgttatacagaagtgcatagagtgtgtccccacggaacatattggttttgtagtatctgcttttcggggacaagttgctagcctttcaatgcatccatatggttgccgtgttattcagagagttttggagcattgtggtggtgattcacgaggtcagtgcataatagatgaaatattgcagtccgcttgcatcctcgcacaagaccagtatggcaactatgtcacacagcatgttgtggaaaaaggaaaaagtcatgaaagggctcaaattatcagtaagttggctgggcaggttgtcaccatgagccaaaataaatttgcatcaaatgtgatagagaagtgttttcaacatggggatattgcggaacgagatcttctgatcagagagattgtggagcagactgacggaaatgataccttgctggcaatgatgaaggatcagtatgctaattatgttgttcagaagatacttgaaacatgcaacgatgagcagcgggaacttctggtcagccgtgtaaagggtcacctgcaagcattgaggaagtacacctatggcaagcatatcgcgagccgagtcgagcagctttgcggtgaaggagatgccgagtgtgactcataagcgacgggaatgcctcaacgcccggcaaattcatcagcaaggaagaaaccataacttggaaccgcggtgcttcaaagtgctaacaaaacttggaactccagcaaggaagattgtacatatgtgactttgtttaggcagtgtagggaggtgctaggcacaaggtttattctgtgcgcaccagtgtatctatgttagagtgtggatatgtttaggtgtgcttatccacactgtactagttggtagccgtttgcaaaatatgtatagtaatagtggtttggcttgtagtatgtgatacatgtgtgtatcttgactgcttggtaatgtaattgcttgcttaaatctccagttgtgtggtaaaacatcgtccattcattggattgaccgaagagaaaatggcctgtgatttattgcag

SEQ ID NO: 6215 - DNA, 3626 bp, Secale cereale
acgcgacatcctttttctccgcccgcaaaagagaaagaggggaagaccgatagaggagaaggaaggcttccagaaggagaagatcggcggagacgagagggagaaggggggactcgagctggttcttctccggggagcgagggagagggaagcgaggcctggccagctgccgcggcttggggccgaggcgggagaggggaaggaggaggccgggttggtgctggcgctggtgctcgcctagggtttggaaccttcggctgcctcggaggcgtcaagtgtaatggccacacagagtgctgttcggttaattggagggggaggggctggtggctggactaaggatttcggagcatttgactctccactgggaaatcttccaggagaaggcctggggtttgtggagaatggcagtgggatttatgggggctggggggaatctgtcccaaatcgaagtggaagtgcacctcctagcatggagggatctctggctgctcttggtaatcttataggtcatcggagtggaaacttcgacgccagtttaggtaacttggacaatgtgactggcagttccacggctgaggagcagttacgtgctgatcctgcatactttgactattatggttccaaggtgaatttgaacccaaggcttcctcctccactaatctcaagggagagtcgccgcttcatgaaccgagttggcaaggttaaagaatggagagtggtttcccaagatgacagcaataaaggctccttatttatacctcgatctactctatcaactcacaaggaagaacctgaagatgataagtctccaaggttggattcaagttctgcagatgatgaacagatgaatcttgtggattttgtgccggagagctttcagcagaaccccgattcgttgtatagctcttcgcatctatcaagtagcagtattggtgatggtgtagctgtccatcctaatattgactcatcaaggaatttgtcacatgatgttgtcaagccgtcagggttgaattcgtggacacctgtacctttggccagtgtactgagaagtacacttagcaacaatcttgcatctacatctgttcccagttcatcatgttctgataataaccctagtgtacaaatttctgagcaacagcaagaaaagcagagcatagacatgaagcctggaaatgacgtgcctgtcagtggggcagttgttactgaacttgatgttgtggactcaagcatgaagaatttgaagttaagtttggatagccagactacaccacaagttaagcagcagtggcagggcaatttcttgcagcagtatggcttctcacctctagtccagggcgagcatatgccaatgactcctcatagagcacatctgccccatgttccttttgttgacaatgtgtctcatactcagctaaaactacccactggtgacatgcagcaacttttacctcaacttggcatgccaacacccttttatgcaccgaattcttttggaagcccatattatcagaatttgcatccagccagtgtattggcaaatccttatgtgactgctgggtatgctttgggtggttcaggtttcccacccgttatgactagctattctccccagagttctgctgcgacacctcttgacagccctatgactccaagctttagtggtaggccatctggttttccttcagcagggaatcttactgcaggaaccgagtttgtccagccatataaaatgtatgggcaacttggggttcccatgcagccacccattcccgacccgaacttttttcagttctttcagcatccctcttttccacagtatgctagtggaaatcaatacagtacattggctccaaggggaagtgtttttggaaatgttgccgataattttgatccacgcaagttatttcctcaagctcaatatccgtctgatcagaggcttcagcttcccaaaactggaatttctaattctcctacaaccctaagaggaggaactgttccaaattatcatggcatttcaccctatgttggagcgccattgacttatccaacaagcccagtgtttcaggggcaacctttctctggaatgtccccctctggtagaaatgattccgcgaggtttcagtccgcctcaagaagtatgactgctgtttctgggtttcaaggacagcgagaaagggagaaatttgataatccgaaggcatgcactttcctggaagaactgaagtccaacagagcacgtagggttgagctatctgatatcacaggtcgcatagtagatttcagcgctgaccaacatggtagccgtttcatccagcagaaattggaaaactgcactgctgaagagaaggcagctgtgtttgcagaagttcttcctcatgcttcatctttaatgactgatgtgttcgggaattatgtgatccaaaagttttttgaacatggaactcctgagcaaagaagggatcttgccgccaagcttgctggtcatgttgtacctttgagccttcagatgtatggatgccgagtaattcaaaaggctctggaagttatggaacttgaccagaaaatagatctggtccgcgagcttgatggaaatattatgcgatgtgttcgtgaccaaaatgggaatcatgttatacagaagtgcatagagtgtgtccccacggaacatattggttttgtggtatctgcttttcggggacaagttgctagcctttcaatgcatccatatggttgccgtgttattcagagagttttggagcattgtggtggtgattcacgaggtcagtgcataatagatgaaatattgcagtccgcttgcatcctcgcacaagaccagtatggcaactatgtcacacagcatgttgtggaaaaaggaaaaagtcatgaaagggctcaaattatcagtaagttggctgggcaggttgtcaccatgagccaaaataaatttgcatcaaatgtgatagagaagtgtttccaacatggagatattgcggaacgggatcttctaatcagagagattgtggaacagactgacggaaatgataccttgctggcaatgatgaaggatcagtatgctaattatgttgttcagaagatacttgaaacatgcaacgatgagcagcgggaactactggtcagccgtgtaaagggtcacttgcaagcactgaggaagtacacctatggcaagcatatcgcgagccgagtcgagcagctttgcggtgaaggagatgtcgagtgcgactcctaggccacgggagcgcctcaacacccgccaaattcatcagcaagaaaccataacttggaaccgtggtacttcaaagtgctaacagaacttggaactccagcaagaaagattgtacatatgtgactttgtttaggcagtgtagggaggtgctaggcacaaggtttattctgtgcgcgccagtgtatctatgttagggtgtgcttatccacactgtactagttggtgtccgtgtgcaaaatatgtatagtggctgtggtttggcttgtatgtgtgatacatgtgtgtatgtcgactgcttggtaatgtaattgcttgcttgtttaaaatctccagttgtgtggtaaaacatcgtccattcattggattgaaggaaaaagtc

SEQ ID NO: 6216 - DNA, 632 bp, Pseudoroegneria spicata
  misc_feature (118)..(118): n is a, c, g, or t
  misc_feature (158)..(158): n is a, c, g, or t
  misc_feature (167)..(167): n is a, c, g, or t
  misc_feature (371)..(371): n is a, c, g, or t
cgtctttcatcagaagaaaaaaaagaggagagaaggggtaagagatgaaggaggcgacggcgtcggggggcggcgcgacggcgggggcgaacgacccgaggcagccgacgacggcgangccgtacgcgccgcccaagctgtcttcgcaggacctgccngttgactangcgggcttcctcgccgtcgtcttcggcgtcgtcggcgtcatgctccactacaaggtgtgctcgtggatcgccatcatcttctgcgcgcagtcgctggcaaacatgaagaacttcgagaatgatctcaagcagctctccatggctttcatgtttgctgtcatgggtttggtgacgaactatttcgggcctcgtccaggcggtacnaagcgctaatctgcacacatgcgccgtatgaagtttcctgttaaatgtttggtgcctcggaagctattggcatggtggagctcacatttctgaatccttgatttgggcacgcatcaaatgtaccaccacctcatcggttagggacaagacatgtattatgatgctcagtaattcatttgcacggtacttgttcttccagttttatattattataaaggggatagtcaaagggccttgcataaaaaaaagaaaaaaatgcgt

SEQ ID NO: 6217 - DNA, 705 bp, Secale cereale
acttcagatcgtcttttttttcagaagaaaaagaggagagaagggggagagatgaaggaggcgacggcgtcggggggcggcgcgacggcgggggcgaacgacccgaggcagccggcgacggcgaggccgtacgcgccgcccaagctgtcgtcgcaggacctgcccgtcgactacgcgggcttcctcgccgtcgtcttcggcgtcgtcggcgtcatgctccactacaaggtgtgctcgtggatcgccatcatcttctgcgcgcagtcgctgtcaaacatgaagaacttcgagaatgacctcaagcagctctccatggctttcatgtttgctgtcatgggtttggtgacgaactatttcgggcctcgtccaggcggcgcaaagcgctaatctgcgcaccatgccccgtgtgaagtttcctgttgaatctttggtgcctcggaagctactggcatggtggtgcccacatttctgaatccttgatttgggcacgacgtcaaatgtaccaccgcctcatcggttagggaccaagacatgtatcatgatgctcggtaatttattgcacagtacttgctattccagtttttggttataaagatagtccaagggtcaattattccctgcgagctttcggtgttgtaattgttttagtattggagtagcaaccactttcagtttcatgcatgatcaagattaaatactgttaaa

SEQ ID NO: 6218 - DNA, 695 bp, Secale cereale
acttcagatcgtcttttttttcagaagaaaaagaggagagaagggggagagatgaaggaggcgacggcgtcggggggcggcgcgacggcgggggcgaacgacccgaggcagccggcgacggcgaggccgtacgcgccgcccaagctgtcgtcgcaggacctgcccgtcgactacgcgggcttcctcgccgtcgtcttcggcgtcgtcggcgtcatgctccactacaaggtgtgctcgtggatcgccatcatcttctgcgcgcagtcgctgtcaaacatgaagaacttcgagaacgacctcaagcagctctccatggctttcatgtttgctgtcatgggcttggtgacgaactatttcgggcctcgtccaggcggcgcaaagcgctagtccgtgcaccatgtactgtatgaagtttcctgttgaatttttggtgtcttggaagctactggcatggtggggcccatgtttatgaatccttgatttggtcacgcgtcaaatgtaccaccacctcatcggttagggaccaagacgagtaaatcggaacggagggagtatcatgatgcttggtaatttatttgctcggtacttgctattccagtttggttataaagatagtccaagggtcaattattccctgcgagctttcggtgttgtaattgttttattattggagtagcaaccactttcagtttcat

SEQ ID NO: 6219 - DNA, 526 bp, Secale cereale
gactcttcagatcgtctttttttcagaagaaaaagaggagagaagggggagagatgaaggaggcgacggcgtcggggggcggcgcgacggcgggggcgaacgacccgaggcagccggcgacggcgaggccgtacgcgccgcccaagctgtcgtcgcaggacctgcccgtcgactacgcgggcttcctcgccgtcgtcttcggcgtcgtcggcgtcatgctccactacaaggtgtgctcgtggatcgccatcatcttctgcgcgcagtcgctgtcaaacatgaagaacttcgagaatgacctcaagcagctctccatggctttcatgtttgctgtcatgggtttggtgacgaactatttcgggcctcgtccaggcggcgcaaagcgctaatctgcgcaccatgccccgtgtgaagtttcctgttgaatttttggtgcctcggaagctactggcatggtggtgcttgctttgggcacgcgtcaaatgtaccaccacctcatcggttagggaccaagacatgtatcatg

SEQ ID NO: 6220 - DNA, 717 bp, Hordeum vulgare
aagaaaaaggagaggaggggggagagaagagatgaaggaggcgacggcgtcggggggcggcgcggccgcgggggcgaacgacccgaggcagccgacgacggcgaggccctacgcgccgcccaagctgtcgtcgcaggacctgcccgtcgactacgcgggcttcctcgccgtcgtcttcggcgtcgtcggcgtcatgctccactacaaggcgtgctcgtggatcgccatcatcttctgcgcgcagtcgctggcgaacatgaagaacttcgagaatgatctcaagcagctctccatggctttcatgtttgctgtcatgggtttggtgacaaactattttgggcctcgtccaggtggtacaaagcgctaatctgcagaccatgcgccgtatgaagtttcctgttaaaatttcggtgcctcggaagctattgccatggtggtgctcgcatttctgaatccttgagtcgtaagcgtcaaatgtaccgcctcatcagttagggaccaagacatgtatcatgatgctcagtaatttatttgcacggtacttgttcttccagttatgttataaagatagtcgaagggccttttcctacctcagcacattgatcaattacctgcgagcttttggttttgtattgtcttaggagcatctttagcagataccttatatcgtggtactgtaaaatcagtttagtgtgcactggaaactgtttttagggt

SEQ ID NO: 6221 - DNA, 899 bp, Hordeum vulgare
atctagtgccacttctctgttgggtgtctctccttggttcttcagatcgtctttcagaagaaaggaaaggaaaaaagaaaaaggagaggaggggggagagaagagatgaaggaggcgacggcgtcggggggcggcgcggccgcgggggcgaacgacccgaggcagccgacgacggcgaggccctacgcgccgcccaagctgtcgtcgcaggacctgcccgtcgactacgcgggcttcctcgccgtcgtcttcggcgtcgtcggcgtcatgctccactacaaggcgtgctcgtggatcgccatcatcttctgcgcgcagtcgctggcgaacatgaagaacttcgagaatgatctcaagcagctctccatggctttcatgtttgctgtcatgggtttggtgacaaactattttgggcctcgtccaggtggtacaaagcgctaatctgcagaccatgcgccgtatgaagtttcctgttaaaatttcggtgcctcggaagctattgccatggtggtgctcgcatttctgaatccttgagtcgtaagcgtcaaatgtaccgcctcatcagttagggaccaagacatgtatcatgatgctcagtaatttatttgcacggtacttgttcttccagttatgttataaagatagtcgaagggccttttcctacctcagcacattgatcaattacctgcgagcttttggttttgtattgtcttaggagcatctttagcagataccttatatcgtggtactgtaaaatcagtttagtgtgcactggaaactgtttttagggtatgaagtggacggcacaggtactgaaaaactgtactgcagacaaaaatgttaattttcccccctccgtttctctccacccttcttcccgtgtccgccagccgtcaccg

SEQ ID NO: 6222 - DNA, 707 bp, Secale cereale
tcatcagaaatcagagaagggaaagaaaaaaaaggagagtgatgaaggaggcgacggcgtcggggggcggcgcggcggcgggggcgaacgacccgaggcagccggcgacggcgaggccgtacgcgccgcccaagctgtcgtcgcaggacctgcccgtcgactacgcgggcttcctcgccgtcgtcttcggcgtcgtcggcgtcatgctccactacaaggtgtgctcgtggatcgccatcatcttctgcgcgcagtcgctgtcaaacatgaagaacttcgaaaacgacctcaagcagctctccatggctttcatgtttgctgtcatgggcttggtgacgaactatttcgggcctcgtccaggcggcgcaaagcgctagtccgtgcaccatgtactgtatgaagtttcctgttgaatttttggtgcctcggaagctactggcatggtggtgcttgctttgggcacgcgtcaaatgtaccaccacctcatcggttagggaccaagacatgtatcatgatgcttggtaatttatttgcgcggtacttgctattccagtttggttataaagatagtcgaagggtcgattattccctgcgagctttcggtgttgtaattgttttagtattggagtagcaaccactttcagtttcatgcatgatcaagattaaatactgttaacgtggcccttggttggtcttgttatatgctc

SEQ ID NO: 6223 - DNA, 594 bp, Avena sativa
ttttgtctcagatctcgaaaaggaaggggagagagaagatgaaggaggcgacgacgtcggggggcgcgaccgccggggcgaacgacccgaggcagcctacgacggcgaggccctacgcgccgccgaagctgtcgtcgcaggacctgcccgtcgactacgcgggcttcctcgccgtcgtcttcggcgtcgtcggcgtcatgatgcactacaaggtttgctcgtggatcgcgatcatcttctgtgcgcagtccttggcaaacatgaagaacttcgagaatgatctcaagcagctctccatggctttcatgtttgctatcatgggtttggtgacaaactattttgggccccctcgtccaggcagtgtgaagcgctaatctgtatgcaccatgaactgtacgaagtatactgttcattgttggtgcctcggaaggtattggcatggcgatgcttgcatttctgaacccttgatttgagcatgcaccaagtgtaccacctcatcagttagggaccaaaacatgtattccagtgacgctcattaatttatttgctcggtgcttgttgttccagttttgttatacagaaagatattcaagc

SEQ ID NO: 6224 - DNA, 993 bp, Brachypodium distachyon
atggcgatagccagcagcggactgaggggcggggcagctgtactcgtcgagctcctccgcgcggggtttcttcgtactagctcagtagctcccgagttagggttttggagctggggagcgagctgtgtccgaacgggcgacaggaggagggcgacggagtggggactgaggaagtggaaagactcattactcttcagtttctgctcagtgcctcagattaatctcagatctcgaaaagaaggaaacaaggggagagagagaagagagatgaaggaggcgactacgccggggggcgccagcacgggggcgaacgacccgaggcagccgacgacggcgaggccgtacgcgccgccgaagctgtcctcgcaggaccttcccgtcgactatgcgggcttcctcgccgtggtcttcggcgtcatcggcgtcatgctccgctacaaggtgtgctcgtggatcgcgatcatcttctgcgcgcagtcgctggcgaacatgaagaatttcgagaatgatcttaagcagctctccatggctttcatgtttgctgtgatgggtttggtgacaaactatttcgggcctcctcgtccaggcactacaaagccctaatctggatgcacagcaatccgctgtagaagtatgttgcccaccgaagctattgttgtgtctgtgctcgcatctctgaaacctcggtttgagcacatatcaaatgtaccacctcatcagttagggaccaagacatgtattatgaggctcaataatttatttgcacgggtacttgctcatccagtttcgttatataagatattcaagcttacatcagcacattgatcaatctccatgagctttcggtttaggttcgttttagtagccatcactttcagtctcatgcatgttgaatatcaacttaaggtgactcttacttggtcttcttttacgtgcatgcagtcatagatcacaacaaaactattcataaaaaaaaaccttttttacatgata

SEQ ID NO: 6225 - DNA, 777 bp, Brachypodium distachyon
atggcgatagccagcagcggactgaggggcggggcagctgtactcgtcgagctcctccgcgcggggtttcttcgtactagctcagtagctcccgagttagggttttggagctggggagcgagctgtgtccgaacgggcgacaggaggagggcgacggagtggggactgaggaagtggaaagactcattactcttcagtttctgctcagtgcctcagattaatctcagatctcgaaaagaaggaaacaaggggagagagagaagagagatgaaggaggcgactacgccggggggcgccagcacgggggcgaacgacccgaggcagccgacgacggcgaggccgtacgcgccgccgaagctgtcctcgcaggaccttcccgtcgactatgcgggcttcctcgccgtggtcttcggcgtcatcggcgtcatgctccgctacaaggtgtgctcgtggatcgcgatcatcttctgcgcgcagtcgctggcgaacatgaagaatttcgagaatgatcttaagcagctctccatggctttcatgtttgctgtgatgggtttggtgacaaactatttcgggcctcctcgtccaggcactacaaagccctaatctggatgcacagcaatccgctgtagaagtatgttgcccaccgaagctattgttgtgtctgtgctcgcatctctgaaacctcggtttgagcacatatcaaatgtaccacctcatcagttagggaccaagacatgtattatgaggctcaataatttatttgcacgggtacttgct

SEQ ID NO: 6226 - DNA, 784 bp, Sorghum bicolor
cgggcccacgtataaatctactttcgatctctctctctttctttttttttcagattaatctctctctttctcatccctccagttcggagtccacagaggagagagagagatgaaggagggatcgtcgtcggggggaggggcgttcgctgggggcagcgatccgaggcagccgtcgacggcgaagccgtacgcgccgccgaagctgtcaccccaggacctgcccatcgactatgcgggcttcctcgccgtcgtcttcggcgtcgtcggagtcatgctccgctacaaggtgtgctcgtggatcgcgatcatcttctgtgcacagtcgttggcaaacatgaagaacttcgagaatgatctgaaacagctctccatggccttcatgtttgctgttatgggtctggtgacgaactattttggcccccctcgtccaggcagcacaaagcgctaatctgtggaagaacaccatgtgcctcatccttcataggatatctagccaatctttttggtgcttcgatagctttgccatcggtgctgacatttatgtatgtccaatttgagcaaacgttataggtatggacatcaaattaatggaccggtacatgtataatgctcaataatttatctgtgcagtactagtacacactgtttgaaagagtttttggtgcctccgatcaatgcttcctagacttcggttctactttgtgtcccctccccttaactctgttcttcaggttcacgctcattgttattccgccttctgttactatagtaacttccgttggca

SEQ ID NO: 6227 - DNA, 868 bp, Sorghum bicolor
tttttttcagattaatctctctctcgggcccacgtataaatctactttcgatctctctctctttctttttttttcagattaatctctctctttctcatccctccagttcggagtccacagaggagagagagagatgaaggagggatcgtcgtcggggggaggggcgttcgctgggggcagcgatccgaggcagccgtcgacggcgaagccgtacgcgccgccgaagctgtcaccccaggacctgcccatcgactatgcgggcttcctcgccgtcgtcttcggcgtcgtcggagtcatgctccgctacaaggtgtgctcgtggatcgcgatcatcttctgtgcacagtcgttggcaaacatgaagaacttcgagaatgatctgaaacagctctccatggccttcatgtttgctgttatgggtctggtgacgaactattttggcccccctcgtccaggcagcacaaagcgctaatctgtggaagaacaccatgtgcctcatccttcataggatatctagccaatctttttggtgcttcgatagctttgccatcggtgctgacatttatgtatgtccaatttgagcaaacgttataggtatggacatcaaattaatggaccggtacatgtataatgctcaataatttatctgtgcagtactagtacacactgtttgaaagagtttttggtgcctccgatcaatgcttcctagacttcggttctactttgtgtcccctccccttaactctgttcttcaggttcacgctcattgttattccgccttctgttactatagtaacttccgttggcacgcagtctgggatatggatatgttacttctgctttatcattatcttcgttgagattcgtc

SEQ ID NO: 6228 - DNA, 816 bp, Saccharum officinarum
gagagagagagagagatgaaggagggatcgtcgtcggggggaggggcgttcgctgggggcagcgatccgaggcagccgtcgacggcgaagccgtacgcgccgccgaagctgtctccccaggacctgcccatcgactacgcgggcttcctcgccgtcgtcttcggcgtcgtcggagtcatgctccgctacaaggtgtgctcgtggatcgcgatcatcttctgcgcacaatcgttggcaaacatgaagaacttcgagaatgatctgaagcagctctccatggccttcatgtttgctgttatgggtctggtgacgaactattttggcccccctcgtccaggcagtacaaagcgctaatctgtggaagaacacaccatgtgcttcatccttcattggatatctagccaatctttttggtgcttcgatagctttgccattggttctgacatttatgtatgtccaatttgagcaaacgtcataggtatggacatcaattaatggaccggtacatgtatgatgctcaataatttatttgtgcagtactagtacatgtcttggttctcccagatatttcttttagatccactattatcaacgcatggactgttcgaaagagtttttggtgcctccgggctccgggtatgttggtcaatgcttcctggacttcgggtctacttcatgtcccctcccccttgaatccttgattatgttcttctgggtcattggtattcctcctttttgtgctgcgataaacttccgtgtaagcattctggggatatgtacttctgggtccaatcatatcttacccaaaaaaccccc

SEQ ID NO: 6229 - DNA, 677 bp, Secale cereale
  misc_feature (10)..(10): n is a, c, g, or t
  misc_feature (570)..(570): n is a, c, g, or t
  misc_feature (578)..(578): n is a, c, g, or t
  misc_feature (638)..(638): n is a, c, g, or t
  misc_feature (675)..(675): n is a, c, g, or t
ccacgcgtcngaagaaaaagaggagagaagggggagagatgaaggaggcgacggcgtcggggggcggcgcgacggcgggggcgaacgacccgaggcagccggcgacggcgaggccgtacgcgccgcccaagctgtcgtcgcaggacctgcccgtcgactacgcgggcttcctcgccgtcgtcttcggcgtcgtcggcgtcatgctccactacaaggtgtgctcgtggatcgccatcatcttctgcgcgcagtcgctgtcaaacatgaagaacttcgagaatgacctcaagcagctctccatggctttcatgtttgctgtcatgggcttggtgacgaactatttcgggcctcgtccaggcggcgcaaagcgctagtccgtgcaccatgtactgtatgaagtttcctgttgaatttttggtgcctcggaagctactggcatggtggtgcttgctttgggcacgcgtcaaatgtaccaccacctcatcggttagggaccaagacatgtatcatgatgcttggtaatttatttgcgcggtacttgctattccagtttggttataaagatagtcnaagggtcnattattccctgcgagctttcggtgttgtaattgttttagtattggagtagcaaccacttncagtatcatgcatgatcaagattaaatactgttaacntg

SEQ ID NO: 6230 - DNA, 324 bp, Avena sativa
gagagaggatgaaggaggcgacgacgtcggggggggcgagcgccggggcgaacgacccgaggcagccgacgacggcgaggccctacgcgccgccgaagctgtcgtcgcaggacctgcccgtcgactatgcgggcttcctcgccgccgtgttcggcgtcgtcggcgtcatgatgcactacaaggtttgctcgtggatcgcgatcatcttctgtgcgcagtccctggcaaacatgaagaacttcgagaatgatctcaagcagctctccatggctttcatgtttgctatcatgggtttggtgacgaactattttggcccccctcgtc

SEQ ID NO: 6231 - DNA, 794 bp, Cenchrus ciliaris
gagtttagagagggagaaggagaatgaaggagggatcgtcgtcggggggaggggcggccgctgggggcagcgatccgcggcagccgtcgacggcgaagccctacgcgccgccgaagctgtcgccgcaggacctgcccatcgactacgcgggtttcctcgccgtcgtgttcggcgtcgtcggcgtcatgctccgctacaaggcgtgctcgtggatcgccatcatcttctgcgcgcagtcgttggcaaacatgaagaacttcgagaatgatctgaagcagctctccatggctttcatgttcgcagttatgggtctggtgacgaactactttggcccccctcgtccaggcagtacaaagagctaatctctttgatgcacaccatgcatgcgcctcatcctccacatgatatattagtcaatcttcttggtgcctcaatatgctttatggtccgcgcagacatttatgtatatttgagcacacatcatttgtacggcatcaattaagggatcagtacaggccttaataatttatttgtgcagtactgcagtagtacttgttctcccagatattgatttgttattgtagatttactaccagtatcaaggcttcaactgtgttcaaaagggtgttgtgctttcccgttatgtcgatcaagtcttcttggttttttttttctcttttctgcttcgttgcccctcaccctctttcctcttctgttggctcttgttgtttctccttttgttgatgtgataacttccttttgtttatgcatgctgggtataattctgattatta

SEQ ID NO: 6232 - DNA, 563 bp, Pennisetum glaucum
ggaggagagagagagagagagagtttagagagggagagagaggatgaaggaggggtcgtcgtcggggggaggggcggctgctgggggtagcgatccgcggcagctgtcgacggcgaagccgtacgcgccgccaaagctgtcgccgcaggacctgcccatcgactacgcgggcttcctcgccgtcgtgttcggcgtcgtcggcgtcatgctccgttacaaggtgtgctcgtggatcgccatcatcttctgcgcgcagtcgttggcaaacatgaagaacttcgagaatgatctgaagcagctctccatggctttcatgttcgcggtcatgggcctggtgacgaactattttggcccccctcgtccaggcagtacgaagagctagtcaatgttcttggtacctcaacatgctttatggcccgtgctggcatttatgtatatttgagcacacatcatttgtacgacgtcaatcaatggatcagtacatgcatgatgctcaataatttatttgtgcggtacttctcccagatattaatttgttactgtagatttactattatcaaggc

SEQ ID NO: 6233 - DNA, 606 bp, Zea mays
aaagatctcacccctccagagtcccgggataattcgcttcgatccccagaggcacagacgagacgacagagatgaaggacggaacgtcgtcggggggaggggcgttcgctgcgggcagcgatccaaggcagccgtcgacggcgaagccatacgcgccgccgaagctgtcgccccaggacctacccatcgactatgcaggcttcctcgccgtcgccttcggcgtcctcggcgtcatgctccgctacaaggtgtgctcgtggatcgcaatcatcttctgcgctcagtcgttggcaaacatgaagaactttgagaacgatctgaagcagctttctatggccttcatgtttgctgttatgggtctggtgacgaactattttggccccgctcgtccaggcagtacaaagcgctaaactgcggaagaacatgtgctacattcttcataggactttttggtgcttccgatagctttgccatcggtgctgacattatgtatgtccaatttgagcaaacgtcataggtatgggcatcaaattaatggaccggtacatgtatgatgctcaataatttatttgtgcaatactagtaaacgcatagactgtttgaacg

SEQ ID NO: 6234 - DNA, 1245 bp, Oryza sativa
cgtgcgtgcaagcgagctggagccagcaatcgcgggggcgcataccgaatagaccgcgcggcggcgatgaggcaccgcgccggcgctgctccgacctccccggcttccccctccgcgccgcggctagctcagggagttagggttttggagctcgcgagccagagagcgagagagagagagagagaggagtgggcgacaaaaaaaagaagcagcagaggggacggacgaagcagtgtgaaactggaggaagccgactcgtgcgccgctttgacttttcagtgctcggaccgaagcggtgggccctagccgtgggccggtgggcccggcccaatccaattaactactcttctttttttttcctcctcatcttcttcctccagtttcttcctactctcgttttgtttcgaatcggggaggggagaggagaggagatgaaggaggcgacgtcgtcgggcggcggcggcggcgggggtgcgggggtgaacgacccgcggcagccgtcgacggcgaggcagtacacgccgccgaagctgtcgccgcaggacctgcccatcgactacgcggggttcctcgccgtcgtcttcggcgtcctcggcgtcatgctccggtacaaggtgtgctcgtggatcgctatcatcttctgcgcgcagtctctggtgaacatgaagaatttcgagaatgatctcaagcagttatccatggctttcatgtttgcagttatgggcttggtgacgaactatcttggcccccctcgtccaggcacaaagcgctaatcaggatgcacactatgcaactgtatgagagtatcacttgtatttttatgttccagaagctattggccgcgctcacatctctgaatttcatctgagcatgtagcaaatacagtaatacactgcctcaatcattaggggacaagaatatgtatgatcctcaataatttaattgtgcggtactggtgtagttcttctggccgtcttctgggtgtcatttgcttctagatttcttccactctctctctctttttaaaaaattattttataatttacatcaagcacgttgatcagtgctccttgagctcttgattttgtttcacttgcttcatgttattggaggaatagtcgctttcaagctcatgcatgatagagagtcgagaataaattgctgcatgtagtggcaaacaactctgattgatttcttaatatatccaagtatcagttgtagggctgccatcagttggccaattac

SEQ ID NO: 6235 - DNA, 540 bp, Triticum aestivum
  misc_feature (32)..(32): n is a, c, g, or t
  misc_feature (288)..(288): n is a, c, g, or t
  misc_feature (540)..(540): n is a, c, g, or t
agacgacagagatgaaggacggaacgtcgtcngggggaggggcgttcgctgcgggcagcgatccaaggcagccgtcgacggcgaacattacgcgccgccgaagctgtcgccccaggacctacccatcgactatgcaggcttcctcgccgtcgccttcgggtcctcggcgtcatgctccgctacaaggtgtgctcgtggatcgcaatcatcttctgcgctcagtcgttggcaaacatgaagaactttgagaacgatctgaagcagctttctatggccttcatgtttgcngttatgggtctggtgacgaactattttagccccgctcgtccaggcagtacaaagcgctaaactgcggaagaacatgtgctacattcttcataggactttttggtgcttccgatagctttgccatcggtgctgacattatgtatgtccaatttgagcaaaacgtcataggtatgggcatcaattaattggaccgtacatgtatgatgctcaataatttatttgtgcaatactagtaaacgcatagactgtttn

SEQ ID NO: 6236 - DNA, 2324 bp, Secale cereale
tcagcatcttcttctccctcttgctgctgctctagcttccatcccactccccgtcccccaattcgaccgccccccgcctaaaaatccagtcttgctcgggggaccgtcccttggagcgagcggagatcctcgcctcgccgggaggggatcccgcgtcgtccggtcacgccgcggcggcctctctcctgtccgcgtccgccacgcgttttcctggttccgggcgagggaggggaggggggagcgcgcctggatgagctgcttcttctgcttcggcccggccgtcgaggcggaggccgccaagccggggcccgacgccaaggacccccgcgccgccgccccggatcgcgccggatcagataaattgaggctgcagggtggatcagaccctaagaataatcatctagccatccctcgggatgggagcagccaaaacatcgccgcacagattttcacttttcgtgagcttgctgctgccactaagaacttcagacaagattgcatgttgggcgagggaggttttggacgtgtatacagaggtcgcctggagagtgggcaggctgttgctgtgaagcaacttgatcgtaacggtctccaaggaaatagagaattccttgttgaggtcctcatgctcagtctcttgcatcacactaaccttgtcaatctaattggttattgtgctgatggtgaccaacgcctccttgtttatgagtttatgccactgggctcattagaagatcacttgcatgatgtgccacctgagaaggaacctcttgactggaacacacggatgaagatagctgcaggtgcagccaagggcttagagcatcttcatgacaaggccagccctcctgttatttaccgggatttcaaatcgtcaaacattcttcttggtgaagggtttcacccgaagctgtctgactttggccttgcaaaactcggtccagttggtgacaacactcatgtttcaacacgtgtgatgggaacttatggctactgtgccccagaatatgctatgactgggcagctcacagtgaaatcggatgtctatagctttggcgttgttttccttgaactgattacaggacgcaaagcaatcgacaacaccaaaccccagggggagcaaaacctggtggcatgggctcgtccactcttcaaggatcgcaggaagtttcctaagatggctgacccaatgcttcaaggccggttccccatgaggggtctgtatcaggctttagctgttgctgccatgtgtttgcaagagcaagccacaactcgtcctcatataggggatgttgtcactgctctctcatatctagcttctcagacatatgatccaaatgccccaactcaacatactcggagcaattcatcgacccccagggccagaaatgttggtgggcggaacagcgaacagcgcaacggccgctcgccaaatcatcattctcccaggacatcaaagcacggaggggaggtcagccggactagttctactggtggtgattctggccggaggtcaggattggatgacatggacatggcaggatcacaggcaggcagtccagctcagacagttaggaagagagaaaccccaaggactgctgacaggcagcgcgccatcgcggatgctaaaatttggggggagaactctagagagcggaagcgaccgaatggccatggtagctttgatagcacaaatgagtgaagtggacagttctgtttcatggcgtcgctctagcagggggggcgacgagtttgctcatcagcaccagacgggccaagtttaggaacacggtgtttgttccagctctgtcccgttgtctgtgaataaaggtttttcttgccatcagcactgcctcatggttgctttatctgtaagttgttgcagttgacatgccttctcccggcggcgtccattccttgcgaatgtgattgtgtcatgtactcatgtcctttggagctcaggagcctacaagatgcagctggaaatgtagggaagaagaggggaagattgtcgaagccgcagagttgcgtctgttgggcccctttctttcttccatttctgcagttacacgatgtcgacgagttcgctccgctgcgcctgaactgattgtgcaaccgtgctgggcagtttcttctgatggatgagatctcatcaggtttggttggggataggatagagattacccatgtttcgttcgtacagccgctattgtttttgtgtcgagtcgcgggatcggtcatttatttgtattagcttcgacgtacttcttctgcttgtatcttagtgcgaacatggtttagcatgcagcaaaagtatcaggtta

SEQ ID NO: 6237 - DNA, 2647 bp, Brachypodium distachyon
gcagcggcaggaggcgaaagaaaatgaatggatggatgcgcccccaaaagatcccctctttcctctcttcactcactcgccccagagacagagctgacttttgctctctctctgctccccagcccggcagcctcatgttctcctccttcctgtagcttcttccatcccccgcccgctcccccaaattcgacccaccgcaagccgcaccgcaaaccctctcccgccgcgcctaaaaatccgctctttttgaacgggggcggcgggaatctgtccgcagcggcggcggctccgttctcttggttctagggtgggggggaagacgggagggtgtggccttgtgggggagaggagaggagaggagctcggatgagctgcttctcgtgcttcggatcggcccaggcggcggcggcggcgggggaggccgagaagccggggcacgcgcgcaaggacggcgcggcggcggatcgcggggcggcgccgcacaagggcggatcagataaagtgagaccgcagggtgggtcagactctaagaaggatcatctaaccatccctagggatgcaaacagccaaaatattgcagcacagattttcacttttcgtgaacttgctactgcaactaagaatttcagacaagatagccttttgggcgagggaggttttggccgtgtatataaaggtcgtttggacaatgggcaggctgttgctgtgaagcaacttgatcgtaatggtctccaaggaaatagagaatttctggttgaggtcctcatgctcagtcttttgcatcacactaaccttgtcaatcttattggttactgtgcggatggtgatcagcgccttcttgtttatgagtttatgccattgggctcactagaagaccatttgcatgatgtgccgcctgataaggaacctcttgactggaacacacggatgaagatagctgcaggtgcagctaagggcctagaacatcttcatgacaaggccagccctcctgttatttacagggatttcaagtcatcaaacattcttcttggtgaaggatttcatccgaagctgtctgattttggccttgcaaaactcggtccggttggtgacaagactcatgtttcaactcgtgttatgggaacttatggctactgtgccccagaatatgcaatgactgggcagctcacggtgaaatcagatgtctatagttttggtgttgttttccttgaactgatcacagggcgcaaggcaattgacaacaccaaaccccagggggagcaaaacctggtggcatgggctcgtccactcttcaaagatcgcaggaagtttccgaaaatggccgacccaatgcttcaaggtcggttccccatgagaggtctatatcaggccttggctgttgctgccatgtgtttgcaagagcaagccacaactcgccctcatataggagatgttgtcactgctctctcatatctagcttctcagacatacgatccaaataccccagttcaacataatcggagcaattcatcgacccctagggccagaaatgttgtcaggcggaacgaagatccacgcagtgcgcgctctccgaatcaccattcaccagacttgaggagggaggctgccagagcatcgaaatacggagcggaggttagcaggactagttctgctggagattctggtcggagatcaggattggatgacatggacatggcagggacacaagtaggcagtccagctcaaacagggagaaaaagagagactccaaggactgctgacaggcagcgtgccatcgcagatgccaaatcgtggggccagaattctagagaacggaagctatcaaacggccacggcagctttgatagtagtacaaatgagtaaagtcaacaggtgtagccctagcggagggacgagtttgcttcgtcagcaccaaacggcccagatctaggaacatggtgttctgttccagctcggttccgttgtctgtgaataaaggctttttttcttgtgcccctctggccatcagcaactgcctcatggttgctttatctacgtgtcgttgccatcgacattccttcttcccagcggcgtccattccttgccttgcgaatgcgatcgtgtcatgttactcatggagatcctacaaagatgcagctggaaacaagagattgaaaaggaaagcgaagactgttgtatctgatgagtgctctcgtctgtttccttttgcggttttacaggatatgatgatctgcactgcacctgtgttgtgaaaactgagctggctacctggagcctttgaggttttgttctgatgagatttcaggtttggggatagcatagattattaccatattaccctgtgcctcgtacagctactcttttgtttcttttctttctttttttgtgtgttgagtcgcgttatggagtcatttatttgtattagcttcagtcagtgttcttctttctccctgtatgtatcttagcgctgcgattatgtacttgagcatggagcaagtagttatatcaagtcgttatttcgctgcaatgttccttaatttgttacatgtttcctgaccgagaccaatgtttgtatagtatcatttcgctgctatgttcagtcaagctgggatggaaagaacacgctgctggactgcaaacatgcttg

SEQ ID NO: 6238 - DNA, 2159 bp, Brachypodium distachyon
atgagctgcttctcgtgcttcggatcggcccaggcggcggcggcggcgggggaggccgagaagccggggcacgcgcgcaaggacggcgcggcggcggatcgcggggcggcgccgcacaagggcggatcagataaagtgagaccgcagggtgggtcagactctaagaaggatcatctaaccatccctagggatgcaaacagccaaaatattgcagcacagattttcacttttcgtgaacttgctactgcaactaagaatttcagacaagatagccttttgggcgagggaggttttggccgtgtatataaaggtcgtttggacaatgggcaggctgttgctgtgaagcaacttgatcgtaatggtctccaaggaaatagagaatttctggttgaggtcctcatgctcagtcttttgcatcacactaaccttgtcaatcttattggttactgtgcggatggtgatcagcgccttcttgtttatgagtttatgccattgggctcactagaagaccatttgcatgatgtgccgcctgataaggaacctcttgactggaacacacggatgaagatagctgcaggtgcagctaagggcctagaacatcttcatgacaaggccagccctcctgttatttacagggatttcaagtcatcaaacattcttcttggtgaaggatttcatccgaagctgtctgattttggccttgcaaaactcggtccggttggtgacaagactcatgtttcaactcgtgttatgggaacttatggctactgtgccccagaatatgcaatgactgggcagctcacggtgaaatcagatgtctatagttttggtgttgttttccttgaactgatcacagggcgcaaggcaattgacaacaccaaaccccagggggagcaaaacctggtggcatgggctcgtccactcttcaaagatcgcaggaagtttccgaaaatggccgacccaatgcttcaaggtcggttccccatgagaggtctatatcaggccttggctgttgctgccatgtgtttgcaagagcaagccacaactcgccctcatataggagatgttgtcactgctctctcatatctagcttctcagacatacgatccaaataccccagttcaacataatcggagcaattcatcgacccctagggccagaaatgttgtcaggcggaacgaagatccacgcagtgcgcgctctccgaatcaccattcaccagacttgaggagggaggctgccagagcatcgaaatacggagcggaggttagcaggactagttctgctggagattctggtcggagatcaggattggatgacatggacatggcagggacacaagtaggcagtccagctcaaacagggagaaaaagagagactccaaggactgctgacaggcagcgtgccatcgcagatgccaaatcgtggggccagaattctagagaacggaagctatcaaacggccacggcagctttgatagtagtacaaatgagtaaagtcaacaggtgtagccctagcggagggacgagtttgcttcgtcagcaccaaacggcccagatctaggaacatggtgttctgttccagctcggttccgttgtctgtgaataaaggctttttttcttgtgcccctctggccatcagcaactgcctcatggttgctttatctacgtgtcgttgccatcgacattccttcttcccagcggcgtccattccttgccttgcgaatgcgatcgtgtcatgttactcatggagatcctacaaagatgcagctggaaacaagagattgaaaaggaaagcgaagactgttgtatctgatgagtgctctcgtctgtttccttttgcggttttacaggatatgatgatctgcactgcacctgtgttgtgaaaactgagctggctacctggagcctttgaggttttgttctgatgagatttcaggtttggggatagcatagattattaccatattaccctgtgcctcgtacagctactcttttgtttcttttctttctttttttgtgtgttgagtcgcgttatggagtcatttatttgtattagcttcagtcagtgttcttctttctccctgtatgtatcttagcgctgcgattatgtacttgagcatggagcaagtagttatatcaagtcgttatttcgctgc

SEQ ID NO: 6239 - DNA, 2402 bp, Zea mays
ctggacgcgctgtggcctgccctgccaacctcacactggccgctgctgagcagagctgacttttgctccgcttgccttgccccaaacctcatattcccctcctccttgctgtagctatagctgtagctttcaccccactccctccacggcaccgcgcctccctcccccccttccccaaatcctcctcccctccccaattgggccaatagcccgctccgcttccagtcgcggcgtcggtcggggaagaagcttcgctcccgtgccgcagatcgggagaggagctccccgctcccgcctcgtcgtccgcttccccgccgccggtctctccgggaggcgtctccgtcgccggcgatgagctgcttcgtctgcttcgggtcggcggcgcaggacgaggagcctaggaagcccgctgccgcgggcgccggcaaggacgccgcgccggatcgcgcagtggctcgcgtcggatcagataaatcaagatcacagggtggaccagactctaagaaggatctaattatccataaggatgggaatagtcaaaatattgcagcacagactttcacttttcgtgagctcgctgcagccactaagaacttcaggcaagattgccttttaggagagggaggttttggtcgtgtatataaaggacgcttggagaatgggcaggctgttgctgtgaaacaacttgatcgtaatggtctccaaggaaacagggaatttctggttgaggttctcatgctcagtctcttacatcacactaacctggtcaatctaattggctactgtgctgatggtgaccaacgccttcttgtttatgagtttatgccattggggtcactagaagatcatctgcatgatctgccaccagataaagagcctcttgattggaacacacggatgaagatagctgcaggtgcagctaagggcttagaacaccttcatgacaaggcgagtcctcctgtgatttaccgggattttaagtcatcaaacattcttcttggagaaggatttcatccgaagctatcggactttggccttgcaaaacttggtccggttggtgacaagacccatgtttcaacacgtgtgatgggtacatatggctactgtgccccagaatatgcaatgactgggcagctgacggttaaatccgatgtgtatagctttggtgttgtgttccttgaacttatcacggggcgtaaagcaattgacaatactaagacccaaggggagcaaaatttagtggcatgggctcgtccactgttcaaggaccgaaggaaattccctaaaatggctgatccaatgcttcagggccgcttccctatgaggggtctataccaggccttagccgttgctgccatgtgcttgcaagagcaagctgctacacgtcctcacatcggggatgtcgtcactgctctctcatatcttgcttctcaggcatatgacccaaatgcccctgttcaacacgtccggagcaattcatccacccccagggccagaaaccctgctgggtggaacggcgaccagcgcagcgtgcgctcgcctaaccatcattctccagacccgcggcgcagagacgctgcgggggcatccaagtatggagcagaggttagcaggactagctctaccagcgactctggccggcgatcaggcctggatgacatggacctgaccgggtcgcaagtgggaagcccagcgcagaccggaagaagaagagaagctccaaggggcaccgacagacagcgtgctgtcgcagaggccaggacatggggggagaattcaagggagcgaacaaatggccatggcagcttcgacagcacccatgagtgaagccgtcaggttctgttccagtcatcattccagaacccccaccatgggttgagtccactcattcatcagcaccagtcagatccgatcttgggacatggcgtcggtccaagtgtctgtgaataaggcttttcttgccctcctgtggcgaatgcaattctcctggcgcccattccttgccaatgcgacctgtgtgtgtcatgcctctggcgactgggagcctcaggaggagcctgtaggattcagtcagaggtagacaggtcagtgaagaaagaggaggggcgcggagtcacattggcgagtgttttgttttttttggcggctaaatgctgagtatgttcagctgcatgtgtcctttttgtgtatgtgtacgtgtaagacgtgtaatagcaaccgtgtcaggtttggctacctgagaggcctttgaagcttctgctgctgcttccttccccttgggaattgggagttcagagttgaaatgtaggataggcgatgttgttgagtacatcaactgtttttacccttccatgttgtacggcgacgcttccctgaacaatatgaccatgatgtgcccccct

SEQ ID NO: 6240 - DNA, 1656 bp, Hordeum vulgare
cgggcctagctgaggcccgtattcctcgtcacactctctctccgtgctgacctgacccatgggctctcccacctgcagcatttctgcttcttcttctcccccgatctctcctccgcgacctgctccgataccctgcgagcacggactcctgcaagcggaaggggcttctcaggcgagctcgcaggcgtgatggacgaggcgggcacctcggcgtccgcaggctccgcaccgcgcggggggcgcccggcgagatcgggagtattctataaattcacccagcaggatcttccagcttggaaaccggcaatgacaccaggatacgtgatagccattttcttggtaattgggattatttttgtaccggtcggactaatttgccttcaagcttcaaacagagttgcagaagttgttcaccgctatgatattgattgtctacctaatgcttacagaagtaataagcaggcttatatcaaagacagctcaatttcgaagaagtgtattcagaaagtgaaggttcaataccatatgaaagctccaatttatgtgtattatgaactcgacaactactaccagaatcatcgtaggtatatcaaaagtagaagcgacaaacaactacgctatgggctgaagtacactgatagctcatgcagtccaatagaaaggagcaacggccttccaattgttccctgcggattgattgcctggagcttgttcaatgatacttatgactttacccgtggatccatgggaataatggttgataggaaaaatatttcatggagaagtgatcgggaacataagtatggcaaggatgtctatcctttcaactttcagaatggatccttgattggaggagggaagcttgaccctgatataccactaagcaatcaggaagatcttattgtgtggatgcgcgcagctgctcttccccagtttcgaaagctgtatggtgtcattgaagaggatatacaagctgacgaaatcattaccatgcacataacaaacaattacaatacctacagttttggtggaaagaaaagcctggttcttacaacatcaacctggctaggtggcaagaatgacttccttggatatgcgtaccttatcactggttcctcgagcattttcttgtccattgtctttgctctgatccatgtgaaaatcccaaggccacaaggtgatgctgcttacctatcttggagcaggaaaaacggcaataactaagcttctgtgcacaattcgttttgtgtgtaagagctagtagcttagaaccctgtccggaggttcattatgtctcggtgagtgcaccctgtcttgagggaaatggcatagtagcagcagcttcaggtttcatacacacatacttggatgcagcatgaaatgtttgatgactgctgaggatgtatctggtcggccatggttcattgacatgttcgtgcgaaatttggaatagccctccgacggggcccttgaagaaaagtagggtcgtataaaactgatatatgtgtgtataaagcgccataccatgtactccatgatgctgtacgaatgaatgtacttacaatatttcagtttcacatcgacagtgaagcatggcgttagagcaacttcaatgtggtgacccaaacgaacaatggacaccaattttgtatgtcc

SEQ ID NO: 6241 - DNA, 1967 bp, Hordeum vulgare
gaccggcagcatttctgcttcttcttctcccccgatctctcctccgcgacctgctccgataccctgcgagcacggactcctgcaagcggaaggggcttctcaggcgagctcgcaggcgtgatggacgaggcgggcacctcggcgtccgcaggctccgcaccgcgcggggggcgcccggcgagatcgggagtattctataaattcacccagcaggatcttccagcttggaaaccggcaatgacaccaggatacgtgatagccattttcttggtaattgggattatttttgtaccggtcggactaatttgccttcaagcttcaaacagagttgcagaagttgttcaccgctatgatattgattgtctacctaatgcttacagaagtaataagcaggcttatatcaaagacagctcaatttcaaagaagtgtattcagaaagtgaaggttcaataccatatgaaagctccaatttatgtgtattatgaactcgacaactactaccagaatcatcgtaggtatatcaaaagtagaagcgacaaacaactacgctatgggctgaagtacactgatagctcatgcagtccaatagaaaggagcaacggccttccaattgttccctgcggattgattgcctggagcttgttcaatgatacttatgactttacccgtggatccatgggaataatggttgataggaaaaatatttcatggagaagtgatcgggaacataagtatggcaaggatgtctatcctttcaactttcagaatggatccttgattggaggagggaagcttgaccctgatataccactaagcaatcaggaagatcttattgtgtggatgcgcgcagctgctcttccccagtttcgaaagctgtatggtgtcattgaagaggatatacaagctgacgaaatcattaccatgcacataacaaacaattacaatacctacagttttggtggaaagaaaagcctggttcttacaacatcaacctggctaggtggcaagaatgacttccttggatatgcgtaccttatcactggttcctcgagcattttcttgtccattgtctttgctctgatccatgtgaaaatcccaaggccacaaggtgatgctgcttacctatcttggagcaggaaaaacggcaataactaagcttctgtgcacaattcgttttgtgtgtaagagctagtagcttagaaccctgtccggaggttcattatgtctcggtgagtgcaccctgtcttgagggaaatggcatagtagcagcagcttcaggtttcatacacacatacttggatgcagcatgaaatgtttgatgactgctgaggatgtatctggtcggccatggttcattgacatgttcgtgcgaaatttggaatagccctccgacggggcccttgaagaaaagtagggtcgtataaaactgatatatgtgtgtataaagcgccataccatgtactccatgatgctgtacgaatgaatgtacttacaatatttcagtttcacatcgacagtgaagcatggcgttagagcaacttcaacgtggtgacccaaacgaacaatggacaccatttttgttaaaacaaaaaatataaatttctttcgaggggaggctccggtcccaattattctgatagtgagctagataacaaatcactggccttattatttacctctccgccacccgatacacccttcctttccctaaccttaataagcctgttctaaataccctttatggcccccaaggtgtatactcgaaaaagctccgttttagcgccgcaatctttacacttttttttccttatagtctaaacccaacgaccgcacccatatccctacatcaaaaatggacttaatcattcgtccagagctacgcctttacgcacgaattccacctattatataagcgagaccattatgagattcccgctctccctctcgtcgtgctaaattcgcaccgg

SEQ ID NO: 6242 - DNA, 1565 bp, Triticum aestivum
cccacctgcaggctgcagcatctgttcttcttctccggcccctctcccccgatctctcggccgcgacctgctccgataccctgcgaagtacggactccggcgagcttacggggctcgcgcggcgagctcgcaaccgtgatggacgaggcgggcacctcggcgtccgcaggctccgccccgcgcggggggcgcccggcgagatcgggagtattctatatattcacccagcaggatcttccagcttggaaaccggcaatgacaccaggatacgtgatagccattttcttgataattgggattattttcgtaccagttgggctaatttgtcttcaagcttcaaacagagttgcagaaatcgttcaccgttatgatattgattgtgtacctaatgcttacagaagcaataagcaggcttatatcaaagacagctcgatttcgaagaaatgtattcagaaagtgaaggttcaataccatatgaaagctccaatttatgtgtattatgaactcgacaacttctaccagaatcatcgtaggtatatcaaaagtagaagcgataagcaactacgccatgggctccaatacactgatagctcatgcagtccgatggaaaggagcaacggccttccagttgttccctgtggattgattgcttggagcttgttcaatgatacttatgattttacccgtgggtccatgggattgatggttgataggaaaaacatttcgtggagaagtgatcgggaacataagtatggccaggatgtctatcctttcaactttcagaatggatccttgattggaggaggaaaacttgaccctgatataccactaagcaatcaggaagatcttattgtgtggatgcgcgcagctgctcttccccagtttcgaaagctgtacggtgtcattgaagaggatatacaagctgatgaaaccattaccatgcacataacaaacaattacaatacctacagttttggtggaaagaaaagcctggttcttacaacatcaacatggctaggtggcaagaatgactttcttggatatgcataccttatcactggttcctcgagcattttcttgtccattctctttgctctgatccatgtgaaaatcccaaggccacatggtgatgctgcttacctatcttggagcaggaaaaacggcaataactaagcttctgtgcatagttctttttggtaagctagtagcatagcaccctggccagaggttcccggcggcgttccgtctccgcaccatgtctcgagggaaatggcatagtagcagcttcaggtttcatacacttgacacttggacggagcatgaaatgcgtagcagcttcaggtttcatacacatacttggagcatgaaatgcttgatgactgctgaggatatatggtaaggccatggttcaccgacacggcgtcctcgaggaaaactagagccgtgtaaaactgatatatacttggagtatgtatgtaaaaagcgccataccatggattccatgatgttgtatgaatacatataatgtttcagtttcgcaccgatgtcgaagcatgcttttcccc

SEQ ID NO: 6243 - DNA, 1461 bp, Secale cereale
tcgtctttcttctcttcttcggctcctctccccgagatctctcgcccgcgactccggcgagcgaaggggcttccgcggcgagctcgcgggcgtgatggacgaggcgggcacctcggcgtccgcaggatccgctccgcgcggagggcgtccggcgagatcgggagtattctataaattcacccagcaggatcttccagcttggaaaccggcaatgacaccaggatacgtgatagccattttcttgataattgggattatttttgtacctgttggactaatttgtcttcaagcttcaaacagagttgcagaaatcgttcaccgttatgatattgattgtgtacctaatgcttacagaagcaataagcaagcttatatcaaagacagctcgatttcaaagaaatgtattcagaaagtgaaggttcaataccatatgaaagctccaatttatgtgtattatgaactcgacaacttctaccagaatcatcgtaggtatatcaaaagtagaagcgacaagcaactacgctatgggctgaaatacactgatagctcatgcagtccaatagaaaagagcaacggccttccaattgttccctgtggattgattgcctggagcttgttcaatgatacttatgattttacccgtgggtccatgggattgatggttgataggaaaaatattgcatggagaagtgatcgggaacataagtatggcaaggatgtctatcctttcaactttcagaatggatccttgattggaggaggaaagcttgaccctgatataccactaagcaatcaggaagatcttattgtgtggatgcgcgcagctgctcttccccagtttcgaaagctttatggtgtcatcgaagaggatatacaagctgatgaaaccattaccatgcacataacaaacaattacaatacctacagttttggtggaaagaaaagcctggttcttacaacgtcaacctggctaggtggcaagaatgactttcttggatatgcgtaccttatcactggttcctcgagcattttcttgtccattctctttgctctgatccatgtgaaaataccaaggtaatcgatcaggccccatggtgatgctgcttacctatcatggagcaggaaaaacggcaataactaagcttgtgtgcatagttctttgtgtgtaagctagtaggctagcaccctggccgggggttccccatggtgttctgtctcagtgagcgcaccctgtctcgagggaaatggcatagcagcagcttcaggtttcatacacacacttggatggagcatgaaatgcttgatgactgatgaggatatatagttgcccatggttcaccgacatgttcgtgcaacggcgtccttgaggaaaagaaaactagagccgtatcaaattgatctatgtatgtaaagcgccataccatgttgtactcctccctgatgttatatgaatatatcttt

SEQ ID NO: 6244 - DNA, 1397 bp, Triticum aestivum
gcgcccggcgagatcgggagtattctataaattcacccagcaggatcttccagcttggaaaccggcaatgacaccaggatacgtgatagccattttcttgataattgggattatttttgtaccggttgggctaatttgtctgcaagcttcaaacagagttgcagaaatcgttcaccgttatgatattgattgtgtacctaatgcttacagaagcaataagcaggcctatatcaaagacagctcgatttcgaaggaatgcattcagaaagtgaaggtacaataccacatgaaagctccaatttatgtgtattacgaactcgacaacttctaccagaatcatcgtaggtatatcaaaagtagaagcgataagcaactacgccatgggctccaatacactgatagctcatgcagtccgatagaaaggagcaacggccttccagttgttccctgtggattgattgcctggagcttgttcaatgatacttatgattttacccgtgggtccatgggattgatggttgataggaaaaacatttcatggagaagtgatcgggaacataagtatggccaggatgtctatcctttcaactttcagaatggatccttgattggaggaggaaaacttgaccctgatataccactaagcaatcaggaagatcttattgtgtggatgcgcgcagctgctcttccccagtttcgaaagctgtatggtgtcatcgaagaggatatacaagctgatgaaaccattaccatgcacataacaaacaattacaatacctacagttttggtggaaagaaaagcctggttcttacaacatcaacatggctaggtggcaagaatgactttcttggatatgcataccttatcaccggttcctcgagcattttcttgtgcattctctttgctctgatccatgtgaaaatcccaaggccacatggtgatgctgcttacctatcttggagcaggaaaaacggcaataactaagcttctgtgcatagttctttttggtaaggtacacgctcgatcgacactagcccccctgtaaaagccggaaggaaatgtcctgtttcttttacctgtaacaacatgcagttgagataatgttccaagtactctgccgtgcagctagtagcatagcaccctggccagaggttcccggcgcgtccgtctccgcaccatgtctcggagggaaatggcatagtagcagcttcaggtttcatacacttgacacttggacggagcatgaaatgcgtagcagcttcaggtttcatacacatacttggagcatgaaatgcttgatgactgctgaggatatatggtaaggccatggttcaccgacacggcgtcctcgaggaaactagagcgtagtaaactgatatatacttggagtatgtat

SEQ ID NO: 6245 - DNA, 1666 bp, Brachypodium distachyon
taccgtgggccgaaagatatgcaatgggcctgatttagggctgtattcttacagtcttttgcttatggtgacccatgggctcttccacctgcagtctatgttcgctcagaaaaaagaactgctttctatgttcttctcttccggttccccttctccgatctctctcgtccgtgactccgatcccgtggcgcttggcccggactccggcgagctgacagtgcttgtgcggcgagctcgcgggcgggatggaagaggcaagcacctcggctaacggaggctccgccgcgggcggcgggcgctccttcccgccggcgagatcgggagtattctataagttcacccagcaagatcttccagcttggaaaccggcaatgacaccaggatgtgtgataactattttcttgttgatcggaattacttttgtacctgttgggctagtttgtcttcaagcttcaaacagtgttgcggaaatagttcaccgctatgatattgactgtgtacctgatgcttacagaagaaataagcaggcttatattaaagatagcttgatttctaagaaatgtattcaaaaagtgaaggttcaatatcatatgaaagctccaatttatgtgtattatgaacttgacaacttttatcagaatcatcgtaggtatgtcaaaagtagaagtgataagcaactacgccatgggatgaaatacacggatagctcatgcggtcctctagaaaggaacaatggccttccgattgttccttgtggattgattgcctggagcttgttcaatgatacttttggttttacccgcggatccattggaataatggttgataggaaaaatatttcatggagaagtgatcgggaacacaaatttggcaaggatgtttatcctttcaactttcagaatggatccttaattggaggagggaaacttgaccctgatataccactgagcaatcaggaagatcttattgtgtggatgcgtgctgctgctcttccccaattccgaaagctctatggtgtcattgaagatgatctacaagctgatgaaaccattgacatccacataacaaataattataatacctacagttttggtggaaagaaaagcctagttcttacaacgtcaacttggctaggtggcaagaatgactttcttggatatgcatatcttgtcaccggttcagcgagcattttcttgtccattctatttgctctgattcatgtgaaaattccaaggccacatggtgatgctgcttacctatcttggagccggaaaagcagcaattagctgaggttgtttgtctaaggtagaacccgggggtttccattcttctgaaagaacgcaaccagctcgtgcttcgaaacagaactggcaaagtagcagcttcaggttcaggttcatccacatgcttggatactgaaacgttcgttgacttctgaggatagttggccgtggttgacggacatgttcgtgcaatgtaggcttgcgccctgacgcatcttccaagaagagtactgtcatatggattgatatttgtaaagtggtgtacggtgatcacgatgttgttaggtaaaagaaaaaacggtcccttggtgctgtaacttgtatatggatgtctttcatttcacacaggaagcaaagcatagactaccgcataccgcatacgc

SEQ ID NO: 6246 - DNA, 1365 bp, Brachypodium distachyon
ctcgcgggcgggatggaagaggcaagcacctcggctaacggaggctccgccgcgggcggcgggcgctccttcccgccggcgagatcgggagtattctataagttcacccagcaagatcttccagcttggaaaccggcaatgacaccaggatgtgtgataactattttcttgttgatcggaattacttttgtacctgttgggctagtttgtcttcaagcttcaaacagtgttgcggaaatagttcaccgctatgatattgactgtgtacctgatgcttacagaagaaataagcaggcttatattaaagatagcttgatttctaagaaatgtattcaaaaagtgaaggttcaatatcatatgaaagctccaatttatgtgtattatgaacttgacaacttttatcagaatcatcgtaggtatgtcaaaagtagaagtgataagcaactacgccatgggatgaaatacacggatagctcatgcggtcctctagaaaggaacaatggccttccgattgttccttgtggattgattgcctggagcttgttcaatgatacttttggttttacccgcggatccattggaataatggttgataggaaaaatatttcatggagaagtgatcgggaacacaaatttggcaaggatgtttatcctttcaactttcagaatggatccttaattggaggagggaaacttgaccctgatataccactgagcaatcaggaagatcttattgtgtggatgcgtgctgctgctcttccccaattccgaaagctctatggtgtcattgaagatgatctacaagctgatgaaaccattgacatccacataacaaataattataatacctacagttttggtggaaagaaaagcctagttcttacaacgtcaacttggctaggtggcaagaatgactttcttggatatgcatatcttgtcaccggttcagcgagcattttcttgtccattctatttgctctgattcatgtgaaaattccaaggccacatggtgatgctgcttacctatcttggagccggaaaagcagcaattagctgaggttgtttgtctaaggtagaacccgggggtttccattcttctgaaagaacgcaaccagctcgtgcttcgaaacagaactggcaaagtagcagcttcaggttcaggttcatccacatgcttggatactgaaacgttcgttgacttctgaggatagttggccgtggttgacggacatgttcgtgcaatgtaggcttgcgccctgacgcatcttccaagaagagtactgtcatatggattgatatttgtaaagtggtgtacggtgatcacgatgttgttaggtaaaagaaaaaacggtcccttggtgctgt

SEQ ID NO: 6247 - DNA, 1305 bp, Triticum aestivum
agccattttcttgataattgggattatttttgtaccgcttggactaatttgtcttcaagcttcaaacagagttgcagaaatcgttcaccgttatgatattgattgtgtacctaatgcttacagaagcaataagcaggcctatatcaaagacagctcgatttcgaaggaatgcattcagaaagtgaaggtacaataccacatgaaagctccaatttatgtgtattatgaactcgacaacttctaccagaatcatcgtaggtatatcaaaagtagaagcgacaagcaactacgctatgggctgaaatacactgatagctcatgcagtccaatagaaaagagcgacggccttccaattgttccctgtggattgattgcctggagcttgttcaatgatacttatgattttacccgtggatccatgggaatagtggttgatcggaaaaatatttcatggagaagtgatcgggagcataagtatggcaaggatgtctatcctttcaactttcagaatggatctttgattggaggaggaaaacttgaccctgatataccactaagcaatcaggaagatcttatcgtgtggatgcgcgcagctgctcttccccagtttcgaaagctgtatggtgtcatcgaagaggatatacaagctgatgaaatcattaccatgcacataacaaacaattacaatacctacagctttggtggaaagaaaagcctggttcttacaacatcaacctggctaggtggcaagaatgactttcttggatatgcatatcttatcactggttccttgagcattttcttgtcgattctctttgctctgatccatgtgaaaatcccaaggccacatggtgatgctgcttacctatcttggagcaggaaaaacggcaataactaagcttctgtgcatagttttttctttgtgtaagctagcagtacagcaccctggccagaggtttccccgcggcgttccgtctgcgcaccctgtctcgagggaaatggcatagtagcagcttcaggtttcatacactcgacacttggacggagcatgaaatgcgtagcagcttcagatttcatacacatacttggagcatgaaacgcttgatgactgctgaggatatacggtaaggccatggttcaccgacatgttcgtgcaattcaggccagcgctctgacggcgccctcgaggaaaactagagccgtgtaaaaactgatatatgtgtatgtaaagcgccataccatggattccatgatgttgtatgaatgaatacatataatgtttcagtttcgtgccgatgtcgaagc

SEQ ID NO: 6248 - DNA, 8390 bp, Oryza sativa
catatataacgaggctgcggaatcagatcgcatagcatgattttgagcttgaccaagagattggaatgtgtcaagtgcatcaactgttaattgccagccagaaagtggtgaactacttgagcttgattcagtgttgctacagcaagctgctgccacagttccatttacccatgggcagtaactgttgtgatgcttaacaggatcaaattctggaagtcctgattcaaaatcattttctccattttacctaatccattctgagggtcataatctaaccccattggcacatcaccagcgatcaatagtttgccagcctgtgtcacttcctctttagatacatccaaaccggtctgcatccctgcattgcaagaaagagaaggatgcatcctgcttgcatgaccaacagcatgccctcctatcttttctccactctcaacagaatcagctttagtggaaccataaatttttgagccactgtcagcttggccgactgactgagacaccatatcttggctatctccatgaggttcttgccgatcaacttcgtcaggtacaaactcatccattagtccaggtccaggaactgattcaccagtatgacccatcgtctctgttagctcagtattaggttctgcatcacctacaacactttcagccctttgcaaagaaacatcaattccatgaatttcagcttcatggctagcacccatgccaacactaccaccgctaattcctacactaagttgatcccttgcaaaagcaggggctgttactgcatcaaggacttcctccccttcatttgtactgcttcctcctatttcccttccatcacttccagaagcaggctgtacacatgcactttgctgtgcttggttactatagttcaggcccaagacatcatccatttcaatatttctgtgtgcactagatgagggcatgtcaatatcattaccatcacctggatagtattcaacgctctccatggagtcttcatcagcactatgaacagtatccattgcagctacagaagattccctcatagaatctctgtcaacagcggctagacctgcagctctagcatgactgaatttaccagcatccgcatcaggatcaaagcaaaagtttctactgggaccagctccagaagaagatggaagataggaaccaaatagatcaaacccacgtgaccttttattcgggatgtccgaatcttgcgcagcatcatcaacttcctcaccatcacgatctatcacacttccttctatgctatcagcatgctgaagcctgtcctgtggcttgtcaactgtgctcccaccttcctcatggttgcgcttccttgagcttggacctcgggactcgtatgaagttgcatgatcaccaacttcacttccagtaggttgtccaatcatcagatctcttcccaatcctccgttgaaacgctcagatgcaattggtatagaagattgaattgatggtaatcctccagccattgttagattcaggtccactccagcatttgataatgatttaccctcatttgttgcttcttcatcacgcccttcagcaggatctctttccatcccatcagtaacccattcattgatcccactggcagcgctaattccacgtgtcagagcaagcttcttgcctgtttcaggtgcatcaatgttatttggactaaaacgacaaggacgtgacacagatctaaagtcccagatcttgactgtagagccacaaaagctacaatctaacaaaggtgatctcatgctacatccagagtctttgagtggccttttgccttttcctttatcttttttggctgacccagagaatgaatttttttgatgttcagcaaaacggggaaaaaatggttccaccgaatctgcatttttagctgagtgggttgaattttcttcacagtcttgaacatttggaagccacctaggctcccatccacaaaggcttataagcttcctagcctagaaagcaaaagcaaatcagaagttatatcaacgaaagctaaagtctccaaagtcattgtaaactaataatgccaaaaccaagacatcacatgagaacatggaagaaaagtaaacatacttttgagtagctacaagaggaatcttgctggatatcaattcctgttgtgctctctgctttgtaactaagctctccagataaaaaggtaattgattgggataataagcggtcaatctgggaactcctggtcagcctcatgtgctcaattgctgatgaagcaatcactggaagggaagtaaactgcagaagtccatcacatcgatctttaaaacccccaataagggctgattgtgttaggtggagctgcaccaagctgtcagcacagctattgcctctccagggacagctattatggtgtgatgcatcaagctgctcggcaaaggcttctccagcatttgaaactaatacagaacatagaaagaaaggtttcatagctgagcaaaattcagtttgcaaagggagaggtaccaatttattttccagcctagcacaatggtgagatataagtaacatcagtcagacttgttatgcagtagaatactaagcatagagttttattgatgatgcgtaatgacattttacttcctttgttgacataatgttgggtgttaattcaagatatgacttagttgtaaagatgagattcatgcaacaaaagaaaagatgaatccttgttttccgctgtaaccccccaagttccttatgtcatctgaaacttgttattttcttttatgccaatagatcagattttctcaccctccctttggcactccagttacgtgagcaagccatttagagagcatggaaaagactagaatgcccttgatctcttctccctgtctgatgattggcttgagggcaaatcgacgaagaacgtagtgttgtcctttgaactccacaagatataccgacttctccacagtatggctcgacagcaaagaacccacaaaccagttttcccaccatgagctagtgctcagtgagtaacgctacttggggacacatccactaatatggagacacatacaaactgagatggggagaaattacgaccaaacaattcgtcaataaggagacatcaatttatcttgggacatgaacagatgcgtcaaataggagacactaatttacagagaatcacctcgtaataaagtaaatgcagccactgaatgcatgtaatcaaattacaatcaatgaaattatagcaagggtagtggcatggccaaggagagaaaatgctgcatcagccatgagctcagggccaagcagatcgacaacaaccacgtgaaaccaaagaagatgagatcgagatactcgagctgtactctacgctcttgaaatggacctgatgcacagcaggagacaagttgaaccatgtgcccaccttaatttgctaaccatacgcctcaagctcctcccctgctccccgctggaatagcaccaactggcgatccacatggagaagggccagcagagtgatgcgggttgaggcagcggtcagcggagaaaagcagaggaggaagaggaagaataataagagagaggaatagaagttgacacttgacaggtaggccaggggtagatcggggattttatcaaaatactgacaagccttccacccctaacagtagctttcgacctgaggtgacggcagtggcacatagaagatgtaaaattccataccatggcacataaaggaacagtcaaatttggtaggcaaataaggaagcccataaactatgaacggcaaataaataattctcaaaaaaaattcacaaaggcaatccgattttttatgaccatcacaattcacaagttttcaactattgttgattagttctgcacaaagaattttataatggtattatttgactacagtgaatggcattcacatcagcaaatgcacaaaccagaaagcataaatgtgttgctagtcacggcatggttaaggcattacatcataactaaaccatgtgaattgtaataagacatacaacttattttcagaagtttatgctctctaattaggtatgggcatttaaaataaaaatgttgtatgatttgttttccaccattaaaagatgccgaagcctgaagaaacttggtaaaccacacataatatcccccagaaacttttcaaactaacatattgtctacaaaagcttagttactgaaaacataccttcagctggagaccaggatgtcaatgtactgaatatgagatgtgcaccacatgactcgcattcaattttgtccatgtcaacgttaacccaacctctccgagcacaagccaaagaactagcagcctgcaatacatgtttttcttaaagtgtggtcaaatgagtatagaatattcctcaaaaataaatactgcagatggaaaccggaatttcttttgaacctaatatatacaataaaaaaaactgcatttccaacaagcacaagagacatgaaccagagtcaaatttcaatatatccaagagcctcaacgttccgcttatacttattataagcaaacagcttattagtgattaaaaaataatttatgggtaaaacttttatatgtgtaatcttagcgctttaaaagcagatgctggaaaataaactaagatgaaaaaaacccaatatgaactctaaaattatgttttaaaattcaaattttcgcttatgcttataagctgaagggctaaagatggggttgcaagcaacaaaattattattataaatgacacgaatgaagaaaagtctatgcatataagttgatttaccatgatcataatttcactataatacacaataacaaaaaaaaaagaaagcaaaaacatcaccctcaaagtatcggccatctgtgtcttcctaccattaacaacagaagtaagttatactaatagctctggtgagggaataaataaccttaggcctagaagcccaagttgtaggcttatatgttgccagtcgacgaagtaagtctccgcgttcccatggcctacatgacggtgcagaatccaaagcagttccagtggcatcgaaactatgagaaggctgatgggcatgcggagcaacatgtgatgaggaatcaactctggaagcttgtctgctacccgaccaatctatgctggcaacattagcttgcatagcaggtgacgagggtcctgcagaactgagaaacataacaaaaacatgagtttaagtgtgcccatgcaaggctcaagagctcccggagttgcagttctctagtcatccaatacccgcccaccatttccagttcataagttttccagctatatatttggaattagaattcaagcaactctgtcatcctactttccatgaatgagacagtgtgttaaatcaactcaccaaaaatcgcataaaaatatctcgtcggatagcaaaaccacgatataataaatcgcctgatctgcagctcgcttccgtcctagggtttaaccaaacatccacactctaccgcacctccttacgctcaccgtacacaagatcaaaattttccaactatacatttggaattggcattcaagcaactcctacttaccatgaatgagacagcgcgctaaatcaactcaccaaatatcgcccggtttccacctagagggatatatatctcgcccgagagcaaaaccgtgatggatgcaggccagtagctcgctcccgccctagggtttaaccaaacatctacactcaccgcctcactacgctcgccgtacacaagaccaaaatcccttcgagcaatcgccgccccagtaacaaatccaacgaacacctcgagaacccaaccacgacacaatcgatccaagcaccgagagcccgattcaccgaccacgcccaccgcgacccctgcgaatctaccgccaaaaatgagcgcccccccgcgatcgtaccttgcaaccggcgtaggaggcggctcggccgccgcccccgacgagctcctcacctcctcccgcatctcccctcccctctcctctcctcacctctccccctcgccgcgccgcgtcgccgcccctctcctcctcgccgcggcgtaattgggagagaaaaaaaaaattccccgaccgcgacgcgcagaggcagagttgggttccccggccgttacagccgttagccctcgccgtcaatcgcaaaccctcacacctcacgccgtcacttagatgggccgggctttaatcgagatcacatgggcccaaacgttgaggaggcccagattccgcggctcgcttcgtcgtctcgtctagctccgtctcctctcgcgaagtctcctcgggccattctctcgccggattcggatcccgcggcggcgagccgactcggcggggggatttgccggcgggatgatggaggaggcgagcacgtcggcgtccggtggtgggggggccgccgcgaacggcgggcagcggggcttcccgccggcgagatcgggagtgttctataggttcactcagcagaacctcccagcttggaagccggcaatgacaccaggatgtgtgataactattttcttgatgatcggagttacttttgttcctgttgggcttgtttgccttcatgcttcaaatcatgttgcagaaattgctcaccgttatgatattgattgtgtacctaatgcttacaaaagaaataggcaggcgtatattaaagatagctcgatttcaaagaactgcactcaagaagtgaaggttaaataccttatgagagcaccaatttatgtgtattatgaactcgacaacttctaccagaatcatcgcaggtatgtcaaaagtagaagtgataagcaactacgctatgggcagaagtacacacatagttcatgtgatcctattgaaaggaatgatggccttccaattgttccatgtggcttgattgcctggagcttgttcaatgacacttatggatttacctgtggatccacggaaataaaggtcaacaggaagaatatttcatggaaaagtgaccgggagcataagtttggcaaggatgtatatccttttaactttcagaatggatccttaattgggggaggaaaacttgaccctgctttaccactgaaccagcaggaagatcttatagtgtggatgcgtacggctgctcttccccaatttcgaaagctctatggtgtcattgaagaggatctacaggctgatgaaatcattacgatgcacatagcaaacaattacaatacctacagttttggcggcaagaaaagcctaattcttacaacatcaacctggctaggtggcaagaatgactttcttggatacgcatatcttatcactggctccttgagccttttcttaaccattctctttgctctgattcacgtgaaaaatccaaggccacacggtgatgccaattacctatcatggaataggccaaacagcaatagctaagctgcctacataactgtacgatatgtaaggtaaacatttgacaaatacagtgtagttgtttccctgtaaaaccaagactattcttctttcatatgataacatagagttcagactgaatttcgtggcagtgcaaatagaacaaccaattttgtcattgccttttcttttaagaatgcacacaatttgtgcatttgaaaagaactggtataattggcagtttttagttcatccaaacatttggtatgttgggataataaagtgctgatgaggattgactggcttcttcatgcattttaattggctctctacatgctcatgaagaaaacaaactaacaagaattgtatgtgcgtgtgccatactatttgagtgaccatgtatagtataaatgcgtttgtcataaggtttctgccactactgcccatatcttatttccatcgtccagtctaaccattgtgaagataaaagctgacttggatttcaagagatggacaagttcaatttaacagttgtgcaggtccgagaatttcctcagttcatgagcttcactatgcaagaagaaaggtccatcttatcccaatctctctcatcaacttttctgtttttcttctgggagatgtgtgagctttctcacgtcatacttgcctgaactatggaagttggcgattctaccaaggtgaaggttacattttgcaggtgcataagcatcaatgggcgacaccaatgcctcgactggttcattcattgacgacatgatgtcatacttttgaactgacttgctgctcatatgacgagctgttataatctcctttgttcatatgacctttacgtgtgaacaaatatgctgtgctggtttatagctgatttgacagacaactttgctttagtataagtagaaacctctcatgctcgagcatcattttcaacaaagctatttcattgtcttccct

SEQ ID NO: 6249 - DNA, 812 bp, Pseudoroegneria spicata
gtcgattcctctctgcacctctacccgttctgcctcctcctccacggccacgcctccaatcccctcctcctccacgtccgccagcgccaccgctacaccccaagcgccgcacccgacggcaactccggcgacacctccacggccccgtccgagccgcctcccactgacacccagcccagcccgccaccctccgcacctccgtccaccaactccggcaccaccagcgtcaagacccgcctccggtccaggaaccaggcccgccgcgtccaggaggcgtacctgcccccggtggaggtgaagatgatgaggggcaagggcaaggcgaatgcttccgcggcgccgaggagggagaaggagaagcggaagaagacgtgggacgagatgagcctcggcgagaaggcctatgagctgtacgtcggggagaagggcgccctcttctggctcaataagttcgcctacgcctccatcttcatcatggccggcgcctggatcctgttccgcttcgtcgggcccgccaccgggctctaccagctcgacgcgccgccgctggcgcccaccgacgtcctgcgcggctcctagtgagagcgagcacctaggtttcttgatagatagcgccgcgggcaagataaaggatgggtgaccggaaaagaagattgatgaataattgttgcttacaatggcttcgatgggatgcttgtatgcgattattatgaaattatcgtagatggatcatggatgtatgtacttccctgggtgattttggagctaaagttttcaccctgaattactgaacaatttacacactatgcaaa

SEQ ID NO: 6250 - DNA, 1002 bp, Avena sativa
gcccgttgctagtatctctccagccacccaaaccccatcgccagaacggcgacaagaaaagcagacaccatccggtgacgccatgaagcacctcctcctcgcctccccgctccctctcctcctccacggctccgcatccaagccggcccacctccacatccgccgccgccgctgctatgtccccagcgccgcacccgatggcaactccggcgacacctccacggccgcgtccgagccttccacggacacccagcccagtccaccaccctccgaacctacctccaccagctccaaccccaccagcgtcaaggaccgcctccgttcccggaaccaggcccgccgtacccccgaggtggtgtacctgcccccggtggaggtgaggatgatgaggggcaagacgaaggcgaaagaggcggcggcgccgccgaggagggagaagcagcggaagaagaagggatgggacgagatgagcctggccgagaaggccttggagctgtacgtcggcgagaagggggcgctcttctggctcaacaagttcgcctacgcgtccatcttcatcatggccggcgcctggatcctgttccgcttcgtcgggcccgtcaccgggctctaccagctcgacgcgccgcctctggcacctgtcgacgtcttgcgtggctcgtagtgagatcgccgtcgagccgtgcactgcctgtggagttgtccagtacctacctagatttctagttaagtagatagtgcagcggataagaatggatcgaagaacagcaggattgatgaatgattgctgagctgctcttatgtgattacgaatagatggatggatgtgttccccagcacatttttggagataaacttttgatattttgctggcaattatcggattatcgtggatgtctgtaccgtctgcatcctgaatttctgaataatttacagactgcagctctgttttttcagtggcatgtaaactcgatgacctgaatctgatgtcataattttgaa

SEQ ID NO: 6251 - DNA, 2088 bp, Triticum aestivum
gcacacccatccctgtcttgtcttctcctctgctctcttgcggctgcggctgccagcgcgaggcgacaagaagcaggatgaagagcctgctgggggaggagcgcagcttcatcatcgagagcgacgacgacgacgaggaggatcccgcccacaggggcgacggcgttggccatggggacgacgggtcgtcgtcggactcgtcgtcctgcgccaccccgcgcggcggcggcggcgacagccagcccaactcctacaccaaccaatggccgcagagctacaggcaatcgatcgacattctgagcaacgtgcagtcgccgagcctggggttcctggggaccccgacgctgagcaggctgtccaactccttcctcaacagctccttcctcaacagctcgttccgaggcaaaacccctgagatcgtctccaatctcgtcaagccgctcatacgcccgaccacaagcgacgagcaacagcaacaacagcagcatgaggatatccggaagagctcgcagtacctcctgccgtcgaggaagccgtcgctgcagcagatccccgaggatcagaagccgctggtggttggccatgaggtttctccctaccagcagtgctcttacacccagggagctatgaatggaataaatgttctgtgtggtgtcggaatcctgtcgacgccttatgccatcaagcaaggggggtggctcggactggtgatactagttgtatttgctctgctcgcatggtacaccggtgtgctgctgcgccgttgcctagacagcaaggagggccttcagacatacccggatatcggtcatgccgcctttggcaccaccggtcgcatagccatctcgataattctgtatgtggaactgtatgcctgctgcatcgagtacttgatactggaaagcgacaatttatccaagttgttccccaatgtacacctgaacattgggggcttgacgataaactcgcatgtgttcttcgcaatcttgactacgcttgttgtcatgccgaccacctggctccgtgacctcacctgtctgagctatatttcagctggaggtgtggttgcatcaatccttgtagtcatctgcctatgctggattggggttgtcgatatgtcggcttcgagaacaaaggactgcgttaaacctcccgggaatcctatcgcgattggactgtatggttactgctactcagggcatggggtgttcccaaacatatactcttctctgaagaaccgcaaccagtttccttccattcttttcacctgcattgggttttctaccattttgtttactgccgctgcggtgatgggatacaaaatgttcggcgaatccaccgagtctcagttcaccctcaacttaccggagaatctggtggtttccaagattgccgtctgggctacggtggcaaatccgataaccaaatatgcattgaccataaccccactggccatgagtctggaagagttgctgccgcgaagccagcagaagtactccaacataatcattcttagatcagccctggtggtgtcaaccctcatcattgctctgtcagttcccttctttgcgcttgtgatggctctgattggctctttattcgcgatgcttgtgacctacattctaccttgtgcctgctttctggccatccttaaggcaaaagcaacttggtatcagactgcgacatgctcattcatcatcgccgtaggggttacttgcgcctgcgtggggacatactcatccctctccgggattgtccagaactacgccacctgactccgaagtacttccttccctacatacataatagagaagattgctcgttcgaccgcattattatacatataattaagcatatgtatgagcgagagtggaggattcaaattttgccgaacaatgaattatgtccatcgatatataaatgttgtatgattaaatttgtattgttgttaagtttgtggcaaccgcaataactttgcattgttattgttaaatttgtatgttgatggatctttatcagtataaagtcccagttgtgctagctaattaccgactacttgaatttttcatcaatctatattgagagtgt

SEQ ID NO: 6252 - DNA, 2005 bp, Secale cereale
tcagccacacccatccctgtcttgttgtcgtctgctctgcgctgctgcggcgaggatgaagagcctgctgggggaggagcggagcttcatgatcgagagcgacgaggaggacgaggaggatcccgcccacagggacggcgccggtggcggccatggggatgatgatgggtcgtcgtcggactcgtcgtcctgcgccaccccgcgcggcggcggcggggacagccagcccaactcctacaccaaccaatggccgcagagctacaggcagtcgatcgacattctgagcaacgtgcagtcgccgagcctggggttcctggggacgccgacgctgagcaggctgtccaactccttcctcaacagctccttcctcaacagctccttccggggcaaaacccccgagatcgtctccaatcttgtcaagccgttgatacgcccgaccacaagcgatgagcaacagcaacagcagcagcagcaacaacagcagcatgaggacatccggaagagctcgcagtacctcctgccatccagaaagccgtcgctgcagcagatccccgaggaccggaagccggcggtggttggccatgaggtctctccctaccagcagtgctcttacacccagggagccatgaacgggataaatgttctgtgtggtgtcggaatcctgtcgacgccttatgccatcaagcaagggggctggctcggactggtgatactagtcgtttttgctctgctcgcatggtacaccggagtgctgctgcgccgttgcctggacagcaaggagggcctccagacgtacccggatatcggtcatgccgcctttggcaccaccggtcgcatagccatctcgataatcctgtatgtggaactatatgcctgttgcatcgagtatttgatactggaaagcgacaatttatccaagttgttcccaaatgtacacctgaacattgggggcttgacgataaactcgcacgtgttcttcgcaatcttgacgacgctcgtcgtcatgccgaccacttggctccgtgacctcacctgcctgagctatatttcagctggaggtgttgtggcatcaatccttgtagtcatctgcctatgctggattggggttgtcgacaatgtcggcttcgagaacaaagggaccgcgttaaacctcccgggaatccctatcgcgattggactgtacggttactgctactcgggccacggggtgttcccaaacatctactcttctctgaagaaccgcaaccagtttccatccattcttttcacttgcattgggttctctaccattttgtttactgccgccgcggtgatgggatacaaaatgttcggtgaatccaccgagtctcagttcaccctcaacttaccggagaatttggtggtttccaagattgccgtctgggctacggtggcaaatccaataaccaaatatgcattgaccataaccccactggccatgagtctggaagagttgctgccgcgaagccagcagaagtactccaacataatcatacttagatcagccctggtggtgtcaaccctcatcattgctctgtcagttcccttctttgcacttgtgatggctctgattggttctttattcgcgatgcttgtgacctacattctaccttgtgcctgctttctggccatccttaaggcaaaagcgacttggtatcagactgcgacatgctcgttcatcatcgccgtaggggttacctgcgcctgcgtggggacatactcatccctctccgggattgtccagaactacgcctcctgactctgaagtatctccatccctacatacatcagagagatgattgctcgttcgaccgcattgttatacatataattaagcatatgcatgtatgagcgagagcggaggattcaaattttgccgaacaatgagttatgtccatcgatatatacatgttgtatgattaaatttgtattgttgttaaatttgtggcaaccccgatgactttgcattattattgttaaatttgta

SEQ ID NO: 6253 - DNA, 2291 bp, Hordeum vulgare
agtggtgctaccatgggtatggacagccaatcccttttactggtttccttatgctgtatattactgtgaatcaatagtgggacatagttttgaatcctaggctatatatacatataaacccagcatccaaaccaaagcaatcactcatcccatcccatcccatccctgtcttgtctgctctccatcttctctgctctgcttctggtgcgggaggcgatgaagagcctgctgggggaggagcggagcttcatcatcgagagcgacgacgacgacgacgaggaggaccccatccacaaggacggcgccggcggctcctcgtcggactcgtcgtcgtgcgccagcccgcgcggagggagcggcggcggcggcggcgacagccagcccaactcctacacaaaccaatggccgcagagttacaggcaatcgatcgacattttgagcagcgtgcagtcgccgagcctgggttttctggggaccccgacgctcagcaggctgtccaactccttcctcaacagctccttcctcaacaactcgttccgaggcaaaacccctgaggtcatctccaacctcgtcaagccgcttatacggccgacaacaagtgacgagcaacagcaacaacaacagcatcatgaagatatcaggaagagctcgcagtaccttctaccgtcgaggaagccgtcgctgcagcagattcccgaggatcagaagcccctggtggttggtcatgaggtttctccctaccagcaatgctcttacacccagggagccatgaacggcataaatgttctttgtggtgtcggaatcctttcaacgccttacgccatcaagcaaggcgggtggatcggactggtgatactgattgtatttgctctgctcgcatggtacaccggtgtgctgctgcgccgttgcctggacagcaaggagggccttcagacatacccagatatcggtcatgccgcctttggcaccaccggtcgcatagccatctcgataatcctgtatgtggaactgtatgcctgctgcatcgagtatttgatactggaaagcgacaatttatcgaagttgttccccaacgtacacctgaacatttggggcttggcaataaactcgcatgtattcttcgcaatcttgacgactcttgtggtcatgccgaccacttggctccgtgaccttacctgcctgagctatatttcagctggaggtgttgtggcatcaatccttgtagtcatctgcttgtgctggattggggttgtcgaccatgtcggctttgagaacaaagggactgcgctaaacctcccggggattcctatcgcaattgggctgtacggttactgctactcgggccatggggtgttcccaaacatctactcttctctgaagaatcgcaaccagtttccctccattcttttcacttgcattggattctccaccattttgtttactgccgccgctgtgatgggatacaaaatgtttggtgaatccactgagtctcagttcacgctcaacttaccggagaatctggtggtttccaagattgccgtctgggctacggtggcaaatccaataaccaaatatgcattgacaataaccccactggccatgagtctggaagagttgctgccgcgaagtcagcagaagtactccaacataatcattcttagatcagccctggtggtgtcaacgctcatcattgctctgtcagttcccttctttgcacttgtgatggctctgattggttctctattcgcgatgcttgtgacctacattctaccttgtgcctgctttctggccatccttaaggcaaaagcgacttggtatcagactgcaacatgctcattcatcatcgccgtaggggtgacctgcgcctgcgtggggacatactcatcactctctgggattgtccagaactactccacctgactgcgaagtacttcgttccctacatacatagcagagaagattgctcgatagaccggattattatacatataattaagcatatgtatgggcgagagtggatgattcaaattttgccgaacaatggattgcatccatccatatataaatgttgtattattagatttgtattggtcttaaatttgtggcaactccatatatgcatgcatgataaatttgtattattattgttaaatttctgtgttgatggatctttgtcagttttgctagctaattacgatttacaaatactttaaactttcatataaatctataatgggagtgtaatttggccgacatgcaactcgaacctttatttgtctctatattaacta

SEQ ID NO: 6254 - DNA, 1907 bp, Secale cereale
tggccatggggatgatgatgggtcgtcgtcggactcgtcgtcctgcgccaccccgcgcggcggcggcggcggggacagccagcccaactcctacaccaaccaatggccgcagagttacaggcagtcgatcgacattctgagcaacgtgcagtcgccgagcctggggttcctggggacgccgacgctgagcaggctgtccaactccttcctcaacagctccttcctcaacagctccttccggggcaaaacccccgacgatcgtctccaatcttgtcaagccgttgatacgcccgaccacaagcgatgagcaacagcaacagcagcagcagcaacaacagcagcatgaggacatccggaagagctcgcagtacctcctgccatccagaaagccgtcgctgcagcagatccccgaggaccggaagccggcggtggttggccatgaggtctctccctaccagcagtgctcttacacccagggagccatgaacgggataaatgttctgtgtggtgtcggaatcctgtcgacgccttatgccatcaagcaagggggctggctcggactggtgatactagtcgtttttgctctgctcgcatggtacaccggagtgctgctgcgccgttgcctggacagcaaggagggcctccagacgtacccggatatcggccatgccgcctttggcaccaccggtcgcatagccatctcgataatcctgtacgtggaactgtatgcctgctgcatcgagtacttgatactggaaagcgacaatttatccaagttgttcccaaatgtgcacctgagcattggggcttgacgataaactcgcacgtgttcttcgcaatcttgacgacgctcgtcgtcatgccgaccacttggctccgtgacctcacctgcctgagctatatttcagctggaggtgtggttgcatcaatccttgtggtcatctgcctatgctggattggggttgtcgacaatgtcggctttgagaacaaagggaccgcgttaaacctcccgggaattcctatcgcgattggactgtacggttactgctactcggggcatggggtgttcccaaacatatactcttctctgaagaaccgcaaccagtttccctccattcttttcacctgcattgggttctctaccatttgtttactgccgccgcggtgatgggatacaaaatgttcggcgaatccaccgagtctcagttcacccttaacttaccagagaatctggtggtttccaagattgccgtttgggctacggtggcaaatccgataaccaaatatgcattgaccataaccccactggccatgagtctggaagagttgctgccgcgaagccagcagaagtactccaacataatcatacttagatcagccctggtggtgtcaaccctcatcattgctctgtcagttcccttctttgcacttgtgatggctctgattggttctttattcgcgatgcttgtgacctacattctaccttgtgcctgctttctggccatccttaaggcaaaagcgacttggtatcagaccgcgacatgctcgttcatcatcgccgtaggggttacctgcgcctgcgtagggacatactcatccctctccgggattgtccagaactacgcctcctgactctgaagtacttccttcccaacatacataatagagaagattgctcgttcgatcgcattgttatacatataattaagcatatgtatgtatgagcgagagcggaggattcaaattttgccgaacaatgagttatgtccatcgatatttaaatgttgtatgattaaatttgtattgttgttaaatttgtggcaactctgataactttgcattattattgttaaatttgtatgttgatggatctttatcagtataaagtccagttctgctaagaaact

SEQ ID NO: 6255 - DNA, 1916 bp, Secale cereale
tggggaggaggatgggtcgtcgtcggactcgtcgtcctgcgccaccccgcgcggcggcggcggcggggacagccagcccaactcctacaccaaccaatggccgcagagttacaggcaatcgatcgacattctgagcaacgtgcagtcgccgagcctgggcttcctggggacgcccacgctgagcaggctgtccaactccttcctcaacagctccttcctcaacagctccttccggggcaaaacccccgagatcgtctccaacctcgtcaagccgctgatacgcccgaccacaagcgacgagcaacagcaacagcagcagcaacaacaacagcagcatgaggacatccggaagagctcgcagtacctcctgccgtcgaggaagccgtcgctgcagcagatccccgaggaccggaagccggcggtggctggccatgaggtctctccctaccagcagtgctcttacacccagggagccatgaacgggataaatgttctgtgtggtgtcggaatcctgtcgacgccttatgccatcaagcaagggggctggctcggactggtgatactagtagtatttgctctgctcgcatggtacaccggtgtgctgctgcgccgttgcctggacagcaaggagggcctccagacatacccggatatcggccatgccgcctttggcaccaccggtcgcatagccatctcgataatcctgtacgtggaactgtatgcctgctgcatcgagtacttgatactggaaagcgacaatttatccaagttgttcccaaatgtgcacctgagcattgggggcttgacgataaactcgcacgtgttcttcgcaatcttgacgacgctcgtcgtcatgccgaccacttggctccgtgacctcacctgtctcagctatatttcagctggaggtgtggttgcatcaatccttgtggtcatctgcctatgctggattggggttgtcgacaatgtcggctttgagaacaaagggaccgcgttaaacctcccgggaattcctatcgcgattggactgtacggttactgctactcggggcacggggtgttcccaaacatctactcttctctgaagaaccgcaaccagtttccatccattcttttcacctgcattgggttctctaccattttgtttactgccgccgcggtgatgggatacaaaatgttcggcgaatccaccgagtctcagttcacactcaacttaccggagaatctggtggtttccaagattgccgtctgggctacggtggcaaatccaataaccaaatatgcattgaccataaccccactggccatgagtctggaagagttgctgccgcgaagccagcagaagtactccaacataatcatacttagatcagccctggtggtgtcaaccctcatcattgctctgtcagttcccttctttgcgcttgtgatggctctgattggttctttgttcgcgatgcttgtgacctacattctaccttgtgcctgctttctggccatccttaaggcaaaagcgacttggtatcagaccgcgacatgctcgttcatcatcgccgtaggggttacctgcgcctgcgtggggacatactcatccctctccgggattgtccagaactacgcctcctgactctgaagaacttccttccctacatacataatagagaagattgctcgttcgaccgcattgttatacatataattaagcatatgtatgacatagagacgagagcggaggtattactaaattttcgaccgaaacaatagtaattatgtacaatcgatatatacatgttctatagtaatttaaagtttgttatttgtttagtttaaatttggtggtactaactctagtaattaacttgatattatttattagtttaaatttagtatgttagagtagtattctttatactaag

SEQ ID NO: 6256 - DNA, 1757 bp, Secale cereale
gatgggtcgtcgtcggactcgtcgtcctgcgccaccccgcgcggcggcggcggggacagccagcccaactcctacaccaaccaatggccgcagagctacaggcaatcgatcgacattctgagcaacgtgcagtcgccgagcctgggcttcctggggacgcccacgctgagcaggctgtccaactccttcctcaacagctccttcctcaacagctccttccggggcaaaacccccgagatcgtctccaacctcgtcaagccgctgatacgcccgaccacaagcgacgagcaacagcaacagcagcagcaacaacaacagcagcatgaggacatccggaagagctcgcagtacctcctgccgtcgaggaagccgtcgctgcagcagatccccgaggaccggaagccggcggtggctggccatgaggtctctccctaccagcagtgctcttacacccagggagccatgaacgggataaatgttctgtgtggtgtcggaatcctgtcgacgccttatgccatcaggcaagggggctggctcggactggtgatactagtcgtatttgctctgcttgcatggtacaccggggtgctgctgcgccgttgcctggacagcaaggagggcctccagacatacccggatatcggtcatgccgcctttggcaccaccggtcgcatagccatctcgataatcctgtacgtggaactgtatgcctgctgcatcgagtacttgatactggaaagcgacaatttatccaagttgttccccaatgtgcacctgaacattgggggcttgacgataaactcgcatgtgttcttcgcaatcttgacgacgctcgtcgtcatgccgaccacttggctccgtgacctcacctgtctcagctatatttcagctggaggtgtggttgcatcaatccttgtggtcatctgcttatgctggattggggttgtcgacaatgtcggctttgagaacaaagggaccgcgttaaacctcccgggaattcctatcgcgattggactgtacggttactgctactcggggcatggggtgttcccaaacatctactcttctctgaagaaccgcaaccagtttccctccattcttttcacctgcattgggttctctaccattttgtttactgccgccgcggtgatgggatacaaaatgttcggcgaatccaccgagtctcagttcacccttaacttaccagagaatctggtggtttccaagattgccgtttgggctacggtggcaaatccgataaccaaatatgcattgaccataaccccactggccatgagtctggaagagttgctgccgcgaagccagcagaagtactccaacataatcattcttagatcagccctggtggtgtcaaccctcatcattgctctgtcagttcccttctttgcgcttgtgatggctctgattggttctttgttcgcgatgcttgtgacctacattctaccttgtgcctgctttctggccatccttaaggcaaaagcgacttggtatcagactgcgacatgctcgttcatcatcgccgtaggggttacctgcgcctgcgtggggacatactcatccctctccgggattgtccagaactacgcctcctgactctgaagaacttccttccctacatacataatagagaagattgctcgttcgaccgcattgttatacatataattaagcatatgtatgcatgagcgagagcggaggattcaaattttgccgaacaatgaattatgtcaatcgat

SEQ ID NO: 6257 - DNA, 2043 bp, Triticum aestivum
ttttgttttgttcaaagtcatcatttctgactggatcttactgtattttgtcaagttcttactatatctgctgttacaatgctcaaaaatcacatttcttgctctgcttattctcatgtcagtaacaattcttttctattttctctcttgtattttgacaggcaatcgatcgacattctgagcaacgtgcagtcgccgagcctggggttcctggggaccccgacgctgagcaggctgtccaactccttcctcaacagctccttcctcaacagctcgttccgaggcaaaacccctgagatcgtctccaatctcgtcaagccgctcatacgcccgaccacaagcgacgagcaacagcaacaacagcagcatgaggatatccggaagagctcgcagtacctcctgccgtcgaggaagccgtcgctgcagcagatccccgaggatcagaagccgctggtggttggccatgaggtttctccctaccagcagtgctcttacacccagggagctatgaatggaataaatgttctgtgtggtgtcggaatcctgtcgacgccttatgccatcaagcaaggggggtggctcggactggtgatactagttgtatttgctctgctcgcatggtacaccggtgtgctgctgcgccgttgcctagacagcaaggagggccttcagacatacccggatatcggtcatgccgcctttggcaccaccggtcgcatagccatctcgataattctgtatgtggaactgtatgcctgctgcatcgagtacttgatactggaaagcgacaatttatccaagttgttccccaatgtacacctgaacattgggggcttgacgataaactcgcatgtgttcttcgcaatcttgactacgcttgttgtcatgccgaccacctggctccgtgacctcacctgtctgagctatatttcagctggaggtgtggttgcatcaatccttgtagtcatctgcctatgctggattggggttgtcgatcatgtcggcttcgagaacaaagggactgcgttaaacctcccgggaattcctatcgcgattggactgtatggttactgctactcagggcatggggtgttcccaaacatatactcttctctgaagaaccgcaaccagtttccttccattcttttcacctgcattgggttttctaccattttgtttactgccgctgcggtgatgggatacaaaatgttcggcgaatccaccgagtctcagttcaccctcaacttaccggagaatctggtggtttccaagattgccgtctgggctacggtggcaaatccaataaccaaatatgcattgaccataaccccactggccatgagtctggaagagttgctgccgcgaagccagcagaagtactccaacataatcattcttagatcagccctggtggtgtcaaccctcatcattgctctgtcagttcccttctttgcgcttgtgatggctctgattggctctttattcgcgatgcttgtgacctacattctaccttgtgcctgctttctggccatccttaaggcaaaagcaacttggtatcagactgcgacatgctcattcatcatcgccgtaggggttacttgcgcctgcgtggggacatactcatccctctccgggattgtccagaactacgccacctgactctgaagtacttccttccctacatacataatagagaagattgctcgttcgaccgcattattatacatataattgagcatatgtatgagcgagagtggaggattcaaattttgccgaacaatgaattatgtccatcgatatataaatgttgtatgattaaatttgtattgttgttaaatttgtggcaaccgcaataactttgcattgttattgttaaattcgtatgttgatggatctttatcagtataaagtcccagttctgctagctaattaccgactacttgaatttttcatcaatctatattgagagtgtaattttgccgacatgcaactagaacctttatttgtctctagattaattatatttagagtgaggtgtgtatg

SEQ ID NO: 6258 - DNA, 1593 bp, Secale cereale
ggatgatgatgggtctcgtcggactcgtcgtcctgcgccacccgcgcggcggcggcggaagcggcggcggcagccagcccaactcctacaccaaccaatggccgcagaattcagcaatcgatcgacattctgagcaacgtgcagtcgccgagcctaggttcctggggacgcccacgctgagcaggctgtccaactccttcctcaacagctccttcctccaatagctccttccacggggcgaaaacccccgaacgaatcgtctccaacctcgtcaagccgctgatacacccgaccacaagcgacgagcaacagcaacagcagcagcagcaacaacagcagcatgaggacatccggaagagctcgcagtacctcctgccgtccaggaagccgtcgctgcagcagatccccgaggaccggaagccggcggtggctggccatgaggtctctccctaccagcagtgctcttacacccagggagccatgaacgggataaatgttctgtgtggtgtcggaatcctgtcgacgccttatgccatcaagcaagggggctggctcggactggtgatactagtagtatttgctctgctcgcatggtacaccggtgtgctgctgcgccgttgcctggacagcaaggagggcctccagacgtacccggatatcggccatgccgcctttggcaccaccggtcgcatagccatctcgataatcctgtatgtggaactgtatgcctgctgcatcgagtatttgatactggaaagcgacaatttatccaagttgttccccaatgtacacctgagcattgggggcttgacgataaactcgcacgtgttcttcgcaatcttgacgacgctcgtcgtcatgccgaccacttggctccgtgacctcacctgcctgagctatatttcagctggaggtgtggttgcatcaatccttgtggtcatctgcctatgctggattggggttgtcgacaatgtcggctttgagaacaaagggaccgcgttaaacctcccgggaattcctatcgcgattggactgtacggttactgctactcggggcacggggtgttcccaaacatctactcttctctgaagaaccgcaaccagtttccctccattcttttcacctgcattggttctctaccattttgtttactgccgccgcggtgatgggatacaaaatgttcggcgaatccaccgagtctcagttcaccctcaacttaccggagaatctggtggtttccaagattgccgtctgggctacggtggcaaatccgataaccaaatatgcattgaccataaccccactggccatgagtctggaattacggtccggcgcgaagccagcagaggggctccaacataatcattcttagatcagccctggtggtgtcaaccctgatcattgctctgtcagttcccgtcttgcacttgtgatggctctgattggttctttgttcgcgatgcttgtgacctacattctaccttgtgcctgctttctggccatgctgaaggcgaaagcgacttggtatcagactgcgacatgctcgttcatcatctgcgtaggggttacctgcgcctgcgtggggacatact

SEQ ID NO: 6259 - DNA, 1767 bp, Triticum aestivum
acaggcaatcgatcgacattctgagcaacgtgcagtcgccgagcctggggttcctggggaccccgacgctgagcaggctgtccaactccttcctcaacagctccttcctcaacacctccttccggggcaaaacccccgagatcgtctcgagtctcgtcaagccgctcatacgcccgaccacaagcgacgagcaacagcagcatgaggacatccggaagaagagctcgcagtacctcctgccgtcgaggaagccatcgctgcagcagatccccgaggaccggaagccggtggtggtcggccatgaggcttcgccgtatcagcagtgctcttacacccagggagctatgaacgggataaatgttctgtgtggcgtcggaatcctgtcgacgccttacgccatcaagcaagggggctggctcggactggtgatactggttgtgtttgctctgctcgcatggtacaccggtgtgctgctgcgccgttgcctggacagcaaagagggcctccagacgtacccggatatcgggcacgccgcctttggcaccaccggccgcatagccatctcgataattctgtatgtggaactgtatgcctgctgcatcgagtatttgatactggaaagcgacaatttatcaaagttgttccccaatgtacacctcaacattgggggcttgacgataaactcgcacgtgttcttcgcaatcttgacgacgcttgttgtcatgccgaccacttggctccgtgaccttacatgcctgagctatatttcagctggtggtgtggttgcatcaatccttgtggtcatgtgcctatgctggattggggttgtcgatcatgtcggcttcgagaacaaagggaccgcgttaaacctcccgggaattcctatcgcgattggactgtatggttactgctactcgggccacggggtgttcccaaacatctactcttctctgaagaaccgcaaccagtttccttccattcttttcacctgcattgggttttctaccattttgtttactgccgccgctgttatgggatacaaaatgttcggcgaagccaccgagtctcagttcaccctcaacttaccggagaatctggtggtttccaagattgccgtctgggctacggtggcaaatccgataaccaaatatgcattgaccataaccccactggccatgagtctggaagagttgctgccgcggagccagcagaagtactccaacataatcattcttagatcagccctggtggtgtcaaccctcatcattgccctgtcagttcccttctttgcacttgtgatggctctgattggctctttattcgcgatgcttgtgacctacattctgccttgtgcctgctttctggccatcctcaaggcaaaagcgacttggtatcagactgcgacatgctcattcatcatcgccgtaggggttacctgcgcctgcgtggggacatactcatccctctccgggattgtccagaactacgccacctgaccctgaagtacttccttccctacatacataatagagaagattgctcgttcgaccgcattatattatacatataattaagcatatgtatgtatgagcgagagtggaggattcaaattttgccgaacaatgaattgtgtccatcgatatataaatgttgtatgattgaatttgtattgttgttaaatttgtggcaaccccgataactctgcattattattgttaaatttgtgcgttgatggatctttagcagtataaagtccgagttctgcta

SEQ ID NO: 6260 - DNA, 1795 bp, Secale cereale
cgattctatttctgccgttacaatgctcacgaaatcacagtgagtgttgcagtaactacacttttttgtctctgttcattatcatgttactaactaatactttttgttcactcttgtgttttcacaggcaatcgatcgacattctgagcaacgtgcagtcgttccgagcctggggtcctgggacgcccacgctgagcaggctgtccaactccttcctcaacagccccttccggggcaaaacccccgagatcgtctccaatcttgtcctaagccgttgataacgcccgaccacaagcgatgagcaacagcaacagacagcagcagcaacaacagcagcatgaggacatccggaagagctcgcagtacctcctgccatccagaaagccgtcgctgcagcagatccccgaggaccggaagccggcggtggttggccatgaggtctctccctaccagcagtgctcttacacccagggagccatgaacgggataaatgttctgtagtggtgtcggaatcctgtcgacgccttatgccatcaagcaagggggctggctcggactggtgatactagtagtatttgctctgctcgcatggtacaccggtgtgctgctgcgccgttgcctggacagcaagggagggcctccagacatacccggatatcggccatgccgcctttggcaccaccggtcgcatagccatctcgataatcctgtacgtggaactgtatgcctgctgcatcgagtacttgatactggaaagcgacaatttatccaagttgttcccaaatgtgcacctgagcattgggggcttgacgataaactcgcacgtgttcttcgcaatcttgacgacgctcgtcgtcatgccgaccacttggctccgtgacctcacctgcctgagctatatttcagctggaggtgtggttgcatcaatccttgtggtcatctgcttatgctggattggggttgtcgacaatgtcggctttgagaacaaagggaccgcgttaaacctcccgggaattcctatcgcgattggactgtatggttactgctactcggggcatggggtgttcccaaacatctactcttctctgaagaaccgcaaccagtttccctccattcttttcacctgcattgggttctctaccattttgtttactgccgctgcggtgatgggatacaaaatgttcggcgaatccaccgagtctcagttcaccctcaacttaccggagaatttggtggtttccaagattgccgtttgggctacggtggcaaatccgataaccaaatatgcattgaccataaccccactggccatgagtctggaagagttgctgccgcgaagccagcagaagtactccaacataatcattcttagatcagccctggtggtgtcaaccctcatcattgctctgtcagttcccttcttcgcgcttgtgatggctctgattggttctttgttcgcgatgcttgtgacctacattctaccttgtgcctgctttctggccatccttaaggcaaaagcgacttggtatcagactgcgacatgctcgttcatcatcgccgtaggggttacctgcgcctgcgtggggacatactcatccctctccgggattgtccagaactacgcctcctgactctgaagtatctccatccctacatacatcagagagatgattgctcgttcgaccgcattgttatacatataattaagcatatgtatgtatgagcgagagcggaggattcaaattttgccgaacaatgagttatgtccatcgatatttaaatgttgtatgattaa

SEQ ID NO: 6261 - DNA, 2386 bp, Oryza sativa
ccgctccgttttctgtgtttactgtgcaagttgggaacacctatgtgcgaacacagccttaatcatgcacttgttgtctactccaatcgtatagtatgcatgtgtggagtcatccaatggttccttctcccttgcatcagctggggctaaaagtgtgtgtgcgacagtgagagagagagagagagagagaggagaactaatttaatcctaatcaggtcttggcattatctctaacattgatcagtacacacagctcttgttcttgtactgctactaatcttgtataggaggaggactgcagttgcagacttgcagagcccaagagaggagaggagattccaagagaagagatgagatcccacgagatgaacaactcttcttctcgttatgcgtcagaggaggagcgcggcagcaacagcttcctcatcgagagcgaggaggaggaggaggacgaggaagcccacccccactcctccatcctcctcaaggatgccgactccgactccgactccgacgactcctcctgcgctaccccgcgcccaagctcctacgccacccaccaatggccgcaaagctacaggcaatcaatcgacatttatagtagcgtgcagtctcccaacctgagctttttgggaactccaactctaagcaggctctccaactcattcctcaccaactcttttcgtggcaaaacccctgaaattctctctaatcttgtcaagccacttctacgcccatcatcttcaagcgacgaccagcagcagcagcagcagcatgacgatgatacccgtaagagttcccagtacctgcttccctcaagaaaaccgtctttgcaacagatcccggaggatcaaaaaccattggtgccggctcatgaggtgccggcttatcaacaatgctcctacacccaggcagtgatgaatggaataaatgttctgtgtggtgtggggatcctatcgactccatatgccattaaacagggaggctggcttggactggtgatactttgcttatttgctgtgctcgcttggtacaccggagtgctccttcgacgttgtctggacagcaaggagggtcttgagacataccctgatattggtcatgccgcctttggcaccactggacgtatagcaatctcgataatcctgtacatcgaactgtatgcctgttgcattgagtatttgatattggagagcgacaatttgtcaaagttattccccaatgcacatctaaccattgggagcatgacactaaactctcatgtgttcttcgcaatcttgaccaccctcatagtcatgccaaccacttggctccgcgaccttagctgtctgagttatctttcagctgggggtgtcattgcatcaatccttgtagttgtctgcctatgctgggttggggttgttgaccatgttggttttgagaacaaagggactgcactgaatctcccaggaattcccatcgcaattggactgtatggttattgctactcaggacatggtgtgttcccgaacatctattcttctctgaagaatcgcaaccagtttccttctattcttttcacttgtattgggttgtcctcaattttgtttgccggtgctgctgtgatgggatataagatgtttggtgagtccactgaatctcagttcacgctgaacttaccagagaatttggtggtttcaaaggttgctgtctggaccacggtggcaaatccaataaccaaatatgcattgaccataaccccattggctatgagtttggaagaattgctgcctccaaatcagcagaagtatgcgaacataatcatgcttagatcctccctggtggtctcaaccctcctcattgctctatctgtccccttctttgggctagttatggcgttggttggttctttactcaccatgcttgtgacctacatccttccatgcgcctgtttcttggccatccttaagagaaaagtgacttggcatcagattgcagcttgctcattcatcatcgtggtaggggtttgctgcgcttgcgtggggacatactcatccctctccaagattatccagaactacacctgacctgagtggccagctgaggaacggagcactagctgcttatgtagtaataagaaaataattaatcatccttctatagccctgcacataccggaacaaagttttgcccgggaactggagtcgacttgatcaattatatatgtataatataattagtttggatcgtttgtttaatttgtggcaactccaggcatgttaatgtataattaacgataaaaacaccacagtaccacatagtggagttttgttaatgataaaaataaataatgctatacatggtgtatgatcgatattacagaccaatataaatcgagttgttgcca

SEQ ID NO: 6262 - DNA, 711 bp, Brachypodium distachyon
taggctcgctggacttgcgtgtatgttctccacgagcattctcttgcaaatcttggcatgtgctttgtacaacaattggtggcctatgttagcagcactcatgtatatcctcgttccaatgccatgcctattctttggtgatggatccacacggttcttgactactggagagggtggagcgtggatcaatgctgcaaagtttctgaccggagcgtctgccatgggcagcctcgctatcccagcaatcctgaggcatgctggcctgatcgagaccggggccatgttcatcgagttcacgtccttcttcattcttgtgtgcacggtgatgtgcttccacagggctaccctggacgaagattggtgaaaggtgcaagacagccaaggagtacccaagaagaagagcagtgccggtgtcgcttcgccttctctcttgacacctgaaaagaattcccttggtgggagctaacatggaactgtgtacaaagaagcatgtttcaagtgcatgactactatatggagtataaatgtagttaagatcctgcagtcaagtggcaatgccattattttacttccacttcttcatgtcaagtttttctgtgtgttatccatggcgaactgccgttgtaaaacatgacctggtgcactgattgacaccgtttttattaggttggtcgtcacttctatatattttctggattcatatttgcattt

SEQ ID NO: 6263 - DNA, 405 bp, Brachypodium distachyon
gctcgctggacttgcgtgtatgttctccacgagcattctcttgcaaatcttggcatgtgctttgtacaacaattggtggcctatgttagcagcactcatgtatatcctcgttccaatgccatgcctattctttggtgatggatccacacggttcttgactactggagagggtggagcgtggatcaatgctgcaaagtttctgaccggagcgtctgccatgggcagcctcgctatcccagcaatcctgaggcatgctggcctgatcgagaccggggccatgttcatcgagttcacgtccttcttcattcttgtgtgcacggtgatgtgcttccacagggctaccctggacgaagattggtgaaaggtgcaagacagccaaggagtacccaagaagaagagcagtgc

SEQ ID NO: 6264 - DNA, 926 bp, Sorghum bicolor
aaaaaaaggtctcgagtctcccctgtcccctccctccctacgctcgctgtagaggaaaggcgaagatggcgatgaccgtcgaaggcttgctggactcgcgttcatgttctccacgagtattctgctgcagatactggcatgtgctttgtacaacaactggtggcccatgttagcagctctcatgtatgtccttgtaccaatgccatgcctgttttttggtggtggatccacacacttcttgactagcagagaaggtggagggtggatgaatgctgcaaaattcctgactggtgcgtccgccatgggaagccttgctattccagcaattctgaggcatgctggcctaatcgaaacgggggcaatgttcatcgagttcacgtccttcttcatccttgtatgcacggtgctgtgcttccatagggctaccctggatgaagactggtaaatgcgcatgcacggaaccccctaaacctgaagattagccattctgtggccacttttctccatgctaagaaaactcctgacatggatctgtatgtacaaagaagcaaatttcgagcttacgtagctgatgttttatgtatacacttgttaagattctgtagtcatgtggcaatgcagattgcgttacgatcactctgataatttattgtcgtcgaatgttctgtggtgaaggaaccatccgtgtaaaacatgaccgagagcagataccctacttggctacttatgtcgtgggctttgcgttaacctattatggatgaagtgatgaactgatgattggatcttgatggcgatattttgtttgtatttggagtgtcgatttgaaaagtaaaagactcaattgtgaagcaagcctcaaattacatatttgaaggatatgaaacttgtggtttctgatacatctaggtaactaggtgctattgttt

SEQ ID NO: 6265 - DNA, 692 bp, Triticum aestivum
agtgcttgctggactcgcgttcatgttctccacgagtattctgctgcagatactggcatgtgctttgtacaacaactggtggcccatgttagcagctctcatgtatgtccttgtaccaatgccatgcctgttttttggtggtggatccacacacttcttgactagcagagaaggtggagggtggatgaatgctgcaaaattcctgactggtgcgtccgccatgggaagccttgctattccagcaattctgaggcatgctggcctaatcgaaacgggggcaatgttcatcgagttcacgtccttcttcatccttgtatgcacggtgctgtgcttccatagggctaccctggatgaagactggtaaatgcgcatgcacggaaccccctaaacctgaagattagccattctgtggccacttttctccatgctaagaaaactcctgacatggatctgtatgtacaaagaagcaaatttcgagcttacgtagctgatgttttatgtatacacttgttaagattctgtagtcatgtggcaatgcagattgcgttacgatcactctgataatttattggcgtcgaatgttctgtggtgaaggaaccatccgtgtaaaacatgaccgagagcagataccctacttggctacttatgtcgtgggctttgcgttaacctattatggatgaagtgatgaactg

SEQ ID NO: 6266 - protein, 377 aa, Arabidopsis lyrata
MACSNLTTMWVSSKPSLSADSSSLSFRSVLKCPVPLPNHTSSPPSRSSSVSPLQASLRELRDRIDSVKNTQKITEAMKLVAAAKVRRAQEAVVNGRPFSETLVEVLYNINEQLQTDDVDVPLTKVRPVKKVALVVVTGDRGLCGGFNNFIIKKAEARIKELKGLGLDYTVISVGKKGNSYFLRRPYIPVDRYLEAGTLPTAKEAQAVADDVFSLFISEEVDKVELLYTKFVSLVKSEPVIHTLLPLSPKGEICDINGTCVDAAEDELFRLTTKGGKLTVERETFRTPTADFSPILQFEQDPVQILDALLPLYLNSQILRALQESLASELAARMSAMSSASDNASDLKKSLSMVYNRKRQAKITGEILEIVAGANAQV

SEQ ID NO: 6267 - protein, 374 aa, Unknown
  Sequence found in Organisms: Thellungiella halophila, Eutrema halophilum
MACTNLTTMWVSSKPSLSDSSSLSFRSVLNPLPLPNHNSSPSRSSSVSPIQSSLRELRDRIDSVKNTQKITEAMKLVAAAKVRRAQEAVVNGRPFSETLVEVLYNINEQLQTDDIDVPLTKVRPVKKVALVVVTGDRGLCGGFNNFIIKKAEARIKELKGLGLDYTVISVGKKGNSYFLRRPYIPVDKYLEAGTLPTAKEAQAVADDVFSLFISEEVDKVELLYTKFVSLVKSEPVIHTLLPLSPKGEICDINGNCVDAAEDELFRLTTKEGKLTVERETFRTATADFSPILQFEQDPVQILDALLPLYLNSQILRALQESLASELAARMSAMSSASDNASDLKKSLSMVYNRKRQAKITGEILEIVAGANAQA

SEQ ID NO: 6268 - protein, 374 aa, Brassica juncea
MACTNLTTMWVSSKPSLSDSSSLSFRSVLNPLPLPNHNTSPSRSSSVSPIQSSLRELRDRIDSVKNTQKITEAMKLVAAAKVRRAQEAVVNGRPFSETLVEVLYNINEQLQTDDIDVPLTKIRPVKKVALVVVTGDRGLCGGFNNFIIKKAEARIKELQGLGLDYTVISVGKKGNSYFLRRPYIPVDKYLEAGTLPTAKEAQAVADDVFSLFISEEVDKVELLYTKFVSLVKSEPVIHTLLPLSPKGEICDINGNCVDAAEDELFRLTTKEGKLTVERETFRTPTADFSPILQFEQDPVQILDALLPLYLNSQILRALQESLASELAARMSAMSSASDNASDLKKSLSMVYNRKRQAKITGEILEIVAGANAQA

SEQ ID NO: 6269 - protein, 374 aa, Eutrema parvulum
MACTNLTTMWVSSKPSLSDSSSLSFRSVLNPLPLPNHNSSPSRSSSVSPIQSSLRELRDRIDSVKNTQKITEAMKLVAAAKVRRAQEAVVNGRPFSETLVEVLYNINEQLQTDDIDVPLTKIRPVKKVALVVVTGDRGLCGGFNNFIIKKAEARIRELKGLGLDYTVISVGKKGNTYFLRRPYIPVDKYLEAGTLPTAKEAQAVADDVFSLFISEEVDKVELLYTKFVSLVKSEPVIHTLLPLSPKGEICDINGTCVDAAEDELFRLTTKEGKLTVERETFRTPTADFSPILQFEQDPVQILDALLPLYLNSQILRALQESLASELAARMSAMSSASENASDLKKSLSMVYNRKRQAKITGEILEIVAGANAQA

SEQ ID NO: 6270 - protein, 374 aa, Unknown
  Sequence found in Organisms: Brassica napus, Brassica oleracea, Brassica rapa
MACTNLTTMYLSSKPSLSDSSSLSFRSVLNPLPLPNHNSSPSRSSSVSPIQSSLRELRDRIDSVKNTQKITEAMKLVAAAKVRRAQEAVVNGRPFSETLVEVLYNINEQLQTDDIDVPLTKIRPVKKVALVVVTGDRGLCGGFNNFIIKKAEARIKELQGLGLDYTVISVGKKGNSYFLRRPYIPVDKYLEAGTLPTAKEAQAVADDVFSLFISEEVDKVELLYTKFVSLVKSEPVIHTLLPLSPKGEICDINGNCVDAAEDELFRLTTKEGKLTVERETFRTPTADFSPILQFEQDPVQILDALLPLYLNSQILRALQESLASELAARMSAMSSASDNASDLKKSLSMVYNRKRQAKITGEILEIVAGANAQA

SEQ ID NO: 6271 - protein, 375 aa, Brassica juncea
MACTNLTTMWGVSSNPSLSDSSSLSFRSVLNPLPLPNHNSSPSRSSSVAPIQSSLRELRDRIDSVKNTQKITEAMKLVAAAKVRRAQEAVVNGRPFSETLVEVLYNINEQLQTDDIDVPLTKIRPVKKVALVVVTGDRGLCGGFNNFIIKKAEARIKELQGLGLDYTVISVGKKGNSYFLRRPYIPVDKYLEAGTLPTAKEAQAVADDVFSLFISEEVDKVELLYTKFVSLVKSEPVIHTLLPLSPKGEICDINGNCVDAAEDELFRLTTKEGKLTVERETFRTPTADFSPILQFEQDPVQILDALLPLYLNSQILRALQESLASELAARMSAMSSASDNASDLKKSLSMVYNRKRQAKITGEILEIVAGANAQA

SEQ ID NO: 6272 - protein, 374 aa, Brassica rapa
MACTNLTTMWVSSKLSVSDSSSLSFRSILNPLPLPNHNSSPSRSSSVSPIQSSLRELRDRIDSVKNTQKITEAMKLVAAAKVRRAQEAVVNGRPFSETLVEVLYNINEQLQTDDIDVPLTKIRPVKKVALVVVTGDRGLCGGFNNFIIKKAEARIKELQGLGLDYTVISVGKKGNSYFLRRPYIPVDKYLEAGTLPTAKEAQAVADDVFSLFISEEVDKVELLYTKFVSLVKSEPVIHTLLPLSPKGEICDINGNCVDAAEDELFRLTTKEGKLTVERETFRTPTADFSPILQFEQDPVQILDALLPLYLNSQILRALQESLASELAARMSAMSSASDNASDLKKSLSMVYNRKRQAKITGEILEIVAGANAQA

SEQ ID NO: 6273 - protein, 374 aa, Raphanus sativus
MACSNLTTMWVSSNPSLSDSSSLSFRSVLNPLPLPNHNSSPSRSSFVAPIQSSLRELRDRIDSVKNTQKITEAMKLVAAAKVRRAQEAVVNGRPFSETLVEVLYNINEQLQTDDIDVPLTKIRPVKKVALVVVTGDRGLCGGFNNFIIKKAEARIKELQGLGLDYTVISVGKKGNSYFLRRPYIPVDKYLEAGTLPTAKEAQAVADDVFSLFISEEVDKVELLYTKFVSLVRSEPVIHTLLPLSPKGEICDINGNCVDAAEDEFFRLTTKEGKLTVERETFRTATADFSPILQFEQDPVQILDALLPLYLNSQILRALQESLASELAARMSAMSSASDNASDLKKSLSMVYNRKRQAKITGEILEIVAGANAQA

SEQ ID NO: 6274 - protein, 113 aa, Brassica juncea
MACTNLTTMWVSSKPSLSDSSSLSFRSVLNPLPLPNHNTSPSRSSSVSPIQSSLRELRDRIDSVKNTQKITEAMKLVAAAKVREGSRSRRQRPTILRNPSRSPLQHQRTASNR

SEQ ID NO: 6275 - protein, 374 aa, Triticum aestivum
MACTNLTTMWVSSKLSVSDSSSLSFRSILNPLPLPNHNSSPSRSSSVSPIQSSLRELRDRIDSVKNTQKITEAMKLVAAAKVRRAQEAVVNGRPFSETLVEVLYNINEQLQTDDIDVPLTKIRPVKKVALVVVTGDRGLCGGFNNFIIKKAEARIKELQGLGLDYTVISVGKKGNSYFLRRPYIPVDKYLEAGTLPTAKEAQAVADDVFSLFISEEVDKVELLYTKFVSLVKSEPVIHTLLPLSPKGEICDINGNCVDAAEDELFRLTTKEGKLTVERETFRTPTADFSPILQFEQDPVQILDALLPLYLNSQILRALQESLASELAARMSAMSSASDNASDLKKSLSMVYNRKRQAKITGQILEIVAGANAQA

SEQ ID NO: 6276 - protein, 375 aa, Brassica rapa
MACTNLTTMWGVSSNPSLSDSSSLSFRSVLSPLPLPNHNISPSRSSSVAPIQSSLRELRDRIDSVKNTQKITEAMKLVAAAKVRRAQEAVVNGRPFSETLVEVLYNINEQLQTDDIDVPLTKIRPVKKVALVVVTGDRGLCGGFNNFIIKKAEARIKELQGLGLDYTVISVGKKGNSYFLRRPYIPVDKYLEAGTLPTAKEAQAVADDVFSLFISEEVDKVELLYTKFVSLVKSEPVIHTLLPLSPKGEICDINGNCVDAAEDELFRLTTKEGKLTVERETFRTPTADFSPILQFEQDPVQILDALLPLYLNSQILRALQESLASELAARMSAMSSASDNASDLKKSLSMVYNRKRQAKITGEILEIVAGANAQA

SEQ ID NO: 6277 - protein, 375 aa, Brassica napus
MACTNLTTMWGVSSNPSLSDSSSLSFRSVLNPLSLPNHNISPSRSSSVAPIQSSLRELRDRIDSVKNTQKITEAMKLVAAAKVRRAQEAVVNGRPFSETLVEVLYNINEQLQTDDIDVPLTKIRPVKKVALVVVTGDRGLCGGFNNFIIKKSEARIKELQGLGLDYTVISVGKKGNSYFLRRPYIPVDKYLEAGTLPTAKEAQAVADDVFSLFISEEVDKVELLYTKFVSLVKSEPVIHTLLPLSPKGEICDINGNCVDAAEDELFRLTTKEGKLTVERETFRTPTADFSPILQFEQDPVQILDALLPLYLNSQILRALQESLASELAARMSAMSSASDNASDLKKSLSMVYNRKRQAKITGEILEIVAGANAQV

SEQ ID NO: 6278 - protein, 160 aa, Brassica juncea
MACTNLTTMYLSSKPSLSDSSSLSFRSVLNPLPLPNHNSSPSRSSSVSPIQSSLRELRDRIDSVKNTQKITEAMKLVAAAKVRRAQEAVVNGRPFSETLVEVLYNINEQLQTDDIDVPLTKIRPVKKVALVVVTGDRGLCVGFNNFIIKKAEARIKELKG

SEQ ID NO: 6279 - protein, 203 aa, Brassica napus
MACTNLTTMWVSSKLSVSDSSSLSFRSILNPLPLPNHNSSPSRSSSVSPIQSSLRELRDRIDSVKNTQKITEAMKLVAAAKVRRAQEAVVNGRPFSETLVEVLYNINEQLQTDDIDVPLTKIRPVKKVALVVVTGDRGLCGGFNNFIIKKAEARIKELQGLGLDYTVISVGKRETLISSVVLTSPSTSTSKPEPYRPRKKLKL

SEQ ID NO: 6280 - protein, 360 aa, Brassica juncea
PSLSDSSSLSFRSVLNPLPLPNHNSSPSRSSSVAPIQSSLRELRDRIDSVKNTQKITEAMKLVAAAKVRRAQEAVVNGRPFSETLVEVLYNINEQLQTDDIDVPLTKIRPVKKVALVVVTGDRGLCGGFNNFIIKKAEARIKELQGLGLDYTVISVGKKGNSYFLRRPYIPVDKYLEAGTLPTAKEAQAVADDVFSLFISEEVDKVELLYTKFVSLVKSEPVIHTLLPLSPKGEICDINGNCVDAAEDELFRLTTKEGKLTVERETFRTPTADFSPILQFEQDPVQILDALLPLYLNSQILRALQESLASELAARMSAMSSASDNASDLKKSLSMVYNRKRQAKITGEILEIVAGANAQA

SEQ ID NO: 6281 - protein, 361 aa, Brassica juncea
KLSVSDSSSLSFRSILNPLPLPNHNSSPSRSSSVSPIQSSLRELRDRIDSVKNTQKITEAMKLVAAAKVRRAQEAVVNGRPFSETLVEVLYNINEQLQTDDIDVPLTKIRPVKKVALVVVTGDRGLCGGFNNFIIKKAEARIKELQGLGLDYTVISVGKKGNSYFLRRPYIPVDKYLEAGTLPTAKEAQAVADDVFSLFISEEVDKVELLYTKFVSLVKSEPVIHTLLPLSPKGEICDINGNCVDAAEDELFRLTTKEGKLTVERETFRTPTADFSPILQFEQDPVQILDALLPLYLNSQILRALQESLASELAARMSAMSSASDNASDLKKSLSMVYNRKRQAKITGEILEIVAGANAQA

SEQ ID NO: 6282 - protein, 512 aa, Brassica rapa
MACTNLTTMWVSSKLSVSDSSSLSFRSILNPLPLPNHNSSPSRSSSVSPIQSSLRELRDRIDSVKNTQKITEAMKLVAAAKVRRAQEAVVNGRPFSETLVEVLYNINEQLQTDDIDVPLTKIRPVKKVALVVVTGDRGLCGGFNNFIIKKAEARIKELQGLGLDYTVISVGKKGNSYFLRRPYIPVDKYLEAGTLPTAKEAQAVADDVFSLFISEEVDKVELLYTKFVSLVKSEPVIHTLLPLSPKGEICDINGNCVDAAEDELFRLTTKEGKLTVERETFRTPTADFSPILQFEQDPVQILDALLPLYLNSQILRALQESLASELAARMSAMSSASDNASDLKKSLSMVYNRKRQAKITGFDHRTLVSLDHRFASSSSLDTDRIAMAKNSFKLSNPLEVRMAESTRIREKYQDRVPVIVEKAGQSDVPDIDKKKYLVPADLTVGQFVYVVRKRIKLGAEKAIFVFVKNTLPPTAALMSAIYEEHKDEDGFLYMTYSGENTFGSASANIALP

SEQ ID NO: 6283 - protein, 251 aa, Brassica juncea
MACTNLTTMWGVSSNPSLSDSSSLSFRSVLNPLPLPNHNTSPSRSSSVAPIQSSLRELRDRIDSVKNTQKITEAMKLVAAAKVRRAQEAVVNGRPFSETLVEVLYNINEQLQTDDIDVPLTKIRPVKKVALVVVTGDRGLCGGFNNFIIKKAEARIKELKGLGLDYTVISVGKKGNTYFLRRPYIPVDKYLEAGTLPTAKEAQAVADDVFSLFYKRGSRQSGALVHKVCVIGQIRTRDPHATASITQRRDL

SEQ ID NO: 6284 - protein, 340 aa, Brassica juncea
PNHNSSPSRSSSVSPIQSSLRELRDRIDSVKNTQKITEAMKLVAAAKVRRAQEAVVNGRPFSETLVEVLYNINEQLQTDDIDVPLTKIRPVKKVALVVVTGDRGLCGGFNNFIIKKAEARIKELQGLGLDYTVISVGKKGNSYFLRRPYIPVDKYLEAGTLPTAKEAQAVADDVFSLFISEEVDKVELLYTKFVSLVKSEPVIHTLLPLSPKGEICDINGNCVDAAEDELFRLTTKEGKLTVERETFRTPTADFSPILQFEQDPVQILDALLPLYLNSQILRALQESLASELAARMSAMSSASDNASDLKKSLSMVYNRKRQAKITGEILEIVAGANAQA

SEQ ID NO: 6285 - protein, 377 aa, Humulus lupulus
MSCSNLTMWVSSKPSLSDASSLSSRSFLTPFQLPSQTSSPTPNPSRSSSVTPIHCNLRELRDRIGSVKNTQKITEAMKLVAAAKVRRAQEAVVNGRPFSETLVEVLYNINEQLQTDDVESPLTKVRPVKKVALVVVTGDRGLCGGFNNFLIKKAEARIAELKSLGLSYTIISVGKKGNSYFLRRPYIPVDKFLEGGNLPTAKEAQAIADDVFSLFVSEEVDKVELLYTKFVSLVKSNPVIHTLLPLSPKGEICDINGVCVDAAEDEFFRLTTKEGKLTVERDSVRTETIDFSPILQFEQDPVQILDALLPLYLNSQILRALQESLASELAARMSAMSNATDNASELKKSLSMVYNRKRQAKITGEILEIVAGANALS

SEQ ID NO: 6286 - protein, 374 aa, Quercus alba
MSCSNLTMWVSSKPSLSDASALSFRSFLNPFQVPSHNSTSCNPSRSVTPIHCGLRELRERIDSVKNTQKITEAMKLVAAAKVRRAQEAVVNGRPFSETLVEVLYNINEQLQTDDVDVPLTKVRPVKKVALVVVTGDRGLCGNFNNLLIKKAEARIAELKDLGLDYTVISVGKKGNSYFRRRPYIPVDKFLEGGSLPTAKEAQAIADDVFSFFVSEEVDKVELLYTKFVSLVKSSPVIHTLLPLSPKGEICDINGTCVDAAEDEFFRLTTREGKLTVERDVVRTKTVDFSPILQFEQDPVQILDALLPLYLNSQILRALQESLASELAARMSAMSSASDNASELKKSLSMVYNRQRQAKITGEILEIVAGANAQI

SEQ ID NO: 6287 - protein, 378 aa, Cleome spinosa
MSCSNLTMWVSSKPSLPDSSALSFRSVLSPLHHHLPNYSSNSNVSSRSSSVTPIQCGLRELRDRIDSVKNTQKITEAMKLVAAAKVRRAQEAVVNGRPFSETLVEVLYNINEQLQTDDIDVPLTKIRPVKKVALVVVTGDRGLCGGYNNAIIKKAEARIAELKGLGLDYTVISVGKKGNAYFIRRPYIPVDKFLEAGNLPTAKEAQAIADDVFSLFVSEEVDKVELLYTKFVSLVKSDPVIHTLLPLSPKGEICDINGNCVDAAEDELFRLTTKEGKLTVERETIRTATVDFSPILQFEQDPVQILDALLPLYLNSQILRALQESLASELAARMSAMSSASDNAVELKKTLSTVYNRQRQAKITGEILEIVAGANALV

SEQ ID NO: 6288 - protein, 376 aa, Cucurbita pepo
MSCSNLTMLVSSKSTVSDASSLSFRSVLSPFNLPSHNPTSSYPTRSWSVTPIHCGLRDLRDRIDSVKNTQKITEAMKLVAAAKVRRAQEAVVNGRPFSEALVEVLYNINEQLQTEDVDVPLTKVRPVKKVALVVVTGDRGLCGGFNNSIIKKAEARISELKELGLDYTVISVGKKGNSYFLRRPYIPVDKFLEGGTLPTAKEAQAIADDVFSLFISEEVDKVELLYTKFVSLVKSDPVIHTLLPLSPKGEICDINGVCVDAAEDEFFRLTTKEGKLTVERDTVRTSTSDFSPILEFEQDPVQILDALLPLYLNSQILRSLQESLASELAARMSAMSSASDNASELKRSLSMVYNRQRQAKITGEILEIVAGANALT

SEQ ID NO: 6289 - protein, 200 aa, Euonymus alatus
MSCSNLTMWVSSKPSLADPSSLSFRSSISQFQLPNHNSFPSSPSRSSSVTPIQCSLREIRDRIDSVKNTQKITEAMKLVAAAKVRRAQEAVVNGRPFSETLVEVLYNINEQLQTEDVDTPLTKVRPVKKVALVVCTGDRGLCGGFNNFIIKKAEARIAELKDLGLEYTVISVGKKGNTYFLRRPYIPVDKFLRGRVIANS

SEQ ID NO: 6290 - protein, 378 aa, Cannabis sativa
MSCSNLTMWVSSKPSLSEASTLSSRSFITPFQLPSQSSSPTPNPSSRSSSVTPIHCNLRELRDRIGSVKNTQKITEAMKLVAAAKVRRAQEAVVNGRPFSETLVEVLYNINEQLQTDDVESPLTKVRPVKKVALVVVTGDRGLCGGFNNFLIKKAEARIAELKSLGLSYTVISVGKKGNSYFLRRPYIPVDKFLEGGNLPTAKEAQAIADDVFSLFVSEEVDKVELLYTKFVSLVKSNPVIHTLLPLSPKGEICDINGVCVDAAEDEFFRLTTKEGKLTVERDSVRTETLDFSPILQFEQDPVQILDALLPLYLNSQILRALQESLASELAARMSAMSSATDNASELKKNLSMVYNRKRQAKITGEILEIVAGANALS

SEQ ID NO: 6291 - protein, 378 aa, Cleome gynandra
MSCTNLTMWVSPKPSLSDSSSLSFRSVLSPLQLPNYNSATGANGSSRSSSVMPVQCGLRELRDRIDSVKNTQKITEAMKLVAAAKVRRAQEAVVNGRPFSETLVEVLYNINEQLQTDDIDVPLTKIRPVKKVALVVVTGDRGLCGGFNNLIIKKAEARIRELKELGVEYTVISVGKKGNTYFIRRPYIPVDKFLEAGNLPTAKEAQAISDDVFSLFVSEEVDKVELLYTKFVSLVKSSPVIHTLLPLSPKGEICDINGNCVDAAEDEMFRLTTKEGKLTVERETVRTATADFSPILQFEQDPVQILDALLPLYLNSQILRALQESLASELAARMSAMSSATDNAVELKKTLSIVYNRQRQAKITGEILEIVAGANALI

SEQ ID NO: 6292 - protein, 376 aa, Citrullus lanatus
MSCSNLTMWVSSKPTVSDASSLSFRSFLSPFQLPSQNSSSTYPGRSCSVSPIHCGLRELRDRIDSVKNTQKITEAMKLVAAAKVRRAQEAVVNGRPFSEALVEVLYNINEQLQTEDVDVPLTKVRPVKKVALVVVTGDRGLCGGFNNSIIKKAEARISELKALGLDYTVISVGKKGNSYFLRRPYIPVDKFLEGGTLPTAKEAQAIADDVFSLFVSEEVDKVELLYTKFVSLVKSDPVIHTLLPLSPKGEICDINGVCVDAAEDEFFRLTTKEGKLTVERDSVRTSTSDFSPILEFEQDPVQILDALLPLYLNSQILRALQESLASELAARMSAMSNATDNASELKRTLSIVYNRQRQAKITGEILEIVAGANALT

SEQ ID NO: 6293 - protein, 373 aa, Cucumis sativus
MSCSNLTMWVSSKPTVSDASSLSFRSFLSPFQLPSQNSTPARSWSVTPIHCGLRELRDRIDSVKNTQKITEAMKLVAAAKVRRAQEAVVNGRPFSEALVEVLYNINEQLQTEDVDVPLTKVRPVKKVALVVVTGDRGLCGGFNNSIIKKAEARIKELKALGLDYTVISVGKKGNSYFLRRPYIPVDKFLEGGTLPTAKEAQAIADDVFSLFVSEEVDKVELLYTKFVSLVKSDPVIHTLLPLSPKGEICDINGVCVDAAEDEFFRLTTKEGKLTVERDSVRTSTSDFSPILEFEQDPVQILDALLPLYLNSQILRALQESLASELAARMSAMSNATDNASELKRTLSIVYNRQRQAKITGEILEIVAGANALT

SEQ ID NO: 6294 - protein, 378 aa, Cleome gynandra
MSCSNLTMWVSPKPSLSDSSALSFRSVLSPLQLFNYNSATGANSSSRSSSVTPVQCGLRELRDRIDSVKNTQKITEAMKLVAAAKVRRAQEAVVNARPFSETLVEVLYNINEQLQTDDIDVPLTNIRPVKKVALVVVTGDRGLCGGFNNAIIKKAEARIAELKDLGLEYTVISVGKKGNSYFGRRPYIPVDRFIEAGNLPTAKEAQAIADDVFSLFVSEEVDKVELLYTKFVSLVKSNPVIHTLLPLSPKGEICDINGNCVDAAEDELFRLTTKEGKLTVERETIRSSTADFSPILQFEQDPVQILDALLPLYLNSQILRALQESLASELAARMSAMSSATDNAVELKKTLSIVYNRQRQAKITGEILEIVAGANALV

SEQ ID NO: 6295 - protein, 374 aa, Castanea mollissima
MSCSNLTMWVSSKPSLSDASALSFRSFLNPFQVPSHNSTSCNPSRSVTPIHCGLRELRERIDSVKNTQKITEAMKLVAAAKVRRAQEAVVNGRPFSETLVEVLYNINEQLQTEDVDVPLTKVRPVKKVCLVVVTGDRGLCGNFNNQLIKKAEARMAELRGLGLDYTVISVGKKGNTYFRRRPYIPVDKFLEGGSLPTAKEAQAIADDVFSFFVSEEVDKVELLYTKFVSLVKSDPVIHTLLPLSPKGEICDINGTCVDAAEDEFFRLTTREGKLTVERDVVRTQTVDFSPILQFEQDPVQILDALLPLYLNSQILRALQESLASELAARMSAMSSASDNASELKKSLSLVYNRQRQAKITGEILEIVAGANAQI

SEQ ID NO: 6296 - protein, 371 aa, Cucumis melo
MACSNLAMWVSSKPSSSDSSALSFRPVNPLQVPSQGSASRSSSVSPIQCGLRELRERIDSVKNTQKITEAMKLVAAAKVRRAQEAVVNGRPFSESLVEVLYNINEQLQTEDIDVPLTKVRPVKKVALIVVTGDRGLCGSFNNMIIKKAESRIAELKTLGLDYTVISVGKKGNSYFSRRPYIPVDRFLEGGSLPTAKEAQAIADDVFSLFISEEVDKVELLYTKFVSLVKSDPVIHTLLPLSPKGEICDINGVCVDAAEDEFFRLTTKEGKLTVERDAVRTKTSDFSPILQFEQDPVQILDALLPLYLNSQILRSLQESLASELAARMSAMSNATDNASELKKTLSIVYNRQRQAKITGEILEIVAGANALT

SEQ ID NO: 6297 - protein, 375 aa, Phaseolus coccineus
MSCSNLTMLVSSKPSLSDPSNLSFRSVLNPFQLPSQNPTSCTPSRSSSTQVQCGLRELRTRIDSVKNTQKITEAMKLVAAAKVRRAQEAVVNARPFSETLVEVLYNINEQLQTEDVDIPLTKVRPVKKVALVVCTGDRGLCGGFNNAIIKKAEARIKELTALGLEYTVISVGKKGNSYFLRRPYIPVDRFLEGGSLPTAKEAQAIADDVFSLFVSEEVDKVELLYTKFVSLVKSDPVIHTLLPLSPKGEICDVNGVCIDAAEDEFFRLTTKEGKLTVERDVVRTKTPEFSAILQFEQDPVQILDALLPLYLNSQILRALQESLASELAARMSAMSNASDNASDLKKKLSTVYNRERQAKITGEILEIVAGANALQ

SEQ ID NO: 6298 - protein, 375 aa, Vigna unguiculata
MSCSNLTMLVSSKPSLSDPSNLSFRSVLNPFQLPSQNPTSCTPSRSSSTQVQCGLRELRTRIDSVKNTQKITEAMKLVAAAKVRRAQEAVVNARPFSETLVEVLYNINEQLQTEDVDIPLTKVRPVKKVALVVCTGDRGLCGGFNNAIIKKAESRIKELKELGLEYTVISVGKKGNTYFIRRPYIPVDRFLEGGSLPTAKEAQAIADDVFSLFVSEEVDKVELLYTKFVSLVKSDPVIHTLLPLSPKGEICDINGVCVDAAEDEFFRLTTKEGKLTVERDVVRTKTTDYSPILQFEQDPVQILDALLPLYLNSQILRALQESLASELAARMSAMSNATDNASDLKKKLSIVYNRERQAKITGEILEIVAGANALQ

SEQ ID NO: 6299 - protein, 375 aa, Glycine max
MSCSNLTMLVSSKPSLSDPSNLSFRSVLNPFQLPSQNPTSCTPSRSSTTQIQCGLRELRTRIDSVKNTQKITEAMKLVAAAKVRRAQEAVVNGRPFSETLVEVLYNINEQLLTEDVDIPLTKVRPVKKVALVVVTGDRGLCGGFNNAIIKKAEARIRELKELGLEFTVISVGKKGNSYFIRRPYIPVDRFLEGGTLPTAKEAQAIADDVFSLFVSEEVDKVELLYTKFVSLVKSDPVIHTLLPLSPKGEICDVNGVCVDAAEDEFFRLTTKEGKLTVERDVVRTKTADFSPILQFEQDPVQILDALLPLYLNSQVLRALQESLASELAARMSAMSNATDNAIELKKNLSIVYNRERQAKITGEILEIVAGANALQ

SEQ ID NO: 6300 - protein, 373 aa, Eucalyptus grandis
MSSSNLTMWASSKPSISDASPLSFRASVGSIFQLPSSGSPSRANPVAPIQCNLRELRDRIDSVKNTQKITEAMKLVAAAKVRRAQEAVVNGRPFSETLVEVLYNINEQLQIEDIDAPLTSVRPVKKVALVVVTGDRGLCGGFNNNIIKKAEARIAELKGLGLNYTVISVGKKGNSYFLRRPYIPVDKFLEGGTLPTAKEAQAIADDVFSLFVSEEVDKVELLYTKFVSLVKSDPVIHTLLPLSPKGEICDVNGNCVDAAEDEFFRLTTREGKLTVERDVVRTETIDFSPILQFEQDPVQILDALLPLYLNSQILRALQESLASELAARMSAMSNATDNASELKKSLSMVYNRRRQAKITGEILEIVAGANALT

SEQ ID NO: 6301 - protein, 371 aa, Cleome spinosa
MWVSPKPSLSDSSPLSFRSILSPLQLPSYNSATGVNSLSRSSSVTPVQCGLRELRDRIDSVKNTQKITEAMKLVAAAKVRRAQEAVVNGRPFSETLVEVLYNINEQLQTDDIDIPLTKIRPVKKVALVVVTGDRGLFGGFNNTIIKKAEARIAELKGLGLEYTVISVGKKGNSYFIRRPYIPVDKFLEAGNLPTAKEAQAIADDVFSLFVSEEVDKVELLYTKFVSLVKSDPVIHTLLPLSPKGEICDINGNCVDAAEDELFRLTTKEGKLTVERETVRTATVDFSPILQFEQDPVQILDALLPLYLNSQILRALQESLASELAARMSAMSSATDNAMELKKTLSMVYNRQRQAKITGEILEIVAGANALV

SEQ ID NO: 6302 - protein, 377 aa, Solanum tuberosum
MSCSNLTMLVSSKPSLSDSSALSFRSAVSSFQLPNQNSSGPSNPSRSSSVIPVQCGLRDLRDRIDSVKNTQKITEAMKLVAAAKVRRAQEAVVGARPFSETLVEVLYNINEQLQTDDIDVPLTKVRPVKKVALVVVTGDRGLCGGFNNYIIKKAEARIRDLKALGLDYTIISVGKKGNSYFLRRPYIPVDKFLEGSSLPTAKDAQAIADDVFSLFVSEEVDKVELLYTKFVSLVKSEPVIHTLLPLSPKGEICDINGNCVDAAEDEFFRLTTKEGKLTVERDVMRTKTTDFSAILQFEQDPVQILDALLPLYLNSQILRALQESLASELASRMSAMSSASDNASELKKNLSRVYNRQRQAKITGEILEIVAGADALI

SEQ ID NO: 6303 - protein, 375 aa, Glycine max
MSCSNLTMLVSSKPSLSDPSNLSFRSVLNPFQLPTQNPASCTPSRSSSTQIQCGLRELRTRIESVKNTQKITEAMKLVAAAKVRRAQEAVVNGRPFSETLVEVLYNINEQLQTEDVDIPLTKVRPVKKVALVVITGDRGLCGGFNNAIIKKAEARIRELKELGLQFTVISVGKKGNSYFIRRPYIPVDKFLEGGTLPTAKEAQAIADDVFSLFVSEEVDKVELLYTKFVSLVKSDPVIHTLLPLSPKGEICDINGVCVDAAEDEFFRLTTKEGKLTVERDVVRTKTIDFSPILQFEQDPVQILDALLPLYLNSQVLRALQESLASELAARMSAMSNATDNAIELKKNLSIVYNRERQAKITGEILEIVAGANALQ

SEQ ID NO: 6304 - protein, 371 aa, Citrullus lanatus
MACSNFTMWVSSKPSSSDSSALSFGPFNPLQLPSQGSASRSSSVTPIQCGLRELRERIDSVKNTQKITEAMKLVAAAKVRRAQEAVVNGRPFSESLVEVLYNINEQLQTEDIDVPLTKVRPVKKVALIVVTGDRGLCGSFNNMIIKKAESRIAELKTLGLDYTVISVGKKGNSYFLRRPYIPVDRFLEGGSLPTAKEAQAIADDVFSLFISEEVDKVELLYTKFVSLVKSDPVIHTLLPLSPKGEICDINGVCVDAAEDEFFRLTTKEGKLTVERDAVRTKTSDFSPILQFEQDPVQILDALLPLYLNSQILRSLQESLASELAARMSAMSNATDNASELKKTLSIVYNRQRQAKITGEILEIVAGANALT

SEQ ID NO: 6305 - protein, 377 aa, Solanum phureja
MSCSNLTMLVSSKPSLSDSSALSFRSAVSSFQLPNHNSSGPSNPSRSSSVIPVQCGLRDLRDRIDSVKNTQKITEAMKLVAAAKVRRAQEAVVGARPFSETLVEVLYNINEQLQTDDIDVPLTKVRPVKKVALVVVTGDRGLCGGFNNYIIKKAEARIRDLKALGIDYTIISVGKKGNSYFLRRPYIPVDKFLEGSSLPTAKDAQAIADDVFSLFVSEEVDKVELLYTKFVSLVKSEPVIHTLLPLSPKGEICDINGNCVDAAEDEFFRLTTKEGKLTVERDVMRTKTTDFSAILQFEQDPVQILDALLPLYLNSQILRALQESLASELASRMSAMSSATDNASELKKNLSRVYNRQRQAKITGEILEIVAGADALV

SEQ ID NO: 6306 - protein, 372 aa, Vitis vinifera
MSCSNLTMWVSSKPSLSDSSLLSFRSSLNPFQLPSHNSPTASPSKSVIQCGLRELRERIDSVKNTQKITEAMKLVAAAKVRRAQEAVVNGRPFSETLVEVLYNINEQLQTDDIDVPLTKVRPVKKVALVVVTGDRGLCGGFNNAIIKKAESRIAELKDLGLDYTVISVGKKGNSYFLRRPYIPVDKFLEGGSLPTAKEAQTIADDVFSLFVSEEVDKVELLYTKFVSLVKADPVIHTLLPLSPKGEICDVNGKCVDAAEDEFFRLTTREGKLTVERDVIRTQTVEFSPILQFEQDPVQILDALLPLYLNSQILRALQESLASELAARMSAMSNATDNAVELKKNLSMVYNRQRQAKITGEILEIVAGADALV

SEQ ID NO: 6307 - protein, 371 aa, Cucumis sativus
MACSKLAMWVSSKPSSSDSSALSFRPVNPFRVPSHGSASRSSSVTPIQCGLRELRERIDSVKNTQKITEAMKLVAAAKVRRAQEAVVNGRPFSESLVEVLYNINEQLQTEDIDVPLTKVRPVKKVALIVVTGDRGLCGGFNNMIIKKAESRIAELKTLGLDYTIISVGKKGNSYFFRRPYIPVDRFLEGGSLPTAKEAQAIADDVFSLFISEEVDKVELLYTKFVSLVKSNPVIHTLLPLSPKGEICDINGVCVDAAEDEFFRLTTKEGKLTVERDAVRTKTSDFSPILQFEQDPVQILDALLPLYLNSQILRSLQESLASELAARMSAMSNATDNASELKKTLSIVYNRQRQAKITGEILEIIAGANALT

SEQ ID NO: 6308 - protein, 376 aa, Manihot esculenta
MSCSNLTMWMSSKPSLSDTSSLSFCSSLNPFQLPTHTSSSSNTPRSSSVTPIHCGLRELRSRIDSVKNTQKITEAMKLVAAAKVRRAQEAVVNGRPFSETLVEVLYNINEQLQTEDIDAPLTKIRPVKKVALVVCTGDRGLCGGFNNNIIKKAEARIAELKGLGLDYTVISVGKKGNSYFVRRPYIPVDRFLEGTTLPTAKEAQAIADDVFSLFVSEEVDKVELLYTKFVSLVKSDPVIHTLLPLSPKGEICDINGNCVDAAEDEFFRLTTREGKLTVERDVVRTQTADFSAILQFEQDPVQILDALLPLYLNSQILKALQESLASELAARMSAMSNATDNAVELKKNLSIVYNRQRQAKITGEILEIVAGADALV

SEQ ID NO: 6309 - protein, 376 aa, Gossypium hirsutum
MSCSNLTMWVSSKPSLSDTSSLSFRSFISPFQLPSQSSTPGNPSRSSSVTPVHCGLRELRDRIDSVKNTQKITEAMKLVAAAKVRRAQEAVVNGRPFSESLVEVLYNINEQLQTEDIDAPLTNVRPVKKVALVVVTGDRGLCGGFNNAIIKKAEARIAELKQLGLDYTIISVGKKGNSYFIRRPYIPVDRFLDGSSLPTAKEAQAIADDVFSLFVSEEVDKVELLYTKFVSLVKSDPVIHTLLPLSPKGEICDVNGVCVDAAEDEFFRLTTREGKLTVEREVMRTQTADFSPILQFEQDPVQILDALLPLYLNSQVLRALQESLASELAARMSAMSNATDNAQELKKTLSIVYNRQRQAKITGEILEIVAGANALV

SEQ ID NO: 6310 - protein, 375 aa, Arachis hypogaea
MSCSNLTMLVSSKPSLSDASNLSFRSVLNPFQLPSQNSPSCSPSRSSVTPIQCGLRELRTRIESVKNTQKITEAMKLVAAAKVRRAQEAVVNGRPFSETLVEVLYNINEQLQTEDIDVPLTKVRPVKKVALVVCTGDRGLCGGFNNNIIKKAEKRIAELKDLGLDYTIISVGKKGNSYFLRRPYIPVDRFLEGGTLPTAKEAQAIADDAFSLFISEEVDKVELLYTKFVSLVKSDPVIHTLLPLSPKGEICDINGNCVDAADDEFFRLTTKEGKLTVERDSVRTKTEDYSPILEFEQDPVQILDALLPLYLNSQVLRALQESLASELAARMSAMSSATDNAVELKKNLSIIYNRERQAKITGEILEIVAGANALQ

SEQ ID NO: 6311 - protein, 375 aa, Cajanus cajan
MSCSNLTMLVSSKPSLSDGSSLSFRSVLNPFQLPSQNPSTAPPRSSSAAPIQCGLRELRTRIESVKNTQKITEAMKLVAAAKVRRAQEAVVNARPFSETLVEVLYNINEQLQTEDIDIPLTKIRPVKKVALVVCTGDRGLCGGFNNNIIKKAEARIAELKKLGLEYTVISVGKKGNSYFIRRPYIPVDRFLEGGTLPTAKEAQAIADDVFSLFVSEEVDKVELLYTKFVSLVKSDPVIHTLLPLSPKGEICDVNGVCIDAAEDEFFRLTTKEGKLTVERDVVRTKTADFEAILQFEQDPVQILDALLPLYLNSQILRALQESLASELAARMSAMSNATDNATELKKNLSTVYNRERQAKITGEILEIVAGANALQ

SEQ ID NO: 6312 - protein, 376 aa, Tabernaemontana elegans
MSCSNITMWVSSKTSLSDSAALSFRSTLNPLQLPTNNQTTTNTSRSSPVTPIYCGLRELRERIGSVKNTQKITEAMKLVAAAKVRRAQEAVVNSRPFSETLVEVLYNINEQLQTDDVDVPLTKVRPVKKVALVVVTGDRGLCGAFNNNIIKKAERRIAELKDLGLEYTVISVGKKGNTYFIRRPYIPVDKFLDGSSLPTAKEAQAIADDVFSLFVSEEVDKVELLYTKFVSLVKSDPVIHTLLPLSPKGEICDINGVCVDAAEDEFFRLTTKEGKLTVERDVMRTKTAEFSPILQFEQDPVQILDALLPLYLNSQILRALQESLASELAARMSAMSNATDNAMELKKTLSIVYNRERQAKITGEILEIVAGANALV

SEQ ID NO: 6313 - protein, 377 aa, Solanum lycopersicum
MSCSNLTMLVSSKPSLSESSALSFRSAVSSFQLPNHNLSGPSNPSRSSSVIPVRCGLRDLRDRIDSVKNTQKITEAMKLVAAAKVRRAQEAVVGARPFSETLVEVLYNINEQLQTDDIDVPLTKVRPVKKVALVVVTGDRGLCGGFNNYIIKKAEARIRDLKALGLDYTIISVGKKGNSYFLRRPYIPVDKFLEGSNLPTAKDAQAIADDVFSFFVSEEVDKVELLYTKFVSLVKSEPVIHTLLPLSPKGEICDINGNCVDAAEDEFFRLTTKEGKLTVERDVMRTKTTDFSAILQFEQDPVQILDALLPLYLNSQILRALQESLASELASRMSAMSSATDNASELKKNLSRVYNRQRQAKITGEILEIVAGADALV

SEQ ID NO: 6314 - protein, 375 aa, Unknown
  Sequence found in Organisms: Theobroma cacao, Pteridium aquilinum
MSCSNLTMWVSSKPSLSDTSSLSFRSFISPFQLPSQSSAPNPSRSSSATQIHCGLRELRERIDSVKNTQKITEAMKLVAAAKVRRAQEAVVNGRPFSESLVEVLYNINEQLQTEDIDVPLTKVRPVKKVALVVVTGDRGLCGGFNNNIIKKAESRIAELKELGLDYTVISVGKKGNTYFLRRPYIPVDRFLEGTSLPTAKEAQAIADDVFSLFVSEEVDKVELLYTKFVSLVKSDPVIHTLLPLSPRGEICDINGVCVDAAEDEFFRLTTKEGKLTVERDVVRTETADFSPILQFEQDPVQILDALLPLYLNSQILRALQESLASELAARMSAMSNATDNAVELRRTLSIVYNRERQAKITGEILEIVAGANALV

SEQ ID NO: 6315 - protein, 379 aa, Catharanthus roseus
MSCSNLTMWVSSKPSLSDSSSPLSFRSLISNPLQLPTNNSTTTNPSSSRSSSSVVHCGLRELRDRIGSVKNTQKITEAMKLVAAAKVRRAQEAVVNSRPFSETLVEVLYNINEQLQTEDIDVPLTKVRPVKKVALVVVTGDRGLCGGFNNSIIKKAESRIAELKGLGLDYTVISVGKKGNSYFIRRPFIPVDKYLEGSSLPTAKEAQAIADDVFSLFVSEEVDKVELLYTKFVSLVKSDPVIHTLLPLSPKGEICDINGNCVDAAEDEFFRLTTKEGKLTVERDVVRTQTSDFSPILQFEQDPAQILDALLPLYLNSQILRALQESLASELAARMSAMSNATDNARELKKNLSRVYNRERQAKITGEILEIVAGANSLA

SEQ ID NO: 6316 - protein, 376 aa, Amsonia hubrichtii
MACSNLTMWVSSKPSLSDSSALSFRSLLNPLQLPANNSTTTNPSRSSSVTPIHCGLRELRERIGSVKNTQKITEAMKLVAAAKVRRAQEAVVNARPFSETLVEVLYNINEQLQTEDIDAPLTKVRPVKKVGLVVVTGDRGLCGGFNNAIIKKAERRIAELKNLGLQYTVISVGKKGNSYFIRRPYIPVDKFVEGSSLPTAKEAQTIADDVFSLFVSEEVDKVELLYTKFVSLVKSDPVIHTLLPLSPKGEICDINGNCVDAAEDEFFRLTTKEGKLTVERDVVRTKTAEFSPILQFEQDPVQILDALLPLYLNSQILRALQESLASELAARMSAMSNATDNAIELKKNLSRAYNRERQAKITGEILEIVAGADALV

SEQ ID NO: 6317 - protein, 374 aa, Triphysaria pusilla
MSCSNLTMFSSKPSLSDPSSSLSSRSFIAPFHLPNTKSPSSPPPSSSTQIQCSLRDLRDRIESVKNTQKITEAMKLVAAAKVRRAQEAVVNARPFSETLVGVLYNINEQLQTEDIDIPLTRVRPVKKVALVVVTGDRGLCGGFNNFILKKAEARIRELKALGISYTVISVGKKGNSYFLRRPHIPVDRYQEGSNLPTAKEAQAIADDVFSLFVSEEVDKVELLYTKFVSLVKSDPVIHTLLPLSPKGEICDINGTCVDAAEDEFFRLTTKGGKLTVERDVVRTSTADFSPILQFEQDPAQILDALLPLYLNSQILRSLQESLASELAARMSAMSSASDNASELKKNLSRVYNRKRQAKITGEILEIVAGANALT

SEQ ID NO: 6318 - protein, 377 aa, Capsicum annuum
MSCSNLTMLVSSKPSLSDSSALSFRSAVSPFQLPNHNSSGASNPSRSSSAATVRCGLRDLRDRIDSVKNTQKITEAMKLVAAAKVRRAQEAVVGARPFSETLVEVLYNINEQLQTDDIDVPLTKVRPVKKVALVVVTGDRGLCGGFNNYILKKAEARIKDLKALGLDYVVISVGKKGNSYFLRRPYIPVDKFLEGSNLPTAKDAQAIADDVFSLFVSEEVDKVELLYTKFVSLVKSEPIIHTLLPLSPKGEICDINGNCVDAAEDEFFRLTTKEGKLTVERDIMRTKTAEFSAILQFEQDPVQILDALLPLYLNSQILRALQESLASELASRMSAMSSATDNASELKKNLSRVYNRQRQAKITGEILEIVAGADALA

SEQ ID NO: 6319 - protein, 376 aa, Gossypium raimondii
MSCSNLTMWVSSKPSLSDTSSLSFRSFISPFQLPSQSSTPGNPSRSSSVTPVHCGLRELRDRIDSVKNTQKITEAMKLVAAAKVRRAQEAVVNGRPFSESLVEVLYNINEQLQTEDIDAPLTNVRPVKKVALVVVTGDRGLCGGFNNAILKKAEARIAELKQLGLDYTIISVGKKGNSYFIRRPYIPVDRFLDGSSLPTAKEAQAIADDVFSLFVSEEVDKVELLYTKFVSLVKSDPVIHTLLPLSPKGEICDVNGVCVDAAEDEFFRLTTREGKLTVEREVMRTETADFSPILQFEQDPVQILDALLPLYLNSQVLRALQESLASELAARMSAMSNATDNAQELKKTLSIVYNRQRQAKITGEILEIVAGANALA

SEQ ID NO: 6320 - protein, 376 aa, Gossypium hirsutum
MSCSNLTMWVSSKPSLSDTSSLSFRSFISPFQLPSQSSTSGNPSRSSSVTPVHCGLRELRDRIDSVKNTQKITEAMKLVAAAKVRRAQEAVVNGRPFSESLVEVLYNINEQLQTEDIDAPLTNVRPVKKVALVVVTGDRGLCGGFNNAILKKAEARIAELKQLGLDYTIISVGKKGNSYFIRRPYIPVDRFLDGSSLPTAKEAQAIADDVFSLFVSEEVDKVELLYTKFVSLVKSDPVIHTLLPLSPKGEICDVNGVCVDAAEDEFFRLTTREGKLTVEREVMRTETADFSPILQFEQDPVQILDALLPLYLNSQVLRALQESLASELAARMSAMSNATDNAQELKKTLSIVYNRQRQAKITGEILEIVAGANALA

SEQ ID NO: 6321 - protein, 375 aa, Populus trichocarpa
MSCSNLTMLVSSKPSLSDTTSLSFRSSLNPFQLPSSPAANNPSRSTSVTPIHCGLRELRTRIQSVKNTQKITEAMKLVAAAKVRRAQEAVVNGRPFSETLVEVLYNINEQLQTDDVDAPLTKVRPVKKVALVVVTGDRGLCGGFNNYLIKKAEARIADLKQLGIDYTIISVGKKGNTYFLRRPYIPVDRFLEKGGLPTAKEAQAIADDVFSLFVSEEVDKVELLYTKFVSLVKSEPVIHTLLPLSPKGEICDVNGVCVDAAEDEFFRLTTREGKLTVERGVSRTATTDFSPILQFEQDPVQILDALLPLYLNSQILKALQESLASELAARMSAMSNATDNASELKKSLSMVYNRQRQAKITGEILEIVAGADALT

SEQ ID NO: 6322 - protein, 273 aa, Euphorbia peplus
MSCSNLTMWVSSKSPLSDASSLSFCSSLSPFQLPSGSPSTNPSRSSSVTPIHSSLRELRNRIASVKNTQKITEAMKLVAAAKVRRAQEAVVNGRPFSETLVEVLYNINEQLQVEDVDAPLTKVRPVKKVALVVITGDRGLCGGYNNYIIKKAEARIKELKGLGVAYTIISVGKKGNSYFNRRPYIPVDRFIEGTNLPTAKEAQAIADDVFSLFVSEEVDKVELLYTKFVSLVKSSPVIHTLLPLSPKGEICDINGNCVDAAEDEFFRLHNKRR

SEQ ID NO: 6323 - protein, 371 aa, Lippia dulcis
MSSSNLTMWVSSKPSLSDRSFIAPFQLPSSSSSTASRSSSSSSPTQIQCSLRDLRERIDSVKNTQKITEAMKLVAAAKVRRAQEAVVNARPFSETLVEVLYNINEQLQTDDIDIPLTKVRPVKKVALVVVTGDRGLCGGFNNQIIKKAEARMRELKELGLTYTVISVGRKGNSYFQRRPYIPVDKFLEGSSLPTAKEAQAIADDVFSLFVSEEVDKVELLYTKFVSLVKSDPLIHTLLPLSPKGEICDINGVCVDAAEDEFFRLTTKEGKLTVERDTMRTATVDFSPILQFEQDPVQILDALLPLYLNSQILRALQESLASELAARMSAMSTASDNADELKKTLSIIYNRQRQAKITGEILEIVAGANAMS

SEQ ID NO: 6324 - protein, 380 aa, Vinca minor
MSCSNLTMWVSSKSSLSDSSPLSFRSSLNPLQLPTTTNNNNNSTNPSRSSSSVSPIHCGLRELRERIGSVKNTQKITEAMKLVSAAKVRRAQEAVVNARPFSETLVEVLYNINEQVQAEDIDVPLTKVRPVKKVALVVVTGDRGLCGGFNNYIIKKAERRIKELKTLGLEYTVISVGKKGNSYFKRRPYIPVDKFLEGTSLPTAKEAQAIADDVFSLFVSEEVDKVELLYTKFVSLVKSDPVIHTLLPLSPKGEICDINGICVDAAEDEFFRLTTKEGKLTVERDVMRTKTADFSPILQFEQDPAQILDALLPLYLNSQILRALQESLASELAARMTAMSNATDNAIELKKNLSMAYNRQRQAKITGEILEIIAGADALV

SEQ ID NO: 6325 - protein, 376 aa, Ricinus communis
MSCSNLTMWVSSKPSLSDTSSLSFCSSLNPFQLPTHSSGSNSPSRSSSATPIHCNLRDLRTRIDSVKNTQKITEAMKLVAAAKVRRAQEAVVNGRPFSETLVEVLYNINEQLQTEDIDVPLTKNRPVKKVALVVVTGDRGLCGGFNNNIIKKAESRIAELKDLGVDYTIISVGKKGNSYFIRRPYIPVDRFLEGTNLPTAKEAQAIADDVFSLFVSEEVDKVELLYTKFVSLVKSDPVIHTLLPLSPEGEICDINGNCVDAAEDEFFRLTTKEGKLTVERDVVRTQTVDFSPILQFEQDPVQILDALLPLYLNSQILKALQESLASELAARMSAMSNASDNAAELKKTLSIVYNRARQAKITGEILEIVAGANALG

SEQ ID NO: 6326 - protein, 367 aa, Platanus occidentalis
MWVSSKPSLCDSSTLSFRSSLSPFRLPSHTSTTIIPSRSTNPIHCSLRDLRDRIDSVKNTQKITEAMKLVAAAKVRRAQEAVVNGRPFSETLVEVLYNINEQLQTEDVDVPLTSVRTVKKVALVVVTGDRGLCGGFNNAIIKKAEARIAELKDLGVEFTVISVGKKGNSYFLRRPYIPVDRFLEGGSLPTAKEAQAIADDVFSLFISEEVDKVELLYTKFVSLVKSDPVIHTLLPLSPKGEICDVNGNCVDAAEDELFRLTTKEGKLTVERDTVRTETIDFSPILQFEQDPVQILDALLPLYLNSQILRALQESLASELAARMSAMSNATDNANELKKTLSMAYNRQRQAKITGEILEIVAGADALV

SEQ ID NO: 6327 - protein, 376 aa, Prunus persica
MSCSNLTMWVSSKPALSDTSSLSCRSFISPFQLPSQNSLPASPSRSSSVSPIHCGLRELRERIDSVKNTQKITEAMKLVAAAKVRRAQEAVVNGRPFSETLVEVLYNINEQLQVEDIDAPLTNVRPVKKVALVVITGDRGLCGGFNNSIIKKAERRISELKALGLEYTIISVGKKGNSYFLRRPYIPVDKFLEGTNLPTAKEAQAIADDVFSLFVSEEVDKVELLYTKFVSLVKSDPVIHTLLPLSPKGEICDINGVCVDAADDEFFRLTTKEGKLTVERDVVRTTTVDFTPVLQFEQDPVQILDALLPLYLNSQILRALQESLASELAARMSAMSNATDNAVELKKNLSRVYNRQRQAKITGEILEIVSGANALV

SEQ ID NO: 6328 - protein, 377 aa, Nicotiana tabacum
MSCSNLTMLVSSKPSLSDSSALSFRSSVSPFQLPNHNTSGPSNPSRSSSVTPVHCGLRDLRDRIESVKNTQKITEAMKLVAAAKVRRAQEAVVGARPFSETLVEVLYNINEQLQTDDIDVPLTKVRPVKKVALVVVTGDRGLCGGFNNYLIKKAEARIRDLKALGIDYTIISVGKKGNSYFIRRPYIPVDKFLEGSNLPTAKDAQAIADDVFSLFVSEEVDKVELLYTKFVSLVKSEPVIHTLLPLSPKGEICDINGNCVDAADDEFFRLTTKEGKLTVERDIMRTKTTDFSPILQFEQDPVQILDALLPLYLNSQILRALQESLASELAARMSAMSAATDNATELKKNLSRAYNRQRQAKITGEILEIVAGADALV

SEQ ID NO: 6329 - protein, 376 aa, Tripterygium wilfordii
MSCSNLTMWISSKPSLSDPSSLSFRSSISQFQFPNQNLFPSSPSRPSSVTRIQCGLRELRVRIDSVKNTQKITEAMKLVAAAKVRRAQEAVVNGRPFSETLVEVLYNINEQLQTEDVDTPLTKIRPVKKVALVVVTGDRGLCGGFNNYIIKKAEARIAQLKDLGVDYTVISVGKKGNSYFIRRPYIPVDKFIEGGSLPTAKEAQAIADDVFSLFVSEEVDKVELLYTKFVSLVKSNPVIHTLLPLSPKGEICDLNGNCVDAADDEFFRLTTKEGKLTVEREAVRTQTDNFSPILQFEQDPVQILDALLPLYLNSQILRALQESLASELAARMTAMSNATDNAMELKKNLSLVYNRQRQAKITGEILEIVAGANALS

SEQ ID NO: 6330 - protein, 74 aa, Arachis hypogaea
MSCSNLTMLVSSKPSLSDASNLSFHSVINPFQLPSQNSPSCSLSRSSVTQYSVVSESSEPALNLSRTHRRSQKQ

SEQ ID NO: 6331 - protein, 376 aa, Coffea canephora
MSCSNLTMWVSSKTSLSDSTALSFRSSITPVQLPSNNSTTANPSRPSSVTPIHCGLRELRDRIGTVKNTQKITEAMKLVAAAKVRRAQEAVVNARPFSESLVEVLYNINEQLQTDDIDVPLTKVRPVKKVGLVVVTGDRGLCGGFNNAIIKKAEARIAELKGLGLDYTIISVGKKGNSYFIRRPYIPVDRFLDGTSLPTAKEAQAIADDVFSLFISEEVDKVELLYTKFVSLVKAEPVIHTLLPLSPKGEICDINGNCVDAAEDEFFRLTTKEGKLTVERDIMRTKTTEFSAILQFEQDPVQILDALLPLYLNSQILRSLQESLASELAARMTAMSNATDNAIELKKSLSIVYNRERQAKITGEILEIIAGANALT

SEQ ID NO: 6332 - protein, 373 aa, Papaver somniferum
MSCSNLTMLVSSKSSLSDPSALSFRSALNPFCLPTYNSTTPSSRSSSQISCNLRELRDRIGSVTNTQKITEAMKLVAAAKVRRAQEAVVSGRPFSETLVEVLYSLNEQLQNEDVDIPLTTVRPVKKVALVVVTGDRGLCGGFNNQLLKKAEARIAELKSLGLQYTIISVGKKGNTYFSRRPYIPVDKYLDGGNLPTTKEAQAIADDVFSLFISEEVDKVELLYTKFVSLVKSDPVIHTLLPLSPKGEICDINGTCVDAADDELFRLTTKEGKLTVERDVVRTKTIDFSPIIQFEQDPVQILDALLPLYLNSQILRALQESLASELAARMSAMSSASDNASDLKKALSTQFNRRRQAKITGEILEIVAGADALV

SEQ ID NO: 6333 - protein, 235 aa, Petunia hybrida
TVCQNHVLFKFNNVVSSKPALSDPSSLSFCSSINPFQLFNHNSSGPSNPSRSSSVVHCSLRDLRDRIDSVKNTQKITEAMKLVAAAKVRRAQEAVVGARPFSETLVEVLYNINEQLQTDDIDVPLTKVRPVKKVALVVVTGDRGLCGGFNNNILKKAEARIRDLKALGLDYTLISVGKKGNTYFSRRPYIPVDKFIEGSNLPTAKEAQAIADDVFSLFVSEEVDKVELLYTSLCL

SEQ ID NO: 6334 - protein, 376 aa, Arnica chamissonis
MSCSNLTMWVSSKPSLDSSSPLSSRSFITTVPIPTSNPSNSNYAISKSSSSIHCSLRDLRTRIDSVKNTQKITEAMKLVAAAKVRRAQEAVVNARPFSETLVEVLYSINEQLQTEDVDVPLTNVRPVKKVALVVVTGDRGLCGGFNNFILKKAEARIKELKTLGIDYVVISVGKKGNSYFLRRPYIPVDKFFDGSNLPTAKEAQAIADDVFSLFVSEEVDKVELLYTKFVSLVKSNPVIHTLLPLSPKGEICDINGVCVDAAEDEFFRLTTKEGKLTVERDVVRTETVDFSPILQFEQDPVQILDALLPLYLNSQILRALQESLASELAARMTAMGNATDNASELKKSLSQVYNRQRQAKITGEILEIVAGADALV

SEQ ID NO: 6335 - protein, 374 aa, Lactuca sativa
MSCSNLTMWVSSKPSSLDSSALSFRSFISPVQIPNSNPSISNSRPSSSSINCSLKELRGRIESVKNTQKITEAMKLVAAAKVRRAQEAVVNARPFSETLVEVLYSINEQLQVEDVDVPLTSVRPVKKVALVVVTGDRGLCGGFNNMILKKAEARIRELKTLGLEYVVISVGKKGNSYFSRRPYIPVDKFLDGSNLPTAKEAQAIADDVFSLFVSEEVDKVELLYTKFVSLVKSDPVIHTLLPLSPKGEICDINGVCVDAAEDEFFRLTTKEGKLTVERDVVRAETIDFSPILQFEQDPVQILDALLPLYLNSQILRALQESLASELAARMTAMGNATDNAVELKKNLSQVYNRRRQAKITGEILEIVAGADALV

SEQ ID NO: 6336 - protein, 373 aa, Papaver somniferum
MSCSNLTMLVSSKSSLSDPSALSFRSALNPFCLPTYNSTTPSSRSSSQISCNLRELRDRIGSVTNTQKITEAMKLVAAAKVRRAQEAVVSGRPFSETLVEVLYSLNEQLQNEDVDIPLTTVRPVKKVALVVVTGDRGLCGGFNNQLLKKAEARIAELKSLGLQYTIISVGKKGNTYFSRRPYIPVDKYLDGGNLPTTKEAQAIADDVFSLFISEEVDKVELLYTKFVSLVKSDPVIHTLLPLSPKGEICDVNGTCVDAADDELFRLTTKEGKLTVERDVVRTKTIDFSPIIQFEQDPVQILDALLPLYLNSQILRALQESLASELAARMSAMSSASDNASDLKKALSTQFNRRRQAKITGEILEIVAGADALV

SEQ ID NO: 6337 - protein, 373 aa, Papaver somniferum
MSCSNLTMLVSSKSSLSDPSALSFRSALNPFCIPTYNSTTPSSRSSSQISCNLRELRDRIGSVTNTQKITEAMKLVAAAKVRRAQEAVVSGRPFSETLVEVLYSLNEQLQNEDVDIPLTTVRPVKKVALVVVTGDRGLCGGFNNQLLKKAEARIAELKSLGLQYTIISVGKKGNTYFSRRPYIPVDKYLDGGNLPTTKEAQAIADDVFSLFISEEVDKVELLYTKFVSLVKSDPVIHTLLPLSPKGEICDVNGTCVDAADDELFRLTTKEGKLTVERDVVRTKTVDFSPIIQFEQDPVQILDALLPLYLNSQILRALQESLASELAARMSAMSSASDNASDLKKALSTQFNRRRQAKITGEILEIVAGADALV

SEQ ID NO: 6338 - protein, 332 aa, Brassica juncea
MCLSSKPSLSDSSSLSFRSVLNPLPLPNHNSSPSRSSSVSPIQSSLRELRDRIDSVKNTHKITEAMKLVAAAKVRRAQEAVVNGRPFSETLVEVLYNINEQLQTDDIDVPLTKIRPVKKVALVVVTGDRGLCGGFNNFIIKKAEARIKELQGLGLDYTVISVGKKGNSYFLRRPYIPVDKYLEAGTLPTAKEAQAVADDVFSLFISEEVDKVELLYTKFVSLVKSEPVIHTLLPLSPKGEICDINGNCVDAAEDELFRLTTKEGKLTVERETFRTPTADFSPILQFEQDPVQILDALLPLYLNSQILMALQESLASELAARMSAMSSASDNA

SEQ ID NO: 6339 - protein, 364 aa, Actinidia deliciosa
MSCSNLSMWVSSKPSLSDPSSRSYSSFHRHSRSSSVRPIQCGSLRELRNRIDSVKSTQKITEAMKLVAAAKVRRAQEAVVNGRPFSQTLVEVLYSINEQVQTEDIDIPLTKVRPVKKVALVVVTGDRGLCGGFNSAIIKKAEARIAELKDLGLEYTLISVGRKGNTYFLRRPYIPVEKFLEGGRLPTAKEAQAIADNVFSLFISEEVDKVELLYTKFVSLVKSDPVIHTLLPLSPKGEICDINGKCVDAAEDEFFRLTTKEGKLTVERDVVRTQTVDFSPILQFEQDPVQILDALLPLYLNSQILRALQESLASELAARMTAMSNATDNAVELRKTLSMVYNRQRQAKITGEILEIVAGADALS

SEQ ID NO: 6340 - protein, 374 aa, Aristolochia fimbriata
MSCANLTMWVSSSKPSLSDPNPLSSRSAITPFRLPSPPSSVPNRASPTQIQCGLRELRVRIDSVKNTQKITEAMKLVAAAKVRRAQEAVVNARPFSETLVEVLYNINEQLQTDDIDVPLTKVRPVKKVALVVVTGDRGLCGGFNNAILKKAESRIAELKQLGLEYTIISVGKKGNTYFLRRPYIPVDRFLEGGTLPTTKEAQAIADDVFSLFVSEEVDKVELLYTKFVSLVKSDPVIHTLLPLSPKGEVCDINGVCVDAAEDELFRLTTKEGKLTVERDTVRTPTPQFSAILQFEQDPVQILDALLPLYLNSQLLRALQESLASELAARMSAMSNATDNAMELKKNLSIAYNRQRQAKITGEILEIVAGAEALT

SEQ ID NO: 6341 - protein, 376 aa, Cicer arietinum
MSCSNVTMLVSSKPSLSDASNLSFRSAFNPFQLPSQNSSTCTPSKTSHTPSIQCGLRELRNRIDSVKNTQKITEAMKLVAAAKVRRAQEAVVNGRPFSETLVEVLYSINEQLQTEDVDSPLTKLRPVKKVALVVCTGDRGLCGGFNNNILKKAERRIAELKTLGLDYTVISVGKKGNSYFIRRPYIPVDRFLEGGTLPTAKEAQAIADDVFSLFVSEEVDKVELLYTKFVSLVKSDPIIHTLLPLSPKGEICDINGICVDAAEDELFRLTTKEGKLTVERDTVRTKTIDFSPILQFEQDPVQILDALLPLYLNSQILRALQESLASELAARMSAMSNATDNAVELKKNLSRVYNRERQAKITGEILEIVAGADALQ

SEQ ID NO: 6342 - protein, 376 aa, Gossypium hirsutum
MSCSNLTMWVSSKPSLSDTSSLSFRSFISPFQLPSQSSTPGNPSRSSSVTPVHCGLRELRDRIDSVKNTQKITEAMKLVAAAKVRRAQEAVVNGRPFSESLVEVLYNINEQLQTEDIDAPLTNVRPVKKVALVVVTGDRGLCGGFNNAIIKKAEARIAELKQLGLDYTIISVGKKGNSYFIRRPYIPVDKFLDGSSLPTAKEAQAIADDVFSLFVSEEVDKVELLYTKFVSLVKSDPVIHTLLPLSPKGEICDVNGVCVDAAEDEFFRLTTREGKLTVEREVMRTQTADFFPILQFEQDPVQIFDALLPLYLNSQVLRALQESLASELAVRMSAMSNVTDNAQELKKTLFFVYNRQGQGKIPGEILEIVAGANALV

SEQ ID NO: 6343 - protein, 375 aa, Mimulus guttatus
MSCSNLTMLVSSKPSLSDPSTLSSRSFLSPFHLPNSATSSPTPSRPSSTQINCGLRELRERIVSVTNTKKITEAMKLVAAAKVRRAQEAVVNARPFSETLVEVLYNINEQLQIEDVDIPLTKIRPVKKVALVVITGDRGLCGGYNNYIIKKAEARIKELKQLGLEYTVISVGKKGNTYFTRRPYIPVDKFIEGSNLPTAKEAQAIADDVFSLFVSEECDKVELLYTKFVSLVKSNPVIHTLLPLSPRGEICDINGICVDAADDEFFRLTTKEGKLTVERDVVRTKTTDFSPILQFEQDPVQILDALLPLYLNSQILRALQESLASELAARMSAMSNATDNADELKKNLSRVYNRQRQAKITGEILEIVAGANALV

SEQ ID NO: 6344 - protein, 367 aa, Antirrhinum majus
MWVSSKPSLSDPSPLSSRSFIAPFHLPNSGSSTPSRSSTSTQIQCSLRDLRDRIDSVKNTQKITEAMKLVAAAKVRRAQEAVVNARPFSETLVGVLYNINEQLQTEDVDIPLTKVRPVKKVALVVVTGDRGLCGGFNNAILKKAEARIKELKALGLDYTVVSVGKKGNTYFTRRPYIPLDKIFEGTNLPTAKEAQAIADDVFSLFVSEEVDKVELLYTKFVSLVKSDPVIHTLLPLSPKGEICDINGTCVDAAEDEFFRLTTKEGKLTLERDSVRTETSDFSPILQFEQDPVQILDALLPLYLNSQILRSLQESLASELAARMSAMSNASDNAVELKKNLSRVYNRQRQAKITGEILEIVAGANAMV

SEQ ID NO: 6345 - protein, 374 aa, Malus domestica
MSCSNLTMWASSKPSLSDASALSCRSFIAPLQLPSQNSLPASRSSSVTPVQCGLRELRERISSVKNTQKITEAMKLVAAAKVRRAQEAVVNGRPFSETLVEVLYNINEQLQVEDIDAPLTKVRPVKKVALVVITGDRGLCGGFNNMIIKKAERRISELKALGLEFTIISVGKKGNSYFLRRPYIPVDKFLEGTNLPTAKEAQAIADDVFSLFVSEEVDKVELLYTKFVSLVKSDPVIHTLLPLSPKGEICDINGVCVDAVDDEFFRLTTKEGKLTVERDVIKTQTVDFTPVLQFEQDPVQILDALLPLYLNSQILRALQESLASELAARMTAMSNATDNAVELKKTLSQTYNRQRQAKITGEILEIVSGANALV

SEQ ID NO: 6346 - protein, 371 aa, Utricularia gibba
MAASNLTMWVSSKPEASSLSSRSFLAPLPLHITGAGVAASPSRSTLIQCGLRELRDRIDSVKNTQKITEAMKLVAAAKVRRAQEAVVNARPFSETLVEVLYNINEQLGTEDIDVPLTKVRPVKKVALVVVTGDRGLCGGFNNSIIKKAEARIRDLKALGLEYTVISVGKKGNSYFIRRPHIPVDRFLEGSNLPTAKEAQAIADDVFSLFVSEEVDKVELLYTKFVSLVKSDPVIHTLLPLSPRGEICDINGICVDAAEDEFFRLTTREGKLTVERDVMRTKTADFSPILQFEQDPVQILDALLPLYLNSQILRSLQESLASELAARMSAMSNATDNAVELRKNLSRVYNRARQAKITGEILEIVAGANALT

SEQ ID NO: 6347 - protein, 378 aa, Helianthus annuus
MSCSNLTMWVSSSKPSLDSSSPLSFRSFITPSPIPTSNSNYGTSSKSSSSSSSIQCSLRDLRTRIDSVKNTQKITEAMKLVAAAKVRRAQEAVVNARPFSETLVEVLYSINEQLQTEDVDVPLTNIRPVKKVALVVVTGDRGLCGGFNNFILKKAEARIKELKTLGLDYVVISVGKKGNSYFVRRPYIPVDKFLDGSNLPTAKEAQAIADDVFSLFVSEEVDKVELLYTKFVSLVKSDPVIHTLLPLSPKGEICDINGVCVDAAEDEFFRLTTKEGKLTVERDVVRADTMDFSPILQFEQDPVQILDALLPLYLNSQILRALQESLASELAARMTAMGNATDNASELKKNLSRVYNRQRQAKITGEILEIVAGADALA

SEQ ID NO: 6348 - protein, 374 aa, Helianthus annuus
MSCSNLTMLVSSKPSLDSSSPLSFRSFIAPVQIPSSNANNSISKPSSSSIHCSLRDLRTRIDSVKNTQKITEAMKLVAAAKVRRAQEAVVNARPFSETLVEVLYSINEQLQTEDVDVPLTNVRPVKKVALVVVTGDRGLCGGFNNFILKKAEARIRELKTLGLDYVVISVGKKGNSYFLRRPQIPVDKFLDGSNLPTAKEAQAIADDVFSLFVSEEVDKVELLYTKFVSLVKSDPVIHTLLPLSPKGEICDINGICVDAAEDEFFRLTTKEGKLTVERDVIRAETMDFSPILQFEQDPVQILDALLPLYLNSQILRALQESLASELAARMTAMGNATDNASELKKNLSRVYNRQRQAKITGEILEIVAGADALA

SEQ ID NO: 6349 - protein, 375 aa, Cynara scolymus
  misc_feature (2)..(2): Xaa can be any naturally occurring amino acid
  misc_feature (4)..(4): Xaa can be any naturally occurring amino acid
  misc_feature (113)..(113): Xaa can be any naturally occurring amino acid
MXCXNLTTMWVSSKPSTLDSSSLSFRSSFINPLQIPSSNPSNSSKSSSSSIHCSLRELRNRIDSVTNTKKITEAMKLVAAAKVRRAQEAVVNARPFSETLVEVLYSINEQLQXEDVDVPLTSVRPVKKVALVVITGDRGLCGGFNNAILKKAEARIRELKTLGLEFTVISVGKKGNTYFLRRPYIPLDKSLDGSNLPTAKEAQAIADDVFSLFVSEEVDKVELLYTKFVSLVKSDPVIHTLLPLSPKGEICDINGICVDAAEDEFFRLTTKEGKLTVERDVVRTETMDFSPILQFEQDPVQILDALLPLYLNSQILRALQESLASELAARMTAMGNATDNAVELKKNLSRVYNRQRQAKITGEILEIVAGADALV

SEQ ID NO: 6350 - protein, 374 aa, Tragopogon dubius
MSSSNLTMWVSSKPSLDSSSLSFRSFISPVQIPSTNPSNSNSNSRPSSSINCSLRELRGRIDSVTNTKKITEAMKLVAAAKVRRAQEAVVNARPFSETLVEVLYSINEQLQNEDVDVPLTSVRPVKKVALVVVTGDRGLCGGFNNAILKKAESRIRELKTLGLEFVVISVGKKGNSYFLRRPYIPVDKFVDGSNLPTAKEAQAIADDVFSLFVSEEVDKVELLYTKFVSLVKSNPVIHTLLPLSPKGEICDINGICVDAAEDEFFRLTTKEGKLTVERDVVRTVTADFSPILQFEQDPVQILDALLPLYLNSQILRALQESLASELAARMTAMGNATDNAIELKKNLSRVYNRRRQAKITGEILEIVAGADALV

SEQ ID NO: 6351 - protein, 378 aa, Helianthus annuus
MSCSILTMWVSSSKPSLDSSSPLSFRSFITPSPFPTSNSNYGTSSKSSSSSSSIQCSLRDLRTRIDSVKNTQKITEAMKLVAAAKVRRAQEAVVNARPFSETLVEVLYSINEQLQTEDVDVPLTNIRPVKKVALVVVTGDRGLCGGFNNFILKKAEARIKELKTLGLDYVVISVGKKGNSYFLRRPYIPVDKFLDGSNLPTAKEAQAIADDVFSLFVSEEVDKVELLYTKFVSLVKSDPVIHTLLPLSPKGEICDINGVCVDAAEDEFFRLTTKEGKLTVERDVVRADTMDFSPILQFEQDPVQILDALLPLYLNSQILRALQESLASELAARMTAMGNATDNASELKKNLSRVYNRQRQAKITGEILEIVAGADALA

SEQ ID NO: 6352 - protein, 374 aa, Malus domestica
MSCSNLTMWASSTPSLSDTSALSCRSFIAPLQLPSQNSLPASRSSSVTPVQCGLRELRERISSVKNTQKITEAMKLVAAAKVRRAQEAVVNGRPFSETLVEVLYNINEQLQVEDIDAPLTKVRPVKKVALVVITGDRGLCGGFNNMIIKKAERRIAELKALGLEFTIISVGKKGNSYFLRRPYIPVDKFLEGTNLPTAKEAQAIADDVFSLFVSEEVDKVELLYTKFVSLVKSDPVIHTLLPLSPKGEICDINGVCVDAADDEFFRLTTKEGKLTVERDIIKTQTVDFTPVLQFEQDPVQILDALLPLYLNSQLLRALQESLASELAARMTAMSNATDNAVELKKTLSQTYNRQRQAKITGEILEIVSGANALV

SEQ ID NO: 6353 - protein, 372 aa, Cichorium intybus
MSCSNLTMWVSSKPSIDSSPLSFRSFISPNQIPNSNPSNSNSRPSSSINCSLKELRGRIDSVKNTQKITEAMKLVAAAKVRRAQEAVVNARPFSETLVEVLYSINEQLQSEDVDVPLTSVRPVKKVALVVVTGDRGLCGGFNNAILKKAESRIRELKTLGLEYTIISVGKKGNTYFLRRPLIPVDKYLDGSNLPTAKEAQAIADDVFSLFVSEEVDKVELLYTKFVSLVKSDPVIHTLLPLSPKGEICDINGVCVDAAEDEFFRLTTKEGKLTVERDVVRTETIDFSPILQFEQDPVQILDALLPLYLNSQILRALQESLASELAARMTAMGNATDNAVELKKNLSQIYNRQRQAKITGEILEIVAGADALV

SEQ ID NO: 6354 - protein, 376 aa, Flaveria ramosissima
MSCSNLTMWVSSKPSLDSSSPLSFRSFITPVQIPTSNPSNSNYLISKSSTSIYCNLRELRTRIDSVKNTQKITEAMKLVAAAKVRRAQEAVVNARPFSETLVEVLYSINEQLQTEDVDVPLTNVRPVKKVALVVVTGDRGLCGGFNNFILKKAEARIKELKTLGLDYVVISVGKKGNSYFQRRPYIPVDKFLDGSNLPTAKEAQAIADDVFSLFVSEEVDKVELLYTKFVSLVKSDPVIHTLLPLSPKGEICDINGVCVDAAEDEFFRLTTKEGKLTVERDVVRAETMDFSPILQFEQDPVQILDALLPLYLNSQILRSLQESLASELAARMTAMGNATDNASELKKSLSRVYNRQRQAKITGEILEIVAGADALA

SEQ ID NO: 6355 - protein, 301 aa, Ambrosia trifida
MKLVAAAKVRRAQEAVVNARPFSETLVEVLYSINEQLQTEDVDVPLTNVRPVKKVALVVVTGDRGLCGGFNNFILKKAEARIRELKTLGLDYVVISVGKKGNSYFLRRPYIPVDKFLDGSNLPTAKEAQAIADDVFSLFVSEEVDKVELLYTKFVSLVKSDPVIHTLLPLSPKGEICDINGICVDAAEDEFFRLTTKEGKLTVERDVVRAETMDFSPILQFEQDPVQILDALLPLYLNSQILRALQESLASELAARMTAMGNATDNASELKKNLSRVYNRQRQAKITGEILEIVAGADALA

SEQ ID NO: 6356 - protein, 374 aa, Helianthus annuus
MACSNLTMLVSSKPSLDSSSPLSFRSFIAPVQIPSSNANNSIPLLSSSSIHCSLRDLRTRIDSVKNTQKITEAMKLVAAAKVRRAQEAVVNARPFSETLVEVLYSINEQLQTEDVDVPLTNVRPVKKVALVVVTGDRGLCGGFNNFILKKAEARIRELKTLGLDYVVISVGKKGNSYFLRRPQIPVDKFLDGSNLPTAKEAQAIADDVFSLFVSEEVDKVELLYTKFVSLVKSDPVIHTLLPLSPKGEICDINGICVDAAEDEFFRLTTKEGKLTVERDVIRADTMDFSPILQFEQDPVQILDALLPLYLNSQILRALQESLASELAARMTAMGNATDNASELKKNLSRVYNRQRQAKITGEILEIVAGADALA

SEQ ID NO: 6357 - protein, 376 aa, Ambrosia trifida
MSCSNLTMLVSSKPSLKDSSSPLSFRSFIAPVQIPSSNACNNSISSKPSSSIHCSLRDLRTRIDSVKNTQKITEAMKLVAAAKVRRAQEAVVNARPFSETLVEVLYSINEQLQTEDVDVPLTNVRPVKKVALVVVTGDRGLCGGFNNFILKKAEARIRELKTLGLDYVVISVGKKGNSYFLRRPYIPVDKFLDGSNLPTAKEAQAIADDVFSLFVSEEVDKVELLYTKFVSLVKSDPVIHTLLPLSPKGEICDINGICVDAAEDEFFRLTTKEGKLTVERDVVRAETMDFSPILQFEQDPVQILDALLPLYLNSQILRALQESLASELAARMTAMGNATDNASELKKNLSRVYNRQRQAKITGEILEIVAGADALA

SEQ ID NO: 6358 - protein, 375 aa, Ambrosia trifida
MSCSNLTMLVSSKPSLKDSSSPLSFRSFIAPVQIPSSNANNNSISKPSSSIHCSLRDLRTRIDSVKNTQKITEAMKLVAAAKVRRAQEAVVNARPFSETLVEVLYSINEQLQTEDVDVPLTNVRPVKKVALVVVTGDRGLCGGFNNFILKKAEARIRELKTLGLDYVVISVGKKGNSYFLRRPYIPVDKFLDGSNLPTAKEAQAIADDVFSLFVSEEVDKVELLYTKFVSLVKSDPVIHTLLPLSPKGEICDINGICVDAAEDEFFRLTTKEGKLTVERDVVRAETMDFSPILQFEQDPVQILDALLPLYLNSQILRALQESLASELAARMTAMGNATDNASELKKNLSRVYNRQRQAKITGEILEIVAGADALA

SEQ ID NO: 6359 - protein, 118 aa, Ambrosia trifida
MSSCSNLTMWLSSKPSLDSSSPLSFTSFITPSPFPTSISNHGLSKSSSSIQCSLRDLRTRIDSVKNTQKITEAMKLVAAAKVRRAQEAVVNARPFLKLWLRFFTASTSSFKLKMLMSP

SEQ ID NO: 6360 - protein, 410 aa, Tropaeolum majus
MSCSNVTMCVSDASALSFRSFVAPFPLSSTNTATSCNPTRSNSATPIQCGLRELRGRIDSVKNTQKITEAMKLVAAAKVRRAQEAVVNGRPFSETLVEVLYNINEQLQTEDVESPLTNVRPVKKVALVVVTGDRGLCGGFNNNIIKKAEARIKELKTLGLEYVVISVGKKGNSYFLRRPYIPVDKFLEGGGLPTAKEAQAIADDVFSLFVSEEVDKVELLYTKFVSLVKSDPVIHTLLPLSPKGEICDINGVCVDAAEDEFFRLTTKGGKLTVERDAVRTATPEFSPILQFEQDPVQILDALLPLYLNSQVLRALQESLASELAARMSAMSSATDNAVELKKNLSRQYNRQRQAKITGEIFGDCCWCRGFDLISILIGFRSMGEEWWCFLLLISDNRVWIVEVKTNLGSC

SEQ ID NO: 6361 - protein, 301 aa, Arnica chamissonis
MKLVAAAKVRRAQEAVVNSRPFSETLVEVLYSINEQLQTEDVDVPLTSVRPVKKVALVVVTGDRGLCGGYNNFILKKAEARIRELKTLGLDYVVISVGKKGNSYFLRRPYIPVDKFFDGSNLPTAKEAQAIADDVFSLFVSEEVDKVELLYTKFVSLVKSNPVIHTLLPLSPKGEICDINGVCVDAAEDEFFRLTTKEGKLTVEREAIRGETVDFSPILQFEQDPVQILDALLPLYLNSQILRALQESLASKLAARMTAMGNATDNASELKKSLSQVYNRQRQAKITGEILEIVAGADALL

SEQ ID NO: 6362 - protein, 100 aa, Flaveria ramosissima
MSCSNLTMWVSSKPSLDSSSPLSFRSFITPVQIPTSNPSNSNYLISKSSTSIYCNLRELRTRIDSVKNTQKITEAMKLVAAAKVRRAQEAVVNARPFLKP

SEQ ID NO: 6363 - protein, 374 aa, Helianthus annuus
MSCSNLTMLVSSKPSLDSSSPLSFRSFIAPVQIPSSNANNSISKPSSSSIHCSLRDLRTRIDSVKNTQKITEAMKLVAAAKVRRAQEAVVNARPFSETLVEVLYSINEQLQTEDVDVPLTNVRPVKKVALVVVTGDRGLCGGFNNFVLKKAEARIRELKTLGLDYVVISVGKKGNSYFVRRPQIPVDKFLEGSNLPTAKEAQAIADDVFSLFVSEEVDKVELLYTKFVSLVKSDPVIHTLLPLSPKGEICDINGVCVDAAEDEFFRLTTKEGKLTVERDVIRAEKMDFSPILQFEQDPVQILDALLPLYLNSQILRALQESLASELAARMTAMGNATDNASELKKNLSRVYNRQRQAKITGEILEIVAGADALA

SEQ ID NO: 6364 - protein, 376 aa, Flaveria ramosissima
MSCSNLTMWVSSKPSLDSSSPLSFRSFITPVQIPTSNPSNSNYLISKSSSSIHCNLRELRTRIDSVKNTQKITEAMKLVAAAKVRRAQEAVVNARPFSETLVEVLYSINEQLQTEDVDVPLTNVRPVKKVALVVVTGDRGLCGGFNNFILKKAEARIKELKTLGLDYVVISVGKKGNSYFQRRPYIPVDKFIDGSNLPTAKEAQAIADDVFSLFVSEEVDKVELLYTKFVSLVKSDPVIHTLLPLSPKGEICDINGVCVDAAEDEFFRLTTKEGKLTVERDVVRADTMDFSPILQFEQDPVQILDALLPLYLNSQILRSLQESLASELAARMTAMGNATDNASELKKNLSRVYNRQRQAKITGEILEIVAGADALA

SEQ ID NO: 6365 - protein, 376 aa, Flaveria ramosissima
MSCSNLTMWVSSKQSLDSSSPLSFRSFITPVQIPTSNPSNSNYLISKSSTSIQCNLRELRTRIDSVKNTQKITEAMKLVAAAKVRRAQEAVVNARPFSETLVEVLYSINEQLQTEDVDVPLTNVRPVKKVALVVVTGDRGLCGGFNNFILKKAEARIKELKTLGLDYVVISVGKKGNSYFQRRPYIPVDKFIDGSNLPTAKEAQAIADDVFSLFVSEEVDKVELLYTKFVSLVKSDPVIHTLLPLSPKGEICDINGVCVDAAEDEFFRLTTKEGKLTVERDVVRADTMDFSPILQFEQDPVQILDALLPLYLNSQILRSLQESLASELAARMTAMGNATDNASELKKSLSRVYNRQRQAKITGEILEIVAGADALA

SEQ ID NO: 6366 - protein, 353 aa, Lotus japonicus
LYLMPLTSPSVLSTSTLFSFPSRLSVSPVQCGLRELRTRIESVKNTQKITEAMKLVAAAKVRRAQEAVVNGRPFSETLVEVLYSINEQLQTEDVDVPLTKIRPVKKVALVVCTGDRGLCGGFNNFILKKAEARIKELKELGLEYTIISVGKKGNSYFIRRPYIPVDRFLEGGTLPTAKEAQAIADDVFSLFVSEEVDKVELLYTKFVSLVKSDPVIHTLLPLSPKGEICDINGNCVDAAEDELFRLTTKEGKLTVERDTFRTKTAEFSPILQFEQDPVQILDTLLPLYLNSQVLRALQESLASELAARMSAMSNASDNASDLKKNLSTVYNRQRQAKITGEILEIVAGANALE

SEQ ID NO: 6367 - protein, 366 aa, Plantago ovata
WSSSKPSLSDTSLLSSRSFIAPFQIPNPSSSSPSTRSTTFQIQCNLRELRGRIDSVKNTQKITEAMKLVAAAKVRRAQEAVVNARPFSETLVEVLYNINEQLQTEDVDIPLTKVRPVKKVGLVVVTGDRGLCGGFNNMIIKKAEARIRELKTLGLDFVVVSVGKKGNSYFSRRPYIPVDKFIEGTNLPTSKEAQAIADDVFSLFVSEEVDKVELLYTKFVSLVKSDPVIHTLLPLSPKGEICDINGVCVDAAEDEFFRLTTKEGKLTVERDVMRTKTADFSPILQFEQDPVQILDALLPLYLNSQILRSLQESLASELAARMSAMSNATDNASELKKNLSMVYNRKRQAKITGEILEIVAGADALV

SEQ ID NO: 6368 - protein, 368 aa, Citrus sinensis
MSCSNLTVCRDTSSLSFGSFLNPFRPPHNSTPNNPSRSSSVTPIHCGLRELRERIDSVKNTQKITEAMKLVAAAKVRRAQEAVVNGRPFSETLVEVLYNINEQLQNEDIDVPLIKVRPVKKVALVVVTGDRGLCGGFNNNIIKKAEARIAELKTLGLDYTIISVGKKGNAYFLRRPYIPVDRFLEGGSLPTAKEAQTIADDVFSLFVSEEVDKVELLYTKFVSLVKSDPVIHTLLPLSPRGEICDVNGVCVDAAEDEFFRLTTKEGKLTVERDVVRTETASFSPILQFEQDPVQILDALLPLYLNSQILRALQESLASELASRMSAMSNATDNAMELKKNLSIVYNRQRQAKITGEILEIVAGADALV

SEQ ID NO: 6369 - protein, 368 aa, Euphorbia peplus
MWVSSKSPLSDASSLSFCSSLSPFQVPSGSPSNTPSRSSSVTPIHSSLRDLRNRIASVKNTQKITEAMKLVAAAKVRRAQEAVVNGRPFSETLVEVLYNINEQLQVEDVDAPLTKVRPVKKVALVVITGDRGLCGGYNNSILKKAEARIKELKGLGVEFTIISVGKKGNTYFTRRPYIPVDRFIEGTNLPTAKEAQAIADDVFSLFVSEEVDKVELLYTKFVSLVKSNPVIHTLLPLSPKGEICDINGNCVDAAEDEFFRLTTKEGKLTVERGSTRTKTADFSAILQFEQDPVQILDALLPLYLNSQILKALQESLASELAARMSAMSNATDNASELQKELSRVYNRKRQAKITGEILEIVAGADALV

SEQ ID NO: 6370 - protein, 368 aa, Citrus sinensis
MSCSNLPVCRDTSSLSFGSFLNPFRPPHNATPNNPSRSSSVTPIHCGLRELRERIDSVKNTQKITEAMKLVAAAKVRRAQEAVVNGRPFSETLVEVLYNINEQLQNEDIDVPLIKVRPVKKVALVVVTGDRGLCGGFNNNIIKKAEARIAELKTLGLDYTIISVGKKGNAYFLRRPYIPVDRFLEGGSLPTAKEAQTIADDVFSLFVSEEVDKVELLYTKFVSLVKSDPVIHTLLPLSPRGEICDVNGVCVDAAEDEFFRLTTKEGKLTVERDVVRTETASFSPILQFEQDPVQILDALLPLYLNSQILRALQESLASELASRMSAMSNATDNAMELKKNLSIVYNRQRQAKITGEILEIVAGADALV

SEQ ID NO: 6371 - protein, 358 aa, Primula obconica
MSCSNLSFRSSLNPFLSNPSSPALSPARSSPSPIHCALRDLRERIDSVKNTQKITEAMKLVAAAKVRRAQEAVVNGRPFSETLVSVLYNINEQLQIEDVDAPLTKVRPVRKVALVVVTGDRGLCGGFNNYLIKKAEARIKQLKGLGIEYTVISVGKKGNSYFQRRPYIPVDKFLEGGNLPTAKEAQAIADDVFSLFVSEEVDKVELLYTKFVSLVKSEPVIHTLLPLSPKGEICDINGTCVDAADDEFFRLTTKEGKLTVERGTMRTETVDFSPILQFEQDPVQILDALLPLYLNSQILRALQESLASELAARMSAMSNASDNATELKKSLSQVYNRQRQAKITGEILEIVSGANALE

SEQ ID NO: 6372 - protein, 374 aa, Medicago truncatula
MSCSNITMLVSSKPSLPDASNLSFRSALNPFQLPSQNSSSSCTPSRPTQIQCGLRELRNRIDSVKNTQKITEAMKLVAAAKVRRAQEAVVNGRPFSQTLVEVLYSINEQLQTDDIEAPLTKLRPVKKVALVVCTGDRGLCGGFNNAILKKAEKRIAELKGLGLDYTIISVGRKGNSYFLRRPYIPVDRFLEGGNLPTAKEAQTIADDVFSLFVSEEVDKVELLYTKFVSLVKSEPIIHTLLPLSPKGEICDINGNCVDAAEDELFRLTTKEGKLTVERDAVRSKTIDFSPILQFEQDPVQILDALLPLYLNSQILRALQESLASELAARMTAMSSACDNAIELKKNLSRVYNRQRQAKITGEILEIVAGADALV

SEQ ID NO: 6373 - protein, 370 aa, Artemisia annua
MSCSNLTTMWVSSKPSLDSSSPLSFRSFISPVQIPSSNPSNGNYSISKSSTSIHCNLRELRTRIDSVKNTQKITEAMKLVAAAKVRRAQEAVVNARPFSETLVEVLYSINEQLQTEDVDVPLVNVRPVKKVALVVVTGDRGLCGGFNNFILKKAEARIRELKTLGLDYVIISVGKKGNSYFSRRPQIPVDKYLDGSNLPTAKEAQALFVSEEVDKVELLYTKFVSLVKSDPVIHTLLPLSPKGEICDINGVCVDAAEDEFFRLTTKEGKLTVERDVVRSETIDFSPILQFEQDPVQILDALLPLYLNSQILRALQESLASELAARMTAMGNATDNASELKKSLSRVYNRKRQAKITGEILEIVAGADALV

SEQ ID NO: 6374 - protein, 369 aa, Guizotia abyssinica
MSSSNLTTMWVSSKPSLDFKSFINPLQLPSTNPNYHANSKSTTSINCNLRELRTRIDSVKNTQKITEAMKLVAAAKVRRAQEAVVNARPFSETLVEVLYSINEQLQTEDVDVPLTNVRPVKKVALVVVTGDRGLCGGFNNFILKKAEARIKELKTLGLDYVVISVGKKGNSYFLRRPNIPVDKFLDGSNLPTAKEAQAIADDVFSLFVSEEVDKVELLYTKFVSLVKSDPVIHTLLPLSPKGEICDINGVCVDAAEDEFFRLTTKEGKLTVERDVIRTETMDFSPILQFEQDPVQILVALLPLYLNSQILRALQESLASELAARMTAMGNATDNASELKKNLSRVYNRQTSAKITGEILEIVAGADALG

SEQ ID NO: 6375 - protein, 368 aa, Citrus clementina
MSCSNLTVCRDTSSLSFGSFLNPFRPPHNSTPNNPSRPSSVTPIHCGLRELRERIDSVKNTQKITEAMKLVAAAKVRRAQEAVVNGRPFSETLVEVLYNINEQLQNEDIDVPLIKVRPVKKVALVVVTGDRGLCGGFNNNLIKKAEARIAELRTLGLDYTIISVGKKGNAYFLRRPYIPVDRFLEGGSLPTAKEAQTIADDVFSLFVSEEVDKVELLYTKFVSLVKSDPVIHTLLPLSPMGEICDVNGVCVDAAEDEFFRLTTKEGKLTVERDVVRTETASFSPILQFEQDPVQILDALLPLYLNSQILRALQESLASELASRMSAMSNATDNAMELKKNLSIVYNRQRQAKITGEILEIVAGADALV

SEQ ID NO: 6376 - protein, 376 aa, Flaveria ramosissima
MSCSNLTMWVSSKPSLDSSSPLSFRSFITPVQIPTSNPSNSNYLISKSSTSIHCNLRELRTRIDSVKNTQKITEAMKLVAAAKVRRAQEAVVNARPFSETLVEVLYSINEQLQTEDVDVPLTNVRPVKKVALVVVTGDRGLCGGFNNFILKKAEARMKELKTLGLDYVVISVGKKGNSYFQRRPYIPVDKFIDGSNLPTAKEAQAIADDVFSLFVSEEVDKVELLYTKFVSLVKSDPVIHTLLPLSPKGEICDVNGVCVDAAEDEFFRLTTKEGKLTVERDVVRADTMDFSPILQFEQDPVQILDALLPLYLNSQILRSLQESLASELAARMTAMGNATDNASELKKNLSRVYNRQRQAKITGEILEIVAGADALA

SEQ ID NO: 6377 - protein, 370 aa, Helianthus annuus
MWVSSSKPSLDSSSPLSFRSFITPSPIPTSNPSNSNYGISKSSSSIHCSLRDLRTRIDSVKNTQKITEAMKLVAAAKVRRAQEAVVNARPFSETLVEVLYSINEQLQTEDVDVPLTNIRPVKKVALVVVTGDRGLCGGFNNFILKKAEARIKELKTLGLDYVVISVGKKGNSYFLRRPYIPVDKFLDGSNLPTAKEAQAIADDVFSLFVSEEVDKVELLYTKFVSLVKSDPVIHTLLPLSPKGEICDINGVCVDAAEDEFFRLTTKEGKLTVERDVVRADTLDFSPILQFEQDPVQILDALLPLYLNSQILRALQESLASELAARMTAMGNATDNASELKKNLSRVYNRQRQAKITGEILEIVAGADALA

SEQ ID NO: 6378 - protein, 373 aa, Fragaria vesca
MSCSNVTMWVSSKPSLTDTSTLSFRSCLSPFQLPSQNSLTGNPSRSSTVTCGLRELRDRIASVSNTKKITEAMKLVAAAKVRRAQEAVVNGRPFSQTLVEVLYNINEQLQVEDIDSPLTNVRPVKKVALVVVTGDRGLCGGFNNQIIKKAERRIAELKALGLEYTIVSVGKKGNSYFSRRPYIPVDKFIEGTNQPTAKEAQAIADDVFSLFVSEEVDKVELLYTKFVSLVKADPVIHTLLPLSPKGEICDINGTCVDAAEDEFFRLTTKEGKLTVERDATTTATVDFSPILQFEQDPVQILDALLPLYLNSQVLRALQESLASELAARMTAMSNASDNAVELKKNLSQVYNRQRQAKITGEILEIVSGADALT

SEQ ID NO: 6379 - protein, 197 aa, Brassica juncea
MWGVSSNPSLSDSSSLSFRSVLNPLPLPNHNTSPSRSSSVSPIQSSLRELRDRIDSVKNTQKITEAMKLVAAAKVRRAQEAVVNGRPFSETLVEVLYNINEQLQTDDIDVPLTKIRPVKKVALVVVTGDRGLCGGFNNFIIKKAEARIKELQGLGLATQSLAWGRRELLLPPSSLHPRRQVPRSRDLTDGERGSSCC

SEQ ID NO: 6380 - protein, 376 aa, Aquilegia formosa
MSCSNLTMWVSSKSPLSDTSSLSFGASLNPIRLPSQNLTTITPSRSITSNPIRCSLRALRDRIDSVKNTQKITEAMKLVAAAKVRRAQEAVVNGRPFSETLVEVLYSINEQVQGDIDDIPLTKVRPVKKVGLVVITGDRGLCGGFNNFVLKKAEARMAELRQLGIEFTIISVGKKGNSYFIRRPYIPVDKFLEGGNLPTTKEAQAIADDVFSLFISEEVDKVELLYTKFVSLVKADPVIHTLLPLSPKGEVCDINGVCVDAAEDELFRLTTKEGKLTVERDVVMSKTEDFSPILQFEQDPVQILDALLPLYLNSQILRALQESLASELAARMTAMSAATDNASELKKDLSMKYNRRRQAKITGEILEIVAGADALI

SEQ ID NO: 6381 - protein, 365 aa, Vaccinium corymbosum
MASCANTTMRLYSNFNPFQLPTKHSLSSSHSNPPCKPFHVTCSLRDLRDRIGSVKNTQKITEAMKLVAAAKVRRAQEAVVNGRPFSETLVEVLYSINEQIQTEDVDVPLTKVRPVKKVALVVVTGDKGLCGGFNNQVIKKAEARIAELKGLGLEYTVISVGKKGNAYFQRRPYIPVDRYLEGGYLPTAKEAQAIADDVFSLFVSEEVDKVELLYTKFVSLLRSDPVIHTLLPLSPKGEICDINGTCVDAAEDEFFRLTTKEGKLTVERDTVRAQTEEFSPILQFEQDPVQILDALLPLYLNSQILRALQESLASELAARMTAMSNASDNAEELKKSLSMIYNRERQAKITGEMLEIVAGAAAMGG

SEQ ID NO: 6382 - protein, 358 aa, Panax ginseng
TAGSFSSCINPFQISNQNSTISNPSSRSSSVTPIHCSLRDLRERIDSVKNTQKITEAMKLVAAAKVRRAQEAVVNARPFSETLVEVLYSINEQLQTEDIDVSLTNVRPVKKVALVVVTGDRGLCGGFNNAIIKKAEARIRELKALGLDYTVISVGKKGNTYFQRRPYIPVDKFLEGGNLPTAKEAQAIADDVFSLFVSEEVDKVELLYTKFVSLVKSNPVIHTLLPLSPKGEICDINGTCVDAAEDEFFRLTTKEGKLTVERDTVRTETVEFSPVLQFEQDPVQILDALLPLYLNSQILRSLQESLASELAARMSAMSSATDNAKELKKNLSQVYNRQRQAKITGEILEIVAGADALV

SEQ ID NO: 6383 - protein, 366 aa, Linum usitatissimum
MWVSSRHSLSDPCLFSSITPFKISIPKSSTSRSSSSSIPLIQCSSLRELRTRIESVKNTQKITEAMKLVAAAKVRRAQEAVVNGRPFSETLVEVLYNINEQLQVEDVDAPLTKVRPVKKVALVVITGDRGLCGGYNSQIIKKAELRIKELKSLGLEYTIISVGRKGNTYFLRRPYIPVDRFLEGSNLPTTKEAQTIADDVFSLFVSEEVDKVELLYTKFVSLVKSDPVIHTLLPLSPKGEICDINGVCVDAAEDEFFRLTTKEGKLTVERDVVRTATPDFSPILQFEQDPVQILDALLPLYLNSQILKALQESLASELANRMSAMSTASDNASDLKKSLSKVYNRQRQAKITGEILEIVAGADALT

SEQ ID NO: 6384 - protein, 301 aa, Helianthus annuus
MKLVAAAKVRRAQEAVVNARPFSETLVEVLYSINEQLQTEDVDVPLTNIRPVKKVALVVVTGDRGLCGGFNNFILKKAEARIKELKTLGLDYVVISVGKKGNSYFVRRPYIPVDKFLDGSNLPTAKEAQAIADDVFSLFVSEEVDKVELLYTKFVSLVKSDPVIHTLLPLSPKGEICDINGVCVDAAEDEFFRLTTKEGKLTVERDVVRADTMDFSPILQFEQDPVQILDALLPLYLNSQILRALQESLASELAARMTAMGNATDNASELKKNLSRVYNRQRQAKITGEILEIVAGADALA

SEQ ID NO: 6385 - protein, 365 aa, Vaccinium corymbosum
MASCANTTMRLYSNFNPFQLPTKHPLSSSHSNPPCKPFHVTCSLRDLRDRIGSVKNTQKITEAMKLVAAAKVRRAQEAVVNGRPFSETLVEVLYSINEQIQTEDVDVPLTKVRPVKKVALVVVTGDKGLCGGFNNQLIKKAEGRIAELKGLGLEYTVISVGKKGNAYFQRRPYIPVDRYLEGGYLPTAKEAQAIADDVFSLFVSEEVDKVELLYTKFVSLLRSDPVIHTLLPLSPKGEICDINGTCVDAAEDEFFRLTTKEGKLTVERDTVRAQTEEFSPILQFEQDPVQILDALLPLYLNSQILRALQESLASELAARMTAMSNASDNAEELKKSLSMIYNRERQAKITGEMLEIVAGAAAMGG

SEQ ID NO: 6386 - protein, 375 aa, Arabidopsis lyrata
MEKKSVKISDKLSLIRVLRGIICLMVLVSTAFMMLIFWGFLSAVLLRLFSVRYSRKCVSFFFGSWLALWPFLFEKINRTKVIFSGDKVPCEDRVLLIANHRTEVDWMYFWDLALRKGQIGNIKYVLKSSLMKLPLFGWAFHLFEFIPVERKWEVDEANLRQILSSFKDPRDALWLALFPEGTDYTEAKCERSKKFAAENGLPILNNVLLPRTKGFVSCLQELSCSLDAVYDVTIGYKTRCPSFLDNVYGIEPSEVHIHIRRINVTQIPNQEKDINAWLMNTFQLKDQLLNDFYSNGHFPNEGTEKEFNTKKYLINCLAVIAFTTICTHLTFFSSMIWFKIYVSLACAYLTSATHFNLRSVPLVETAKKAFKLLNK

SEQ ID NO: 6387 - protein, 382 aa, Eutrema halophilum
MEKKVTKSEENIPNSNNKLSLIRVLRGITCLMVLVSTAFMMLIFWGFLSAVVLRLFSVHYSRKCVSFFFGSWLALWPFLFEKINRTKVVFCGDKVPCEERVLLMANHRTEVDWMYFWDLALRKGQIGNMKYVLKSSLMKLPLFGWAFHLFEFIPVERKWEVDEANLRQMVSSFKDPRDALWLALFPEGTDYTEAKCERSKKFAAANGLPVLNNVLLPRTKGFVSCLEELSCSLDAVYDVTIGYKNRCPSFLDNVYGIEPSEVHIHIRRINLTQIPNKEKEINAWLVNTFQLKDQLLNDFYSRGHFPNEGTEKEFNTTKYLINCLAVIVFTIICTHLTFFSSMIWFKIYVSLACAYLTSATHLNLRAVPLVETAKRAFKLVNK

SEQ ID NO: 6388 - protein, 382 aa, Eutrema parvulum
MEKKVTKSEENISNSSNKLSLIRVLRGIICLMVLVSTAFMMLIFWGFLSGVVLRLFSVHYSRKCVSFFFGSWLALWPFLFEKINRTKVVFCGDKVPCEERVLLIANHRTEVDWMYFWDLALRKGQIGNMKYVLKSSLMKLPLFGWAFHLFEFIPVERKWEVDEANLRQIVSSFKDPRDALWLALFPEGTDYTEAKCERSKKFAAEHGLPALSNVLLPRTKGFVSCLQELSCSLDAVYDVTIGYKTRCPSFLDNVYGIEPSEVHIHIRRINQTQIPNQEKEINAWLMNTFQLKDQLLSDFHSCGHFPNEGTEIEFSTKKYLINCLAVIVFTIICTHLTFFSSMPWFKIYVTLACVYLTSATHFNLRSAPLVETAKKAFKLVNK

SEQ ID NO: 6389 - protein, 378 aa, Brassica rapa
MKNKVTKSEGNIPNSDNKLSLIRMLRGITCLMVLVSTAFMMLIFWGFLSGVVLRLFSIHYSRKCVSFFFGSWLALWPFLFEKINGTKVVFSGDKVPCEERVLLIANHRTEVDWMYFWDLALRKGQIGNMKYVLKSSLMKLPLFGWAFHLFEFIPVERRWEVDEANLRQIVSSFKDPRDALWLALFPEGTDYTEAKCERSKKFAAEHGLPVLSNVLLPRTKGFVSCLQELSSSLDAVYDVTIGYKTRCPSFLDNVYGIEPSEVHIRIRRIDQSQIPNQEKEINDWLMNAFQLKDQLLSDFYSSGHFPNEGTEKEFNTLKHLINCLAVIVFTVICAYLTFFSSMVWFKIYVSLVCAYLASATHFNLRSVPLVETAKKAFK

SEQ ID NO: 6390 - protein, 374 aa, Raphanus sativus
MEKKLKNSNKMSLIRMLRGIACLMVLVSTAFMMLIFWGFLSAVVVRLFSLHYSRRCVSFFFGSWLALWPFLFEKINRTKVVFSGDKVPCEERVLLIANHRTEVDWMYFWDLALRKGQIGNMKYVLKSSLMKLPLFGWAFHLFEFIPVERRWKVDEANLRQMVSSFKDPRDALWLGLFPEGTDYTEAKCERSKKFAAENGLPVLNNVLLPKTKGFVSCLEELNGSLDAVYDVTIGYKTRCPSFLDNVYGTEPSEVHIHIRRISQNQIPNEEKEINAWLMSTFEIKDQLLSDFYTRGHFPNEGTEKEFSTLKHLINCLAVIVFTIICTHLTFFSSMIWFKIYVSLVCAYLTYATHFNFRPAPLVETAKQAFKLANK

SEQ ID NO: 6391 - protein, 377 aa, Brassica rapa
MEKKLTNSNNMSLIRMLRGIICLMVLVSTAFMMLIFWGFISAVVMRLFSLHYSRKCVSFFFGSWLALWPFLFEKINRTKVIFSGDKVPCESRVLLIANHRTEVDWMYFWDLALRKGQIGNMKYVLKSSLMKLPLFGWAFHLFEFIPVERKWKVDEANLRQMVSSFKDPRDGLWLGLFPEGTDYTEAKCERSKKFAAENGLPELNNVLLPKTKGFVSCLEELDSSLDAVYDVTIGYKTRCPSFLDNVYGTEPSEVHIHIRRISQNQIPNQEKEINAWLMNTFQLKDQLLSEFYSRGHFPNEGTEKEFSTIKQLINCLAVIVFTIICTHLTFFSSMIWFKIYVSLVCAYLTYATHFNLRPAPLVETAKKSFQISKKMNF

SEQ ID NO: 6392 - protein, 267 aa, Brassica napus
MEKKLKNSNNLSLIRMLRGIICLMVLVSTAFMMLIFWGFLSAVVMRLFSLHYSRKCVYFFFGSWLALWPFLFEKINRTKVIFSGDKVPCESRVLLIANHRTEVDWMYFWDLALRKGQIGNMKYVLKSSLMKLPLFGWAFHLFEFIPVERKWKVDEANLRQMVSSFKDPRDGLWLGLFPEGTDYTEAKCERSKKFAAENGLPELNNVLLPKTKGFVSCLEELDSSLDAVYDVTIGYKTRCPSFLDNVYGTEPSEVHIHIRRISQNNPK

SEQ ID NO: 6393 - protein, 377 aa, Brassica napus
MEKKLTNSNNMSLIRMLRGIICLMVLVSTAFMMLIFWGFLSAVVMRLFSLHYSRKCVYFFFGSWLALWPFLFEKINRTKVIFSGDKVPCESRVLLIANHRTEVDWMYFWDLALRKGQIGNMKYVLKSSLMKLPLFGWAFHLFEFIPVERKWKVDEANLRQMVSSFKDPRDGLWLGLFPEGTDYTEAKRERSKKFAAENGLPILNNVLLPKTKGFVSCLEELGCSLDAVYDVTIGYKTRCPSFLDNVYGTEPSEVHIHIRRISQNQIPNEEKEISAWLMNTFQIKDQLLSEFYSRGHFPNEGTEKEFSTIKQLINCLAVIVFTIICTHLTFFSSMIWFKIYVSLVCAYLTCATHFNLRPAPLVETAKKSFQISKKMNF

SEQ ID NO: 6394 - protein, 624 aa, Arabidopsis lyrata
MSRFLISRIVGKQTQSLLSNQKERVSQWGSYRTAFTAALRSPQFRTYSSSGRVPSNGYCILAFRDLKGSFLSKHLSRSYSTVPARNVVSHHAQVAWKRLHYKYSERISTMAQAFSLSLTRSHLLIPGIVALTCGQVAWAQRAPGSGINHYASDKSLYTRAKNGPIFLSSLLFSVIEGFILIGRAFYIACLFTPSILMGLVVESCGPRFRKIWLQMVHRTLERAGPAFIKWGQWAATRPDLFPKDLCLQLSKLHSNAPEHSFAYTKKTIEKAFGRKLSEIFEEFEEVPVASGSIAQVHRASLRFQYPGQKSKSSLVAVKVRHPGVGESIRRDFVIINLVAKISTLIPALKWLRLDESVQQFGVFMLSQVDLAREASHLSRFIYNFRRWKDVSFPKPVYPLVHPAVLVETYEHGESVARYVDGMEGHEWIKTRLAHIGTHALLKMLLVDNFIHADMHPGNILVRKKASGGGLFKTKKPHIVFLDVGMTAELSKNDRENLLDFFKAVARRDGRTAAERTLKLSRKQNCPNPEAFIEEVEEAFKFWGTPEGDLVHPADCMHELLEKVRRHRVNIDGNVCTVMVTTLVLEGWQRKLDPGYDVMHTLQTMVLKTDWAKSLSYTVDGLMAP

SEQ ID NO: 6395 - protein, 630 aa, Eutrema halophilum
MSRFFIFRIVGKHTQSLLSNQKERGSQWGSYRTAITAALRSPQFRVYSSSARLPSNGHCTFSLRDPKGSFLRNHLSRSYSTASARNVATHHAQVAWKRIHHKCSVRQWSLPRISTIAQAFTLSITRSHLLIPGIVALTCGQVALAQRAPNYALDPYPSHQSLYTRAKNGPIFLSSLLFSVIEGFILIGRAFYIACLFTPSVLMGLVVESCGPRFRKIWLEMVHRTLERAGPAFIKWGQWAATRPDLFPKDLCSQLSKLHSNAPEHSFAYTKKTIEKAFGRKLSEIFEEFEEAPVASGSIAQVHRASLRFQYPGQKSKSSLVAVKVRHPGVGESIRRDFVIINLVAKISTFIPALKWLRLDESVQQFGVFMLSQVDLAREASHLSRFIYNFRRWKDVSFPKPVYPLVHPAVLVETYEHGESVARYVDGMEGHEWIKTRLAHIGTHALLKMLLVDNFIHADMHPGNILVRKKASRGGLFKAKKPHIVFLDVGMTAELSKNDRENLLDFFKAVALRDGRTAAERTLKLSRKQNCPNPEAFIEEVEEAFKFWGTPEGDLVHPADCMHELLEKVRRHRVNIDGNVCTVMVTTLVLEGWQRKLDPGYDVMHTLQTMVLKTDWAKSLSYTVDGLMAP

SEQ ID NO: 6396 - protein, 630 aa, Eutrema parvulum
MSRFFIFRIVGKHTQSLFSNQKERRSQWGSYRTAVTVALRSSHFRVYSSSARIPSNGHCISSLRDLKGSVLSNHLSRRYYTTASARNVVTHHAQVAWKRLHRKYSVRQWNLPRINTIAQAFCLSLSRSHLLIPGIVAVTCGQVAWAQRVPSSASDPYPSHKSLYTRAKNGPIFLTSLLFSVIEGFILIGRAFYIACLFTPSILMGLVVEVCGPRFRKIWLEMVHQTLERAGPAFIKWGQWAATRPDLFPKDLCSQLSKLHSNAPEHSFAHTKKTIEKAFGRKLSEIFEDFEEAPVASGSIAQVHRASLRFQYPGQKSKSSLVAVKVRHPGVGESIRRDFVIINLVAKISTLIPALKWLRLDESVQQFGVFMLSQVDLAREASHLSRFIYNFRRWKDVSFPKPVYPLVHPAVLVETYEHGESVARYVDGMDGHEWIKTRLAHIGTHALLKMLLVDNFIHADMHPGNILVRKKASRGVFKTKKPHIVFLDVGMTAELSKNDRENLLDFFKAVARRDGRTAAERTLKLSRKQNCPNPEAFIEEVEEAFKFWGTPEGDLVHPADCMHELLEKVRRHRVNIDGNVCTVMVTTLVLEGWQRKLDPGYDVMHTLQTMVLKTDWAKSLSYTVDGLMAP

SEQ ID NO: 6397 - protein, 612 aa, Brassica rapa
MSRFLIFRIVGKQKEYLLLNQKERASQAALRSPQFRVYTSSSRIPSNGLCKGSFLSNHLSRRCCSTTTTTVSARNVVTHHAQVAWNRLHRQWNLPRINTIAQAFCLSLTRSHLLIPGIAAVTCGKVAWAAQRAPLDPYPSHKSLYTRAKNGPIFLTSLLFSVIEGFILIGRAFYIACLFTPSVLMGLVVEVCGPRFRKVWLEMVHRTLERAGPAFIKWGQWAATRPDLFPQDLCSQLSKLHSDAPQHSFAYTKKTIEKAFGRKLSEIFEEFEEAPLASGSIAQVHRASLRFQYPGQKSKSSLVAVKVRHPGVGESIRRDFVIINFVARVSTLVPALKWLRLDESVQQFGVFMLSQVDLAREASHLSRFIYNFRRWKDVSFPKPVYPLVHPAVLVETYEHGESVARYVDGVEGHEWIKTRLAHIGTHALLKMLLVDNFIHADMHPGNILVRKKASRGGLFKTKKPHIVFLDVGMTAELSKNDRENLLDFFKAVALRDGRTAAERTLKLSRKQNCPNPEAFIEEVEEAFKFWGTAEGDLVHPADCMHELLEKVRRHRVNIDGNVCTVMVTTLVLEGWQRKLDPGYDVMHTLQTMVLKTDWAKSLSYTVDGLMAP

SEQ ID NO: 6398 - protein, 599 aa, Brassica rapa
MSRFFIYRLVGKHTQSLFSNHKETRSQWGSFKTALRSPQFRVHSSSAGYCTTVSARNVVTHTHHAQVAWNRLLHRQWNLPRINTIAQAFCLSLSLRSHLLIPGIAAVTCGKLAWAQKKRAPPLDPYPSHKSLYTRAKNGPIFITSLILSLIEFFILIGRAFYISCLFTPSILMGLVVELCGPRFRKLWLETVHRTLERAGPAFIKWGQWAATRPDLFPKDLCTQLSKLHSDAPQHSFAYTKKTIEKAFGRKLSEIFEEFEEAPLASGSIAQVHRASLRFQYPGQKSKSSLVAVKVRHPGVGESIRRDFVIINFVARVSTLVPALKWLRLDESVQQFGVFMLSQVDLAREASHLSRFIYNFRRWKDVSFPKPVYPLVHPAVLVETYEHGESVAGYVDGMEGHEWIKTRLAHIGTHALLKMLLVDNFIHADMHPGNILVRKKASRGVFKTKKPHIVFLDVGMTAELSKNDRENLLDFFKAVALRDGRTAAERTLKLSRKQNCPNPEAFIEEVEEAFKFWGTPEGDLVHPADCMHELLEKVRRHRVNIDGNVCTVMVTTLVLEGWQRKLDPGYDVMHTLQTMVLKTDWAKSLSYTVDGLMAP

SEQ ID NO: 6399 - protein, 365 aa, Arabidopsis lyrata
MDNINFEFSNASQESRLQSQPFNLQDLNMIQYNQPPSPWTTETFSGLSPYDCTANQSFPVQCSSSKPYPSSFHPYHHQSSDPPSLDQSVSMLPMQPLPDQYLKPFYQRSCANDFAATNASSASYSLSFEANHDPQELCRRTYSSSNVTHLNFSSLQPKQNHPRFSSPPSFSTHGGSVAPNCVNKTRIRWTQDLHEKFVECVNRIGGADKATPKAILKLMDSDGLTIFHVKSHLQKYRIAKYMPESQEGKFEKRACAKELSQLDTRTGVQIKEALQLQLDVQRHLHEQLEIQRNLQLRIEEQGKQLKMMMEQQQKTKKSLLKPPDAEASLCLLASDDSPPSPFLVQDTEALMLTSYEDTQLQSKIS

SEQ ID NO: 6400 - protein, 372 aa, Eutrema parvulum
MDNINFESSTASQGSPLQLQSQPQPPQPFNLQDMNMIHYNQSSPWTNETFSGFTPYDCTANQSFSVQCSSSKPYPASFHPHHHQSLDPPSLDQSQSMVLMQPLPDPYLKPLYQRSCAHDFAATNASSASYSLSFEASQDPQELCRRTYSNSNVTELNFSSSHHHQPKQTHPRFSSPPSFSTHGGSMAPNCGTVIGNKTRIRWTQDLHEKFVECVNCLGGADKATPKAILKLMDSDGLTIFHVKSHLQKYRIAKYIPDSQEGKFEKRSCSKDLSQLDTKTGVQIKEALKLQLDVQRHLHEQLEIQRNLQLRIEEQGKQLKRMIEQQQKTKECLLKTPNAEASLSLSDHSSPPFSVQDAEALMLTSETLNSNQR

SEQ ID NO: 6401 - protein, 375 aa, Eutrema halophilum
MDNINFEFSNASQGSRLQSQPQPPQPFNLQDVNMIHYNQSSPWTTETFSDFTPYDCTANPSFSGQCSLSKPYPSSLHPYHHQSSDPPSLDQSESMVPMQPLPDRYLKPLYQRSCANDFAAANASSASYSLSFEASQDSQGLCRSTYSNSNVTQLNFSSSHHQPKQTHPRFSSPPSFSTHGSGSMAPNCGTITGNKTRIRWTQDLHEKFVECVNRLGGADKATPKAILKLMDSEGLTIFHVKSHLQKYRIAKYIPDSEEGKFEKRACAKELSQLDTKTGVQIKEALQLQLDVQRHLHEQLEIQRNLQLRIEEQGKQLKIMIEQQQKTKESLLKTPNTEASLPLSAPDHSPPPVSIQDPEALMLTNYGDALLHSKIG

SEQ ID NO: 6402 - protein, 493 aa, Secale cereale
MQATGSVTWVVGAQASVLGRCSGGLPYPSSSSSSASSGRSQGLGTVRCSVQAQEKKPRVRKTKEERREMVESFVGTYRVSNNGKFPSVNLTHKEVGGSYYIVREIMRDIIQENRVLGPGDLNAKTLSFEDCPDSSELSNRHELGQGNIEILDMSNGYLGNKDSVLETSDKDETFSLQTNFISTQQLLTSSDILESGILNSVLQNGNVADATCLELNLEKQDEALRGQPRESQTNSSEMQAPSLAHVSDLHKENELNKAGDEHGETTSSVTDEVTLSPEHSVVSLTNGALLHEHVTSPDDCGVTTNTAVDEAIVCSDNNGVLQTDQILIQEHEIVPETASIKTEVVQIADGQFRSATPAAQTDAYTLNTSAATIESAVFIDHHDVVEQPLLGASPNKQRKPEDLASRPAMDTKGFLQKEDNHNTLEKDESEFKKSVSGITDEEREASKANHEQGITATTTISRRTGKGQQKKEDNLFWLIVRAFVVSMSKLWAK

SEQ ID NO: 6403 - protein, 437 aa, Triticum aestivum
PRVRKTKEERREMVESFVDTYRVSNNGKFPSVNLTHKEVGGSYYIVREIMRDIIQENRVLGPGDLNAKTLSFEDCPDSSELSNRHELGQDNIEILDMSDGYHGNKDYVLEMSDKDEAFSLQTNFISTQQLLTSSDILESGILNSVLQNGNVADATCLEPNLEKQDEAFRGKPSESQTNSSEMQAPSLAHVSDLHKEIELNNAGDEHEETTSSITDEVTLSPEPSVVSQTNGALLHEHVTSPDDCGVTTNTSVDEAIVYSENNGVLQTDRILIQEHEIVPETASIKTEVVQIADGQFRSATPATQMDAYTSNTSAATIESAVSIDHHDVVEQPLLGASPNEQRKSEDLASRPAMDTKGFLQKEYNHNTVEKDVSEFKKSVSGITEEEREASKANHEHGISATTTISRRTGKGQQKKEDNLFWLIVRAFVVSMSKLWAK

SEQ ID NO: 6404 - protein, 474 aa, Secale cereale
AARGFAESTAEMLRELGLGVWDVAAQSLAGAEDSELARRLRRPAAAAGKRLSFMNEYLPEDRDPVRCWVVVAAVAFVALLVLGVGSSDDTPVEQPKKLYISPPNAKRFQLPDGRHLAYEEKGISADRARFSLVAPHSFLSSRLAGIPGISSSLLEEFGARLVTYDLPGFGESDPHPGRNLNSSALDMLHLADALGIVDKFWVVGYSGGGMHAWSALRYIPDRVAGAAMFAPMANPYDSKMTKDEKRKIWDRWSTKRKLMHILARRFPSLLRLFYHRSFLSGKQGQPESWLSLSMGKKDKTLLEAPTFSAFWEKDVAESVRQGDVQPFVEEAVLQVSDWGFSLSDIQMQKKEDQGVFEFIKSLFSQAEREWVGFLGPIHIWQGMDDRVVPPSATEFARRMVPGATVHKLLDEGHFSYFCFCDECHRQIFSTLFGTPQGPLNPAPESSEVALEPTEETIPAYEEAAEQEQETSGLA

SEQ ID NO: 6405 - protein, 349 aa, Triticum aestivum
MASTSSSPLSLVLLRPLPCRSLLLSKHRKPFPTPRTGRLAASAAAGAQQRLLRPPETGRWSRSSRSGRDFACLSYNNPPPPSNKDSNEWPILRRWDVPWEWQTVVLSMVGCGVSFALTGLVEQSILQYVGFSATGATIDEKAEILFLGQLSVTAVVLGVIFSITNTFRPFPDDVFRYDVKEPFKLQNGWLLWAGIGLFGAVISIALVGAAMTYLNGAPPEREKDSLVLLLPLIGSSTLSTAYLVGITGVLAPILEETVFRGFLMVSLTKWFPTPVCVILSAAVFAFAHLTPDQFPQLFVLGVALGFTYAQTRNLLAPITIHAFWNSGVILLLTFLQLQGYDIKELLGAS

SEQ ID NO: 6406 - protein, 331 aa, Secale cereale
MQIPPPIQAQETISHPKNWPPGSFSSSRSSAAVAAAAGDRPVEQELEERQRLRVLILQQSAPDSNKDSSEWPILRRWDVPWEWQTVVLSMVGCGVSFALTGLVEQSILQYVGFSAAGATIDEKAGILFLGQLSVTAVVLGVIFSITNTFRPFPDDVFRYDVKEPFKLQNGWLLWAGIGLFGAVISIALVGTAMTYLNGAPPEREKDSLVLLLPLIGSSTLSTAYLVGITGVLAPILEETVFRGFLMVSLTKWFPTPVCVILSAAVFAFAHLTPDQFPQLFVLGVALGFTYAQTRNLLAPITIHAFWNSGVIVLLTFLQLQGYDIKELLGAS

SEQ ID NO: 6407 - protein, 346 aa, Avena sativa
MASTSSSPLSLLLLRPLPCRSLLLSKHRKPLRSPRTGRLAASTAAGAQQWSVRPPETGRWRRSGGGFVCASYNNPPPPSSKDSDEWPVLRRWDVPWEWQTLVLSMVGCGVSFALTGLVEQTVLQYVGYSAAGASIDEKAGILFLGQLSVTAIVLGVIFSITNTFRPFPDDIFRYDIKEPFKLRNGWLLWAGIGLFGAVISIALVGAAMSYLNGQPPEREKDSLVLLLPLIGSSTLSTAYLVGITGVLAPILEETVFRGFLMVSLTKWFPTPVCVVLSAAVFAFAHLTPDQFPQLFVLGVALGFTYAQTRNLLAPITIHAFWNSGVILLLTFLQLQGYDIKELLGAS

SEQ ID NO: 6408 - protein, 350 aa, Brachypodium distachyon
MACSSSSSPLSLLLLRPLPRIPLIHSRHRKPFPFPRTGRIAASAAARAQQRLLRPRETGRWRRSLRSGGGFVCLSYSNPPPPSNKDSDEWPVLRRWDVPWEWQTVVLTMVGCGVSFALTGLVEQSVLQYAGYKAAGATIDEKAEILFLGQLSVTAVLLGVIFSITNTFRPFPDDIFRYDIKEPFKLRNGWLLWAGIGLFGAVISIALVGAAMTYLNGEPPEREKDSLVLLLPLIGSSTLSTAYLVGITGVLAPILEETVFRGFLMVSLTKWFPTPVCVVFSAAVFAFAHLTPDQFPQLFVLGVALGFTYAQTRNLLAPITIHAFWNSGVILLLTFLQLQGYDIKELLGAS

SEQ ID NO: 6409 - protein, 290 aa, Triticum aestivum
WSRSSRSGRDFACLSYNNPPPPSSKDSNEWPVLRRWDVPWEWQTVVLSMVGCGVSFALTGLVEQSILQYVGFSAAGATIDEKAEILFLGQLSVTAVVLGVIFSITNTFRPFPEDVFCYDVKEPFKLQNGWLLWAGIGLFGAVISIALVGAAMTYLNGAPPEREKDSLVLLLPLIGSSTLSTAYLVGITGVLAPILEETVFRGFLMVSLTKWFPTPVCVILSAAVFAFAHLTPDQFPQLFVLGVALGFTYAQTRNLLAPITIHAFWNSGVILLLTFLQLQGYDIKELLGAS

SEQ ID NO: 6410 - protein, 354 aa, Setaria italica
MFPMASSSSSSPPLSLLLIRALPSKPLLLSRHRKPFPYPKSGRIAVARAQQRLLRLPETGRWGRSWRRGGGFPCFSYNANNESPPPSDKSSDNWRILQRWDVPWEWQTVVLSMVGCGVSFVLTGLVEQSALQYVGFKALEATIDEKAEILFLGQLSVTVVVLGVIFGITNTFRPFPDDVFRYDIKEPFKLKNGWLLWAGVGLFGAIISIGLTGAAMTYLNGEPPERETDSLVLLLPLIGSSTTSTAFLVGITGVLAPLLEETLFRGFLMVSLTKWFPTPVCVLVSAAVFALAHLTPGQFPQLFILGVALGFSYAQTRNLLTPITIHAFWNSGVILLLTFLQLQGYDIKELLGAS

SEQ ID NO: 6411 - protein, 123 aa, Secale cereale
MGGGMEVNKNRWIEEWNAGRENLELNFRFTRRSLAVIGLFGLAVPILVYKGDRPRISICRTRTPAGRTGSSCERSAPVDAETPGLCRVSVREKESPSVCFPYCCNQTGDFVLTCCARYVLNKL

SEQ ID NO: 6412 - protein, 121 aa, Secale cereale
MGGGMEVNKNRWIEEWNAGRENLELNFRFTRRSLAVIGLFGLAVPILVYKGIVREFHMQDEDAGRPYRKFPVSVGSGGCRDSEPSAGFRSGRRNLHSVCFPYCCNQTGVFCSHMLCAICVK

SEQ ID NO: 6413 - protein, 71 aa, Avena sativa
MGGGMEVNKNRWIEEWNAGRENLELNFRFTRRSLAIIGLFGLAVPVLVYKGIVREFHMQDEDAGRPYRKFL

SEQ ID NO: 6414 - protein, 121 aa, Secale cereale
MGGGMEVNKNRWIEEWNAGRENLELNFRFTRRSLAVIGLFGLAVPILVYKGILRDSICRTRTPAGRTGSSCERQLRWMPRLPGRLQGFGQGEGISIRFVSRTVVIRPEYFVLTLLCAICVK

SEQ ID NO: 6415 - protein, 126 aa, Secale cereale
  misc_feature (87)..(87): Xaa can be any naturally occurring amino acid
  misc_feature (98)..(98): Xaa can be any naturally occurring amino acid
  misc_feature (104)..(104): Xaa can be any naturally occurring amino acid
AHRHSQSGEEAGGGGSRRGDEKMGGGMEVNKNRWIEEWNAGRENLELNFALYPPQSRRHRRSSASPSPSSSTRASSANSICRTRTPXGRTGSSCERWXRWMSRXRAVCRVSVREKESPFGLFPVLL

SEQ ID NO: 6416 - protein, 71 aa, Unknown
  Sequence found in Organisms: Pennisetum glaucum, Cenchrus ciliaris
MGGGMEVNKNRWIEEWNAGRENLEFNFRWTRRSLAVVGLFGLAVPILVYKGIVREFHMQDEDAGRPYRKFL

SEQ ID NO: 6417 - protein, 71 aa, Avena sativa
MGGGMEVNKNRWIEEWNAGRENLELNFRFTRRSLAIIGLFGIAVPVLVYKGIVREFHMQDEDAGRPYRKFL

SEQ ID NO: 6418 - protein, 71 aa, Sorghum bicolor
MGGGMEVHKNRWIEEWNAGRENLEFNFRWTRRSLAVIGLFGLAVPILVYKGIVREFHMQDEDAGRPYRKFL

SEQ ID NO: 6419 - protein, 71 aa, Secale cereale
MGGGMEVNKNRWIEEWNAAGRTSSSTSALPAAVSPSSASSASPSHPRLQGHRPRIPYAGRGRPGRPYRKFL

SEQ ID NO: 6420 - protein, 118 aa, Secale cereale
MGGGMEVNKNRWIEEWNAGRENLELNFRFTRRSLAVIGLFGLAVPSSSTRASSANSICRTRTPAAVQEVPVSVSSGGCRDSGPSAGFRQGEGISIRFVSPYVVIRPEYFVSHVVRDMC

SEQ ID NO: 6421 - protein, 71 aa, Unknown
  Sequence found in Organisms: Zea mays, Setaria italica, Saccharum officinarum
MGGGMEVHKNRWIEEWNAGRENLEFNFRWTRRSLAVVGLFGLAVPILVYKGIVREFHMQDEDAGRPYRKFL

SEQ ID NO: 6422 - protein, 71 aa, Avena sativa
MGGGMEVNKNRWIEEWNAGRENLELNFRFTRRSLAIIGLFGIAVPVLVYKGIVREFHMQDEDAGRPHRKFL

SEQ ID NO: 6423 - protein, 71 aa, Cynodon dactylon
MGGGMEVHKNRWVEEWNAGRENLEFNFRWTRRSLAVVGLFGLAVPILVYKGIVREFHMQDEDAGRPYRKFL

SEQ ID NO: 6424 - protein, 71 aa, Oryza sativa
MGGGMEVHKNKWIEEWNAGRENLEFNFRWTRRSLAVVGLFGLAVPILVYKGIVREFHMQDEDAGRPYRKFL

SEQ ID NO: 6425 - protein, 71 aa, Panicum virgatum
MGGGMEVHKNRWIEEWNAGRENLEFNFRWTRRSLAVVGLFGLAVPILVYKGIVREFHMQDEDAGRPLRKFL

SEQ ID NO: 6426 - protein, 316 aa, Oryza sativa
MLLHHRLLPRLLLSPSTPVTTTLLVHRTSLFPTRRILSPCCSALSQVAAAPETVDHSDGDEPQGDVQVQLPLDRLFVPPGASVSAGDAEAVTARVLKGSNIVLGPYARGDANVIAADFVKSSVRPDDCPRDGLPEFALVGRSNVGKSSLLNSLVRRKRLALTSKKPGKTQCINHFKVNDSWYLVDLPGYGYAAAPQEARTNWDEFTRNYFLGRENLVSVFLLVDASIPAKKIDLDYASWLGQNKVPMTLVFTKCDKRKKKKNGGKRPEENVENFQSLIREYFEAAPPWIMTSSVTNQGRDEILLHMSQLRNYWLKH

SEQ ID NO: 6427 - protein, 97 aa, Eragrostis curvula
GDLARSPAPRTPSFASRRIEAREEGLLGGGMEVHKNRWIEDWNAGRENLEFNFRWTRRSLAVVGLFGLAVPILVYKGIVREFHMQDEDAGRPYRKFL

SEQ ID NO: 6428 - protein, 71 aa, Saccharum officinarum
MGGGMEVHKNKWIEEWNAGRENLEFNFRWTRRSLAVVGLFGLAVPILVYKGIVREFHMQDEDAGRPPRKFL

SEQ ID NO: 6429 - protein, 71 aa, Sorghum bicolor
MGGGMEVHKNKWIEEWNAGRENLEFNFRWTRRSLAVVGLFGLAVPILVYKGIVRDFHMQDEDAGRPPRKFL

SEQ ID NO: 6430 - protein, 71 aa, Musa acuminata
MGGGMEVNKNKYIEDWNAARENLELNFRWTRRNLALIGIFGLAVPILVYKGIVREFHMQDEDAGRPLRKFL

SEQ ID NO: 6431 - protein, 71 aa, Panicum virgatum
MGGGMEVHKNRWIEEWNAGRENLEFNFRWTRRSLAVVVLFGFAVPILVYKGIVREFHMQDEVVGRPLRKFL

SEQ ID NO: 6432 - protein, 81 aa, Triticum aestivum
  misc_feature (8)..(8): Xaa can be any naturally occurring amino acid
  misc_feature (13)..(14): Xaa can be any naturally occurring amino acid
  misc_feature (23)..(23): Xaa can be any naturally occurring amino acid
  misc_feature (47)..(47): Xaa can be any naturally occurring amino acid
  misc_feature (72)..(73): Xaa can be any naturally occurring amino acid
  misc_feature (81)..(81): Xaa can be any naturally occurring amino acid
RKQEAADXGEETXXWVAAWEVNXNRWIEEWNAGRENLELNFRFTRRXLAVIGLFGPRRPHPRPQRASFANSXXRTRTPGRX

SEQ ID NO: 6433 - protein, 71 aa, Elaeis guineensis
MGGGMEVNKNRWIEEWNAGRENLEFNFRWTRRNLAIVGIFGIAVPILIYKGIVNEFHMQDEDAGRPLRKFL

SEQ ID NO: 6434 - protein, 71 aa, Elaeis guineensis
MGGGMEVNKNRWIEAWNAGRENLEFNFRWTRRNLAIVGIFGVAVPILIYKGIVNEFHMQDEDAGRPLRKFL

SEQ ID NO: 6435 - protein, 71 aa, Aristolochia fimbriata
MAGGLEVKKNKFIEEWNAGRENLEFNFRWTRRNWALIGIFGVAVPILVYKGIVREFHMQDEDAGRPYRKFL

SEQ ID NO: 6436 - protein, 71 aa, Catharanthus roseus
MGGGMEAHKNRWIEDWSTARENLEHNFRWTRRNLAIVGLFGIAVPILVYKGIVREFHMQDEDAGRPYRKFL

SEQ ID NO: 6437 - protein, 70 aa, Secale cereale
MGGGMEVNKNRWIEEWNAGRENLELNFRFTRRSLAVIGLFGLAVPILVYRASSAIPYAGRDARRPYRKFL

SEQ ID NO: 6438 - protein, 71 aa, Zostera marina
MGGGMEVNKNKFIEDWNAGRENLELNFRFTRRNLALIGIFGIAVPMLLYRGIVKDFHMQDEDAGRPHRKFL

SEQ ID NO: 6439 - protein, 112 aa, Secale cereale
MGGGMGVNKNRWIEEWNAGRENLELNFRFTRRSLAVIGLFGLAVPILVYKGIVANHMQTRTRAYRVCERRLQWMSRLRAVCRVSQVKDLHSVVPVCRNQTGVFVLTMLCVDK

SEQ ID NO: 6440 - protein, 73 aa, Lippia dulcis
MGGGMEVNKNRWVEEWGAARENLELNFRWTRRNLALVGIFGIAVPVLVYKGIVKDFHMQDEDAGRPYRKFWFS

SEQ ID NO: 6441 - protein, 71 aa, Unknown
  Sequence found in Organisms: Rosa hybrid cultivar, Fragaria vesca
MGGGMEANKNRFVEEWGAARENLEHNFRWTRRNFAIIGIFGIAIPVLVYKGIVREFHMQDEDAGRPYRKFL

SEQ ID NO: 6442 - protein, 71 aa, Antirrhinum majus
MGGGMEANKNRWIEDWGSARENLEHNFRWTRRNFALIGIFGIAIPVLVYKGIVREFHMQDEDAGRPYRKFL

SEQ ID NO: 6443 - protein, 71 aa, Unknown
  Sequence found in Organisms: Citrus sinensis, Citrus clementina, Citrus sinensis
MGGGMEANKNRFIEEWGAARENLEHNFRWTRRNLALVGLFGIAVPVFIYKGIVKEFHMQDEDAGRPYRKFL

SEQ ID NO: 6444 - protein, 71 aa, Cleome spinosa
MGGGMETNKNRFIEDWSSARENLEHNFRWTRRNLALVGIFGIALPILVYKGIVREFHMQDEDAGRPYRKFL

SEQ ID NO: 6445 - protein, 71 aa, Euphorbia peplus
MGGGMEVNKNKFIEDWGSARENLEHNFRWTRRNFALIGLFGIAVPILVYKGIVKEFNMQDEDAGRPYRKFL

SEQ ID NO: 6446 - protein, 71 aa, Actinidia deliciosa
MGGGMEVNKNKFIEEWGTVRENLEYNFRWTRRNFAIIGLFGIAVPIFIYKGIVREFHMQDEDAGRPYRKFM

SEQ ID NO: 6447 - protein, 71 aa, Silene vulgaris
MGGGMEANKNKFIEDWGSARENLELNFRWTRRNFALIGIFGIAVPLLVYKGIVREFHMQDEDAGRPYRKFL

SEQ ID NO: 6448 - protein, 71 aa, Tabernaemontana elegans
MGGGMEAHKNRWIEDWSTARENLEHNFRWTRRNLAIVGLFGIAVPVLIYKGIVREFHMQDEDAGRPYRKFL

SEQ ID NO: 6449 - protein, 71 aa, Juglans hindsii x Juglans regia
MGGGMEANKNKFIEDWGSARENLEHNFRWTRRNFALVGIFGLAVPILVYKGIVREFHMQDEDAGRPYRKFL

SEQ ID NO: 6450 - protein, 73 aa, Sesamum indicum
MGGGMEAHKNRWIEDWSSARENLELNFRWTRRNLALVGIFGVAVPILVYKGIVKEFHMQDEDAGRPYRKFWMA

SEQ ID NO: 6451 - protein, 73 aa, Orobanche aegyptiaca
MGGGMEANKNRWIEEWASARENLEFNFRWTRRNFALVGLFGIAVPVLVYKGIVKEFHMQDEDAGRPYRKFWWT

SEQ ID NO: 6452 - protein, 86 aa, Euphorbia esula
  misc_feature (6)..(7): Xaa can be any naturally occurring amino acid
RAESKXXRNQQIEEKMGGGMEVNKNKFIEDWGSARENLEHNFRWTRRNFALIGLFGIAVPILVYKGIVKEFNMQDEDAGRPYRKFL

SEQ ID NO: 6453 - protein, 262 aa, Hordeum vulgare
MRRYSPQYRSPPRRGYGGRGRSPPRRGYGGRREQGSGSLLVRNIPLSCRPEDLRVPFERFGPVRDVYLPKDYYTREPRGFAFVEFVDPYDASDAQYHLNRSLFFGREITVVVAAESRKRPDDMRNRARVRGYSGEPERRNSRYGRSRSRSRSYSPRYRGRPRSRSRSYSPAPRRRDDYSASPPRSHHTQSPRRLPKGHEEDERRSYSPAGRGGGERDADTNGKRRSPPSDIDRSPPRSRRHSSGSPVGSRSRSPEASPARSD

SEQ ID NO: 6454 - protein, 264 aa, Triticum aestivum
MRRYSPQYRSPPRRGYGGRGRSPPRRGYGGRREQGSGSLLVRNIPLSCRPEDLRVPFERFGPVRDVYLPKDYYTREPRGFAFVEFVDPYDASDAQYHLNHTVFCGREITVVVASESRKRPDDMRNRARIRGYSGEPERRHSRYGRSRSRSRSYSPRYRGRPRSRSRSYSPAPRRRDDYSASPPRSHHTQSPRRLPKGHEEDERRSYSPAGRGGGERDADTNGKRSPPSDTEGSPPRTRRSPRQSSGSPVGSRSRSPEASPARSD

SEQ ID NO: 6455 - protein, 266 aa, Triticum aestivum
MRRYSPQYRSPPRRGYGGRGRSPPRRGYGGRREQGSGSLLVRNIPLSCRPEDLRVPFERFGPVRDVYLPKDYYTREPRGFAFVEFVDPYDASDAQYHLNHTVFCGREITVVVAAESRKRPDDMRNRARIRGYSGEPERRHSRYGRSRSRSCSYSPRYRGRPRSRSRSRSYSPAPRRRDDYSASPPRSHHTQSPRRLPKGHEEDERRSYSPAGRGGGERDANTNGKRSPPSDIDGSPPRIRRSPRQSSGSPVGSRSRSPEASPARSD

SEQ ID NO: 6456 - protein, 256 aa, Triticum aestivum
PPRRGYGGRGRSPPRRGYGGRREQGSGSLLVRNIPLSCRPEDLRVPFERFGPVRDVYLPKDYYTREPRGFAFVEFVDPYDASDAQYHLNHTVFCGREITVVVAAESRKRPDDMRNRARIRGYSGEPERRHSRYGRSRSRSRSYSPRYRGRPRSRSRSRSYSPAPRRRDDYSASPPRSHHTQSPRRLPKGHEEDERRSYSPAGRGGGERDADTNGKRSPPSDTEGSPPRTRRSPRQSSGSPVGSRSRSPEASPARSD

SEQ ID NO: 6457 - protein, 282 aa, Secale cereale
MGRYSPQYRSPPRRGYGGRGRSPPRRGYGGRREQSSGSLLVRNIPLSCRPEDLRVPFERFGPVRDVYLPKDYYTREPRGFAFVEFVDPYDASDAQYHLNHTLFFGREITVVVAAESRKRPDDMRNRARIRGYSGEPERRHSRHGRSRSRSRSYSPRYRGRPQSRSRSRSRSYSPAPRRRGDYSASPPRSHHTQSPRRLPKGHEEDKRRSYSPAGRGSGERDADTNGKRSPPSDIDGSPPRSRRSPRQSSGSPPRTRRSPRQSSGSPVGSRSRSPEASPARSD

SEQ ID NO: 6458 - protein, 263 aa, Oryza sativa
MRRYSPPYRSPPRRGYGGRGRSPPRRGYGGRREQGSGSLLVRNIPLSCRGEDLRVPFERFGPVRDVYLPKDYYSGEPRGFAFVEFVDPYDASEAQYHMNRQVFFGREITVVLAAESRKRPEEMRSRARVRGYSGNEGRRSSYYGRSRSRSRSPHYRGRPRSRSYSPAPRRRDDYSASPPRKDTHPTKSPRRQPKEHDEEKKRRSYSPASRDGDPRDADNGYEKRSPPPDSDGSPPHRRSPRHSSGSPPGSRSRSADVSPARSD

SEQ ID NO: 6459 - protein, 172 aa, Pseudoroegneria spicata
MVKYSRDPSNPTKSAKACGKDLRVHFKNTRETAFALRKMPLGKAKRYLEDVLAHKQAIPFRRYCRGVGRTAQVKNRQPNGQGRWPAKSAQFVLDLLKNAESNAEVKGLDVDNLYISHIQVNQAQKQRRRTYRAHGRINPYMSNPCHIELILSEKEEPVKKEADNVVAPRKAI

SEQ ID NO: 6460 - protein, 172 aa, Secale cereale
MVKYSRDPSNPTKSAKACGKDLRVHFKNTRETAFALRKMALGKAKRYLEDVLAHKQAIPFRRYCRGVGRTAQVKNRQPNGQGRWPAKSAQFVLDLLKNAESNAEVKGLDVDNLYISHIQVNQAQKQRRRTYRAHGRINPYMSNPCHIELILSEKEEPVKKEADNVVAPRKAI

SEQ ID NO: 6461 - protein, 89 aa, Secale cereale
STHPPIPPLRPQPHRRRHGEVLEDPSNPTKSAKACGKDLRVHFKNTRETAFALRKMALGKAKRYLEDVLPTSKRFPSGDTAEVWAVLRK

SEQ ID NO: 6462 - protein, 172 aa, Brachypodium distachyon
MVKYSRDPSNPTKSAKACGKDLRVHFKNTRETAFALRKMPLVKAKRYLEDVLAHKQAIPFRRYCRGVGRTAQAKNRQSNGQGRWPAKSAKFVLDLLKNAESNAEVKGLDVDTLYISHIQVNQAQKQRRRTYRAHGRINPYMSNPCHIELILSEKEEPVKKEPDNVVAPRKAM

SEQ ID NO: 6463 - protein, 172 aa, Avena sativa
MVKYSRDPSNPTKSAKACGKDLRVHFKNTRETAFALRKMPLNKAKRYLEDVLAHKQAIPFRRYCRGVGRTAQAKNRQPNGQGRWPAKSAQFVLDLLKNAESNAEVKGLDVDSLYISHIQVNQAMKQRRRTYRAHGRINPYMSNPCHIELILSEKEEPVKKEPDNVVAQRKAV

SEQ ID NO: 6464 - protein, 171 aa, Avena sativa
MVKYSTDPVNPTKSAKAMGRDLRVHFKNTRETAFALRKMPLNKAKRYLEDVLAHKQAIPFRRYCRGVGRTAQAKNRQPNGQGRWPAKSAQFVLDLLKNAESNAEVKGLDVDALYISHIQVNQAQKQRRRTYRAHGRINPYMSNPCHIELILSEKEEPVKKEAESQIAPRKA

SEQ ID NO: 6465 - protein, 170 aa, Hordeum vulgare
MVKYSTDPANPTKSAKAMGRDLRVHFKNTRETAFALRKMPLNKAKRYLEDVLAHKQAIPFRRYCRGVGRTAQVKNRQPNGQGRWPAKSAKFVLDLLKNAESNAEVKGLDVDALYISHIQVNQAQKQRRRTYRAHGRINPYMSNPCHIELILSEKEEPVKKEAESQIARKA

SEQ ID NO: 6466 - protein, 170 aa, Secale cereale
MVKYSTDPANPTKSAKAMGRDLRVHFKNTRETAFSLRKMPLNKAKRYLEDVLAHKQAIPFRRYCRGVGRTAQVKNRQPNGQGRWPAKSAKFVLDLLKNAESNAEVKGLDVDALYISHIQVNQAQKQRRRTYRAHGRINPYMSNPCHIELILSEKEEPVKKEAESQIARKA

SEQ ID NO: 6467 - protein, 170 aa, Unknown
  Sequence found in Organisms: Pseudoroegneria spicata, Triticum aestivum
MVKYSTDPANPTKSAKAMGRDLRVHFKNTRETAFALRKMSLNKAKRYLEDVLAHKQAIPFRRYCRGVGRTAQVKNRQPNGQGRWPAKSAKFVLDLLKNAESNAEVKGLDVDALYISHIQVNQAQKQRRRTYRAHGRINPYMSNPCHIELILSEKEEPVKKEAESQIARKA

SEQ ID NO: 6468 - protein, 171 aa, Brachypodium distachyon
MVKYSTDPANPTKSAKAMGRDLRVHFKNTRETAFALRKMPLGKAKRYLEDVLAHKQAIPFRRYCRGVGRTAQAKNRQSNGQGRWPAKSAKFVLDLLKNAESNAEVKGLDVDALYISHIQVNQAQKQRRRTYRAHGRINPYMSNPCHIELILSEKEEPVKKEPESQIASRKA

SEQ ID NO: 6469 - protein, 104 aa, Secale cereale
MVKYSTDPANPTKSAKAMGRDLRVHFKNTRETAFSLRKMSLNKAKRYLEDVWHTSKLSPSGGTAVVLGVRPRLRTASQMVRDAGLPSLLSSFWIFLRTQRAMLR

SEQ ID NO: 6470 - protein, 171 aa, Pennisetum glaucum
MVKYSRDPSNPTKSAKAMGRDLRVHFKNTRETAFALRKMPLTKAKRYLEDVLAHKQAIPFRRYCGGVGRTAQAKSRHSNGQGRWPVKSARFILDLLKNAESNAEVKGLDVDTLYISHIQVNQAQKQRRRTYRAHGRINPYMSSPCHIELILSEKEEPVKKEAESQIATRKA

SEQ ID NO: 6471 - protein, 81 aa, Secale cereale
MALGKAKRYLEDVLAHKQAIPFRRYCRGVGRTAQVKNRQPNGQGRWPAKSAQFVLDLLKNAESNAEVKAWMSTTSTFHTSR

SEQ ID NO: 6472 - protein, 171 aa, Cynodon dactylon
MVKYSTEPVNPTKSAKAMGRDLRVHFKNTRETAFALRKMPLTKAKRYLEDVIAHKQAIPFRRYCGGVGRTAQAKNRQPNGQGRWPAKSARFILDLLKNAESNAEVKGLDVDTLYISHIQVNQAQKQRRRTYRAHGRINPYMSSPCHIELIVSEKEEPVKKEAESQIATRKA

SEQ ID NO: 6473 - protein, 171 aa, Pennisetum glaucum
MVKYSRDPSNPTKSAKAMGRDLRVHFKNTRETAFALRKMPLTKAKRYLEDVLAHKQAIPFRRYCGGVGRTAQAKSRHSNGQGRWPVKSARFILDLLKNAESNAEVKGLDVDALYVSHIQVNQAQKQRRRTYRAHGRINPYMSSPCHIELILSEKEEPVKKEAESQIATRKA

SEQ ID NO: 6474 - protein, 70 aa, Eragrostis curvula
  misc_feature (13)..(14): Xaa can be any naturally occurring amino acid
RENPPDARARRPXXSRVLWLSALLPARALSLRIEVRRRLSHGEVLHGTGQSHQVRQGHGPGPPCSLQEHP

SEQ ID NO: 6475 - protein, 171 aa, Pennisetum glaucum
MVKYSQEAGNPTKSAKAMGRDLRVHFKNTRETAFALRKMPLAKAKRYLEDVMAHKQAIPFRRYCGGVGRTAQAKSRHSNGQGRWPVKSARFILDLLKNAESNADVKGLDVDNLYISHIQVNQAQKQRRRTYRAHGRINPYMSSPCHIELILSEKEEPVKKEPDNIVAPRKQ

SEQ ID NO: 6476 - protein, 171 aa, Setaria italica
MVKYSQEAGNPTKSAKAMGRDLRVHFKNTRETAFALRKLPLAKAKRYLEDVMAHKQAIPFRRYCRGVGRTAQAKSRHSNGQGRWPVKSARFILDLLKNAESNADVKGLDVDNLYVSHIQVNQAQKQRRRTYRAHGRINPYMSSPCHIELILSEKEEPVKKEPDNIVAPRKQ

SEQ ID NO: 6477 - protein, 171 aa, Unknown
  Sequence found in Organisms: Zea mays, Saccharum officinarum
MVKYSQEPGNPTKSAKAMGRDLRVHFKNTRETAFALRKLPLTKAKRYLEDVIAHKQAIPFRRYCGGVGRTAQAKSRHSNGQGRWPVKSARFILDLLKNAESNADVKGLDVDNLYVSHIQVNQAQKQRRRTYRAHGRINPYMSSPCHIELILSEKEEPVKKEADNIVAARKQ

SEQ ID NO: 6478 - protein, 171 aa, Pennisetum glaucum
MVKYSQESGNPTKSAKAMGRDLRVHFKNTRETAFALRKMPLTKAKRYLEDVMAHKQAIPFRRYCGGVGRTAQAKSRHSNGQGRWPVKSARFILDLLKNAESNADVKGLDVDTLYISHIQVNQAQKQRRRTYRAHGRINPYMSSPCHIELILSEKEEPVKKEPDNIVAPRKQ

SEQ ID NO: 6479 - protein, 171 aa, Saccharum officinarum
MVKYSREPSNPTKSAKAMGRDLRVHFKNTRETAFAIRKLHLAKAKRYLEDVIAHKQAIPFRRYCGGVGRTAQAKSRHSNGQGRWPAKSARFILDLLKNAESNAEVKGLDVDTLYVSHIQVNQAQKQRRRTYRAHGRINPYMSSPCHIELMLSEKEEPVKKEADTQIAPRKA

SEQ ID NO: 6480 - protein, 171 aa, Panicum virgatum
MVKYSQEPGNPTKSAKAMGRDLRVHFKNTRETAFALRKLPLAKAKRYLEDVMAHKQAIPFRRYCGGVGRTAQAKSRHSNGQGRWPVKSARFILDLLKNAESNADVKGLDVDNLYVSHIQVNQAQKQRRRTYRAHGRINPYMSSPCHIELILSEKEEPVKKEADNIVASRKQ

SEQ ID NO: 6481 - protein, 171 aa, Panicum virgatum
MVKYSQEPGNPTKSAKAMGRDLRVHFKNTRETAFALRKLPLAKAKRYLEDVMAHKQAIPFRRYCGGVGRTAQAKSRHSNGQGRWPVKSAKFILDLLKNAESNADVKGLDVDNLYVSHIQVNQAQKQRRRTYRAHGRINPYMSSPCHIELILSEKEEPVKKEADNIVASRKQ

SEQ ID NO: 6482 - protein, 173 aa, Allium cepa
MVKYSRDPSNPTKSSKAMGQNLRVHFKNTRETAFALKKLPLEKAKRYLEDVIAHKQAIPFRRYCRGVGRTAQAKNHHPNGQGRWPAKSAQFILDLLKNAESNADVKGLDVDALYISHIQVNQAQKQRRRTYRAHGRINPYMSNPCHIELILSEKEEPVKKERETQIATTKPKN

SEQ ID NO: 6483 - protein, 171 aa, Cenchrus ciliaris
MVKYSRDPTNPTKSAKAMGRDLRVHFKNTRETAFALRKLSLTKAKRYLEDVIAHKQAIPFRRYCGGVGRTAQAKSRHSNGQGRWPVKSARFILDLLKNAESNAEVKGLDVDTLYVSHIQVNQAQKQRRRTYRAHGRINPYMSSPCHIELILSEKEEPVKKEAESQIATRKA

SEQ ID NO: 6484 - protein, 171 aa, Setaria italica
MVKYSREPTNPTKSAKAMGRDLRVHFKNTRETAFALRKLSLTKAKRYLEDVIAHKQAIPFRRYCGGVGRTAQVKSRHSNGQGRWPVKSARFILDLLKNAESNAEVKGLDVDTLYVSHIQVNQAQKQRRRTYRAHGRINPYMSSPCHIELILSEKEEPVKKEAESQIATRKA

SEQ ID NO: 6485 - protein, 171 aa, Zea mays
MVKYSQEPGNPTKSAKAMGRDLRVHFKNTRETAFALRKLSLTKAKRYLEDVIAHKQAIPFRRYCGGVGRTAQAKSRHSNGQGRWPVKSARFILDLLKNAESNADVKGLDVDNLYVSHIQVNQAQKQRRRTYRAHGRINPYMSSPCHIELILSEKEEPVKKEADNIVAARKQ

SEQ ID NO: 6486 - protein, 171 aa, Sorghum bicolor
MVKYSREPSNPTKSAKAMGRDLRVHFKNTRETAFAIRKLQLSKAKRYLEDVIAHKQAIPFRRYCGGVGRTAQAKSRHSNGQGRWPAKSAKFILDLLKNAESNAEVKGLDVDTLYVSHIQVNQAQKQRRRTYRAHGRINPYMSSPCHIELMLSEKEEPVKKEAETQIAPRKA

SEQ ID NO: 6487 - protein, 171 aa, Panicum virgatum
MVKYSREPNNPTKSAKAMGRDLRVHFKNTRETAFALRKLPLTKAKRYLEDVIAHKQAIPFRRYCGGVGRTAQAKSRHSNGQGRWPVKSARFILDLLKNAESNAEVKGLDVDTLYVSHIQVNQAQKQRRRTYRAHGRINPYMSSPCHIELILSEKEEPVKKEAESQIATRKA

SEQ ID NO: 6488 - protein, 171 aa, Panicum virgatum
MVKYSREPTNPTKSAKAMGRDLRVHFKNTRETAFALRKLPLTKAKRYLEDVIAHKQAIPFRRYCGGVGRTAQAKSRHSNGQGRWPVKSARFILDLLKNAESNAEVKGLDVDTLYVSHIQVNQAQKQRRRTYRAHGRINPYMSSPCHIELILSEKEEPVKKEAESQIATRKA

SEQ ID NO: 6489 - protein, 171 aa, Panicum virgatum
MVKYSQEPGNPTKSAKAMGRDLRVHFKNTRETAFALRKLPLTKAKRYLEDVMAHKQAIPFRRYCGGVGRTAQAKSRHSNGQGRWPVKSARFILDLLKNAESNADVKGLDVDNLYVSHIQVNQAQKQRRRTYRAHGRINPYMSSPCHIELILSEKEEPVKKEPDNIVASRKQ

SEQ ID NO: 6490 - protein, 171 aa, Panicum virgatum
MVKYSTEPSNPTKSAKAMGRDLRVHFKNTRETAFALRKLSLTKAKRYLEDVIAHKQAIPFRRYCGGVGRTAQAKSRHSNGQGRWPAKSARFILDLLKNAESNAEVKGLDVDTLYVSHIQVNQAQKQRRRTYRAHGRINPYMSSPCHIELILSEKEEPVKKEAESQIATRKA

SEQ ID NO: 6491 - protein, 171 aa, Unknown
  Sequence found in Organisms: Cenchrus ciliaris, Saccharum officinarum
MVKYSREPTNPTKSAKAMGRDLRVHFKNTRETAFALRKLSLTKAKRYLEDVIAHKQAIPFRRYCGGVGRTAQAKSRHSNGQGRWPVKSARFILDLLKNAESNAEVKGLDVDTLYVSHIQVNQAQKQRRRTYRAHGRINPYMSSPCHIELILSEKEEPVKKEAESQIATRKA

SEQ ID NO: 6492 - protein, 171 aa, Setaria italica
MVKYSQESGNPTKSAKAMGRDLRVHFKNTRETAFALRKLSLTKAKRYLEDVMAHKQAIPFRRYCGGVGRTAQAKSRHSNGQGRWPVKSARFILDLLKNAESNADVKGLDVDNLYVSHIQVNQAQKQRRRTYRAHGRINPYMSSPCHIELILSEKEEPVKKEPDNIVAPRKQ

SEQ ID NO: 6493 - protein, 171 aa, Sorghum bicolor
MVKYSREPSNPTKSAKAMGRDLRVHFKNTRETAFAIRKLQLSKAKRYLEDVIAHKQAIPFRRYCGGVGRTAQAKSRHSNGQGRWPAKSAKFILDLLKNAESNAEVKGLDVDTLYVSHIQVNQAQKQRRRTYRAHGRINPYMSSPCHIELMLSEKEEPVKKEAETQIAARKA

SEQ ID NO: 6494 - protein, 171 aa, Sorghum bicolor
MVKYSREPTNPTKSAKAMGRDLRVHFKNTRETAFALRKLSLTKAKRYLEDVIAHKQAIPFRRYCGGVGRTAQAKSRHSNGQGRWPVKSAKFILDLLKNAESNAEVKGLDVDTLYVSHIQVNQAQKQRRRTYRAHGRINPYMSSPCHIELILSEKEEPVKKEAESQIATRKA

SEQ ID NO: 6495 - protein, 171 aa, Panicum virgatum
MVKYSREPTNPTKSAKAMGRDLRVHFKNTRETAFALRKLPLTKAKRYLEDVIAHKQAIPFRRYCGGVGRTAQAKSRHSNGQGRWPVKSSRFILDLLKNAESNAEVKGLDVDTLYVSHIQVNQAQKQRRRTYRAHGRINPYMSSPCHIELILSEKEEPVKKEAESQIATRKA

SEQ ID NO: 6496 - protein, 184 aa, Chelidonium majus
MVKYSKEPDNPTKSCKARGSDLRVHFKNTRETAFSLRKMSLVKAKRYLEDVLAHKQAIPFRRFCRGVGRTAQAKNRHSNGQGRWPAKSAKFILDLLKNAESNADVKGLDVDSLYISHIQVNQAQKQRRRTYRAHGRINPYMSSPCHIELTLSEKEEAVKKEADTQLAPRKSKKGGQVLRSGASS

SEQ ID NO: 6497 - protein, 183 aa, Eschscholzia californica
MVKYSKEPDNPTKSCKARGSDLRVHFKNTRETAFSIRKLPLVKAKRYLEDVLAHKQAIPFRRYCGGVGRTAQAKNRHSNGQGRWPAKSAKFILDLLKNAESNADVKGLDVDSLYISHIQVNQAQKQRRRTYRAHGRINPYMSSPCHIELTLSEKEEPVKKEVDTQLAPRKAKKSHVLRSGASS

SEQ ID NO: 6498 - protein, 183 aa, Papaver somniferum
MVKYSKEPDNPTKSCKARGSDLRVHFKNTRETAFSLRKMPLVKAKRYLEDVLAHKQAIPFRRFCGGVGRTAQAKNRHSNGQGRWPAKSAKFILDLLKNAESNADVKGLDVDSLYISHIQVNQAQKQRRRTYRAHGRINPYMSSPCHIELTLSEKEEAVKKEADTQLAPRKSKKSQVLRSGASS

SEQ ID NO: 6499 - protein, 174 aa, Plantago ovata
MVKYSREPDNATKSCKARGSDLRVHFKNTRETAHALRKMPLVKAKRYLEDVLAHKQAIPFTRFCRGVGRTAQAKNRHSNGQGRWPVKSANFILDLLKNAESNAEVKGLDVDALYISHIQVNQAQKQRRRTYRAHGRINPYMSSPCHIELILSEKEEPVKKEAETQIAPTKTRKA

SEQ ID NO: 6500 - protein, 297 aa, Zingiber officinale
KEQVEAWKPIVSAVHAKGALFFCQIWHAGRSSITDFQPNGQAPISSTDKPVPTQYLHDGSVQEYPAPRRLTTEEIPQIVNDFRLAARNAIDAGFDGVEIHGANGYLIEQFMKDSTNDRGDEYGGGIDNRCRFALDVVEAVAEEVGGHRVGMRLSPFLDLMDCWDSDPEALGLHMAAKLNELGILYCHMLEPRMVKVEGRYQIPHRLLPMRKAFRGTFMVAGGYDREEGNKVVAEGYADLVVYGRLFLANPDLPRRFEVGAALNKYNRLTFYTPDPVVGYTDYPFLETSNFTQDNLDL

SEQ ID NO: 6501 - protein, 173 aa, Allium cepa
MVKYSRDPSNPTKSSKAMGQNLRVHFKNTRETAFALKKLPLEKAKRYLEDVIAHKQAIPFRRYCRGVGRTAQAKNHHSNGQGRWPAKSARFILDLLKNAESNADVKGLDVDALYISHIQVNQAQKQRRRTYRAHGRINPYMSNPCHIELILSEKEEPVKKERETQIATTKPKN

SEQ ID NO: 6502 - protein, 183 aa, Epimedium sagittatum
MVKYSREPDNPTKSCKAKGSDLRVHFKNTRETAFSIRKMPLIKAKRYLEDVLAHKQAIPFRRFCRGVGRTAQAKNAGHSNGQGRWPAKSAKFILDLLKNAESNADVKGLDVDSLYISHIQVNQAQKQRRRTYRAHGRINPYMSSPCHIELILSEKEEPVKKEAETQLAPRRSKKAALRSGASS

SEQ ID NO: 6503 - protein, 68 aa, Papaver somniferum
MVKYSKEPDNPTKSCKARGSDLRVHFKNTRETAFSLRKMPLVKAKRYLEDVLAHKQAIPFRRFLWWCW

SEQ ID NO: 6504 - protein, 183 aa, Malus domestica
MVKYSREPNNPTKSCKAQGEGLRVHFKNTRETAHAIRKMHLAKAKRYLEDVLAHKQAIPFRRFCRGVGRTAQAKNRQSNGQGRWPVKSANFILDLLKNAESNAEVKGLDVDSLYVSHIQVNQAQKQRRRTYRAHGRINPYMSSPCHIELILSEKEEAVKKEPDTQLAPRKSRKGQALQSGASS

SEQ ID NO: 6505 - protein, 183 aa, Malus domestica
MVKYSREPDNPTKSCKAQGEGLRVHFKNTRETAHAIRKMHLVKAKRYLEDVLAHKQAIPFRRFCRGVGRTAQAKNRQSNGQGRWPVKSANFILDLLKNAESNAEVKGLDVDSLYVSHIQVNQAQKQRRRTYRAHGRINPYMSSPCHIELILSEKEEAVKKEAETQLAPRKSRKGQALQSGASS

SEQ ID NO: 6506 - protein, 183 aa, Chelidonium majus
MVKYSKEPDNPTKSCKARGSDLRVHFKNTRETAFSLRKMSLVKAKRYLEDVLAHKQAIPFRRFCRGVGRTAQAKNRHSNGQGRWPAKSAKFILDLLKNAESNADVKGLDVDSLYISHIQVNQAQKQRRRTYRAHGRINPYMSSPCHIELTLSEKEEAVKKEVDTQLAPRKSRKSQVLRSGASS

SEQ ID NO: 6507 - protein, 171 aa, Setaria italica
MVKYSREPTNPTKSTKAMGRDLRVHFKNTRETAFALRKLSLTKAKRYLEDVIAHKQAIPFRRYCGGVGRTAQAKSRHSNGQGRWPVKSARFILDLLKNAESNAEVKGLDVDTLYVSHIQVNQAQKQRRRTYRAHGRINPYMSSPCHIELILSEKEEPVKKEAESQIATRKA

SEQ ID NO: 6508 - protein, 182 aa, Glycyrrhiza uralensis
MVKYSREPDNPTKSCKARGADLRVHFKNTRETAFAIRKLPLGKAKRYLEDVLAHKQAIPFRRFCGGVGRTAQAKNRHSNGQGRWPVKSAKFILDLLKNAESNAEVKGLDVDALYISHIQVNQAQKQRRRTYRAHGRINPYMSSPCHIELILSEKEEPVKKEPETQLATSKKKSQALRSGASS

SEQ ID NO: 6509 - protein, 183 aa, Prunus persica
MVKYSREPDNPTKSCKARGSDLRVHFKNTRETAHAIRKMQLGKAKSYLEDVLAHKQAIPFRRFCRGVGRTAQAKNRQSNGQGRWPVKSANFILDLLKNAESNAEVKGLDVDSLYVSHIQVNQAQKQRRRTYRAHGRINPYMSSPCHIELVLSEKEEPVKKEPETQLAPRKSRKGQALHSGASS

SEQ ID NO: 6510 - protein, 171 aa, Oryza sativa
MVKYSREANNPTKSSKAMGRDLRVHFKNTRETAFAIRKLPLGKAKRYLEDVIAHKQAIPFRRYCGGVGRTAQAKSRHSNGQGRWPAKSARFILDLLKNAESNAEVKGLDVDTLYVSHIQVNQAQKQRRRTYRAHGRINPYMSSPCHIELILSEKEEPVKKEPESQIAARKA

SEQ ID NO: 6511 - protein, 175 aa, Petunia hybrida
MVKYSREPENPTKSCKARGSDLRVHFKNTRETAHALRKMPLGKAKRYLEDVLAHKQAIPFTRFCRGVGRTAQAKNRHSNGQGRWPVKSANFILDLLKNAESNAEVKGLDVDSLYISHIQVNQAQKQRRRTYRAHGRINPYMSNPCHIELILSEKEESVRKEPETQLAPRKTKASA

SEQ ID NO: 6512 - protein, 173 aa, Lotus japonicus
MVKYSREPDNPTKSCKARGSDLRVHFKNTRETAHALRKLPLAKAKRYLEDVLAHKQAIPFRRFCRGVGRTAQAKNRHSNGQGRWPAKSAKFILDLLKNAESNAEVKGLDVDALHISHIQVNQAQKQRRRTYRAHGRINPYMSSPCHIELILSEKEEPVKKEPEAQLATSKRVA

SEQ ID NO: 6513 - protein, 183 aa, Musa acuminata
MVKYSREPANPTKSAKAMGQDLRVHFKNTRETAHALRKLPLSKAKRYLEDVIAHKQAIPFRRFCGGVGRTAQAKGRHPNGQGRWPAKSAGFILDLLKNAESNAEVKGLDVDALYISHIQVNQAPKQRRRTYRAHGRINPYMSSPCHIELILSEKEESVKKEPETQIAPSKPKKGQALRSGASS

SEQ ID NO: 6514 - protein, 83 aa, Epimedium sagittatum
PGVSAAGVDHSHGEVLKEPDNPTKSCKAKGADLRVHFKNTRETAFSIRKCLWSRQKDIWRMCLLTSKQFLSDDSVEVLVGLLK

SEQ ID NO: 6515 - protein, 183 aa, Amorphophallus konjac
MVKYSREPGNPTKSAKAMGRDLRVHFKNTRETAHAIRKLPLGKAKRYLEDVIAHKQAIPFTRFCRGVGRTAQAKNRHPNGQGRWPMKSARFILDLLKNAESNAEVKGLDVDTLYISHVQVNQAQKQRRRTYRAHGRINPYMSSPCHIELILSEKEEAVKKEPETQLATRKPKKSQALRSGASS

SEQ ID NO: 6516 - protein, 183 aa, Musa acuminata
MVKYSREPANPTKSAKAMGRDLRVHFKNTRETAHALRKLPLSKAKRYLEDVIAHKQAIPFRRFCRGVGRTAQAKGRHPNGQGRWPMKSASFILDLLKNAESNAEVKGLDVDALYISHIQVNQAPKQRRRTYRAHGRINPYMSSPCHIELILSEKEESVKKEPETQIAPSKPKKAQALRSGASS

SEQ ID NO: 6517 - protein, 181 aa, Vigna unguiculata
MVKYSREPNNPTKSCKARGADLRVHFKNTRETAFAIRKLPLVKAKRYLEDVLAHKQAIPFRRFCRGVGRTAQAKNRHSNGQGRWPVKSAKFILDLLKNAESNAEVKGLDVDALYISHIQVNQAQKQRRRTYRAHGRINPYMSSPCHIELILSEKEEPVRKEPETKLATSKKSQALRSGASS

SEQ ID NO: 6518 - protein, 182 aa, Unknown
  Sequence found in Organisms: Cyamopsis tetragonoloba, Glycyrrhiza uralensis
MVKYSREPDNPTKSCKARGADLRVHFKNTRETAFAIRKLPLAKAKRYLEDVLAHKQAIPFRRFCGGVGRTAQAKNRHSNGQGRWPVKSAKFILDLLKNAESNAEVKGLDVDALYISHIQVNQAQKQRRRTYRAHGRINPYMSSPCHIELILSEKEEPVKKEPETQLATSKKKSQALRSGASS

SEQ ID NO: 6519 - protein, 181 aa, Eschscholzia californica
MVKYSKEPDNPTKSCKARGADLRVHFKNTRETAFSIRKLPLVKAKRYLEDVLAHKQAIPFRRFCGGVGRTAQAKNRHSNGQGRWPAKSAKFILDLLKNAESNADVKGLDVDSLYISHIQVNQAQKQRRRTYRAHGRINPYMSSPCHIELTLSEKEEPVKKEADTQLASRKPKKVLRSGASS

SEQ ID NO: 6520 - protein, 181 aa, Carpinus betulus
VKYSREPDNPTKSCKARGSDLRVHFKNTRETAFAIRKLPLIKAKRYLEDVLAHKQAIPFRRFCRGVGRTAQAKNRHSNGQGRWPAKSAKFILDLLKNAESNAEVKGLDVDSLHISHIQVNQAQKQRRRTYRAHGRINPYMSSPCHIELTLSEKEEPVKKEPETQLAPKKSKTQALRSGASS

SEQ ID NO: 6521 - protein, 182 aa, Carpinus betulus
MVKYSREPDNPTKSCKARGSDLRVHFKNTRETAFAIRKLPLIKAKRYLEDVLAHKQAIPFRRFCRGVGRTAQAKNRHSNGQGRWPAKSAKFILDLLKNAESNAEVKGLDVDSLHISHIQVNQAQKQRRRTYRAHGRINPYMSSPCHIELTLSEKEEPVKKEPETQLAAKKSKTQALRSGASS

SEQ ID NO: 6522 - protein, 183 aa, Carpinus betulus
MVKYSREPDNPTKSCKARGSDLRVHFKNTRETAFAIRKLPLVKAKRYLEDVLAHKQAIPFRRFCRGVGRTAQAKNRHSNGQGRWPAKSAKFILDLLKNAESNAEVKGLDVDALHISHIQVNQAQKQRRRTYRAHGRINPYMSSPCHIELVLSEKEEPVKKEPETQLATSKSKKSQALRSGASS

SEQ ID NO: 6523 - protein, 183 aa, Actinidia deliciosa
MVKYSREPDNPTKSCKARGSDLRVHFKNTRETAHAIRKMPLTKAKRYLEDVLAHKQAIPFTRFCRGVGRTAQAKNRHSNGQGRWPVKSAGFILDLLKNAESNAEVKGLDVDTLYISHIQVNQAQKQRRRTYRAHGRINPYMSSPCHIELILSEKEEPVKKEPESQLATSKSRKSQALRSGVSS

SEQ ID NO: 6524 - protein, 182 aa, Elaeis guineensis
MVKYSREPNNPTKSAKAMGQDLRVHFKNTRETAHAIRKLPLGKARRYLEDVIAHKQAIPFRRFCGGVGRTAQAKSRHANGQGRWPVKSARFILDLLKNAESNAEVKGLDVDALYISHIQVNQAQKQRRRTYRAHGRINPYMSSPCHIELILSEKEEPVKKEPESQIAPRKPKKVALRSGTSS

SEQ ID NO: 6525 - protein, 192 aa, Allium cepa
MVKYSREPDNITKSAKAMGRDLRVHFKNTRETAFSIRKMPLAKAKRYLEDVVAHKQAIPFRRYCRGVGRTAQAKNRHSNGQGRWPMKSAKFILDLLKNAESNAEVKGLDVDALYISHIQVNQAQKQRRRTYRAHGRINPYMSSPCHIELILSEKEEPVKKEPETQLATKSKNPLKSGGIVLSFCSEIFWTKV

SEQ ID NO: 6526 - protein, 181 aa, Arachis hypogaea
MVKYSREPENPTKSCKARGSDLRVHFKNTRETAFAIRKLPLVKAKRYLEDVLAHKQAIPFRRFCGGVGRTAQAKNRHSNGQGRWPVKSAKFILDLLKNAESNAEVKGLDVDALYISHIQVNQAQKQRRRTYRAHGRINPYMSSPCHIELILSEKEEPVKKEPESQLATSKKSQGLRSGASS

SEQ ID NO: 6527 - protein, 182 aa, Arachis hypogaea
MVKYSREPENPTKSCKARGSDLRVHFKNTRETAFAIRKLPLVKAKRYLEDVLAHKQAIPFRRFCGGVGRTAQAKNRHSNGQGRWPVKSAKFILDLLKNAESNAEVKGLDVDALYISHIQVNQAQKQRRRTYRAHGRINPYMSSPCHIELILSEKEEPVKKEPETQLATSKKKSQAIRSGASS

SEQ ID NO: 6528 - protein, 181 aa, Unknown
  Sequence found in Organisms: Glycine max, Cajanus cajan
MVKYSREPDNPTKSCKARGADLRVHFKNTRETAFAIRKLPLVKAKRYLEDVLAHKQAIPFRRFCRGVGRTAQAKNRHSNGQGRWPVKSAKFILDLLKNAESNAEVKGLDVDALYISHIQVNQAQKQRRRTYRAHGRINPYMSSPCHIELILSEKEEPVKKEPETKLTTSKKSQALRSGASS

SEQ ID NO: 6529 - protein, 182 aa, Papaver somniferum
VKYSKEPDNPTKSCKARGSDLRVHFKNTRETAFSLRKMSLVKAKRYLEDVLAHKQAIPFRRFCGGVGRTAQAKNRHSNGQGRWPAKSAKFILDLLKNAESNADVKGLDVDSLYISHIQVNQAQKQRRRTYRAHGRINPYMSSPCHIELTLSEKEEAVKKEADTQLAPRKSKKSQVLRSGASS

SEQ ID NO: 6530 - protein, 145 aa, Papaver somniferum
MSLVKAKRYLEDVLAHKQAIPFRRFCGGVGRTAQAKNRHSNGQGRWPAKSAKFILDLLKNAESNADVKGLDVDSLYISHIQVNQAQKQRRRTYRAHGRINPYMSSPCHIELTLSEKEEAVKKEADTQLAPRKSKKSQVLHSGASS

SEQ ID NO: 6531 - protein, 182 aa, Tripterygium wilfordii
MVKYSREPSNPTKSCKARGSDLRVHFKNTRETAFAIRKLALVKAKRYLEDVIAHKQAIPFRRFCRGVGRTAQAKNRHSNGQGRWPMKSATFILDLLKNAESNAEVKGLDVDALYVSHIQVNQAQKQRRRTYRAHGRINPYMSSPCHIELILSEKEEPVQKEPETQLAPRKPKGKALRSGASS

SEQ ID NO: 6532 - protein, 171 aa, Setaria italica
MVKYSREPSNPTKSAKAMGRDLRVHFKNTRETAFAIRKLQLTKAKRYLEDVIAHKQAIPFHRYCGGVGRTAQAKSRHSNGQGRWPVKSARFILDLLKNAESNAEVKGLDVDTLYVSHVQVNQAQKQRRRTYRAHGRINPYMSSPCHIELILSEKEEPVKKEAETQIATRKA

SEQ ID NO: 6533 - protein, 172 aa, Fraxinus spp
MVKYSREPDNPTKSCKARGSDLRVHFKNTRETAHALRKMPLSKAKRYLEDVLAHKQAIPFTRFCGGVGRTAQAKNRHSNGQGRWPVKSANFILDLLKNAESNAEVKGLDVDSLYISHIQVNQARKQRRRTYRAHGRINPYMSSPCHIELILSEKEEPVKKEPETQLAPKKTK

SEQ ID NO: 6534 - protein, 172 aa, Fraxinus spp
MVKYSREPENPTKSCKARGSDLRVHFKNTRETAHALRKMPLSKAKRYLEDVLAHKQAIPFTRFCGGVGRTAQAKNRHSNGQGRWPVKSANFILDLLKNAESNAEVKGLDVDSLYISHIQVNQARKQRRRTYRAHGRINPYMSSPCHIELILSEKEEPVKKEPETQLAPKKTK

SEQ ID NO: 6535 - protein, 171 aa, Zea mays
MVKYSTEPTNPTKSAKAMGRDLRVHFKNTRETAFALRKLSLTKAKSYLEDVIAHKQAIPFRRYCGGVGRTAQAKSRHSNGQGRWPVKSAKFILDLLKNAESNAEVKGLDVDTLYVSHIQVNQAQKQRRRTYRAHGRINPYMSSPCHIELILSEKEEPVKKEAESQIATRKA

SEQ ID NO: 6536 - protein, 171 aa, Oryza sativa
MGKYSTEPSNPTKSAKAMGRDLRVHFKNTRETAFALRKLPLVKAKRYLEDVIAHKQAIPFRRYCGGVGRTAQVKSRQSNGQGRWPAKSARFILDLLKNAESNADVKGLDVDNLFVSHIQVNQAQKQRRRTYRAHGRINPYMSSPCHVELILSEKEEAVKKEPETTIAPRRQ

SEQ ID NO: 6537 - protein, 174 aa, Ipomoea batatas
MVKYSREPDNPTKSCKARGSDLRVHFKNTRETAHAIRKLPLTKAKRYLEDVLAHKQAIPFTRFCRGVGRTAQAKNRHPNGQGRWPVKSARFILDLLKNAESNAEVKGLDVDTLFISHIQVNQAQKQRRRTYRAHGRINPYMSSPCHIELILSEKEEPVKKEPESQLATSKPRKA

SEQ ID NO: 6538 - protein, 173 aa, Unknown
  Sequence found in Organisms: Solanum lycopersicum, Ocimum basilicum, Solanum tuberosum, Solanum phureja
MVKYSREPDNPTKSCKSRGSSLRVHFKNTRETAHALRKMPLDKAKRYLEDVLAHKQAIPFTRFCRGVGRTAQAKNRHSNGQGRWPVKSAGFILDLLKNAESNAEVKGLDVDSLYISHIQVNEAQKQRRRTYRAHGRINPYMSHPCHIELILSEKEESVKKEPETQLAPRKAKA

SEQ ID NO: 6539 - protein, 172 aa, Trifolium pratense
MVKYSREPDNPTKSTKARGADLRVHFKNTRETAFAIRKLPLIKAKRYLEDVLAHKQAIPFRRFCRGVGRTAQAKNRHSNGQGRWPAKSAKFILDLLKNAESNAEVKGLDVDALYVSHIQVNQAQKQRRRTYRAHGRINPYMSSPCHIELILSEKEEAVRKEPESQLATSKKA

SEQ ID NO: 6540 - protein, 173 aa, Solanum melongena
MVKYSREPDNPTKSCKARGSNLRVHFKNTRETAHALRKMPLDKAKRYLEDVLAHKQAIPFTRFCRGVGRTAQAKNRHSNGQGRWPVKSAGFILDLLKNAESNAEVKGLDVDSLYISHIQVNEAQKQRRRTYRAHGRINPYMSHPCHIELILSEKEESVKKEPETQLAPRKTKA

SEQ ID NO: 6541 - protein, 183 aa, Musa acuminata
MVKYSREPTNPTKSSKAMGRDLRVHFKNTRETAHAIRKLPLAKAKRYLEDVIAHKQAIPFRRFCGGVGRTAQVKGRHPNGQGRWPLKSARFILDLLKNAESNAEVKGLDVDALYISHIQVNQAQRQRRRTYRAHGRINPYMSSPCHIELILSEKEEPVKKEPETQIAPSKPKKSQAIRSGASS

SEQ ID NO: 6542 - protein, 183 aa, Musa acuminata
MVKYSREPSNPTKSAKAMGRDLRVHFKNTRETAHAIRKLPLSKAKRYLEDVIAHKQAIPFRRFCGGVGRTAQAKGRHPNGQGRWPLKSARFILDLLKNAESNAEVKGLDVDALFISHIQVNQAQRQRRRTYRAHGRINPYMSSPCHIELILSEKEEPVKKEPETQIAPSKPKKAQAIRSGASS

SEQ ID NO: 6543 - protein, 181 aa, Phaseolus coccineus
MVKYSREPNNPTKSCKARGADLRVHFKNTRETAFAIRKLPLVKAKRYLEDVLAHKQAIPFRRFCRGVGRTAQAKSRHSNGQGRWPVKSAKFILDLLKNAESNAEVKGLDVDALYISHIQVNQAQKQRRRTYRAHGRINPYMSSPCHIELILSEKEEPVRKEPETNLATSKKSQALRSGASS

SEQ ID NO: 6544 - protein, 181 aa, Phaseolus coccineus
MVKYSREPDNPTKSCKARGADLRVHFKNTRETAFAIRKLPLVKAKRYLEDVLAHKQAIPFRRFCRGVGRTAQAKSRHSNGQGRWPVKSAKFILDLLKNAESNAEVKGLDVDALYISHVQVNQAQKQRRRTYRAHGRINPYMSSPCHIELILSEKEEPVKKEPETQLATSKKKGALRSGASS

SEQ ID NO: 6545 - protein, 183 aa, Vaccinium corymbosum
MVKYSREPDNPTKSCKARGSDLRVHFKNTRETAHAIRKLPLTKAKRYLEDVLAHKQAIPFTRFCRGVGRTAQAKNRHSNGQGRWPVKSAKFVLDLLKNAESNAEVKGLDVDSLYISHIQVNQAQKQRRRTYRAHGRINPYMSSPCHIELTLSEKEEPVKKEPESQLATGKSRKSQSLRSGASS

SEQ ID NO: 6546 - protein, 183 aa, Persea americana
MVKYSREPDNSTKSCKARGSDLRVHFKNTRETAFAIRKLPLGKAKRYLEDVIAHKQAIPFRRFCRGVGRTAQAKNRHSNGQGRWPMKSAKYILDLLKNAESNAEVKGLDVDTLFISHIQVNQAQKQRRRTYRAHGRINPYMSSPCHIELILSEKEESVKKEPETQLAPRKTKKSQALRSGTSS

SEQ ID NO: 6547 - protein, 103 aa, Phaseolus coccineus
MVKYSREPNNPTKSCKARGADLRVHFKNTRETAFAIRKLPLVKAKRYLEDVLAHKQAIPFRRFCRGVGRTAQAKSRHSNGQGRWPVKSAKFILDLLKKCREQC

SEQ ID NO: 6548 - protein, 713 aa, Theobroma cacao
MQARGDNLYNTVKAFAESPKLKNALERESFGISDDYNDERAIFFDYLTSFMIFYSRRVAVVLHSIPIAIFLIMPFYLRLNCGLCCCFSTFYDFVKGMILHATGIMLAIIFPVLFSILRLLFSSYAMNWFANPYLAFMMFIPISLIGLLIPRIVCHLFPLSQDASVFKTSKEMLSDEARFWGAFGFYASLTLAYLVAGLSGGFLTFCTSASMLLAWISFYLSITFYGHQSVRSTVFYVIPLIPCLTYSVYFGGFLLQFLIEKMGMMGAVPPPYGYYITDIVVASVVGVVTGCVIALALSSRFFPYSTDAPKRVVFQHTFLTADANQVVDSSYDFSVVDSNSLLFLFKYAPEVAKELHIGPEFSFDTANMSNQQTFMALFPVSLLFSRSLKFPARSDEILKQYRHFPHLYAYKPQKMLSDGSRRVYLELSLGSLEEVWVAVLNITGPLSSWSFADNKLPVPENAEGGPPSYICRLTGASHENWTFWLEASNSGDIRVDVAVLDQILVDEAKKLKGLFPVWADVTAGSSFLSSYVKYSREPDNPTKSCKARGSDLRVHFKNTRETAFAIRKLPLGKAKRYLEDVMAHKQAIPFRRFCGGVGRTAQAKNRHSNGQGRWPVKSAKFILDLLKNAESNAEVKGLDVDALYISHIQVNQAQKQRRRTYRAHGRINPYMSSPCHIELILSEKEEPVKKEPETQLAASKSKKSQALRSGVSS

SEQ ID NO: 6549 - protein, 182 aa, Unknown
  Sequence found in Organisms: Castanea mollissima, Quercus alba
MVKYSKEPDNPTKSCKARGSDLRVHFKNTRETAFAIRKLHLTKAKRYLEDVLAHKQAIPFRRFCRGVGRTAQAKNRHSNGQGRWPVKSAQFILDLLKNAESNAEVKGLDVDSLFISHIQVNQAQKQRRRTYRAHGRINPYMSSPCHIELTLSEKEEPVKKEPETQLAPKKPKARALRSGASS

SEQ ID NO: 6550 - protein, 183 aa, Eschscholzia californica
MVKYSKEPDNPTKSCKARGADLRVHFKNTRETAFSIRKLPLVKAKRYLEDVLAHKQAIPFRRFCGGVGRTAQAKNRHSNGQGRWPAKSAKFILDLLKNAESNADVKGLDVDSLYISHIQVNQAQKQRRRTYRAHGRINPYMSSPCHIELTLSEKEEPVKKEVDTQLAARKTKKSQVLRSGASS

SEQ ID NO: 6551 - protein, 182 aa, Euonymus alatus
MVKYSREPSNPTKSCKARGSDLRVHFKNTRETAQAIRKLALVKAKRYLEDVIAHKQAIPFRRFCRGVGRTAQAKNRHSNGQGRWPMKSATFILDLLKNAESNAEVKGLDVDALYVSHIQVNQAQKQRRRTYRAHGRINPYMSSPCHIELILSEKEEPVQKEPETQLAPRKTKGQALRSGASS

SEQ ID NO: 6552 - protein, 132 aa, Euphorbia peplus
MAHKQAIPFRRFCGGVGRTAQAKNRHSNGQGRWPAKSAKFILDLLKNAESNAEVKGLDVDNLFISHIQVNQAQKQRRRTYRAHGRINPYMSSPCHIELILSEKEEPVKKEPEAQLATSKSKKSQAIKTGASA

SEQ ID NO: 6553 - protein, 147 aa, Fraxinus spp
MVKYSREPENPTKSCKARGSDLRVHFKNTRETAHALRKMPLSKAKRYLEDVLAHKQAIPFTRFCRGVGRTAQAKNRHSNGQGRWPVKSANFILDLLKNAESNDRSQRLGFRFTLHISHPGEPSKEAEASDIPCPWKNQPLHVVSLPY

SEQ ID NO: 6554 - protein, 147 aa, Panax ginseng
MVKYSKEPDNPTKSCKARGSDLRVHFKNTRETAHAIRKLPLTKAKRYLEDVLAHKQAIPFTRFCRGVGRTAQAKNRHSNGQGRWPVKSAKFILDLLKNAESNAEVKGLDVDSLHISHIQVNQAQKQRRRTYRAHGENQPLHVITLSH

SEQ ID NO: 6555 - protein, 183 aa, Jatropha curcas
MVKYSREPDNSTKSCKARGSDLRVHFKNTRETAHALRKLPLAKAKRYLEDVMAHKQAIPFRRFCGGVGRTAQAKNRHSNGQGRWPVKSARFILDLLKNAESNAEVKGLDVDALYISHIQVNQAQKQRRRTYRAHGRINPYMSSPCHIELILSEKEEPVKKEPENQLATSKSKKSQALRSGAAS

SEQ ID NO: 6556 - protein, 183 aa, Liriodendron tulipifera
MVKYSREPDNPTKSCKARGSDLRVHFKNTRETAHAIRKLPLVKAKRYLEDVIAHKQAIPFRRFCRGVGRTAQAKNRHSNGQGRWPAKSAKFILDLLKNAESNADVKGLDVDTLFVSHVQVNQAQKQRRRTYRAHGRINPYMSSPCHIELILSEKEEPVKKEPDTQLAPRKPKKSQALRSGASS

SEQ ID NO: 6557 - protein, 183 aa, Momordica charantia
MVKYSREPDNSTKSCKARGSDLRVHFKNTRETAHALRKLPLAKAKRYLEDVLAHKQAIPFRRFCGGVGRTAQAKNRHSNGQGRWPVKSAKFILDLLKNAESNAEVKGLDVDSLIISHIQVNQAQKQRRRTYRAHGRINPYMSSPCHIELILSEKEEPVKKEPETQLAASKAKRGQVLRSGASS

SEQ ID NO: 6558 - protein, 183 aa, Phalaenopsis aphrodite
MVKYSKEPSNPTKSTKAMGRDLRVHFKNTRETAHALRKLPLAKAKRYLEDVIAHKQAIPFRRYCGGVGRTAQAKARHSNGQGRWPVKSARFILDLLKNAESNAVVKGLDVDALYISHIQVNQAQKQRRRTYRAHGRINPYMSSPCHIELILSEKEEPVKKEPETQIAARKPKKAQVLRSGASS

SEQ ID NO: 6559 - protein, 183 aa, Platanus occidentalis
MVKYSREPDNSTKSCKARGSDLRVHFKNTRETAFAIRKLPLVKAKRYLEDVLVHKQAIPFRRFCRGVGRTAQAKNRHSNGQGRWPVKSAKFILDLLKNAESNADVKGLDVDSLYVSHIQVNQAQKQRRRTYRAHGRINPYMSSPCHIELILSEKEEPVKKEPETQLAPRKGKKVRALRSGASS

SEQ ID NO: 6560 - protein, 133 aa, Pteridium aquilinum
MLWPTSKPFHSGASVVELGEPRRLKIASSNGQGRWPVKSAKFILDLLKNAESNAEVKGLDVDSLFISHIQVNQAQKQRRRTYRAHGRINPYMSSPCHIELILSEKQESVKKEPETQLAPRKSKGQSLRSGASS

SEQ ID NO: 6561 - protein, 183 aa, Sarracenia psittacina
MVKYSREPDNPTKSCKARGSDLRVHFKNTRETAHAIRKLHLAKAKRYLEDVLAHKQAIPFTRFCRGVGRTAQAKNRHSNGQGRWPAKSARFILDLLKNAESNAEVKGLDVDTLYISHIQVNQAQKQRRRTYRAHGRINPYMSSPCHIELILSEKEEPVKKELESQLATSKSRKSQALRSGASS

SEQ ID NO: 6562 - protein, 183 aa, Scabiosa columbaria
MVKYSREPDNHTKSCKARGSDLRCHFKNTRETAHAIRKLGLTKAKRYLEDVLAHKQAIPFTRFCRGVGRTAQAKNRHSNGQGRWPAKSAKFILDLLKNAESNAEVKGLDVDSLFISHIQVNQAQKQRRRTYRAHGRINPYMSSPCHIELILSEKEEPVKKEAETQLAPRKTKKNQALRSGASS

SEQ ID NO: 6563 - protein, 181 aa, Glycine max
MVKYSREPDNPTKSCKARGADLRVHFKNTRETAFAIRKLPLVKAKRYLEDVLAHKQAIPFRRFCGGVGRTAQAKSRHSNGQGRWPVKSAKFILDLLKNAESNAEVKGLDVDALYISHVQVNQAQKQRRRTYRAHGRINPYMSSPCHIELILSEKEEPVKKEAETQLATSKKKGALRSGASS

SEQ ID NO: 6564 - protein, 183 aa, Juglans hindsii x Juglans regia
MVKYSREPDNPTKSCKARGKDLRVHFKNTRETAFAIRKLPLTKAKRYLEDVLVHKQAIPFRRFCRGVGRTAQAKNRHSNGQGRWPVKSAKFILDLLKNAESNAEVKGLDVDSLYVSHVQVNQAQKQRRRTYRAHGRINPYMSSPCHIELILSEKEEPVKKEPETQLATSKSKKSQALRSGASS

SEQ ID NO: 6565 - protein, 170 aa, Beta vulgaris
MVKYSKEPDNPTKSCKARGSDLRVHFKNTRETAFSLRKMPLGKAKRYLEDVLAHKQAIPFRRFCRGVGRTAQAKNRHSNGQGRWPAKSAKFILDLLKNAESNAEMKGLDVDSLYISHIQVNQAQKQRRRTYRAHGRINPYMSHPCHIELTLSEKEESVRKEPESQLAASK

SEQ ID NO: 6566 - protein, 172 aa, Gerbera hybrid cultivar
MVKYSKEPDNPTKSCKARGSDLRCHFKNTRETAHALRKMPLIKAKRYLEDVLAHKQAIPFTRFCRGVGRTAQAKNRHSNGQGRWPAKSAKFILDLLKNAESNAEVKGLDVDSLHISHIQVNQAQKQRRRTYRAHGRINPYMSSPCHIELTLSEKEEPVKKEPETQLASRKTK

SEQ ID NO: 6567 - protein, 171 aa, Zea mays
MVKYSTEPTNPTKSTKAMGRDLRVHFKNTRETAFALRKLSLTKAKRYLEDVIAHKQAIPFRRYCGGVGRTAQAKSRHSNGQGRWPVKSARFILDLLKNAESNAEVKGLDVDTLYVSHIQVNQAQKQRRRTYRAHGRINPYMSSPCHIELILSEKEEPVKKEAESQIATRNA

SEQ ID NO: 6568 - protein, 171 aa, Orobanche aegyptiaca
MVKYSREPDNPTKSCKARGSDLRVHFKNTRETAHAIRKLPLVKAKRYLEDVLAHKQAIPFTRFCRGVGRTAQAKNRHSNGQGRWPVKSAKFILDLLKNAESNAEVKGLDVDALVISHIQVNQAQKQRRRTYRAHGRINPYMSSPCHIELILSEKEAPVQKEPNTQVATRKA

SEQ ID NO: 6569 - protein, 170 aa, Triphysaria pusilla
MVKYSSEPHNITKSCKARGSDLRVHFKNTRETAHALRKMPLVKAKSYLEDVLAHKQAIPFTRFCRGVGRTAQAKNRHSNGQGRWPVKSAKFILDLLKNAESNAEVKGLDVDALFISHIQVNQAQKQRRRTYRAHGRINPYMSSPCHIELILSEKEEPVKKEPESQLARKA

SEQ ID NO: 6570 - protein, 171 aa, Triphysaria pusilla
MVKYSSEPHNITKSCKARGSDLRVHFKNTRETAHALRKMPLVKAKSYLEDVLAHKQAIPFTRFCRGVGRTAQAKNRHSNGQGRWPVKSAKFILDLLKNAESNAEVKGLDVDALFISHIQVNQAQKQRRRTYRAHGRINPYMSSPCHIELILSEKEEPVKKEPESQLAARKA

SEQ ID NO: 6571 - protein, 174 aa, Sesamum indicum
MVKYSREPDNPTKSCKARGSDLRVHFKNTRETAHAIRKLPLGKAKRYLEDVLVHKQAIPFTRFCGGVGRTAQAKNRHSNGQGRWPVKSAKFILDLLKNAESNAEVKGLDVDALYISHIQVNQAQKQRRRTYRAHGRINPYMSSPCHIELILSEKEEPVKKEPESQLATSKPRKA

SEQ ID NO: 6572 - protein, 174 aa, Antirrhinum majus
MVKYSREPDNITKSCKARGADLRVHFKNTRETAHAIRKLPLIKAKRYLEDVLAHKQAIPFTRFCRGVGRTAQAKNRHSNGQGRWPVKSAKFILDLLKNAESNAEVKGLDVDALYISHIQVNQAQKQRRRTYRAHGRINPYMSSPCHIELILSEKEEPVKKEPESQLAASKPRKA

SEQ ID NO: 6573 - protein, 174 aa, Primula obconica
MPKYSRDPDNHTKSCKARGSDLRVHFKNTRETAHALRKMQLTKAKRYLEDVLAHKQAIPFTRFCRGVGRTAQAKNRHSNGQGRWPAKSAKYILDLLKNAESNAEVKGLDVDTLYISHIQVNQAQKQRRRTYRAHGRINPYMSSPCHIELILSEKEEPVKKEPESQLATGKSRKA

SEQ ID NO: 6574 - protein, 174 aa, Salvia sclarea
MVKYSREPDNITKSCKARGSDLRVHFKNTRETAHAIRKLPLGKAKRYLEDVLAHKQAIPFTRFCGGVGRTAQAKNRHSNGQGRWPVKSAKFILDLLKNAESNAEVKGLDVDTLFISHIQVNQAQKQRRRTYRAHGRINPYMSSPCHIELILSEKEEPVKKEAESQLATSKPRKA

SEQ ID NO: 6575 - protein, 47 aa, Secale cereale
  misc_feature (37)..(37): Xaa can be any naturally occurring amino acid
  misc_feature (47)..(47): Xaa can be any naturally occurring amino acid
RRRRLLCPAAAAMVKYSTDPANPTKSAKAMGRDLRVXSRTRGKQRFX

SEQ ID NO: 6576 - protein, 174 aa, Allium cepa
MVKYSREPDNITKSAKAMGRDLRVHFKNTRETAFSIRKMPLAKAKRYLEDVVAHKQAIPFRRYCRGVGRTAQAKNRHSNGQGRWPMKSAKFILDLLKNAESNAEVKGLDVDALYISHIQVNQAQKQRRRTYRAHGRINPYMSSPCHIELILSEKEEPVKKEPETQLATKSKKSS

SEQ ID NO: 6577 - protein, 174 aa, Plantago ovata
MVKYSREPDNATKSCKAQGSGLRVHFKNTRETAHAIRKMPLIKAKRYLEDVLAHKQAIPFTRFCRGVGRTAQAKNRHSNGQGRWPVKSAKFVLDLLKNAESNAEVKGLDVDALFISHIQVNQAQKQRRRTYRAHGRINPYMSSPCHIELILSEKEEPVKKEPDTQIAPNKVRKA

SEQ ID NO: 6578 - protein, 174 aa, Tamarix hispida
MVKYSREPDNPTKSCKARGSDLRVHFKNTRETAFALRKMHLAKAKRYLEDVLAHKQAIPFRRFCRGVGRTAQAKNRHSNGQGRWPQKSAKFILDLLKNAESNAEMKGLDVDSLYVSHIQVNQAQKQRRRTYRAHGRINPYMSHPCHIELILSEKEEPVKKEPESQLATSKSEKP

SEQ ID NO: 6579 - protein, 173 aa, Trigonella foenum-graecum
MVKYSREPDNPTKSTKARGADLRVHFKNTRETAFAIRKLPLIKAKRYLEDVLAHKQAIPFRRFCRGVGRTAQAKNRHSNGQGRWPVKSAKFILDLLKNAESNAEVKGLDVDALYVSHIQVNQAQKQRRRTYRAHGRINPYMSSPCHIELILSEKEEAVKKEPETQLATNKKKA

SEQ ID NO: 6580 - protein, 170 aa, Artemisia annua
MVKYSKEPDNPTKSCKARGSDLRCHFKNTRETAHALRKMPLIKAKRYLEDVLVHKQAIPFTRFCRGVGRTAQAKNRHSNGQGRWPAKSAKFILDLLKNAESNAEVKGLDVDALVISHIQVNQAQKQRRRTYRAHGRINPYMSSPCHIELTLSEKEEPVKKEAESQLAKSK

SEQ ID NO: 6581 - protein, 171 aa, Artemisia annua
MVKYSKEPENPTKSCKARGSDLRCHFKNTRETAHALRKMPLIKAKRYLEDVLAHKQAIPFTRFCRGVGRTAQAKNRHSNGQGRWPAKSAKFILDLLKNAESNAEVKGLDVDALHISHIQVNQAQKQRRRTYRAHGRINPYMSSPCHIELTLSEKEEPVKKEPESQLASRTK

SEQ ID NO: 6582 - protein, 172 aa, Cichorium intybus
MVKYSKEPENPTKSRKARGSDLRCHFKNTRETAHAIRKLPLIKAKRYLEDVLVHKQAIPFTRFCRGVGRTAQAKNRHSNGQGRWPAKSAKFILDLLKNAESNAEVKGLDVDALHISHIQVNQAQKQRRRTYRAHGRINPYMSSPCHIELTLSEKEEPVKKEAETQLAPRKTK

SEQ ID NO: 6583 - protein, 172 aa, Taraxacum officinale
MVKYSKEPDNPTKSCKARGSDLRCHFKNTRETAHALRKMSLIKAKSYLEDVLVHKQAIPFTRFCRGVGRTAQAKNRHSNGQGRWPAKSAKFILDLLKNAESNAEVKGLDVDALHISHIQVNQAQKQRRRTYRAHGRINPYMSSPCHIELTLSEKEEPVKKEAETQLAPRKTK

SEQ ID NO: 6584 - protein, 183 aa, Amborella trichopoda
MVKYSREPDNPTKSCKARGSDLRVHFKNTRETAFALRKLPLAKAKRYLEDVLAHKQAIPFRRFCGGVGRTAQAKNRHPNGQGRWPVKSAKFILNLLKSAESNADVKGLDVDTLFISHIQVNQAQKQRRRTYRAHGRINPYMSSPCHIELILSEKEAPVKKEAETQVVPKRTKKSQALHSGASS

SEQ ID NO: 6585 - protein, 178 aa, Gossypium raimondii
MVKYSKESDNPTKSCKARGSDLRVHFKNTRETAFAIRKLPLGKAKRYLEDVMAHKQAIPFRRFCGGVGRTAQAKNRHSNGQGRWPVKSAKFILDLLKNAESNAEVKGLDVDALYISHIQVNQAQKQRRRTYRAHGRINPYMSSPCHIELILSEKEEPVKKEPETQLAASKSKKSQVSV

SEQ ID NO: 6586 - protein, 183 aa, Musa acuminata
MVKYSREPTNPTKSSKAMGRDLRVHFKNTRETAHAIRKLPLAKAKRYLEDVIAHKQAIPFRRFCGGVGRTAQAKGRHPNGQGRWPMKSARFILDLLKNAESNAEVKGLDVDALYISHIQVNQAQRQRRRTYRAHGRINPYMSSPCHIELILSEKEEPVKKEPETQIAPSKPKKSQAIRSGASS

SEQ ID NO: 6587 - protein, 183 aa, Musa acuminata
MVKYSREPSNPTKSAKAMGRDMRVHFKNTRETAHAIRKLPLSKAKRYLEDVIAHKQAIPFRRFCGGVGRTAQAKGRHPNGQGRWPLKSARFILDLLKNAESNAEVKGLDVDALFISHIQVNQAQRQRRRTYRAHGRINPYMSSPCHIELILSEKEEPVKKEPETQIAPSKPKKAQAIRSGASS

SEQ ID NO: 6588 - protein, 183 aa, Fagus grandifolia
MVKYSREPDNPTKSCKARGSDLRVHFKNTRETAFAIRKLPLLKAKRYLEDVLAHKQAIPFRRFCRGVGRTAQAKSRHSNGQGRWPVKSAKFILDLLKNAESNAEVKGLDVDSLYISHVQVNQAQKQRRRTYRAHGRINPYMSSPCHIELTLSEKEEPVKKEPETQLATSKSKKSQALRSGASS

SEQ ID NO: 6589 - protein, 55 aa, Vaccinium corymbosum
MVKYSREPDNPTKSCKARGSDLRVHFKNTRETAHAIRKLPLTKAKRYLEDVLAHK

SEQ ID NO: 6590 - protein, 182 aa, Theobroma cacao
MVKYSREPDNPTKSCKARGSDLRVHFKNTRETAFAIRKLPLIKAKRYLEDVMAHKQAIPFRRFCGGVGRTAQAKNRHSNGQGRWPVKSAKFILDLLKNAESNAEVKGLDVDSLFISHIQVNQAQKQRRRTYRAHGRINPYMSSPCHIELILSEKQESVKKEPETQLAPRKSKGQSLRSGASS

SEQ ID NO: 6591 - protein, 183 aa, Castanea mollissima
MVKYSREPDNPTKSCKARGSDLRVHFKNTRETAFAIRKLPLVKAKRYLEDVLAHKQAIPFRRFCRGVGRTAQAKNRHSNGQGRWPVKSAKFILDLLKNAESNAEVKGLDVDSLFISHIQVNQAQKQRRRTYRAHGRINPYMSSPCHIELVLSEKEEPVKKEPESQLTTSKSKKSHALRSGASS

SEQ ID NO: 6592 - protein, 183 aa, Unknown
  Sequence found in Organisms: Castanea mollissima, Quercus alba
MVKYSKEPDNPTKSCKARGSDLRVHFKNTRETAHAIRKLPLAKAKRYLEDVLVHKQAIPFRRFCRGVGRTAQAKNRHSNGQGRWPFKSAKFILDLLKNAESNAEVKGLDVDSLHISHIQVNQAQKQRRRTYRAHGRINPYMSSPCHIELTLSEKEEPVKKEPETQLAPRKNRKSQALHSGASS

SEQ ID NO: 6593 - protein, 183 aa, Unknown
  Sequence found in Organisms: Cucumis sativus, Cucumis melo
MVKYSREPDNPTKSCKARGSDLRVHFKNTRETAHALRKLPLAKAKRYLEDVLAHKQAIPFRRFCGGVGRTAQAKNRHSNGQGRWPVKSAKFILDLLKNAESNAEVKGLDVDSLIVSHIQVNQAQKQRRRTYRAHGRINPYMSSPCHIELILSEKEEPVKKEPETQLATSKSKKSQALRSGASS

SEQ ID NO: 6594 - protein, 181 aa, Eucalyptus grandis
MVKYSREPDNPTKSCKARGSDLRVHFKNTRETAFAIRKLPLVKAKRYLEDVLAHKQAIPFRRFCRGVGRTAQAKNRHSNGQGRWPVKSARFILDLLKNAESNAEVKGLDVDALFVSHVQVNQAQKQRRRTYRAHGRINPYMSSPCHIELILSEKEEPVKKEPETQLATSKSKRSQAMRSSA

SEQ ID NO: 6595 - protein, 181 aa, Eucalyptus grandis
MVKYSKEPDNPTKSCKARGSDLRVHFKNTRETAHAIRKLPLTKAKSYLEDVLAHKQAIPFRRFCRGVGRTAQAKNRHSNGQGRWPVKSAKFILDLLKNAESNAEVKGLDVDTLYVSHIQVNQAQKQRRRTYRAHGRINPYMSSPCHIELILSEKEEPVMKEPETQLAPRKSKSALRSGASS

SEQ ID NO: 6596 - protein, 183 aa, Actinidia deliciosa
MVKYSREPDNPTKSCKARGSDLRVHFKNTRETAHAIRKMPLTKAKRYLEDVLAHKQAIPFTRFCRGIGRTAQAKNRHSNGQGRWPVKSVGFILDLLKNAESNAEVKGLDVDTLYISHIQVNQAQKQRRRTYRAHGRINPYMSSPCHIELILSEKEEPVKKESESQLATSKSRKSQALRSGASS

SEQ ID NO: 6597 - protein, 183 aa, Actinidia deliciosa
  misc_feature (17)..(17): Xaa can be any naturally occurring amino acid
MVKYSREPDNPTKSCKXRGSDLRVHFKNTRETAHAIRKLPLTKAKRYLEDVLAHKQAIPFTRFCRGVGRTAQAKNRHSNGQGRWPVKSATFILDLLKNAESNAEVKGLDVDTLYISHIQVNQAQKQRRRTYRAHGRINPYMSSPCHIELILSEKEEPVKKEPESQLATSKSRKSQALRSGASS

SEQ ID NO: 6598 - protein, 183 aa, Liriodendron tulipifera
MVKYSREPDNPTKSCKARGSDLRVHFKNTRETAHAIRKLHLAKAKRYLEDVIAHKQAIPFRRFCRGVGRTAQAKNRHSNGQGRWPAKSARFILDLLKNAESNADVKGLDVDTLFVSHIQVNQAQKQRRRTYRAHGRINPYMSSPCHIELILSEKEEPVKKEPETQLAPRKTKKGQALHSGTSS

SEQ ID NO: 6599 - protein, 179 aa, Lotus japonicus
MVKYSQEPDNPTKSCKARGSDLRVHFKNTRETAHAIRRLPLAKAKRYLEDVLAHKQAIPFRRFCRGVGRTAQAKNRHSNGQGRWPAKSAKFILDLLKNAESNAEVKGLDVDALYITHVQVNQAQKQRRRTYRAHGRINPYMSSPCHIELICLKRKSLSRRSLRRSLQQARSPKRASSIS

SEQ ID NO: 6600 - protein, 183 aa, Pinus pinaster
MVKYSREPGNPTKSAKARGSDLRVHFKNTRETAQAVKKLPLGKAKRYLEDVIAHKQAIPFRRFCGGVGRTAQAKSRNSNGQGRWPVKSAEFLLGLLKNAESNAEVKGLDVDTLYISHIQVNQAQKQRRRTYRAHGRINPYMSSPCHIELILSEKEAPVKKEVETQIAPRKPRKAQTLRSGASS

SEQ ID NO: 6601 - protein, 183 aa, Nuphar advena
MVKYSREPDNPTKSCKARGSDLRVHFKNTRETAFAIRKLPLAKAKRYLEDVIAHKQAIPFRRFCGGVGRTAQAKVRHSNGQGRWPLKSAKFILNLLKSAESNADVKGLDVDTLYISHIQVNQAQKQRRRTYRAHGRINPYMSSPCHIELILSEKEAPVKKEAETQVAPRKTKKSQVIRSGASS

SEQ ID NO: 6602 - protein, 191 aa, Phalaenopsis aphrodite
MVKYSKEPSNPTKSAKAMGRDLRVHFKNTRETAHALRKLPLAKAKRYLEDVIAHKQAIPFRRYCGGVGRTAQAKARHSNGQGRWPIKSARFILDLLKNAESNADVKGLDVDALYISHIQVNQAQKQRRRTYRAHGRINPYMSSPCHIELILSEKEEPVKKEPETQIATKNKEDHPSSAQRCLFLSNTSSNS

SEQ ID NO: 6603 - protein, 184 aa, Phalaenopsis aphrodite
MVKYSKEPSNPTKSAKAMGRDLRVHFKNTRETAHALRKLPLAKAKRYLEDVIAHKQAIPFRRYCGGVGRTAQAKARHSNGQGRWPVKSARFILDLLKNAESNADVKGLDVDALHISHIQVNQAQKQRRRTYRAHGRINPYMSSPCHIELILSEKEEPVKKEPETQIATKKQKKTTQALRSGTSS

SEQ ID NO: 6604 - protein, 181 aa, Platanus occidentalis
MVKYSREPDNQTKSCKARGSDLRVHFKNTRETAHAIRKLPLVKAKRYLEDVLVHKQAIPFRRFCRGVGRTAQAKNRHSNGQGRWPVKSAKFILDLLKNAESNADVKGLDVDSLYVSHIQVNQAQKQRRRTYRAHGRINPYMSSPCHIELILSEKEEPVKKEPETQLAPRKSKKTLRSGTSS

SEQ ID NO: 6605 - protein, 183 aa, Prunus persica
MVKYSREPDNHTKSCKAKGNDLRVHFKNTRETAHAIRKLPLIKAKRYLEDVLVHKQAIPFRRFCRGVGRTAQAKNRHSNGQGRWPVKSAKFILDLLKNAESNAEVKGLDVDSLYVSHIQVNQAQKQRRRTYRAHGRINPYMSSPCHIELILSEKEEPVKREPETQLASRKAEKGRTLRSGAAS

SEQ ID NO: 6606 - protein, 182 aa, Rhizophora mangle
MVKYSREPDNPTKSCKARGSDLRVHFKNTRETAHAIRKLPLGKAKRYLEDVLSHKQAIPFRRFCGGVGRTAQAKNRHSNGQGRWPVKSATFILDLLKNAESNAEVKGLDMDALYISHIQVNQAQKQRRRTYRAHGRINPYMSSPCHIELVLSEKEEPVAKEPETQLAPRKPKAQALRSGASS

SEQ ID NO: 6607 - protein, 183 aa, Sarracenia psittacina
MVKYSREPDNPTKSCKARGSDLRVHFKNTRETAHAIRKLPLAKAKRYLEDVLAHKQAIPFTRFCRGVGRTAQAKNRHSNGQGRWPAKSARFILDLLKNAESNAEVKGLDVDTLFISHIQVNQAQKQRRRTYRAHGRINPYMSSPCHIELILSEKEEPVNKEPESQLATSKSRKSQALRSGASS

SEQ ID NO: 6608 - protein, 183 aa, Scabiosa columbaria
MVKYSREPDNHTKSCKARGSDLRCHFKNTRETAHAIRKLGLTKAKRYLEDVLVHKQAIPFTRFCRGVGRTAQAKNRHSNGQGRWPAKSAKFILDLLKNAESNAEVKGLDVDSLFISHIQVNQAQKQRRRTYRAHGRINPYMSSPCHIELILSEKEEPVKKEAETQLAPRKTKKNQALRSGASS

SEQ ID NO: 6609 - protein, 183 aa, Picea glauca
MVKYSREPGNPTKSAKARGSDLRVHFKNTRETAQAVKKLPLTKAKRYLEDVIAHKQAIPFRRFCGGVGRTAQAKSRNSNGQGRWPVKSAEFLLGLLKNAESNAEVKGLDVDTLYISHIQVNQAQKQRRRTYRAHGRINPYMSSPCHIELILSEKEAPVKKEAETQIAPRKPRKAQTLRSGASS

SEQ ID NO: 6610 - protein, 174 aa, Antirrhinum majus
MVKYSREPDNITKSCKARGADLRVHFKNTRETAHAIRKLPLTKAKRYLEDVLAHKQAIPFTRFCRGVGRTAQAKNRHSNGQGRWPVKSAKFILDLLKNAESNAEVKGLDVDALFISHIQVNQAQKQRRRTYRAHGRINPYMSSPCHIELILSEKEEPVKKEPESQLAASKPRKA

SEQ ID NO: 6611 - protein, 174 aa, Antirrhinum majus
MVKYSREPDNITKSCKARGADLRVHFKNTRETAHAIRKLPLTKAKRYLEDVLAHKQAIPFTRFCRGVGRTAQAKNRHSNGQGRWPVKSAKFILDLLKNAESNAEVKGLDVDALFISHIQVNQAQKQRRRTYRAHGRINPYMSSPCHIELILSEKEEPVKKEPESQLATSKPRKA

SEQ ID NO: 6612 - protein, 173 aa, Cicer arietinum
MVKYSREPDNPTKSCKARGADLRVHFKNTRETAFSIRKLPLTKAKRYLEDVLAHKQAIPFRRFCRGVGRTAQAKNRHSNGQGRWPAKSAKFILDLLKNAESNAEVKGLDIDALYVSHIQVNQAQKQRRRTYRAHGRINPYMSSPCHIELVLSEKEEAVKKEPETQLAPSKKKA

SEQ ID NO: 6613 - protein, 174 aa, Ipomoea batatas
MVKYSREPDNSTKSCKARGSDLRVHFKNTRETAHAIRKLPLGKAKRYLEDVLAHKQAIPFTRFCRGVGRTAQAKNRHPNGQGRWPVKSAKFILDLLKNAESNAEVKGLDVDILYISHIQVNQAQKQRRRTYRAHGRINPYMSSPCHIELILSEKEEPVKKEPESQITTSKSRKA

SEQ ID NO: 6614 - protein, 174 aa, Ipomoea nil
MVKYSREPDNPTKSCKARGSDLRVHFKNTRETAHAIRKLPLVKAKRYLEDVLAHKQAIPFTRFCRGVGRTAQAKNRHPNGQGRWPVKSAKFILDLLKNAESNAEVKGLDVDTLYISHVQVNQAQKQRRRTYRAHGRINPYMSSPCHIELILSEKEEPVKKEPESQIATTKSRKA

SEQ ID NO: 6615 - protein, 173 aa, Tropaeolum majus
MVKYSREPDNPTKSCKARGSDLRVHFKNTRETAHAIRKMPLNKAKSYLEDVLAHKQAIPFRRFCRGVGRTAQAKSRHSNGQGRWPAKSANFILDLLKNAESNAEVKGLDVDALYVSHIQVNQAQRQRRRTYRAHGRINPYMSSPCHIEICLSEKEEPVKKEPESQLAPRKSKA

SEQ ID NO: 6616 - protein, 182 aa, Platanus occidentalis
MVKYSREPDNHTKSCKARGSDLRVHFKNTRETAHAVRKLPLAKAKRYLEDVLAHKQAIPFRRFCRGVGRTAQAKNRHSNGQGRWPVKSAKFILDLLKNAESNADVKGLDVDSLYVSHIQVNQAQKQRRRTYRAHGRINPYMSSPCHIELILSEKEEPVKRGEPETQLAPRKEKKALRSGASS

SEQ ID NO: 6617 - protein, 172 aa, Helianthus annuus
MVKYSTEPENPTKSCKARGSDLRCHFKNTRETAHAIRKLPLIKAKRYLEDVLAHKQAIPFTRFCRGVGRTAQAKNRHSNGQGRWPAKSAKFILDLLKNAESNAEVKGLDVDALHISHIQVNQAQKQRRRTYRAHGRINPYMSSPCHIELTLSEKEEPVKKEPETQLASRKTK

SEQ ID NO: 6618 - protein, 170 aa, Helianthus annuus
MVKYSQEPDNPTKSCKARGSDLRCHFKNTRETAHAIRKLPLIKAKRYLEDVLAHKQAIPFTRFCRGVGRTAQAKNRHSNGQGRWPAKSAKFILDLLKNAESNAEVKGLDVDALFISHIQVNQAQKQRRRTYRAHGRINPYMSSPCHIELTLSEKEEPVKKEAESQLAKSK

SEQ ID NO: 6619 - protein, 172 aa, Acacia harpophylla
MVKYSREPDNPTKSCKARGSDLRVHFKNTRETAFTIRKLPLVKAKRYLEDVLAHKQTIPFRRFCGGVGRTAQAKNRHSNGQGRWPVKSAKFILDLLKNAESNAEVKGLDVDALYISHIQVNQAQKQRRRTYRAHGRINPYMSSPCHIELTLSEKEEPVRKEPDTQLATSKKS

SEQ ID NO: 6620 - protein, 171 aa, Arnica chamissonis
MVKYSKEPDNPTKSCKARGSDLRCHFKNTRETAHAIRKLPLIKAKRYLEDVLAHKQAIPFTRFCRGVGRTAQAKNRHSNGQGRWPAKSAKFILDLLKNAESNAEVKGLDVDSLHISHIQVNQARKQRRRTYRAHGRINPYMSSPCHIELTLSEKEEPVKKEAESQLAARKT

SEQ ID NO: 6621 - protein, 171 aa, Artemisia annua
MVKYSKEPENPTKSCKARGSDLRCHFKNTRETAHALRKMPLIKAKRYLEDVLAHKQAIPFTRFCRGVGRTAQAKNRHSNGQGRWPAKSAKFILDLLKNAESNAEVKGLDVDALHISHIQVNQAQKQRRRTYRAHGRINPYMSSPCHIELTLSEKEEPVKKEAETQLSAKSK

SEQ ID NO: 6622 - protein, 170 aa, Beta vulgaris
  misc_feature (153)..(153): Xaa can be any naturally occurring amino acid
  misc_feature (156)..(156): Xaa can be any naturally occurring amino acid
  misc_feature (165)..(165): Xaa can be any naturally occurring amino acid
MVKYSKEPDNPTKSCKARGSDLRVHFKNTRETAFSLRKMPLGKAKRYLEDVLAHKQAIPFRRFCRGVGRTAQAKNRHSNGQGRWPAKSAKFILDLLKNAESNAEMKGLDVDSLYISHIQVNQAQKQRRRTYRAHGRINPYMSHPCHIELTLSXKEXSVRKEPESXLAASK

SEQ ID NO: 6623 - protein, 172 aa, Cichorium intybus
MVKYSKEPDNPTKSCKARGSDLRCHFKNTRETAHAIRKMPLIKAKRYLEDVLIHKQAIPFTRFCRGVGRTAQAKNRHSNGQGRWPAKSAKFILDLLKNAESNAEVKGLDVDALFISHIQVNQAQKQRRRTYRAHGRINPYMSSPCHIELTLSEKEEPVKKEAESQLAKSKKP

SEQ ID NO: 6624 - protein, 172 aa, Cirsium arvense
MVKYSKEPENPTKSCKARGSDLRCHFKNTRETAHAIRKLPLIKAKRYLEDVLVHKQAIPFTRFCRGVGRTAQAKNRHSNGQGRWPAKSAKFILDLLKNAESNAEVKGLDVDALYISHIQVNQARKQRRRTYRAHGRINPYMSSPCHIELTLSEKEEPVKKEAESQLAARKSN

SEQ ID NO: 6625 - protein, 172 aa, Camellia sinensis
MVKYSKEPDNPTKSCKARGSDLRVHFKNTRETAHAIRKLPLAKAKRYLEDVLAHKQAIPFTRFCRGVGRTAQAKNRHSNGQGRWPVKSAGFILDLLKNAESNAEVKGLDVDTLYISHIQVNQAQKQRRRTYRAHGRINPYMSSPCHIELILSEKEEPVKKEPSLSLATSQIQ

SEQ ID NO: 6626 - protein, 183 aa, Amborella trichopoda
MVKYSREPDNPTKSCKARGSDLRVHFKNTRETAFALRKLPLAKAKRYLEDVLAHKQAIPFRRFCGGVGRTAQAKNRHPNGQGRWPVKSAKFILNLLKSAESNADVKGLDVDTLFISHIQVNQAQKQRRRTYRAHGRINPYMSSPCHIELILSEKEAPVKKEAETEVVLKRTKKSQALRSGASS

SEQ ID NO: 6627 - protein, 182 aa, Vaccinium corymbosum
MVKYSREPDNPTKSCKARGSDLRVHFKNTRETAHAIRKLPLVKAKRYLEDVLAHKQAIPFTRFCRGVGRTAQAKNRHSNGQGRWPVKSAGFILDLLKNAESNAEVKGLDVEALYISHIQVNQAQKQRRRTYRAHGRINPYMSSPCHIELVLSEKEEPVKKEPEMQVASSAKKSRGLRSGASS

SEQ ID NO: 6628 - protein, 178 aa, Gossypium raimondii
MVKYSKEPDNPTKSCKARGSDLRVHFKNTRETAFAIRKLPLVKAKRYLEDVMAHKQAIPFRRFCGGVGRTAQAKNRHSNGQGRWPVKSAKFILDLLKNAESNAEVKGLDVDALHISHIQVNQAQKQRRRTYRAHGRINPYMSSPCHIELILSEKEEPVKKEPETQLAASKSKKSQASS

SEQ ID NO: 6629 - protein, 182 aa, Medicago truncatula
MVKYSREPDNPTKSTKARGADLRVHFKNTRETAFAIRKLPLTKAKRYLEDVLAHKQAIPFRRFCRGVGRTAQAKNRHSNGQGRWPVKSAKFILDLLKNAESNAEVKGLDVDALYVSHVQVNQAQKQRRRTYRAHGRINPYMSSPCHIELILSEKEETVQKEPETQLATNKKKSQAVRSGASS

SEQ ID NO: 6630 - protein, 183 aa, Rosa hybrid cultivar
MVKYSKEPDNPTKSCKARGSDLRVHFKNTRETAQAIRKLRLAKAKSYLEDVLAHKQAIPFRRFCRGVGRTAQAKNRHSNGQGRWPVKSAKFVLDLLKNAESNAEVKGLDVDSLYVSHIQVNQAMKQRRRTYRAHGRINPYMSSPCHIELTLSEKEEAVKKEPDTQLAPRKSRKGQALHSGASS

SEQ ID NO: 6631 - protein, 337 aa, Malus domestica
MVKYSREPDNITKSCKARGSDLRVHFKNTRETAFAIRKLPLVKAKRYLEDVLAHKQAIPFRRFCRGVGRTAQAKNRHSNGQGRWPVKSAKFILDLLKNAESNAEVKGLDVDSLIVSHIQVNQAQKQRRRTYRAHGRINPYMSSPCHIELILSEKEEPVKKEPESQLTTSKSKKSALRSDGFAETKTWADAVGRSVSVSHFRAFVRWSVRRLQRKELLPKSSFQDGLARAEASRAADADTATGLRRCGFRHRLHNRIVPDDDSDLRWWRGSHDIGHRPQLALLQSPPPQVVGPERSREASQAAAAAAAALDLEEEILQEVRSRSVFSRLITSMDLMRY

SEQ ID NO: 6632 - protein, 183 aa, Persea americana
MVKYSREPENPTKSCKARGSDLRVHFKNTRETAHALRKLPLTKAKRYLEDVIAHKQAIPFRRFCRGVGRTAQAKSRHSNGQGRWPMKSAKFILDLLKNAESNADVKGLDTDTLFISHIQVNQAQKQRRRTYRAHGRINPYMSSPCHIELILSEKEESVKKEPETQLAPRKTKKAKALRSGTSS

SEQ ID NO: 6633 - protein, 778 aa, Brassica napus
TTTRRVYDTAAQQVVSGAMSGINGTVFAYGVTSSGKTHTMHGEQRSPGIIPLAVKDVFSIIQETPEREFLLRVSYLEIYNEVINDLLDPTGQNLRIREDSQGTYVEGIKDEVVLSPAHALSLIASGEEHRHVGSNNVNLFSSRSHTMFTLTIESSPHGKGDDGEDVTLSQLHLIDLAGSESSKSEMTGQRRKEGSSINKSLLTLGTVISKLTDSKAAHIPYRDSKLTRLLQSTLSGHGLVSLICTITPASSTSEETHNTLKFAQRCKHVEIKASRNKIMDEKSLIKKYQKEISCLQEELTQLKHGVSMSTSNQEDLADRKLQVKPQLRLEEEEDEAKAALMGRIQRLTKLILVSTKSSLQGKASVKPDHIWRHTFGEEELAYLPDRRRENMADDNARSTVSEHSREPRDGGTSGLDEMTKDRKKNKTRGGMLGWLKLKKSDGVAGTLLTDGNQNSTNGSASSSSKCAQTKSTRRDKAATNKSFPERTVAEDLFSAAVGSGDPSLIATTIADQMDLLHEQTKILVGEVALRTSSLKRLSEQAARNPEDFHIRDQMQKLEDEISEKKNQIRALEQQMIESFGMSHTTDSLGMSQVLSKLTTQLNEKIFEHEIKSADNRILQEQLEITKSEKAEMQETIMLLRQQLDSLAERQSTYTQQQNGADESAGRNTHNRNGDELSEIYSGAGTPTSVMSLNRVFAQEETKDIKNGTTLNSQALEIENLKKENMRLIEEKDELGKLNNKLTEEASYAKELASAAAVELQNLAEEVTRLCNENAKLSK

SEQ ID NO: 6634 - protein, 177 aa, Manihot esculenta
MVKYSREPENSTKSCKARGSDLRVHFKNTRETAHALRKLPLAKAKRYLEDVMAHKQAIPFRRFCRGVGRTAQAKNRHSNGQGRWPVKSAKFILDLLKNAESNAEVKGLDVDALFVSHIQVNQAQKQRRRTYRAHGRINPYMSSPCHIELILSEKEEPVKKEPETQLATSKSKKSQAI

SEQ ID NO: 6635 - protein, 182 aa, Cedrus atlantica
VKYSREPGNPTKSAKARGSDLRVHFKNTRETAQAVKRLPLVKAKRYLEDVIAHKQAIPFRRFCGGVGRTAQAKSRNSNGQGRWPVKSAEFLLGLLKNAESNAEVKGLDVDTLYISHIQVNQAQKQRRRTYRAHGRINPYMSSPCHIELILAEKEAPVKKEAETQIAPRKPRKAQMLRSGASS

SEQ ID NO: 6636 - protein, 178 aa, Gossypium hirsutum
MVKYSKEPDNPTKSCKARGSDLRVHFKNTRETAFAIRKLPLVKAKRYLEDVIAHKQAIPFRRFCGGVGRTAQAKNRHSNGQGRWPVKSAKFILDLLKNAESNAEVKGLDVDALHISHIQVNQAQKQRRRTYRAHGRINPYMSSPCHIELILSEKEEPVKKEPETQLAASKSKKSQASS

SEQ ID NO: 6637 - protein, 127 aa, Gossypium hirsutum
MAHKQAIPFRRFCGGVGRTAQAKNRHSNGQGRWPVKSAKFILDLLKNAESNAEVKGLDVDALHISHIQVNQAQKQRRRTYRAHGRINPYMSSPCHIELILSEKEEPVKKEPDTQLAASKSKKSQASS

SEQ ID NO: 6638 - protein, 183 aa, Gossypium hirsutum
MVKYSREPDNHTKSCKARGSDLRVHFKNTRETAFAIRKLPLTKAKRYLEDVIAHKQAIPFRRFCGGVGRTAQAKNRHSNGQGRWPVKSAKFILDLLKNAESNAEVKGLDVDSLIISHVQVNQAQKQRRRTYRAHGRINPYMSSPCHIELILSEKEEPVKKSLRLSWLRGNRRVLHLKLLSGGL

SEQ ID NO: 6639 - protein, 183 aa, Cucurbita pepo
MVKYSREPDNITKSCKARGSDLRVHFKNTRETAHALRKLPLAKAKRYLEDVLAHKQAIPFRRFCGGVGRTAQAKNRHSNGQGRWPVKSAKFILDLLKNAESNAEVKGLDVDSLIVSHIQVNQAQKQRRRTYRAHGRINPYMSSPCHIELILSEKEEPVKKEPETQLATSKSKKGQALRSGASS

SEQ ID NO: 6640 - protein, 183 aa, Cycas rumphii
MVKYSREPDNPTKSCKARGSDLRVHFKNTRETAQAIKKLPLAKAKRYLEDVLVHKQAIPFRRFCGGVGRTAQAKSRHSNGQGRWPVKSAKFLLDLLKNAESNAEVKGLDVDTLFISHIQVNQAQKQRRRTYRAHGRINPYMSSPCHIELILSEKEAPVKKEAETQIAPRKSKKAQTLRSGTSS

SEQ ID NO: 6641 - protein, 180 aa, Eschscholzia californica
YSKEPDNPTKSCKARGADLRVHFKNTRETAFSIRKLPLVKAKRYLEDVLAHKQAIPFRRFCGGVGRTAQAKNRHSNGQGRWPAKSAKFILDLLKNAESNADVKGLDVDSLYISHIQVNQAQKQRRRTYRAHGRINPYMSSPCHIELTLSEKEEAVKKEADTQLAPRKSKKGQVLRSGASS

SEQ ID NO: 6642 - protein, 182 aa, Euonymus alatus
MVKYSREPNNPTKSCKARGSELRVHFKNTRETAQAIRKLALVKAKRYLEDVIAHKQAIPFRRFCRGVGRTAQAKNRHSNGQGRWPMKSANFILDLLKNAESNAEVKGLDVDALYVSHIQVNQAQKQRRRTYRAHGRINPYMSSPCHIELILSEKEESVQKEPETQLAPRKAKGQALRSGASS

SEQ ID NO: 6643 - protein, 182 aa, Euonymus alatus
MVKYSREPNNPTKSCKARGSELRVHFKNTRETAQAIRKLALVKAKRYLEDVIAHKQAIPFRRFCRGVGRTAQAKNRHSNGQGRWPMKSANFILDLLKNAESNAEVKGLDVDVLYVSHIQVNQAQKQRRRTYRAHGRINPYMSSPCHIELILSEKEESVQKEPETQLAPRKAKGQALRSGASS

SEQ ID NO: 6644 - protein, 183 aa, Euphorbia peplus
MVKYSRDPDNSTKSCKARGSDLRVHFKNTRETAFALRKLPLAKAKRYLEDVMAHKQAIPFRRFCGGVGRTAQAKSRHSNGQGRWPAKSAKFILDLLKNAESNAEVKGLDVENLYITHIQVNQAQKQRRRTYRAHGRINPYMSSPCHIELILSEKEESVQKEPETQLATSKSKKPQAVRTGASA

SEQ ID NO: 6645 - protein, 183 aa, Vitis vinifera
MVKYSREPDNPTKSCKARGSDLRVHFKNTRETAHAIRKLHLTKAKRYLEDVLAHKQAIPFQRFCRGVGRTAQAKNRHSNGQGRWPVKSAKFILDLLKNAESNADLKGLDVDSLYVSHIQVNQAQKQRRRTYRAHGRINPYMSSPCHIELILSEKEEPVQKEPDTQLAPRKTKKTQALRSGASS

SEQ ID NO: 6646 - protein, 186 aa, Guizotia abyssinica
MVKYSKEPENPTKSCKARGSDLRCHFKNTRETAHAIRKLPLIKAKRYLEDVLAHKQAIPFTRFCRGVGRTAQAKNRHSNGQGRWPAKSAKFILDLLKNAESNAEVKGLDVDALHISHIQVNQAQKQRRRTYRAHGRINPYMSSPCHIELTLSEKEEPVKKEPETQLAPRTKKTKLRSGVHSHEGDS

SEQ ID NO: 6647 - protein, 183 aa, Quercus alba
MVKYSREPDNPTKSCKARGSDLRVHFKNTRETAFAIRKLPLVKAKRYLEDVLAHKQAIPFRRFCRGVGRTAQAKNRHSNGQGRWPVKSAKFILDLLKNAESNAEVKGLDVDSLFVSHIQVNQAQKQRRRTYRAHGRINPYMSSPCHIELVLSEKEEPVKKEPESQLTTSKSKKSHALRSGASS

SEQ ID NO: 6648 - protein, 183 aa, Pinus taeda
MVKYSREPGNPTKSAKARGSDLRVHFKNTRETAQAVKKLPLGKAKRYLEDVIVHKQAIPFRRFCGGVGRTAQAKSRNSNGQGRWPVKSAEFLLGLLKNAESNAEVKGLDVDTLYISHIQVNQAQKQRRRTYRAHGRINPYMSSPCHIELILSEKEAPVKKEVETQIAPRKPRKAQTLRSGASS

SEQ ID NO: 6649 - protein, 183 aa, Pseudotsuga menziesii
MVKYSREPGNSTKSAKARGSDLRVHFKNTRETAQAVKKLPLAKAKRYLEDVIAHKQAIPFRRFCGGVGRTAQAKSRNSNGQGRWPVKSAEFLLGLLKNAESNAEVKGLDVDTLYISHIQVNQAQKQRRRTYRAHGRINPYMSSPCHIELILSEKEAPVKKEAETQIAPRKPGKAQSLRSGASS

SEQ ID NO: 6650 - protein, 179 aa, Fragaria vesca
MVNYSQEPGNITKSCKARGSDLRVHFKNTRETAHALRKMPLVKAKRYLEDVLVHKQAIPFTRFCRGVGRTAQAKNRHSNGQGRWPAKSAKFILDLLKNAESNAEVKGLDVDSLFISHIQVNQARKQRRRTYRAHGRINAYMSSPCHIELILSEKEEPVKKEAETQLASRKTGKTRAVAV

SEQ ID NO: 6651 - protein, 183 aa, Camellia sinensis
MVKYSKEPDNPTKSCKARGSDLRVHFKNTRETAYAIRKLPLTKAKRYLEDVLAHKQAIPFTRFCRGVGRTAQAKNRHSNGQGRWPVKSAGFILDLLKNAESNAEVKGLDVDTLYISHIQVNQAQKQRRRTYRAHGRINPYMSSPCHIELILSEKEEPVKKEPESQLTTSKSRKSQALRSGASS

SEQ ID NO: 6652 - protein, 183 aa, Valeriana officinalis
MVKYSREADNPTKSCKARGADLRCHFKNTRETAHAIRKLPLTKAKRYLEDVLVHKQAIPFTRFCRGVGRTAQAKNRHSNGQGRWPVKSAKFILDLLQNAESNAELKGLDVDSLYISHIQVNQAQKQRRRTYRAHGRINPYMSSPCHIELILSEKEEAVKKEAETQLAPRKAKKGQALRSGASS

SEQ ID NO: 6653 - protein, 183 aa, Amborella trichopoda
MVKYSREPDNPTKSCKARGSDLRVHFKNTRETAFAIRKLPLAKAKRYLEDVLAHKQAIPFRRFCGGVGRTAQAKNRHPNGQGRWPVKSAKFILNLLKSAESNADVKGLDVDTLFISHIQVNQAQKQRRRTYRAHGRINPYMSSPCHIELILSEKEVPVKKEAETQVVPKRTKKSHALRSGASS

SEQ ID NO: 6654 - protein, 182 aa, Vaccinium corymbosum
MVKYSREPDNPTKSCKARGSDLRVHFKNTRETAHAIRKLPLTKAKRYLEDVLAHKQAIPFTRFCRGVGRTAQAKNRHSNGQGRWPVKSAGFILDLLKNAESNAEVKGLDVDTLYISHIQVNQAQKQRRRTYRAHGRINPYMSSPCHIELTLSEKEEPVKKEPEMQVASGTKKGKALRSGASS

SEQ ID NO: 6655 - protein, 182 aa, Sarracenia psittacina
MVKYSREPDNPTKSCKARGSDLRVHFKNTRETAHAIRKLPLAKAKRYLEDVLAHKQAIPFTRFCRGVGRTAQAKNRHSNGQGRWPAKSARFILDLLKNAESNAEVKGLDVESLHISHIQVNQAQKQRRRTYRAHGRINPYMSSPCHIELILSEKEEPVKKEPELQVASSTRKSKALRSGASS

SEQ ID NO: 6656 - protein, 176 aa, Gossypium hirsutum
MVKYSREPDNPTKSCKARGSDLRVHFKNTRETAFAIRKLPLTKAKRYLEDVIAHKQAIPFRRFCGGVGRTAQAKNRHSNGQGRWPVKSAKFILDLLKNAESNAEVKGLDVDSLIISHIQVNQAQKQRRRTYRAHGRINPYMSSPCHIELILSEKEEPVKKEPETQLAPRKSKGASS

SEQ ID NO: 6657 - protein, 176 aa, Cajanus cajan
MVKYSREPDNPTKSCKARGADLRVHFKNTRETAFAIRKLPLVKAKRYLEDVLAHKQAIPFRRFCGGVGRTAQAKNRHSNGQGRWPVKSAKFILDLLKNAESNAEVKGLDVDALYISHIQVNQAQKQRRRTYRAHGRINPYMSSPCHIELILSEKEEPVKKEPETQLATSKKRAAAA

SEQ ID NO: 6658 - protein, 181 aa, Populus trichocarpa
MVKYSREPDNPTKSCKARGSDLRVHFKNTRETAFSIRKLPLGKAKGYLEDVLAHKQAIPFRRFCRGVGRTAQAKNRHSNGQGRWPAKSAKFILDLLKNAESNAEVKGLDVDALYISHIQVNQAQKQRRRTYRAHGRINPYMSSPCHIELTLSEKEEPVKKEADTQIAPRKPKGALRSGASS

SEQ ID NO: 6659 - protein, 181 aa, Populus trichocarpa
MVKYSREPDNQTKSCKARGSDLRVHFKNTRETAFSIRKMPLDKAKRYLEDVLAHKQAIPFRRFCGGVGRTAQAKNRHSNGQGRWPAKSAKFILDLLKNAESNAEVKGLDVDALYISHIQVNQAQKQRRRTYRAHGRINPYMSSPCHIELILSEKEEPVKKEADTQIAPRKPKGALRSGASS

SEQ ID NO: 6660 - protein, 176 aa, Silene vulgaris
MVKYSQEPDNPTKSCKARGSDLRVHFKNTRETAFSLRKMPLVKAKRYLEDVLAHKQAIPFRRFCGGVGRTAQAKSRHSNGQGRWPAKSAKFILDLLKNAESNAEMKGLDVDALYISHIQVNQAQKQRRRTYRAHGRINPYMSHPCHIELVLSEKEEPVKKEAETQLAPSKSKRSQA

SEQ ID NO: 6661 - protein, 176 aa, Tragopogon dubius
MVKYSKEPDNPTKSCKARGSDLRCHFKNTRETAHAIRKLPLLKAKRYLEDVLAHKQAIPFTRFCRGVGRTAQAKNRHSNGQGRWPAKSAKFILDLLKNAESNAEVKGLDVDALHISHIQVNQAQKQRRRTYRAHGRINPYMSSPCHIELTLSEKEEPVKKEVDTQLAPSRKAKNQA

SEQ ID NO: 6662 - protein, 175 aa, Vinca minor
MVKYSREPDNPTKSCKARGSDLRVHFKNTRETAHAIRKLPLVKAKRYLEDVLAHKQAIPFTRFCRGVGRTAQAKNRHSNGQGRWPVKSAKFILDLLKNAESNAEVKGLDVDSLYISHVQVNQAQKQRRRTYRAHGRINPYMSSPCHIELILSEKEEPVKKEPESQLATSNKSRKA

SEQ ID NO: 6663 - protein, 183 aa, Cucumis melo
MVKYSREPDNPTKSCKARGSDLRVHFKNTRETAFAIRKLPLAKAKRYLEDVLAHKQAIPFRRFCGGVGRTAQAKNRHSNGQGRWPVKSAKFILDLLKNAESNAEVKGLDVDLLHVSHIQVNQAQKQRRRTYRAHGRINPYMSSPCHIELILSEKEEPVKKEPETQLATGKPKKGQAIRSGASS

SEQ ID NO: 6664 - protein, 175 aa, Petunia hybrida
MVKYSREPDNQTKSCKARGSSLRVHFKNTRETAHALRKMPLDKAKRYLEDVLAHKQAIPFTRFCRGVGRTAQAKNRHSNGQGRWPVKSAGFILDLLKNAESNAEVKGLDVDSLFISHIQVNQAQKQRRRTYRAHGRINPYMSHPCHIELILSEKEESVKKEPETQLAPRKTKASS

SEQ ID NO: 6665 - protein, 175 aa, Petunia hybrida
MVKYSREPDNHTKSCKARGSALRVHFKNTRETAHALRKMPLDKAKRYLEDVLAHKQAIPFTRYCRGVGRTAQAKNRHSNGQGRWPVKSAKHILDLLKNAESNAEVKGLDVDSLFISHIQVNQAQKQRRRTYRAHGRINPYMSHPCHIELILSEKEESVKKEPETQLAPRKSKASS

SEQ ID NO: 6666 - protein, 174 aa, Lippia dulcis
MVKYSLEPDNPTKSCKARGSDLRVHFKNTRETAHALRKMPLIKAKRYLEDVLSHKQAIPFTRFCGGVGRTAQAKNRHSNGQGRWPVKSAKFILDLLKNAESNAEVKGLDVDALYITHIQVNQAQKQRRRTYRAHGRINPYMSSPCHIELTLSEKEEPVKKEPESQLATSKPRKA

SEQ ID NO: 6667 - protein, 174 aa, Salvia sclarea
MVKYSREPDNITKSCKARGSDLRVHFKNTRETAHAIRKLPLGKAKRYLEDVLAHKQAIPFTRFCGGVGRTAQAKNRHSNGQGRWPVKSAKFILDLLKNAESNAEVKGLDVDALFISHIQVNQAQKQRRRTYRAHGRINPYMSSPCHIELILSEKEEPVKKEPESQLATSKPRKS

SEQ ID NO: 6668 - protein, 175 aa, Nicotiana tabacum
MGKYSREPENPTKSCKARGSDLRVHFKNTRETAHALRKMPLDKAKRYLEDVLAHKQAIPFTRFCRGVGRTAQVKNRHSNGQGRWPVKSAGFILDLLKNAESNAEVKGLDVDSLYITHIQVNQAQKQRRRTYRAHGRINPYMSNPCHIELTLSEKEESVRKEPETQLAPSKTKASS

SEQ ID NO: 6669 - protein, 174 aa, Musa acuminata
MVKYSREPSNPTKSAKAMGHDLRVHFKNTRETAHAIRKLPLSKAKRYLEDVIAHKQAIPFRRFCGGVGRTAQAKGRHPNGQGRWPAKSARFILDLLKGAKSNAEVKGLDVDALFISHIQVNQAPKQRRRTYRAHGRINPYMSSPCHIELILSEKEEPVKKEPETQIAPSKPKKA

SEQ ID NO: 6670 - protein, 173 aa, Cicer arietinum
MVKYSREPDNPTKSCKARGADLRVHFKNTRETAFSIRKLPLTKAKSYLEDVLAHKQAIPFRRFCRGVGRTAQAKNRHSNGQGRWPAKSAKFILDLLKNAESNAEVKGLDIDALYVSHIQVNQAQKQRRRTYRAHGRINPYMSSPCHIELVLSEKEEAVKKEPETQLAPSKKKA

SEQ ID NO: 6671 - protein, 174 aa, Zingiber officinale
MVKYSRDPSNPTKSAKAMGHDLRVHFKNTRETAQAIRKLPLSKAKRYLNDVIAHKQAIPFRRFCRGVGRTAQAKGRHPNGQGRWPVKSAGFILDLLKNAESNAEVKGLDIDSLFISHIQVNQAQKQRRRTYRAHGRINPYMSSPCHIELILSEKEESVKKEPETQLATSKSRKA

SEQ ID NO: 6672 - protein, 174 aa, Ipomoea nil
MVKYSREPDNPTKSCKARGSDLRVHFKNTRETAHAIRKLPLTKAKRYLEDVLVHKQAIPFTRFCRGVGRTAQAKNRHPNGQGRWPVKSARFILDLLKNAESNAEVKGLDVDSLFISHIQVNQAQKQRRRTYRAHGRINPYMSSPCHIELTLSEKEEPVKKEPESQLATSKARKA

SEQ ID NO: 6673 - protein, 174 aa, Petunia hybrida
MVKYSREPENPTKSCKARGSDLRVHFKNTRETAHAIRKLPLVKAKRYLEDVLAHKQAIPFTRFCRGVGRTAQAKNRHSNGQGRWPVKSAGFILDLLKNAESNAEVKGLDVDSLYISHIQVNQAQKQRRRTYRAHGRINPYMSSPCHIELILSEKEESVKKEPESQLAASKSRKA

SEQ ID NO: 6674 - protein, 174 aa, Ananas comosus
MVKYSREPANPTKSAKAMGQDLRVHFKNTRETAHAIRKLPLAKAKRYLEDAVAHKQAIPFRRFCRGVGRTAQAKARHSNGQGRWPVKSCRFILDLLKNAESNAEVKGLDVDTLYVSHIQVNQAQKQRRRTYRAHGRINPYMSSPCHIELILSEKEEPVKKEPETQIAPRKTKNT

SEQ ID NO: 6675 - protein, 173 aa, Utricularia gibba
MVKYSREPDNATKSCKARGSDLRVHFKNTRETAHAIRKLPLAKAKRYLEDVLVHKQAIPFTRFCGGVGRTAQAKNRHSNGQGRWPVKSAKFILDLLKNAESNAEVKGLDVDSLYISHIQVNQAQKQRRRTYRAHGRINPYMSSPCHIELILSEKEEAVKKEPESQLATKPRKA

SEQ ID NO: 6676 - protein, 173 aa, Capsicum annuum
MVKYSREPDNPTKSCKARGSSLRVHFKNTRETAHALRKMPLDKAKKYLEDVLSHKQAIPFTRFCGGVGRTAQVKDRHSNGQGRWPVKSAGFILDLLKNAESNAEVKGLDVDSLFISHIQVNQAQKQRRRTYRAHGRINPYMSHPCHIELVLSEKEESVKKEPETQLAPRKAKA

SEQ ID NO: 6677 - protein, 173 aa, Ricinus communis
MVKYSREPDNPTKSCKARGSDLRVHFKNTRETAYSIRKLHLAKAKRYLEDVMAHKQAIPFRRFCGGVGRTAQAKNRHSNGQGRWPVKSAKFILDLLKNAESNAEMKGLDVDSLYISHIQVNQAQKQRRRTYRAHGRINPYMSSPCHIELILSEKEEAVKKEPETQLAPRKARA

SEQ ID NO: 6678 - protein, 179 aa, Fagopyrum esculentum
MVKYSREPDNPTKSCKARGSDLRVHFKNTRETAFSIRKMPLVKAKRYLEDVLVHKQAIPFRRFCRGVGRTAQAKNAGHPNGQARWPAKSAKFILDLLKNAESNAEMKGLDVDSLYVSHVQVNQAQKQRRRTYRAHGRINPYMSHPCHIELILSEKEEPVKKEPESQLAASKSKKSAASA

SEQ ID NO: 6679 - protein, 173 aa, Capsicum annuum
MVKYSREPDNPTKSCKSRGSSLRVHFKNTRETAHALRKMPLDKAKKYLEDVLAHKQAIPFTRFCRGVGRTAQVKDRHSNGQGRWPVKSAGFILDLLKNAESNAEVKGLDVDSLFISHIQVNQAQKQRRRTYRAHGRINPYMSHPCHIELILSEKEESVKKEPETQLASRKTKA

SEQ ID NO: 6680 - protein, 178 aa, Populus trichocarpa
MVKYSREPDNPTKSCKARGGDLRVHFKNTRETAFALRKLPLAKAKRYLEDVLAHKQAIPFRRFCGGVGRTAQAKNRHSNGQGRWPAKSARFILDLLKNAESNAEVKGLDVDALYISHIQVNQAQKQRRRTYRAHGRINPYMSSPCHIELVLSEKEEPVKKEPETQIATSKSKKSQASS

SEQ ID NO: 6681 - protein, 171 aa, Carthamus tinctorius
MVKYSKEPDNPTKSCKARGSDLRVHFKNTRETAHAIRKLPLIKAKRYLEDVLAHKQAIPFTRFCRGVGRTAQAKNRHSNGQGRWPAKSAKYILDLLKNAESNAEVKGLDVDALFISHIQVNQAQKQRRRTYRAHGRINPYMSSPCHIELTLSEKEEPVKKEAESRLATSGK

SEQ ID NO: 6682 - protein, 176 aa, Brassica juncea
MVKYSQEPDNSTKSCKARGADLRVHFKNTRETAHAIRKLPLNKAKRYLEDVIAHKQAIPFTRFCRGVGRTAQAKNRHSNGQGRWPAKSAHFVLDLLKNAESNAEVKGLDVDALFISHIQVNQAAKQRRRTYRAHGRINPYMSNPCHIELILSEKEEPVKKEPETQLAAKSKKGASA

SEQ ID NO: 6683 - protein, 183 aa, Rosa hybrid cultivar
MVKYSKEPDNPTKSCKARGSDLRVHFKNTRETAFSIRKMSLIKAKRYLEDVLVHKQAIPFRRFCRGVGRTAQAKNRHSNGQGRWPVKSAKFILDLLKNAESNAEVKGLDVDSLVVSHIQVNQAQKQRRRTYRAHGRINPYMSSPCHIELTLSEKEEPVKKEPDSQLATSKSRKSQAVRSGGSA

SEQ ID NO: 6684 - protein, 89 aa, Picea glauca
MVKYSREPGNPTKSAKARGSDLRVHFKNTRETAQAVKKLPLTKAKRYLEDVIAHKQAIPFRRFCGGVWQNRPSKVSKFKWTGSLACQVC

SEQ ID NO: 6685 - protein, 177 aa, Helianthus annuus
MVKYSKEPDNPTKSCKARGSDLRCHFKNTRETAHAIRKLPLIKAKRYLEDVLAHKQAIPFTRFCRGVGRTAQAKNRHSNGQGRWPAKSAKFILDLLKNAESNAEVKGLDVDALFISHIQVNQAQKQRRRTYRAHGRINPYMSSPCHIELTLSEKEEPVKKEAESQLATSGKSKKSQA

SEQ ID NO: 6686 - protein, 170 aa, Helianthus annuus
MVKYSQEPDNPTKSCKARGSDLRCHFKNSRETAHAIRKLPLIKAKRYLEDVLAHKQAIPFTRFCRGVGRTAQAKNRHSNGQGRWPAKSAKFILDLLKNAESNAEVKGLDVDALFISHIQVNQAQKQRRRTYRAHGRINPYMSSPCHIELTLSEKEEPVKKEAESQLAKSK

SEQ ID NO: 6687 - protein, 183 aa, Abies balsamea
MVKYSREPSNPTKSCKARGSDLRVHFKNTRETAQAVKKLPLAKAKSYLEDVLAHKQAIPFRRFCGGVGRTAQAKSRHSNGQGRWPVKSAQFLLQLLKNAESNAEVKGLDVDALYISHIQVNQAQKQRRRTYRAHGRINPYMSSPCHIELILSEKEAPVKKEVESQIAPTRSKKGQALSSGTSS

SEQ ID NO: 6688 - protein, 182 aa, Malus domestica
MVKYSREPDNITKSCKARGSDLRVHFKNTRETAFSIRKMRLDKAKSYLEDVLAHKQAIPFRRFCRGVGRTAQAKNRHSNGQGRWPVKSAKFILDLLKNAESNAEVKGLDVDSLIVSHIQVNQAQKQRRRTYRAHGRINPYMSSPCHIELILSEKEEPVKKEPESQLATSKSKKSALKSGASS

SEQ ID NO: 6689 - protein, 183 aa, Aristolochia fimbriata
MVKYSREPDNPTKACKARGSDLRVHFKNTRETAHAIRKLPLVKAKRYLEDVIAHKQAIPFRRFCGGVGRTAQAKNRHSNGQGRWPVKSAKFILDLLKNAESNADVKGLDVDALYVSHVQVNQAQKQRRRTYRAHGRINPYMSSPCHIELILSEKEESVKKEPDTQLAPRKSKSQALRSGASSA

SEQ ID NO: 6690 - protein, 176 aa, Brassica juncea
MVKYSQEPDNQTKSCKARGSDLRVHFKNTRETAHAIRKLPLLKAKRYLEDVIAHKQAITFTRFCRGVGRTAQAKNRHSNGQGRWPAKSAQFVLDLLKNAESNAEVKGLDVDALFISHIQVNQAAKQRRRTYRAHGRINPYMSNPCHIELILSEKEEPVKKEPETKLAAKSKKGASS

SEQ ID NO: 6691 - protein, 202 aa, Fagus grandifolia
MVKYSREPENPTKSCKARGSDLRAHFKNTRETAHAIRKLPLLKAKRYLEDVLVHKQAIPFRRFCRGVGRTAQAKSRHSNGQGRWPVKSAKFILDLLKNAESNAEVKGLDVDSLHISHIQVNQAQKQRRRTYRAHGRINPYMSSPCHIELTLSEKEEPVKKEPETQLAPSKTRKTQALRVVLLLEIWWLQGILVIHFFIVHSG

SEQ ID NO: 6692 - protein, 175 aa, Brassica napus
VKYSQEPDNSTKSCKARGADLRVHFKNTRETAHAIRKLPLLKAKRYLEDVIAHKQAIPFTRFCRGVGRTAQAKNRHSNGQGRWPAKSAQFVLDLLKNAESNAEVKGLDVDALFISHIQVNQAAKQRRRTYRAHGRINPYMSNPCHIELILSEKEEPVKKEPETQLAAKSKKGASS

SEQ ID NO: 6693 - protein, 172 aa, Centaurea maculosa
  misc_feature (56)..(56): Xaa can be any naturally occurring amino acid
MVKYSKEPDNPTKSCKARGADLRCHFKNTRETAHAIRKLPLIKAKRYLEDVLAHKXAIPFTRFCRGVGRTAQAKNRHSNGQGRWPAKSAKFILDLLKNAESNAEVKGLDVDALHISHIQVNQAQKQRRRTYRAHGRINPYMSSPCHIELTLSEKEEPVKKEPESQLAARKTN

SEQ ID NO: 6694 - protein, 176 aa, Cleome gynandra
MVKYSREPDNSTKSCKARGSDLRVHFKNTRETAHAIRKLPLIKAKRYLEDVIAHKQAIPFTRFCRGVGRTAQAKNRHSNGQGRWPAKSANFILDLLKNAESNAEVKGLDVDALYISHIQVNQARKQRRRTYRAHGRINPYMSSPCHIELILSEKEEPVKKEPETQLATKSKKSASS

SEQ ID NO: 6695 - protein, 178 aa, Gossypium hirsutum
MVKYSKESDNPTKSCKARGSDLRVHFKNTRETAFAIRKLPLGKAKRYLEDVMAHKQAVPFRRFCGGVGRTAQAKNRHSNGQGRWPVKSAKFILDLLKNAESNAEVKGLDVDALYISHIQVNQAQKQRRRTYRAHGRINPYMSSPCHIELILLEKEEPVKKEPETQLAASKSKKSQVSV

SEQ ID NO: 6696 - protein, 178 aa, Gossypium hirsutum
MVKYSKESDNPTKSCKARGSDLRVHFKNTRETAFAIRKLALGKAKTYLEDVMAHKQAIPFRRFCGGVGRTAQAKNRHSNGQGRWPVKSAKFILDLLKNAESNAEVKGLDVDALYISHIQVNQAQKQRRRTYRAHGRINPYMSSPCHIELILSEKEEPVKKEPETQLAASKSKKSQVSV

SEQ ID NO: 6697 - protein, 183 aa, Cucurbita pepo
MVKYSREPDNPTKSCKARGSDLRVHFKNTRETAHAIRKLPLVKAKRYLEDVLAHKQAIPFRRFCGGVGRTAQAKNRHSNGQGRWPVKSAKFILDLLVNAESNAEVKGLDVDLLHVSHIQVNQAQKQRRRTYRAHGRINPYMSSPCHIELILSEKEEPVKKEPETQLATGKSKKGRAIRSGASS

SEQ ID NO: 6698 - protein, 172 aa, Flaveria ramosissima
MVKYSKEPDNPTKSCKARGSDLRCHFKNTRETAHAIRKLPLIKAKRYLEDVLAHKQAIPFTRFCGGVGRTAQAKNRHSNGQGRWPAKSAKFILDLLKNAESNAEVKGLDVDSLYISHIQVNQAQKQRRRTYRAHGRINPYMSSPCHIELTLSEKEEPVKKEPESQLAAKKTK

SEQ ID NO: 6699 - protein, 183 aa, Panax ginseng
MVKYSKEPDNPTKSCKARGSGLRVHFKNTRETAHAIRKLPLTKAKRYLEDVLAHKQAIPFTRFCRGVGRTAQAKNRHSNGQGRWPVKSAKFILDLLKNAESNAEVKGLDVDSLHISHIQVNQAQKQRRRTYRAHGRINPYMSSPCHIELTLSEKEESVKKEPETQLAPRKNKKNQVLRSGASS

SEQ ID NO: 6700 - protein, 185 aa, Vitis vinifera
MVKYSREPDNPTKSCKARGSDLRVHFKNTRETAHAIRKLPLAKAKRYLEDVLVHKQAIPFTRFCRGVGRTAQAKNRHSNGQGRWPVKSAKFILDLLKNAESNADLKGLDVDSLYISHIQVNQAQKQRRRTYRAHGRINPYMSSPCHIELILSEKEEPVKKEPETQLATGKSKKSLRGGASTRIAI

SEQ ID NO: 6701 - protein, 182 aa, Humulus lupulus
MVKYSREPDNITKSCKARGSDLRVHFKNTRETAFAIRKLPLIKAKRYLEDVLVHKQAIPFRRFCRGVGRTAQAKNRHSNGQGRWPVKSAKFILDLLKNAESNAEVKGLDVDALFVSHIQVNQAQKQRRRTYRAHGRINPYMSSPCHIELTLSEKEEAVKKEAETQLATNKSKKTQLRSGASS

SEQ ID NO: 6702 - protein, 177 aa, Mesembryanthemum crystallinum
MVKYSREPDNPTKSCKARGSDLRVHFKNTRETAFSIRKMPLAKAKRYMEDVLAHKQAIPFRRFCGGVGRTAQAKNRHSNGQGRWPAKSAKFILDLLKNAESNAEMKGLDVDSLYVSHVQVNQAQKQRRRTYRAHGRINPYMSHPCHIELILSEKEEPVRKEPESQLATSKSKKSQAS

SEQ ID NO: 6703 - protein, 177 aa, Mesembryanthemum crystallinum
MVKYSQEPDNPTKSCKARGSDLRVHFKNTRETAFSLRKMPLAKAKRYLEDVLAHKQAIPFRRFCRGVGRTAQAKNRHSNGQGRWPAKSAKFILDLLKNAESNAEMKGLDVDSLYISHIQVNQAQKQRRRTYRAHGRINPYMSHPCHIELIVSEKEEPVKKEPESQLATSKSKKGASS

SEQ ID NO: 6704 - protein, 188 aa, Eragrostis curvula
  misc_feature (19)..(19): Xaa can be any naturally occurring amino acid
GKETRTHGEVLDGAVIHQXRQAMGRDLRVHFKNTRETAFALRKLPLTKAKRYLEDVIAHKQAIPFRRYCGGVGRTAQAKNRQPNGQGRWPAKSARFILDLLKNAESNAEVKGLDVDALYISHIQVNQAQKQRRRTYRAHGRINPYMYSPCHIELILSETDEPVKKEAESQIPTRNGLREAKALTHLGM

SEQ ID NO: 6705 - protein, 169 aa, Nuphar advena
MVKYSREPDNPTKSCKARGSDLRVHFKNTRETAFAIRKLPLDKAKRYLEDVIAHKQAIPFRRFCGGVGRTAQAKVRHSNGQGRWPLKSAKFILNLLKSAEINADVKGLDVDTLYISHIQVNQAQKQRRRTYRAHGRINPYMSSPCHIELILSEKEAPVKKEAETQVAPR

SEQ ID NO: 6706 - protein, 176 aa, Ananas comosus
MVKYSREPTNPTKSAKAMGRDLRVHFKNTRETAFAIRKLPLAKTKRYLEDVIAHKQAIPLRRFCGGVGRTAQAKSRHSNGQGRWPVKSCRFILDLLKNAESNAEVKGLDVDALYISHVQVNQAQKQRRRTYRAHGRINPYMSSPCHIELILSEREEPVKKEPESQIAPRKTKNTVA

SEQ ID NO: 6707 - protein, 183 aa, Prunus persica
MVKYSREPDNITKSCKARGSDLRVHFKNTRETAFAIRKLPLVKAKRYLEDVLVHKQAIPFRRFCRGVGRTAQAKNRHSNGQGRWPVKSAKFILDLLKNAESNAEVKGLDVDSLIVSHIQVNQAQKQRRRTYRAHGRINPYMSSPCHIELILAEKEEPVKKEPESQLATSKSKKSQALRSGASS

SEQ ID NO: 6708 - protein, 176 aa, Raphanus sativus
  misc_feature (98)..(98): Xaa can be any naturally occurring amino acid
MVKYSQEPDNTTKSCKARGADLRVHFKNTRETAHAIRKLPLNKAKRYLEDVIAHKQAIPFTRFCRGVGRTAQAKNRHSNGQGRWPAKSAQFVLDLLKXAESNAEVKGLDVDALFISHIQVNQAAKQRRRTYRAHGRINPYMSNPCHIELILSEKEEPVKKEPETQLAAKSKKGTSS

SEQ ID NO: 6709 - protein, 176 aa, Raphanus sativus
MVKYSQEPDNSTKSCKARGADLRVHFKNTRETAHAIRKLPLIKAKRYLEDVIAHKQAIPFTRFCRGVGRTAQAKNRHSNGQGRWPAKSAQFVLDLLKNAESNAEVKGLDVDALFISHIQVNQAAKQRRRTYRAHGRINPYMSNPCHIELILSEKEESVKKEPETQLAAKSKKGASS

SEQ ID NO: 6710 - protein, 183 aa, Rosa hybrid cultivar
MVKYSKEPDNPTKSCKARGSDLRVHFKNTRETAFSIRKMSLIKAKRYLEDVLVHKQAIPFRRFCRGVGRTAQGKNRHSNGQGRWPVKSAKFILDLLKNAESNAEVKGLDVDSLVVSHIQVNQAQKQRRRTYRAHGRINPYMSSPCHIELTLSEKEEPVKKEPDSQLATSKSRKSQAVRSGGSA

SEQ ID NO: 6711 - protein, 183 aa, Euphorbia esula
MVKYSREPDNSTKSCKARGSDLRVHFKNTRETAFALRKLPLAKAKRYLEDVMAHKQAIPFRRFCGGVGRTAQAKSRHSNGQGRWPAKSAKFILDLLKNAESNAEVKGLDVENLYITHIQVNQAQKQRRRTYRAHGRINPYMSSPCHIELILSEKEESVQKEPETQLATSKSKKSQAVRTGASA

SEQ ID NO: 6712 - protein, 176 aa, Unknown
  Sequence found in Organisms: Thellungiella halophila, Eutrema halophilum
MVKYSQEPDNSTKSCKARGADLRVHFKNTRETAHAIRKLPLNKAKRYLEDVIAHKQAIPFTRFCRGVGRTAQAKNRHSNGQGRWPAKSAQFVLDLLKNAESNAEVKGLDVDALFISHIQVNQAAKQRRRTYRAHGRINPYMSNPCHIELILSEKEEPVKKVPETQLAAKSKKGTSS

SEQ ID NO: 6713 - protein, 176 aa, Trigonella foenum-graecum
MVKYSREPDNPTKSTKARGADLRVHFKNTRETAFAIRKLPLIKAKRYLEDVLAHKQAIPFRRFCRGVGRTAQAKNRHSNGQGRWPVKSAKFILDLLKNAESNAEVKGLDVDALYVSHIQVNQSQRQRRRTYRAHGRINPYMSSPCHIELILSEKEEAVQKEPETQLATNKKKSQAL

SEQ ID NO: 6714 - protein, 182 aa, Tripterygium wilfordii
MVKYSREPSNPTKSCKARGSDLRVHFKNTRETAHAIRKLALVKAKSYLEDVIVHKQAIPFRRFCRGVGRTAQAKNRHSNGQGRWPMKSAKFILDLLKNAESNAEVKGLDVDALYVSHIQVNQAQKQRRRTYRAHGRINPYMSSPCHIELTLSEKEESVKKEPETQLAPRKVKGQALRSGASS

SEQ ID NO: 6715 - protein, 183 aa, Tripterygium wilfordii
MVKYSKEPDNPTKSCKARGSDLRVHFKNTRETAFAIRKLPLVKAKRYLEDVTVHKQAIPFRRFCRGVGRTAQAKNRHSNGQGRWPLKSAKFILDLLKNAESNAEVKGLDVDSLYISHIQVNQAQKQRRRTYRAHGRINPYMSSPCHIELTLSEKEEPVKKEPETQLTTSKSKKSQALRSGASS

SEQ ID NO: 6716 - protein, 183 aa, Tripterygium wilfordii
MVKYSKEPDNPTKSCKARGSDLRVHFKNTRETAFAIRKLPLVKAKRYLEDVMGHKQAIPFRRFCRGVGRTAQAKNRHSNGQGRWPLKSAKFILDLLKNAESNAEVKGLDVDSLYISHIQVNQAQKQRRRTYRAHGRINPYMSSPCHIELTLSEKEEPVKKEPETQLTTSKSKKSQSLRSGASS

SEQ ID NO: 6717 - protein, 183 aa, Valeriana officinalis
MVKYSREPDNHTKSCKARGSDLRCHFKNTRETAHAIRKLGLTKAKRYLEDVLVHKQAIPFTRFCRGVGRTAQAKNRHSNGQGRWPVKSAKFILDLLKNAESNAEVKGLDVDSLFISHIQVNQAQKQRRRTYRAHGRINPYMSSPCHIELILSEKEESVKKEAETQLAPRKKGKSQVLRSGASS

SEQ ID NO: 6718 - protein, 182 aa, Actinidia deliciosa
  misc_feature (180)..(180): Xaa can be any naturally occurring amino acid
MVKYSREPDNPTKSCKARGSDLRVHFKNTRETAHAIRKLPLTKAKRYLEDVLAHKQAIPFTRFCRGVGRTAQAKNRHSNGQGRWPVKSAGFILDLLKNAESNAEVKGLDVESLYISHIQVNQAQKQRRRTYRAHGRINPYMSSPCHIELILSEKEEPVKKEPEMQVASSTKKGRALRSGXSA

SEQ ID NO: 6719 - protein, 176 aa, Gossypium raimondii
MVKYSREPDNPTKSCKARGSDLRVHFKNTRETAFAIRKLPLTKAKRYLEDVIAHKQAIPFRRFCGGVGRTAQAKNRHSNGQGRWPVKSAKFILDLLKNAESNAEVKGLDVDSLIISHIQVNQAQKQRRRTYRAHGRINPYMSSPCHIELILSEKEEAVKKEPETQLAPRKSKGASA

SEQ ID NO: 6720 - protein, 176 aa, Gossypium raimondii
MVKYSREPDNPTKSCKARGSDLRVHFKNTRETAFAIRKLPLTKAKRYLEDVIAHKQAIPFRRFCGGVGRTAQAKNRHSNGQGRWPVKSAKFILDLLKNAESNAEVKGLDVDSLIISHIQVNQAQKQRRRTYRAHGRINPYMSSQCHIELILSEKEEPVKKEPETQLAPRKSKGASS

SEQ ID NO: 6721 - protein, 175 aa, Catharanthus roseus
MVKYSREPDNPTKSCKARGSDLRVHFKNTRETAHAIRKLPLVKAKRYLEDVLAHKQAIPFTRYCGGVGRTAQAKNRHSNGQGRWPVKSAKFILDLLRNAESNAEVKGLDVDSLFISHIQVNQAQKQRRRTYRAHGRINPYMSSPCHIELILSEKEEPVKKEPESQLATSNKSRKA

SEQ ID NO: 6722 - protein, 176 aa, Gossypium hirsutum
MVKYSREPDNPTKSCKARGSDLRVHFKNTRETAFAIRKLPLTKAKRYLEDVIAHKQAIPFRRFCGGVGRTAQAKNRHSNGQGRWPMKSAKFILDLLKNAESNAEVKGLDVDSLIISHIQVNQAQKQRRRTYRAHGRINPYMSSPCHIELILSEKEEAVKKEPETQLAPRKSKGASS

SEQ ID NO: 6723 - protein, 176 aa, Gossypium hirsutum
MVKYSREPDNPTKSCKARGSDLRVHFKNTRETAFAIRKLPLTKAKRYLEDVIAHKQAIPFRRFCGGVGRTAQAKNRHSNGQGRWPVKSAKFILDLLKNAESNAEVKGLDVDSLIISHIQVNQAQKQRRRTYRAHGRINPYMSSQCHIELILSEKEEPVKKEPETQLAPRKSKGASF

SEQ ID NO: 6724 - protein, 176 aa, Gossypium hirsutum
MVKYSREPDNPTKSCKARGSDLRVHFKNTRETAFAIRKLPLTKAKRYLEDVIAHKQAIPFRRFCGGVGRTAQAKNRHSNGQGRWPVKSAKFILDLLKNAESNAEVKGLDVDSLVISHIQVNQAQKQRRRTYRAHGRINPYMSSPCHIELILSEKEEAVKKEPETQLAPRKSKGASA

SEQ ID NO: 6725 - protein, 176 aa, Humulus lupulus
MVKYSKEPDNPTKSCKSRGSDLRVHFKNTRETAFAIRKLPLIKAKRYLEDVLAHKQAIPFRRFCRGVGRTAQAKNRHSNGQGRWPVKSAKFILDLLKNAESNAEVKGLDVDSLYISHIQVNQAQKQRRRTYRAHGRINPYMSSPCHIELTLSEKEEPVKKEPESQLASRKPEKSRA

SEQ ID NO: 6726 - protein, 181 aa, Aquilegia formosa
MVKYSKEPDNPTKSCKARGSDLRVHFKNTRETAHSIRKMSLVKAKRYLEDVLAHKQAIPFRRFCRGVGRTAQVKDRHPNGQGRWPVKSAKFVLDLLKNAESNADVKGLDVDALYVSHIQVNQAQKQRRRTYRAHGRINPYMSSPCHIELTLSEKEEPVKKEAETQLTQSRPKKTLRSGASS

SEQ ID NO: 6727 - protein, 183 aa, Abies balsamea
MVKYSREPGNPTKSAKARGSDLRVHFKNTRETAQAVKKLQLVKAKRYLEDVIAHKQAIPFRRFCGGVGRTAQAKSRNSNGQGRWPVKSAEFLLGLLKNAESNAEVKGLDVDTLYISHIQVNQAQKQRRRTYRAHGRINPYMSSPCHIELILSEKEAPVKKEAETQIASRKPRKAQTLRSGASS

SEQ ID NO: 6728 - protein, 183 aa, Citrullus lanatus
MVKYSREPDNPTKSCKARGSDLRVHFKNTRETAHAIRKLPLAKAKRYLEDVLAHKQAIPFRRFCGGVGRTAQAKNRHSNGQGRWPVKSAKFILDLLKNAESNAEVKGLDVDLLHVSHIQVNQAQKQRRRTYRAHGRINPYMSSPCHIELILSEKEEPVKKEPETQLATGKPKKGQAIRSGASS

SEQ ID NO: 6729 - protein, 175 aa, Cynara scolymus
MVKYSKEPENPTKSCKARGSDLRCHFKNTRETAHAIRKLPLIKAKRYLEDVLVHKQAIPFTRFCRGVGRTAQAKNRHSNGQGRWPAKSAKFILDLLKNAESNAEVKGLDVDALHISHIQVNQAQKQRRRTYRAHGRINPYMSSPCHIELTLSEKEEPVKKEAETQLAPRKNKNQA

SEQ ID NO: 6730 - protein, 175 aa, Taraxacum officinale
MVKYSKEPENPTKSCKARGSDLRCHFKNTRETAHALRKMSLIKAKSYLEDVLVHKQAIPFTRFCRGVGRTAQAKNRHSNGQGRWPAKSAKFILDLLKNAESNAEVKGLDVDALYISHIQVNQAQKQRRRTYRAHGRINPYMSSPCHIELTLSEKEEPVKKEPESQLAPRKTKNQA

SEQ ID NO: 6731 - protein, 175 aa, Lactuca sativa
MVKYSKEPDNPTKSCKARGSDLRCHFKNTRETAHALRKMPLIKAKRYLEDVLIHKQAIPFTRFCRGVGRTAQAKNRHSNGQGRWPAKSAKFILDLLKNAESNAEVKGLDVDALFISHIQVNQAQKQRRRTYRAHGRINPYMSSPCHIELTLSEKEEPVKKEAESQLATSGKSKKP

SEQ ID NO: 6732 - protein, 174 aa, Salvia sclarea
MVKYSREPDNITKSCKARGSDLRVHFKNTRETAHAIRKLPLGKAKRYLEDVLAHKQAIPFTRFCGGVGRTAQAKNRHSNGQGRWPVKSAKFILDLLKNAESNAEVKGLDVDALFISHIQVNQAQKQRRRTYRAHGRINPHMSSPCHIELILSEKEEPVKKEPESQLATSKPRKS

SEQ ID NO: 6733 - protein, 175 aa, Nicotiana tabacum
MVKYSREPENPTKSCKARGSDLRVHFKNTRETAHALRKMPLDKAKRYLEDVIAHKQAIPFTRFCRGVGRTAQAKNRHSNGQGRWPVKSAGFILDLLKNAESNAEVKGLDVDSLYITHIQVNQAQKQRRRTYRAHGRINPYMSNPCHIELTLSEKEESVRKEPETQLAPTKTKASS

SEQ ID NO: 6734 - protein, 175 aa, Nicotiana tabacum
MVKYSREPDNPTKSCKARGASLRVHFKNTRETAHALRKMPLDKAKRYLEDVLAHKQAIPFTRFCGGVGRTAQVKHRHSNGQGRWPVKSAKIILDLLKNAESNAEVKGLDVDSLYISHIQVNQAQKQRRRTYRAHGRINPYMSHPCHVELTLSEKEESVKKEPETQLAPRKAKASS

SEQ ID NO: 6735 - protein, 174 aa, Arnica chamissonis
MVKYSKEPENPTKSCKARGSDLRCHFKNTRETAHAIRKLPLIKAKRYLEDVLAHKQAIPFTRFCRGVGRTAQAKNRHSNGQGRWPAKSAKFILDLLKNAESNAEVKGLDVDALHISHIQVNQAQKQRRRTYRAHGRINPYMSSPCHIELTLSEKEEPVKKEPETQLAPRTKNQA

SEQ ID NO: 6736 - protein, 174 aa, Nicotiana tabacum
MVKYSQEPDNPTKSCKARGADLRVHFKNTRETAHAIRKLPLNKAKRYLEDVLAHKQAIPFTRFCRGVGRTAQAKNRHSNGQGRWPVKSAGFILDLLKNAESNAEVKGLDVDSLYVSHIQVNQAQKQRRRTYRAHGRINPYMSSPCHIELILSEKEESVKKEAETQLAASKSRKA

SEQ ID NO: 6737 - protein, 180 aa, Fagopyrum esculentum
MVKYSQEPDNPTKSCKARGSDLRVHFKNTRETAFSIRKMQLAKAKRYLEDVLIHKQAIPFRRFCRGVGRTAQAKNAGHPNGQGRWPAKSAKFILDLLKNAESNAEMKGLDVDSLYISHIQVNEAQKQRRRTYRAHGRINPYMSHPCHIELILSEKEEPVKKEPEAQITTSKSKKSGVVSS

SEQ ID NO: 6738 - protein, 180 aa, Fagopyrum esculentum
MVKYSQEPDNPTKSCKARGSDLRVHFKNTRETAFSIRKMQLAKAKRYLEDVLIHKQAIPFRRFCRGVGRTAQAKNAGHPNGQGRWPAKSAKFILDLLKNAESNAEMKGLDVDSLYISHIQVNEAQKQRRRTYRAHGRINPYMSHPCHIELILSEKEEPVKKEPEAQITTSKSKKSGAVSS

SEQ ID NO: 6739 - protein, 179 aa, Fagopyrum esculentum
MVKYSQEPDNPTKSCKARGSDLRVHFKNTRETAFSIRKMPLVKAKRYLEDVLVHKQAIPFRRFCRGVGRTAQAKNAGHPNGQARWPAKSAKFILDLLKNAESNAEMKGLDVDSLYVSHVQVNQAQKQRRRTYRAHGRINPYMSHPCHIELILSEKEEPVKKEPETQLAASKSKKSAVSS

SEQ ID NO: 6740 - protein, 185 aa, Linum usitatissimum
MVKYSQEPVNPTKSCKARGSDLRVHFKNTRETAFSIRKMALVKAKAYLEDVLAHKQAIPFRRFCRGVGRTAQAKNAGHPNGQARWPAKSAKFILDLLKNAESNAEVKGLDVDALFISHIQVNQAQKQRRRTYRAHGRINPYMSNPCHIELTLSEKEEPVKKEPETQLAASSKSRKGQALRSGASS

SEQ ID NO: 6741 - protein, 123 aa, Zea mays
MVKYSTEPTNPTKSAKAMGRDLHVHFKNTRETAFALRKLSLTKAKSYLEDVIAHKQAIPFRRYCGGVGRTAQAKSRHSNGQGRWPAKSAKFILDLLKNAESNAEVKGLDVDTIYVSHIQVNQA

SEQ ID NO: 6742 - protein, 172 aa, Acacia harpophylla
MVKYSREPDNPTKSCKARGSDLRVHFKNTRETAFAIRKLPLVKAKRYLEDVIAHKQAIPFRRFCGGVGRTAQAKNRHSNGQGRWPVKSAKFILDLLKNAESNAEVKGLDVDALHVSHIQVNQAQKQRRRTYRAHGRINPYMSSPCHIELILSEKEESVRKEPETQLATSKKA

SEQ ID NO: 6743 - protein, 171 aa, Centaurea maculosa
  misc_feature (99)..(99): Xaa can be any naturally occurring amino acid
MVKYSKEPDNPTKSCKARGSDLRVHFKNTRETAHAIRKLPLIKAKRYLEDVLAHKQAIPFTRFCRGVGRTAQAKNRHSNGQGRWPAKSAKYILDLLKNXESNAEVKGLDVDALFISHIQVNQAQKQRRRTYRAHGRINPYMSSPCHIELTLSEKEEPVKKEAESRLATSGK

SEQ ID NO: 6744 - protein, 173 aa, Citrus sinensis
MVKYSKEPDNPTKSCKARGSDLRVHFKNTRETAHAIRKLPLTKAKRYLEDVMAHKQAIPFTRFCGGVGRTAQAKNRHPNGQGRWPVKSAKFILDLLKNAESNAEVKGLDVDALYISHIQVNQAQKQRRRTYRAHGRINPYMSSPCHIELTLSEKEEPVKKEPETQLATSKSKK

SEQ ID NO: 6745 - protein, 173 aa, Tropaeolum majus
MVKYSREPDNPTKSCKARGSDLRVHFKNTRETAHAIRKMQLAKAKSYLEDVLAHKQAIPFRRFCRGVGRTAQAKSRHSNGQGRWPAKSANFILDLLKNAESNAEVKGLDVDSLYISHIQVNQAQRQRRRTYRAHGRINPYMSSPCHIELCLSEKEEAVRKEPESQLASRKSKA

SEQ ID NO: 6746 - protein, 181 aa, Aquilegia formosa
MVKYSQEPDNITKSCKARGSDLRCHFKNTRETAHAIRKMSLIKAKRYLEDVLAHKQAVPFRRFCRGVGRTAQVKDRHPNGQGRWPVKSVKFILDLLKNAESNADVKGLDVDSLYVSHIQVNQAAKQRRRTYRAHGRINPYMSSPCHIELILSEKEEAVKKEAETQLAPRKTKGSLRSGASS

SEQ ID NO: 6747 - protein, 182 aa, Cannabis sativa
MVKYSKEPDNITKSCKARGSDLRVHFKNTRETAFAIRKLPLIKAKRYLEDVLVHKQAIPFRRFCRGVGRTAQAKNRHSNGQGRWPVKSAKFILDLLKNAESNAEVKGLDVDALFVSHIQVNQAQKQRRRTYRAHGRINPYMSSPCHIELTLSEKEEAVKKEAETQLATNKSKKTQLRSGASS

SEQ ID NO: 6748 - protein, 175 aa, Helianthus annuus
MVKYSKEPENPTKSCKARGSDLRCHFKNTRETAHAIRKLPLIKAKRYLEDVLAHKQAIPFTRFCRGVGRTAQAKNRHSNGQGRWPEKSAKFILDLLKNAESNAEVKGLDEDALHISHIQVNQAQKQRRRTYRAHGRINPYMSSPCHIELTLSEKEEPVKKEPETQLAPRTKKNQA

SEQ ID NO: 6749 - protein, 70 aa, Helianthus annuus
MFWPTSKPFRLPVFVGVLGVQLRPKIGTLMVKVGGLPSQLNSFWIYSRMLKAMLRLKAWMLMHFSFHIFK

SEQ ID NO: 6750 - protein, 177 aa, Helianthus annuus
MVKYSKEPDNPTKSCKARGSDLRYHFKNTRETAHAIRKLPLIKAKRYLEDVLAHKQAIPFTRFCRGVGRTAQAKNRHSNGQGRWPAKSAKLILDLLKNAESNAEVKGLDVDALFISHIQVNQAQKQRRRTYRAHGRINPYMSSPCHIELTLSEKEEPVKKEAESQLATSGKSKKSQA

SEQ ID NO: 6751 - protein, 175 aa, Ambrosia trifida
MVKYSKEPENPTKSCKARGSDLRCHFKNTRETAHAIRKLPLIKAKRYLEDVLAHKQAIPFTRFCRGVGRTAQAKNRHSNGQGRWPAKSAKFILDLLKNAESNAEVKGLDVDALHISHIQVNQAQKQRRRTYRAHGRINPYMSSPCHIELTLSEKEEAVTKEPETQLAPRTKKNQA

SEQ ID NO: 6752 - protein, 175 aa, Ambrosia trifida
MVKYSKEPENPTKSCKARGSDLRCHFKNTRETAHAIRKLPLIKAKRYLEDVLAHKQAIPFTRFCRGVGRTAQAKNRHSNGQGRWPAKSAKFILDLLKNAESNAEVKGLDVDALHISHIQVNQAQKQRRRTYRAHGRINPYMSSPCHIELTLSEKEEAVVKEPETQLAPRTKKNQA

SEQ ID NO: 6753 - protein, 183 aa, Aristolochia fimbriata
MVKYSREPDNPTKACKARGSDLRVHFKNTRETAHAIRKLSLVKAKRYLEDVVAHKQAIPFRRFCGGVGRTAQAKARHSNGQGRWPVKSAKFILDLLKNAESNADVKGLDVDTLYVSHIQVNQAQKQRRRTYRAHGRINPYMSSPCHIELILSEKEENVKKEPETQVAPRKSKNQTLRSGASSS

SEQ ID NO: 6754 - protein, 174 aa, Brassica juncea
VKYSQEPDNQTKSCKARGSDLRVHFKNTRETAHAIRKLPLLKAKRYLEDVIAHKQAIPFTRFCRGVGRTAQAKNRHSNGQGRWPAKSAQFVLDLLKNAESNAEVKGLDVDALFISHIQVNQAAKQRRRTYRAHGRINPYMSNPCHIELILSEKEESVKKEPETQLAAKSKKSAA

SEQ ID NO: 6755 - protein, 174 aa, Brassica napus
VKYSQEPDNQTKSCKARGSDLRVHFKNTRETAHAIRKLPLLKAKRYLEDVIAHKQAIPFTRFCRGVGRTAQAKNRHSNGQGRWPAKSAQFVLDLLKNAESNAEVKGLDVDALFISHIQVNQAAKQRRRTYRAHGRINPYMSNPCHIELILSEKEESVKKEPETQLAAKSKKSTA

SEQ ID NO: 6756 - protein, 873 aa, Citrus clementina
MAFRFDYRDVTAFKVLLVLSFMYGLMSALVYSIVHLKFVKPLDSDAPLDRFSEARAIQHVRVLADEIGDRQEGRPGLREAAVYIKTQLEGIKERAGPKFRIEIEENVVNGSFNMIFLGHSISLGYRNHTNIVMRISSTDSQDTDPSVLMNGHFDGPLSSPGAGDCGSCVASMLELARLTIDSGWIPPRPIIFLFNGAEELFMLGAHGFMKAHKWRDSVGAVINVEASGTGGLDLVCQSGPSSWPSSVYAQSAIYPMAHSAAQDVFPVIPGDTDYRIFSQDYGDIPGLDIIFLIGGYYYHTSHDTVDRLLPGSVQARGDNLFNVLKAFSNSSKLQNAHDRASFEATGIKNTDERAIFFDYLTWFMIYYSRSRATVLHWIPIVIFITVPFFLRLLNSGLHSWFATYSDFVKGMMIHATGKMLAIIFPIAFSVLRLFFSGYAMSWFAHPFLAFMMFIPCSLLGLLIPRSLWSHFPLSQDAMLLKTSKEALSDEARFWGAFGFYAMLTMAYLVAGLTGGFLTFIVATSMLPAWIFFCISINFYGRRSLRSTLFYVVPLIPCITYSVYFGGFVVQFLIEKMGMMGAFPSPYGYYVQDIVVAAAVGAVTGWCVGPLLPICGPWLARSSVLQFLLHLTVLALALSSQFFPYSTGAHKRVVFQHTFVTADANQIVESSFDFSVVDSNSFLFLFKYAPEVAKELHIGPEFSLEAANISKRETWMVLFPVSFLFSKSLKFPATSAEISKQYDYFPYLSTSKPHTISGDGSRRVYLELSLGSLEEVWVAVLNITGPLSNWSFADNKVPVPEIVDGGPPSYICRLSGSSHENWTFWLEASSPENLTVEVAVLDQVLVDEAKKLKGLFPDWTDVTAYSSFRSSYTF

SEQ ID NO: 6757 - protein, 183 aa, Cucurbita pepo
MVKYSREPDNHTESCKARGSDLRVHFKNTRETAHALRKLPLAKAKRYLEDVLAHKQAIPFRRFCGGVGRTAQAKNRHSNGQGRWPVKSAKFILDLLRNAESNAEVKGLDVDSLIISHIQVNQAQKQRRRTYRAHGRINPYMSSPCHIELILSEKKEPVKKEPETQLATSKSKKSQALRSGASS

SEQ ID NO: 6758 - protein, 176 aa, Eucalyptus grandis
MVKYSREPDNPTKSCKARGSDLRVHFKNTRETAFAIRKLSLAKAKSYLEDVLVHKQAIPFRRFCRGVGRTAQAKNRHSNGQGRWPVKSARFILDLLKNAESNAEVKGLDVDALYVSHVQVNQAQKQRRRTYRAHGRINPYMSSPCHIELILSEKEEPVRKEPETQLATSKSKKSQA

SEQ ID NO: 6759 - protein, 183 aa, Euonymus alatus
MVKYSKEPDNPTKSCKARGSELRVHFKNTRETAFAIRKLPLVKAKRYLEDVMVHKQAIPFRRFCRGVGRTAQAKNRHSNGQGRWPLKSAKFILDLLKNAESNAEVKGLDVDSLYISHIQVNQAQKQRRRTYRAHGRINPYMSSPCHIELTLSEKEEPVKKEPESQLTTSKSKKSQALRSGASS

SEQ ID NO: 6760 - protein, 183 aa, Euonymus alatus
MVKYSKEPDNPTKSCKARGSELRVHFKNTRETAFAIRKLPLVKAKRYLEDVMAHKQAIPFRRFCRGVGRTAQAKNRHSNGQGRWPLKSAKFILDLLKNAESNAEVKGLDVDSLYISHIQVNQAAKQRRRTYRAHGRINPYMSSPCHIELTLSEKEEPVKKEPETQLTTSKSKKTQPLRSGASS

SEQ ID NO: 6761 - protein, 182 aa, Euphorbia peplus
VKYSREPDNSTKSCKARGSDLRVHFKNTRETAFALRKLPLAKAKRYLEDVMAHKQAIPFRRFCGGVGRTAQAKSRHSNGQGRWPAKSAKFILDLLKNAESNAEVKGLDVENLYITHIQVNQAQKQRRRTYRAHGRINPYMSSPCHIELILSEKEESVQKEPETQLATSKSKKSQAVRTGASA

SEQ ID NO: 6762 - protein, 177 aa, Flaveria ramosissima
MVKYSKEPDNPTKSCKARGSDLRCHFKNTRETAHAIRKLPLIKAKRYLEDVLAHKQAIPFTRFCGGVGRTAQAKNRHSNGQGRWPAKSAKFILDLLKNAESNAEVKGLDVDALFISHIQVNQAQKQRRRTYRAHGRINPYMSSPCHIELTLSEKEEPVKKEAESQLATSGKSKKSQA

SEQ ID NO: 6763 - protein, 175 aa, Flaveria ramosissima
MVKYSKEPENPTKSCKARGSDLRCHFKNTRETAHAIRKLPLVKAKRYLEDVLAHKQAIPFTRFCGGVGRTAQAKNRHSNGQGRRPAKSAKFILDLLKNAESNAEVKGLDVDALHISHIQVNQAQKQRRRTYRAHGRINPYMSSPCHIELTLSEKEEPVKKEPETQLAPRTKKNQA

SEQ ID NO: 6764 - protein, 174 aa, Fraxinus spp
MVKYSREPDNPTKSCKASGSNLRVHFKNTRETAHAIRKLPLTKAKRYLEDVLIHKQAIPFTRFCRGVGRTAQAKNRHSNGQGRWPVKSANFILDLLKNAESNAEVKGLDVDALYISHIQVNQAQKQRRRTYRAHGRINPYMASPCHIELILSEKEEPVKKEPESQLTASKSRKA

SEQ ID NO: 6765 - protein, 174 aa, Lactuca sativa
MVKYSKEPENPTKSCKARGSDLRCHFKNTRETAHAIRKLPLLKAKRYLEDVLVHKQAIPFTRFCRGVGRTAQAKNRHSNGQGRWPAKSAKFILDLLKNAESNAEVKGLDVDALHISHIQVNQAQKQRRRTYRAHGRINPYMSSPCHIELTLSEKEEPVKKDETQLAPRSKKNQA

SEQ ID NO: 6766 - protein, 181 aa, Tropaeolum majus
MVKYSREPDNSTKSCKARGSDLRVHFKNTRETAHAIRKLPLVKAKSYLEDVLAHKQAIPFRRFCRGVGRTAQAKSRHSNGQGRWPAKSANFILDLLKNAESNAEVKGLDVDALYVSHIQVNQAQKQRRRTYRAHGRINPYMSSPCHIELVLSEKEEPVQKEPETQLAASKSKKSQGLRASS

SEQ ID NO: 6767 - protein, 182 aa, Elaeis guineensis
MVKYSKEPDNPTKSAKAMGRDLRVHFKNTRETAHAIRKLPLAKAKRYLEDVIAHKQAIPFRRFCGGVGRTAQAKSRHANGQGRWPVKSCRFILDLLKNAESNAEVKGLDVDSLFISHIQVNQAQKQRRRTYRAHGRINPYMSSPCHIELILAEKEEAVKKEPETQIAPRKPKKVALRTGTSS

SEQ ID NO: 6768 - protein, 873 aa, Citrus sinensis
MAFRFDYRDVTAFKVLLVLSFMYGLMSALVYSIVHLKFVKPLDSDAPLDRFSEARAIQHVRVLADEIGDRQEGRPGLREAAVYIKTQLEGIKERAGPKFRIEIEENVVNGSFNMIFLGHSISLGYRNHTNIVMRISSTDSQDTDPSVLMNGHFDGPLSSPGAGDCGSCVASMLELARLTIDSGWIPPRPIIFLFNGAEELFMLGAHGFMKAHKWRDSVGAVINVEASGTGGLDLVCQSGPSSWPSSVYAQSAIYPMAHSAAQDVFPVIPGDTDYRIFSQDYGDIPGLDIIFLIGGYYYHTSHDTVDRLLPGSVQARGDNLFNVLKAFSNSSKLQNAHDRASFEATGIKNTDERAIFFDYLTWFMIYYSRSRATVLHGIPIVIFITVPFFLRLLNSGLHSWFATYSDFVKGMMIHATGKMLAIIFPIAFSVLRLLFSGYAMSWFAHPFLAFMMFIPCSLLGLLIPRSLWSHFPLSQDAMLLKTSKEALSDEARFWGAFGFYAMLTMAYLVAGLTGGFLTFIVATSMLPAWIFFCISINFYGRRSLRSTLFYVVPLIPCITYSVYFGGFVVQFLIEKMGMMGAFPSPYGYYVQDIVVAAAVGAVTGWCVGPLLPICGLWLARSSVLQFLLHLTVLALALSSQFFPYSTGAHKRLVFQHTFVTADANQIVESSFDFSVVDSNSFLFLFKFAPEVAKELHIGPEFSLEAANVSQRETWMVLFPVSFLFSKSLKFPATSDEISKQYEYFPYLSTSKPHTTSGDGSRRVYLELSLGSLEEVWVAVLNITGPLSNWSFADNKVPVPEIVDGGPPSYICRLSGSSHENWTFWLEASSPENLRVEVAVLDQVLVDEAKKLKGLFPDWTDVTAYSSFRSSYTF

SEQ ID NO: 6769 - protein, 183 aa, Pinus taeda
MVKYSSEPSNPTKSCKARGSDLRVHFKNTRETAQAVKKLPLAKAKAYLEDVLAHKQAIPFRRFCGGVGRTAQAKSRHSNGQGRWPVKSVQFLLQLLKNAESNAEVKGLDVDALYISHIQVNQAQKQRRRTYRAHGRINPYMSSPCHIELILSEKEAPVKKEAESQIAPTRSRRGQALSSGISS

SEQ ID NO: 6770 - protein, 181 aa, Pseudotsuga menziesii
MVKYSREPDNPTKSCKARGSDLRVHFKNTRETAQAVKKLPVAKAKSYLEDVLAHKQAIPFRRFCGGVGRTAQAKSRHSNGQGRWPVKSAQFLLQLLKNAESNAEVKGLDVDALYISHIQVNQAQKQRRRTYRAHGRINPYMSSPCHIELILSEKEAPVKKEAESQIAPTRSRKGQALGTSS

SEQ ID NO: 6771 - protein, 183 aa, Picea glauca
MVKYSREPDNPTKSCKARGSDLRVHFKNTRETAQAVKKLPLAKAKAYLEDVLAHKQAIPFRRFCGGVGRTAQAKSRHSNGQGRWPVKSVQFLLQLLKNAESNAEVKGLDVDALYISHIQVNQAQKQRRRTYRAHGRINPYMSSPCHIELILSEKEVPVKKEAESQIAPTRSRKGRALSSGISS

SEQ ID NO: 6772 - protein, 869 aa, Fragaria vesca
MAAGDASGFKFLLFLVAIYGLLAVLVHSILHMRFITPLEIDAPLDRFSEARAVEHIRVLAKDIDSRQEGSPGLREAARYITAQLEMLKERAGPNLRVEIEETVVNGTFNMLFLGYSISLGYRNHTNIVMRISSVDSQDSDASVLLNGHFDSPLGSPGASDCGSCVASMLEIARLIVDSGWVPPQPVIFLFNGAEELFLLGSHGFMKTHKWRETIGAFINVEASGIGGPDLVCQSGPSSWPSQIYAQSAVYPMAHSAAQDVFPVVPGDTDFRIFSEDYGDIPGLDIIFLLGGYFYHTSFDTVERLLPGSIQARGENLFSILRAFTNSSKLQNTLERHSNLSTTKQQEVGRAVFFDYLTWFMIYYSRKVAMVLHHIPIGIFLAMPFFSQKQNSGLLSWFATFSSFVKGMLFHAAGVVLAIVIPVIFSILRLLFTSRAMNWFAHPYLAYLMFTPCALVGLLIPRFVWSSFPLTQEASVVKSLKEALSDEARFWGAFGLYATITLAYLYAGLSGGFLTFSLAVSMLLGWILYCLSVKLFGRKSLRSTLIYMLPILPCLAYSVYFGAFLVQFLIEKMGMMGALPPPYGYFVPDIVLAAVVGLVTSWSVGPLIPICGRWLARSSILQVLLHLTVLGLALSSQFFPYSTAAPKRVIFQHTFLTEDANHVVESSYDFSVVDSNSLLFLFKHAPEVAKELHISSELSFETAKSSHRGTWMGLFPVSHLFTRSLKFPASSDGILKQYGQFPHLSSYKPHTVFGEESRRIYLELFLGSLEEVWVAVLNITGPLSSWSFADNTLPATETSDGGPPSYICRLSGASPENWSFWLEANSSEELRVEVAVVDQYMVDDAKKLKGLFPEWVDVVAYSGFLSSYIF

SEQ ID NO: 6773 - protein, 175 aa, Eutrema parvulum
VKYSQEPDNSTKSCKARGSDLRVHFKNTRETAHAIRKLQLNKAKRYLEDVIAHKQAIPFTRFCRGVGRTAQAKNRHSNGQGRWPAKSAQFVLDLLKNAESNAEVKGLDVDALFISHIQVNQAAKQRRRTYRAHGRINPYMSNPCHIELILSEKEEPVKKEPETQLAAKSKKGTSS

SEQ ID NO: 6774 - protein, 174 aa, Eutrema parvulum
VKYSQEPDNQTKSCKARGSDLRVHFKNTRETAHAIRKLPLLKAKRYLEDVIAHKQAIPFTRFCRGVGRTAQAKNRHSNGQGRWPAKSAQFVLDLLKNAESNAEVKGLDVDALFISHIQVNQAAKQRRRTYRAHGRINPYMSNPCHIELILSEKEESVKKEPETALAAKSKKSAA

SEQ ID NO: 6775 - protein, 182 aa, Juglans hindsii x Juglans regia
MVKYSKEPDNPTKSCKARGSDLRVHFKNTRETAHAIRKLHLVKAKRYVEDVLAHKQAIPFRRFCRGVGRTAQAKNRHSNGQGRWPVKSAKFILDLLKNAESNAEVKGLDVDSLYISHIQVNQAQKQRRRTYRAHGRINPYMSSPCHIELTLSEKEEPVRKEPETLLATKKPRAQALRSGASS

SEQ ID NO: 6776 - protein, 177 aa, Beta vulgaris
MVKYSKEPDNPTKSCKARGSDLRVHFKNTRETAFSLRKMPLGKAKRYLEDVLAHKQAIPFRRFCRGVGRTAQAKNRHSNGQGRWPAKSAKFILDLLKNAESNAEMKGLDVDSLYISHIQVNQAQKQRRRTYRAHGRINPYMSHPCHIELTLSEKEESVRKEPESQLATSKSKKSQAA

SEQ ID NO: 6777 - protein, 170 aa, Helianthus annuus
MVKYSQEPDNPTKSCKARGSDLRCHYKNTRETAHAIRKLHLIKAKRYLEDVLAHKQAIPFTRFCRGVGRTAQAKNRHSNGQGRWPAKSAKFILDLLKNAESNAEVKGLDVDALFISHIQVNQAQKQRRRTYRAHGRINPYMSSPCHIELTLSEKEEPVKKEAESQLAKSK

SEQ ID NO: 6778 - protein, 168 aa, Brassica rapa
MVKYSQEPDNSTKSCKARGADLRVHFKNTRETAHAIRKLPLLKAKRYLEDVIAHKQAIPFTRFCRGVGRTSQAKNRHSNSQGRWPAKSAQFVLDLLKNAESNAEVKGLDVDALFISHIQVNQAAKQRRRTYRAHGRINPYMSNPCHIELILSEKEEPVKKEPETQLAA

SEQ ID NO: 6779 - protein, 176 aa, Ocimum basilicum
MVKYSIEPGNTTKSCKARGSDLRVHFKNTRETAHAIRKLPLIKAKRYLEDVLAHKQAIPFTRFCGGVGRTAQAKNRHSNGQGRWPVKSAKFILDLLKNAESNAEVKGLDVDALYISHIQVNQAQKQRRRTYRAHGRINPYMSSPCHIELILSEKEEPVKKEPESQQLAATSKPRKA

SEQ ID NO: 6780 - protein, 172 aa, Cynara scolymus
MVKYSKEPDNPTKSCKARGSDLRCHFKNTRETAHAIRKLPLIKAKRYLEDVLVHKQAIPFTRFCRGVGRTAQAKNRHSNGQGRWPAKSAKFILDLLKNAESNAEVKGLDVDALHISHIQVNQARKQRRRTYRAHGRINPYMSSPCHIELTLSEKEEPVKKEVESQLAARKSN

SEQ ID NO: 6781 - protein, 177 aa, Hevea brasiliensis
MVKYSREPENQTKSCKARGSDLRVHFKNTRETAHALRKLPLAKAKRYLEDVMAHKQAIPFRRFCGGVGRTAQAKNRHSNGQGRWPAKSAKFILDLLKNAESNAEVKGLDVDNLFISHIQVNQAQKQRRRTYRAHGRINPYMSSPCHIELILSEKEEPVKKEPETQLATSKSKKSQAT

SEQ ID NO: 6782 - protein, 167 aa, Hevea brasiliensis
MVKYSREPDNPPKSCKARGSDLRVHFKNTRETAHAIRKLHLAKAKRYLEDVMAHKQAIPFRRFCGGVGRTAQAKNRHSNGQGRWPVKSAKFILDLLKNAESNAEVKGLDVDSLYISHIQVNQAQKQRRRTYRAHGRINPYMSSPCHIELILSEKEEPVKKEPETHLA

SEQ ID NO: 6783 - protein, 177 aa, Carica papaya
MVKYSREPDNPTKSCKARGSDLRVHFKNTRETAFAIRKLPLAKAKRYLEDVLAHKQAIPFRRFCGGVGRTAQAKNRHSNGQGRWPVKSAKFILDLLKNAESNAEVKGLDVDALFISHIQVNQAQKQRRRTYRAHGRINPYMSSPCHIELILSEKEEPVKKEPETQLATSKSKKSQAL

SEQ ID NO: 6784 - protein, 160 aa, Sesamum indicum
MVKYSREPDNPTKSCKARGSDLRVHFKNTRETAHAIRKLPLAKAKRYLEDVLAHKQAIPFTRFCGGVGRTAQAKNRHSNGQGRWPVKSAKFILDLLKNAESNAEVKGLDVDALYISHIQVNQAQKQRRRTYRAHGRINPYMSSPCHIELILSEKEEPVKK

SEQ ID NO: 6785 - protein, 172 aa, Tragopogon dubius
MVKYSKEPENPTKSCKARGSDLRCHFKNTRETAHAIRKLPLIKAKRYLEDVLVHKQAIPFTRFCRGVGRTAQAKNRHSNGQGRWPAKSAKFILDLLKNAESNAEVKGLDVDALHISHIQVNQAQKQRRRTYRAHGRINPYMSSPCHIELTLSEKEEPVQKEPESQLAARKTK

SEQ ID NO: 6786 - protein, 176 aa, Cannabis sativa
MVKYSKEPDNPTKSCKARGSDLRVHFKNTRETAFSIRKMPLIKAKRYLEDVLVHKQAIPFRRFCRGVGRTAQAKNRHSNGQGRWPVKSAKFILDLLKNAESNAEVKGLDVDSLYVSHIQVNQAQKQRRRTYRAHGRINPYMSSPCHIELTLSEKEEPVKKEPESQLASRKPEKTRA

SEQ ID NO: 6787 - protein, 176 aa, Gossypium raimondii
MVKYSREPDNPTKSCKARGSDLRVHFKNTRETAFAIRKLPLTKAKRYLEDVIAHKQAIPFRRFCGGVGRTAQAKNRHSNGQGRWPVKSAKFILDLLKNAESNAEVKGLDVDSLIVSHIQVNQAQKQRRRTYRAHGRINPYMSSPCHIELILSEKEEAVKKEPETQLAPRKSKGASS

SEQ ID NO: 6788 - protein, 176 aa, Unknown
  Sequence found in Organisms: Brassica napus, Brassica oleracea, Brassica rapa, Raphanus sativus
MVKYSQEPDNSTKSCKARGADLRVHFKNTRETAHAIRRLPLNKAKRYLEDVIAHKQAIPFTRFCRGVGRTAQAKNRHSNGQGRWPAKSAQFVLDLLKNAESNAEVKGLDVDALFISHIQVNQAAKQRRRTYRAHGRINPYMSNPCHIELILSEKEEPVKKEPETQLAAKSKKGASS

SEQ ID NO: 6789 - protein, 175 aa, Ocimum basilicum
MVKYSREPGNSTKSCKARGSDLRVHFKNTRETAHAIRKLPLVKAKRYLEDVLAHKQAIPFTRFCGGVGRTAQAKNRHSNGQGRWPVKSAKFILDLLKNAESNAEVKGLDVDALYISHIQVNQAQKQRRRTYRAHGRINPYMSSPCHIELILSEKEEPVKKEPESQLAATRRPKKS

SEQ ID NO: 6790 - protein, 175 aa, Catharanthus roseus
MVKYSREPDNPTKSCKARGSDLRVHFKNTRETAHAIRKLPLVKAKRYLEDVLAHKQAIPFTRFCGGVGRTAQAKNRHSNGQGRWPVKSAKFILDLLKNAESNAEVKGLDVDSLYISHIQVNQAQKQRRRTYRAHGRINPYMSSPCHIELILAEKEEPVRKEPESQLATSTKSRKA

SEQ ID NO: 6791 - protein, 176 aa, Silene vulgaris
MVKYSQEPENPTKSCKARGSDLRVHFKNTRETAFSLRKMPLVKAKRYLEDVLAHKQAIPFRRFCGGVGRTAQAKSRHSNGQGRWPAKSAKFILDLLKNAESNAEMKGLDVDSLYISHIQVNQAQKQRRRTYRAHGRINPYMSHPCHIELVLSEKEEPVRKEAETQLATSKSKKSQA

SEQ ID NO: 6792 - protein, 175 aa, Utricularia gibba
MVKYSREPDNPTKSCKARGSDLRVHFKNTRETAHAIRKLPLLKAKRYLEDVIAHKQAIPFTRYCGGVGRTAQAKNRHSNGQGRWPAKSAKFILDLLKNAESNAEVKGLEVDSLYISHIQVNQAQKQRRRTYRAHGRINPYMSSPCHIELILSEKEEPVKKEPESQLAAASKPKRS

SEQ ID NO: 6793 - protein, 184 aa, Ricinus communis
MVKYSREPENPTKSCKARGSDLRVHFKNTRETAFALRKLPLTKAKRYLEDVMAHKQAIPFRRFCGGVGRTAQAKNRHSNGQGRWPVKSAKFILDLLKNAESNAEVKGLDVDALYISHIQVNQAQKQRRRTYRAHGRINPYMSSPCHIELILAEKEEAVRKEPETQLATSNKPKKSQALRSGASS

SEQ ID NO: 6794 - protein, 175 aa, Unknown
  Sequence found in Organisms: Centaurea maculosa, Carthamus tinctorius, Helianthus annuus
MVKYSKEPENPTKSCKARGSDLRCHFKNTRETAHAIRKLPLIKAKRYLEDVLAHKQAIPFTRFCRGVGRTAQAKNRHSNGQGRWPAKSAKFILDLLKNAESNAEVKGLDVDALHISHIQVNQAQKQRRRTYRAHGRINPYMSSPCHIELTLSEKEEPVKKEPETQLAPRTKKNQA

SEQ ID NO: 6795 - protein, 175 aa, Unknown
  Sequence found in Organisms: Arabidopsis thaliana, Arabidopsis lyrata, Thellungiella halophila
MVKYSQEPDNQTKSCKARGSDLRVHFKNTRETAHAIRKLPLIKAKRYLEDVIAHKQAIPFTRFCRGVGRTAQAKNRHSNGQGRWPAKSAQFVLDLLKNAESNAEVKGLDVDALFISHIQVNQAAKQRRRTYRAHGRINPYMSNPCHIELILSEKEEPVKKEPETQLAAKSKKSAA

SEQ ID NO: 6796 - protein, 175 aa, Arnica chamissonis
MVKYSKEPENPTKSCKARGSDLRCHFKNTRETAHAIRKLPLTKAKRYLEDVLAHKQAIPFTRFCRGVGRTAQAKNRHSNGQGRWPAKSAKFILDLLKNAESNAEVKGLDVDALHISHIQVNQAQKQRRRTYRAHGRINPYMSSPCHIELTLSEKEEPVKKEPETQLAPRTKKNQA

SEQ ID NO: 6797 - protein, 175 aa, Unknown
  Sequence found in Organisms: Centaurea maculosa, Cirsium arvense, Carthamus tinctorius
MVKYSKEPENPTKSCKARGSDLRCHFKNTRETAHAIRKLPLIKAKRYLEDVLVHKQAIPFTRFCRGVGRTAQAKNRHSNGQGRWPAKSAKFILDLLKNAESNAEVKGLDVDALHISHIQVNQAQKQRRRTYRAHGRINPYMSSPCHIELTLSEKEEPVKKEPETQLAPRKTKNQA

SEQ ID NO: 6798 - protein, 175 aa, Cichorium intybus
MVKYSKEPENPTKSCKARGSDLRCHFKNTRETAHAIRKLPLLKAKRYLEDVLVHKQAIPFTRFCRGVGRTAQAKNRHSNGQGRWPAKSAKFILDLLKNAESNAEVKGLDVDALHISHIQVNQAQKQRRRTYRAHGRINPYMSSPCHIELTLSEKEEPVKKEAETQLAPRTKKNQA

SEQ ID NO: 6799 - protein, 175 aa, Cirsium arvense
MVKYSKEPENPTKSCKARGSDLRCHFKNTRETAHAIRKLPLIKAKRYLEDVLVHKQAIPFTRFCRGVGRTAQAKNRHSNGQGRWPAKSAKFILDLLKNAESNAEVKGLDVDALHISHIQVNQAQKQRRRTYRAHGRINPYMSSPCHIELTLSEKEEPVKKEPETQLAPRKNKNQA

SEQ ID NO: 6800 - protein, 175 aa, Unknown
  Sequence found in Organisms: Citrus sinensis, Citrus clementina, Citrus sinensis
MVKYSKEPDNPTKSCKARGSDLRVHFKNTREAAHALRKLSLTKAKRYLEDVMAHKQAIPFTRFCRGVGRTAQAKNRNPNGQGRWPVKSAKFILDLLKNAESNAEVKGLDVDALYISHIQVNQAQKQRRRTYRAHGRINPYMSSPCHIELTLSEKEEPVKKEPETQLASRKPRTAT

SEQ ID NO: 6801 - protein, 175 aa, Taraxacum officinale
MVKYSKEPDNPTKSCKARGSDLRCHFKNTRETAHALRKMPLIKAKSYLEDVLVHKQAIPFTRFCRGVGRTAQAKNRHSNGQGRWPAKSAKFILDLLKNAESNAEVKGLDVDALFISHIQVNQAQKQRRRTYRAHGRINPYMSSPCHIELTLSEKEEPVKKEAESQLATSGKSKKP

SEQ ID NO: 6802 - protein, 175 aa, Taraxacum officinale
MVKYSKEPENPTKSCKARGSDLRCHFKNTRETAHALRKMSLIKAKRYLEDVLVHKQAIPFTRFCRGVGRTAQAKNRHSNGQGRWPAKSAKFILDLLKNAESNAEVKGLDVDALHISHIQVNQAQKQRRRTYRAHGRINPYMSSPCHIELTLSEKEEPVKKEPESQLAPRSKKNQA

SEQ ID NO: 6803 - protein, 175 aa, Guizotia abyssinica
MVKYSKEPENPTKSCKARGSDLRCHFKNTRETAHAIRKLPLIKAKRYLEDVLAHKQAIPFTRFCRGVGRTAQAKNRHSNGQGRWPAKSAKFILDLLKNAESNAEVKGLDVDALHISHIQVNQAQKQRRRTYRAHGRINPYMSSPCHIELTLSEKEEPVKKEPETQLAPRTKKNQS

SEQ ID NO: 6804 - protein, 175 aa, Unknown
  Sequence found in Organisms: Solanum lycopersicum, Solanum tuberosum, Solanum phureja
MVKYSNEPENPTKSCKARGSDLRAHFKNTRETAHALRKMPLNKAKSYLEDVLAHKQAIPFTRFCRGVGRTAQAKNRHSNGQGRWPVKSAKFILDLLKNAESNAEVKGLDVDSLYITHIQVNQAQKQRRRTYRAHGRINPYMSHPCHIELVLSEKEESVKKEPETQLAPRKTKASS

SEQ ID NO: 6805 - protein, 175 aa, Nicotiana tabacum
MVKYSREPDNPTKSCKARGASLRVHFKNTRETAHALRKMPLDKAKRYLEDVLAHKQAIPFTRFCGGVGRTAQVKHRHSNGQGRWPVKSAKIILDLLKNAESNAEVKGLDVDSLFISHIQVNQAQKQRRRTYRAHGRINPYMSHPCHVELTLSEKEESVKKEPETQLAPRKAKASS

SEQ ID NO: 6806 - protein, 175 aa, Tragopogon dubius
MVKYSKEPENPTKSCKARGSDLRCHFKNTRETAHAIRKLPLLKAKRYLEDVLAHKQAIPFTRFCRGVGRTAQAKNRHSNGQGRWPAKSAKFILDLLKNAESNAEVKGLDVDVLHISHIQVNQAQKQRRRTYRAHGRINPYMSSPCHIELTLSEKEEPVKKEPETQLAPRTKKNQA

SEQ ID NO: 6807 - protein, 175 aa, Lactuca sativa
MVKYSKEPDNPTKSCKARGSDLRCHFKNTRETAHAIRKMPLIKAKRYLEDVLVHKQAIPFTRFCRGVGRTAQAKNRHSNGQGRWPAKSAKFILDLLKNAESNAEVKGLDVDALHISHIQVNQAQKQRRRTYRAHGRINPYMSSPCHIELTLSEKEEPVKKEPETQLASRKTKNQA

SEQ ID NO: 6808 - protein, 175 aa, Lactuca sativa
MVKYSKEPENPTKSCKARGSDLRCHFKNTRETAHAIRKMPLLKAKRYLEDVLVHKQAIPFTRFCRGVGRTAQAKNRHSNGQGRWPAKSAKFILDLLKNAESNAEVKGLDVDALHISHIQVNQAQKQRRRTYRAHGRINPYMSSPCHIELTLSEKEEPVKKEPETQLAPRTKKNQA

SEQ ID NO: 6809 - protein, 183 aa, Unknown
  Sequence found in Organisms: Cucumis sativus, Cucurbita pepo, Momordica charantia
MVKYSREPDNPTKSCKARGSDLRVHFKNTRETAHAIRKLPLAKAKRYLEDVLAHKQAIPFRRFCGGVGRTAQAKNRHSNGQGRWPVKSAKFILDLLKNAESNAEVKGLDVDLLHVSHVQVNQAQKQRRRTYRAHGRINPYMSSPCHIELILSEKEEPVKKEPETQLATGKPKKGQAIRSGASS

SEQ ID NO: 6810 - protein, 174 aa, Coffea canephora
MVKYSREPDNPTKSCKARGSDLRVHFKNTRETAHAIRKLPLAKAKRYLEDVLAHKQAIPFTRFCGGVGRTAQAKNRHSNGQGRWPVKSASFILDLLKNAESNAEVKGLDVDSLFISHIQVNQAQKQRRRTYRAHGRINPYMSSPCHIELILSEKEESVKKEPESQLATSKSRKA

SEQ ID NO: 6811 - protein, 174 aa, Coffea canephora
MVKYSREPDNPTKSCKARGSDLRVHFKNTRETAHAIRKLPLAKAKRYLEDVLAHKQAIPFTRFCGGVGRTAQAKNRHSNGQGRWPVKSAGFILDLLKNAESNAEVKGLDVDSLFISHIQVNQAQKQRRRTYRAHGRINPYMSSPCHIELILSEKEESVKKEPESQLATSKSRKA

SEQ ID NO: 6812 - protein, 174 aa, Olea europaea
MVKYSREPDNATKSCKARGSDLRVHFKNTRETAHAIRKLPLTKAKRYLEDVLAHKQAIPFTRFCGGVGRTAQAKNRHSNGQGRWPVKSATFILDLLKNAESNAEVKGLDVDALYISHIQVNQARKQRRRTYRAHGRINPYMSSPCHIELILSEKEEPVKKEPESQLATSKSKKA

SEQ ID NO: 6813 - protein, 185 aa, Linum usitatissimum
MVKYSREPENPTKSCKARGSDLRVHFKNTRETAFSIRKMTLVRAKSYLEDVIAHKQAIPFRRFCRGVGRTAQAKNAGHPNGQARWPAKSAKFVLDLLKNAESNAEVKGLDVDALHISHVQVNQARKQRRRTYRAHGRINPYMSNPCHIELILSEKEEPVKKEPESQLATSGRSRKNQALRSGASS

SEQ ID NO: 6814 - protein, 185 aa, Linum usitatissimum
MVKYSQEPVNPTKSCKARGSDLRVHFKNTRETAFSIRKMALVKAKAYLEDVLAHKQAIPFRRFCRGVGRTAQAKNAGHPNGQARWPAKSAKFILDLLKNAESNAEVKGLDVDALFISHIQVNQAQKQRRRTYRAHGRINPYMSNPCPIELTLSEKEEPVKKEPETQLAASSKSRKGQALRSGASS

SEQ ID NO: 6815 - protein, 178 aa, Populus trichocarpa
MVKYSREPDNPTKSCKARGSDLRVHFKNTRETAFALRKLPLVKAKRYLEDVMAHKQAIPFRRFCGGVGRTAQAKNRHSNGQGRWPAKSAKFILDLLKNAESNAEVKGLDVDALYITHIQVNQAQKQRRRTYRAHGRINPYMSSPCHIELTLSEKEEPVKKEPETQLATSKSKKSQASS

SEQ ID NO: 6816 - protein, 183 aa, Amborella trichopoda
MVKYSKEPDNPTKSCKAKGSDLRVHFKNTRETAFAIRKLPLVKAKRYLEDVLAHKQAIPFRRFCGGVGRTAQAKNRHPNGQGRWPVKSAKFILNLLKSAESNADVKGLDVDTLFLSHIQVNQAQKQRRRTYRAHGRINPYMSSPCHIELILSEKEAPVKKEVETQVVPKRTKKSQALRSAASS

SEQ ID NO: 6817 - protein, 177 aa, Helianthus annuus
MVKYSKEPDNPTKSCKARGSDLRCHFKNTRETAHAIRKLPLIKAKRYLEDVLAHKQAIPFTRFCRGVGRTAQAKNRHSNGQGRWPAKSAKFILDLLKNAESNAEVKGLDVDALFTSHIQVNQAQKQRRRTYRAHGRINPYMSSPSHIELTLSEKEEPVKKEAESQLATSGKSKKSQA

SEQ ID NO: 6818 - protein, 177 aa, Ambrosia trifida
MVKYSKEPDNPTKSCKARGSDLRCHFKNTRETAHAIRKLPLIKAKRYLEDVLAHKQAIPFTRFCRGVGRTAQAKNRHSNGQGRWPAKSAKFILDLLKNAESNAEVKGLDVDSLFISHIQVNQAQKQRRRTYRAHGRINPYMSSPCHIELTLSEKEEAVQKEAESQLATSGKSKKSQA

SEQ ID NO: 6819 - protein, 185 aa, Amorphophallus konjac
MVKYSREPGNPTKSAKAMGRDLRVHFKNTRETAHAIRKLPLAKAKRYLEDVIAHKQAIPFTRFCGGVGRTAQAKNRHPNGQGRWPMKSARFILDLLKNAESNADVKGLDVDTLYISHIQVNQAQKQRRRTYRAHGRINPYMSSPCHIELILSEKEEAVKKEPETQLATTTRKPKKTQALRSGASS

SEQ ID NO: 6820 - protein, 177 aa, Arabidopsis lyrata
MVKKYSQEPDNSTKSCKARGADLRVHFKNTRETAHAIRKLPLNKAKRYLEDVIAHKQAIPFTRFCRGVGRTAQAKNRHSNSQGRWPAKSAQFVLDLLKNAESNAEVKGLDVDALFISHIQVNQAAKQRRRTYRAHGRINPYMSNPCHIELILSEKEEPVKKEPETQLAAKSKKGASS

SEQ ID NO: 6821 - protein, 182 aa, Fagus grandifolia
MVKYSREPDNSTKACKARGSDLRVHFKNTRETAQAIRKLQLAKAKRYLEDVLAHKQAIPFRRFCRGVGRTAQAKSRHSNGQGRWPVKSAKFILDLLKNAESNAEVKGLDVDTLYVSHIQVNQAQKQRRRTYRAHGRINPYMSSPCHIELILSEKEEPVKKEPETQLTTKKPKSKALRSGASS

SEQ ID NO: 6822 - protein, 185 aa, Ceratodon purpureus
MVKYARDPDNSTKACKARGSDLRVHFKNTREAAQAIKHMELAKAKRYLEDVCAHKQAIPFRRFCGGVGRTAQAKARHSNGQGRWPVKSAQFLLGLLKNAESNAEVKGLDVDTLCVSHIQVNQAQRQRRRTYRAHGRINPYMSSPCHIELILSEKEAPVKKEAEEVVAPRKKNQGRLRSGATSATA

SEQ ID NO: 6823 - protein, 168 aa, Cirsium arvense
YSKEPDNPTKSCKARGADLRVHFKNTRETAHAIRKLPLNKAKRYLEDVLAHKQAIPFTRFCRGVGRTAQAKNRHSNGQGRWPAKSAKYILDLLKNAESNAEVKGLDVDALFISHIQVNQAQKQRRRTYRAHGRINPYMSSPCHIELTLSEKEEPVKKEAESRLATSGK

SEQ ID NO: 6824 - protein, 176 aa, Cleome gynandra
MVKYSREPDNQTKACKARGSDLRVHFKNTRETAHAIRKLPLVKAKRYLEDVIAHKQAIPFTRFCRGVGRTAQAKNRHSNGQGRWPMKSAKFILDLLKNAESNAEVKGLDIDALYISHIQVNQAQKQRRRTYRAHGRINPYMSSPCHIELILSEKEEAVKKEPETQLAASKSKKSSA

SEQ ID NO: 6825 - protein, 176 aa, Cleome gynandra
MVKYSTEPDNSTKSCKSRGSDLRVHFKNTRETAHAIRKLPLTKAKRYLEDVIAHKQAIPFTRFCRGVGRTAQAKNRHSNGQGRWPAKSAQFILDLLKNAESNAEVKGLDVDALHISHIQVNQARKQRRRTYRAHGRINPYMSSPCHIELILSEKEEPVKKEPETQLATKSKKSAST

SEQ ID NO: 6826 - protein, 177 aa, Cleome spinosa
MVKYSKEPDNPTKSCKARGADLRVHFKNTRETAHAIRKLPLIKAKRYLEDVIAHKQAIPFTRFCRGVGRTAQAKNRHSNGQGRWPAKSAKFILDLLKNAESNAEVKGLDVDALHISHIQVNQARKQRRRTYRAHGRINPYMSSPCHIELVLSEKEEPVKKEPETQLATKSKKSATSS

SEQ ID NO: 6827 - protein, 176 aa, Cleome spinosa
MVKYSREPDNSTKSCKARGSDLRVHFKNTRETAHAIRKLPLTKAKRYLEDVIAHKQAIPFTRFCRGVGRTAQAKNRHSNGQGRWPAKSANFILDLLKNAESNAEVKGLDVDALHISHIQVNQARKQRRRTYRAHGRINPFMSSPCHIELILSEKEEPVKKEPESQLATKSKKPVSS

SEQ ID NO: 6828 - protein, 185 aa, Linum usitatissimum
MVKYSQEPVNPTKSCKARGSDLRVHFKNTRETAFSIRKMALVKAKAYLEDVLAHKQAIPFRRFCRGVGRTAQAKNAGHPNGQARWPAKSAKFILDLLKNAESNAEVKGLDVDALFISHIQVNQAQKQRRRTYRAHGRINPYMSNPCHIELTLSEKEEPVKKEPETQLAASGKSRKGQALRSGASS

SEQ ID NO: 6829 - protein, 178 aa, Gnetum gnemon
MVKYAREPDNLTKAAKARGSDLRVHFKNTRETAQAIKKLPLAKAKRYLEDVIAHKQAIPFRRFCGGVGRTAQAKARHSNGQGRWPVKSAHFLLGLLKNAESNAEVKGLDVDSLYISHIQVNQAQKQRRRTYRAHGRINPYMSSPCHIELILSEKEVQVKKEAETQIAPRKTRRSAVAA

SEQ ID NO: 6830 - protein, 207 aa, Orobanche aegyptiaca
MVKYSREPDNPTKSCKTRGADLRVHFKNTRETAHAIRKLPLVNAKRYLEDVLAHKQAIPFTRFCRGVGRTAQAKNRHSNGQGRWPVKSAKFILDLLKNAESNAEVKGLDVDALFISHIQVNQARKQRRRTYRAHGRINPYMSSPCHIELILSEKERQSRRSLNHNWQLANPGRLESCESITYRWFEKSISRGAFYFVSMSLVICCRF

SEQ ID NO: 6831 - protein, 183 aa, Sequoia sempervirens
MVKYSREPDNSTKSCKARGSDLRVHFKNTRETAQAIKKLPLGKAKRYLEDVLAHKQAIPFRRFCGGVGRTAQAKSRNSNGQGRWPVKSAEFLLGLLKNAESNAEVKGLDVDTLYVTHIQVNQAPKQRRRTYRAHGRINPYMSSPCHIELILSEKEAPVKKEPETQIAPRKSRKAQQLQSGTSS

SEQ ID NO: 6832 - protein, 183 aa, Picea glauca
MVKYSREPDNPTKSCKARGSDLRVHFKNTRETAQAVKKLPVAKAKAYLEDVLAHKQAIPFRRFCGGVGRTAQAKSRHSNGQGRWPVKSVQFLLQLLKNAESNAEVKGLDVDALYISHIQVNQAQKQRRRTYRAHGRINPYMSSPCHIELILSEKEVPVKKEAESQIAPTRSRKGRALSSGISS

SEQ ID NO: 6833 - protein, 183 aa, Camellia sinensis
MVKYSKEPDNPTKSCKAKGSDLRVHFKNTRETAHAIRKLPLSKAKSYLEDVLAHKQAIPFTRFCRGVGRTAQAKNRHSNGQGRWPVKSAGYILDLLKNAESNAEVKGLDVESLYISHIQVNQAQKQRRRTYRAHGRINPYMSSPCHIELILSEKEEPVKKEPEMQVASRTKKSNKALRSGTAS

SEQ ID NO: 6834 - protein, 162 aa, Zamia vazquezii
MVKYSREPDNPTKSCKARGSDLRVHFKNTREAAQAIKKLPLAKAKRYLEDVLAHKQAIPFRRFCGGVGRTAQAKSRHSNGQGRWPVKSAQFLLGLLKNAESNAEVKGLDVHTLYISHIQVNQAQKQRRRTYRAHGRINPYMSSPCHIELILSEKEAPVKKGA

SEQ ID NO: 6835 - protein, 182 aa, Bupleurum chinense
MVKYSKEPDNPTKSCKARGADLRVHFKNTRETAHALRKLPLLKAKRYLEDVLAHKQAIPFTRFCRGVGRTAQAKNRHSNGQGRWPAKSAKFILDLLKNAESNAEVKGLDVDSLYISHIQVNQAQKQRRRTYRAHGRINPYMSSPCHIELTLSEKEEPVKKEPDSQLAPRKKTNQVLRSGASS

SEQ ID NO: 6836 - protein, 167 aa, Amborella trichopoda
  misc_feature (133)..(133): Xaa can be any naturally occurring amino acid
  misc_feature (140)..(140): Xaa can be any naturally occurring amino acid
MVKYSREPDNPTKSCKARGSDLRVHFKNTRETAFAIRKLPLAKAKRYLEDVLAHKQAIPFRRFCGGVGRTAQAKNRHPNGQGRWPVKSAKFILNLLKSAESNADVKGLDVDTLFISHIQVNQAQKQRRRTYRXHGRINPXMSSPCHIELILSEKEAPVKKEAETEVV

SEQ ID NO: 6837 - protein, 177 aa, Manihot esculenta
MVKYSREPENPTKSCKARGSDLRVHFKNTRETAHALRKLPLMKAKRYLEDVMAHKQAIPFRRFCGGVGRTAQAKNRHSNGQGRWPVKSAKFILDLLKNAESNAEVKGLDVDALFISHIQVNQAQKQRRRTYRAHGRINPYMSSPCHIELILSEKEEPVKKEPETQLATSKSKKSQAA

SEQ ID NO: 6838 - protein, 182 aa, Actinidia deliciosa
MVKYSREPDNPTKSCKARGSDLRVHFKNTRETAHAIRKMPLTKAKRYLEDVLAHKQAIPFTRFCRGVGRTAQAKNRHSNGQGRWPVKSAGFILDLLKNAESNAEVKGLDVDSLYISHIQVNQAQKQRRRTYRAHGRINPYMSSPCHIELILSEKEEPVKKEPEMQVASGNKRSKALRSGVSS

SEQ ID NO: 6839 - protein, 172 aa, Lactuca sativa
MVKYSKEPDNPTKSCKARGSDLRCHFKNTRETAHAIRKLPLIKAKRYLEDVLVHKQAIPFTRFCRGVGRTAQAKNRHSNGQGRWPAKSAKFILDLLKNAESNAEVKGLDVDSLHISHIQVNQAQKQRRRTYRAHGRINPYMSSPCHIELTLSEKEEAVKKEPETQLAAKKTK

SEQ ID NO: 6840 - protein, 170 aa, Triphysaria pusilla
MVKYSREPDNVTKSCKARGSGLRVHFKNTRETAHALRKLPLTKAKSYLEDVLAHKQAIPFTRFCRGVGRTAQAKNRHSNGQGRWPVKSAKFILDLLKNAESNAEVKGLDVDALFISHIQVNQAIKQRRRTYRAHGRINPYMSSPCHIELILSEKEQPVKREPESQLSRKA

SEQ ID NO: 6841 - protein, 177 aa, Parthenium argentatum
MVKYSKEPDNPTKSCKARGSDLRCHFKNTRETAHAIRKLPLIKAKRYLEDVLAHKQAIPFTRFCGGVGRTAQAKNRHSNGQGRWPAKSAKFILDLLKNAESNAEVKGLDVDALFISHIQVNQAQKQRRRTYRAHGRINPYMSSPCHIELTLSEKEEPVKKEAESQLAASGKPKKSQA

SEQ ID NO: 6842 - protein, 176 aa, Unknown
  Sequence found in Organisms: Brassica juncea, Brassica oleracea
MVKYSQEPDNSTKSCKARGADLRVHFKNTRETAHAIRKLPLIKAKRYLEDVIAHKQAIPFTRFCRGVGRTAQAKNRHSNGQGRWPAKSAQFVLDLLKNAESNAEVKGLDVDALFISHIQVNQAAKQRRRTYRAHGRINPYMSNPCHIELILSEKEEPVKKEPETKLAAKSKKGASS

SEQ ID NO: 6843 - protein, 175 aa, Amsonia hubrichtii
MVKYSKEPDNPTKSCKARGSDLRVHFKNTRETAHAIRKLPLAKAKRYLEDVLAHKQAIPFTRFCGGVGRTAQAKNRHSNGQGRWPVKSARFILDLLKNAESNAEVKGLDVDSLFISHVQVNQAQKQRRRTYRAHGRINPYMSSPCHIELILSEKEEPVKKEPESQLATSNKSRKA

SEQ ID NO: 6844 - protein, 176 aa, Arabidopsis thaliana
MVKYSQEPDNITKSCKARGADLRVHFKNTRETAHAIRKLPLNKAKRYLEDVIAHKQAIPFTRFCRGVGRTAQAKNRHSNGQGRWPAKSAQFVLDLLKNAESNAEVKGLDVDALFISHIQVNQAAKQRRRTYRAHGRINPYMSNPCHIELILSEKEEPVKKEPETQLAAKSKKGASS

SEQ ID NO: 6845 - protein, 176 aa, Unknown
  Sequence found in Organisms: Brassica napus, Brassica juncea
MVKYSQEPDNSTKSCKARGADLRVHFKNTRETAHAIRKLPLIKAKRYLEDVIAHKQAIPFTRFCRGVGRTAQAKNRHSNGQGRWPAKSAQFVLDLLKNAESNAEVKGLDVDALFISHIQVNQAAKQRRRTYRAHGRINPYMSNPCHIELILSEKEEPVKKEPETQLAAKSKKGASS

SEQ ID NO: 6846 - protein, 176 aa, Brassica juncea
MVKYSQEPDNSTKSCKARGADLRVHFKNTRETAHAIRKLPLLKAKRYLEDVIAHKQAIPFTRFCRGVGRTAQAKNRHSNGQGRWPAKSAQFVLDLLKNAESNAEVKGLDVDALFISHIQVNQAAKQRRRTYRAHGRINPYMSNPCHIELILSEKEEPVKKEPETQLAAKSKKGASS

SEQ ID NO: 6847 - protein, 176 aa, Brassica juncea
MVKYSQEPDNSTKSCKARGADLRVHFKNTRETAHAIRKLPLNKAKRYLEDVIAHKQAIPFTRFCRGVGRTAQAKNRHSNGQGRWPAKSAQFVLDLLKNAESNAEVKGLDVDALFISHIQVNQAAKQRRRTYRAHGRINPYMSNPCHIELILSEKEEPVKKEPETQLAAKSKKGTSS

SEQ ID NO: 6848 - protein, 176 aa, Brassica rapa
MVKYSQEPDNTTKSCKARGADLRVHFKNTRETAHAIRKLPLNKAKRYLEDVIAHKQAIPFTRFCRGVGRTAQAKNRHSNGQGRWPAKSAQFVLDLLKNAESNAEVKGLDVDALFISHIQVNQAAKQRRRTYRAHGRINPYMSNPCHIELILSEKEEPVKKEPETQLAAKSKKGTSS

SEQ ID NO: 6849 - protein, 176 aa, Brassica napus
MVKYSQEPDNSTKSCKARGADLRVHFKNTRETAHAIRKLPLIKAKRYLEDVIAHKQAIPFTRFCRGVGRTAQAKNRHSNGQGRWPAKSAQFVLDLLKNAESNAEVKGLDVDALFISHIQVNQAAKQRRRTYRAHGRINPYMSNPCHIELILSEKEEPVKKEPETKLAAKSKNGASS

SEQ ID NO: 6850 - protein, 176 aa, Cicer arietinum
MVKYSREPDNPTKSCKARGADLRVHFKNTRETAFAIRKLPLTKAKRYLEDVLAHKQAIPFRRFCRGVGRTAQAKNRHSNGQGRWPVKSAKFILDLLKNAESNAEVKGLDVDALYVSHVQVNQAQKQRRRTYRAHGRINPYMSSPCHIELILSEKEEAVQKEPESQLATNKKKSQAL

SEQ ID NO: 6851 - protein, 176 aa, Gossypium hirsutum
MVKYSREPDNPTKSCKARGSDLRVHFKNTRETAFAIRKLPLTKAKRYFEDVIAHKQAIPFRRFCGGVGRTAQAKNRHSNGQGRWPVKSAKFILDLLKNAESNAEVKGLDVDSLIVSHIQVNQAQKQRRRTYRAHGRINPYMSSPCHIELILSEKEEAVKKEPETQLAPRKSKGASV

SEQ ID NO: 6852 - protein, 181 aa, Vigna unguiculata
MVKYSREPENPTKSCKARGADLRVHFKNTRETAFAIRKLPLVKAKRYLEDVLAHKQAIPFRRFCRGVGRTAQAKNRHSNGQGRWPVKSAKFILDLLKNAESNAEVKGLDVDALYISHIQVNQAQKQRRRTYRAHGRINPYMSSPCHIELILSEKEEPVKKEPETQLATSKKKGALRSGASS

SEQ ID NO: 6853 - protein, 181 aa, Eschscholzia californica
MVKYSKEPDNPTKSCKARGSDLRVHFKNTRETAFSIRKLPLIKAKRYLEDVLAHKQAIPFRRFCGGVGRTAQAKNRHSNGQGRWPAKSAKFILDLLKNAESNADVKGLDVDTLYISHIQVNQAQKQRRRTYRAHGRINPYMSSPCHIELTLSEKEEPVKKEADTQLAPRKSKKVLRSGASS

SEQ ID NO: 6854 - protein, 172 aa, Primula obconica
YSREPDNQTKSCKARGSNLRCHFKNTRETAHALRKMPLNKAKSYLEDVLAHKQAIPFTRFCRGVGRTAQAKNRHSNGQGRWPAKSAKFVLDLLKNAESNAEVKGLDVDSLYISHIQVNQAQKQRRRTYRAHGRINPYMSSPCHIELVLSEKEEPVKKEPEMQVASATKKNKA

SEQ ID NO: 6855 - protein, 176 aa, Silene vulgaris
MVKYSKEPENPTKSCKARGSDLRCHFKNTRETAFSLRKMPLVKAKRYLEDVLAHKQAIPFRRFCGGVGRTAQAKARHSNGQGRWPAKSAKFILDLLKNAESNAEMKGLDVDSLYISHIQVNQAQKQRRRTYRAHGRINPYMSHPCHIELVLSEKEEPVRKEAETQLATSKSKKSQA

SEQ ID NO: 6856 - protein, 181 aa, Glycine max
MVKYSREPDNPTKSCKARGADLRVHFKNTRETAFAIRKLPLVKAKRYLEDVLAHKQAIPFRRFCRGVGRTAQAKNRHSNGQGRWPVKSAKFILDLLKNAESNAEVKGLDVDALYISHIQVNQAQKQRRRTYRAHGRINPYMSSPCHIELILSEKEEPVKKEPETKLATSKKSQALRSGTSS

SEQ ID NO: 6857 - protein, 181 aa, Glycine max
MVKYSREPDNPTKSCKARGADLRVHFKNTRETAFAIRKLPLVKAKRYLEDVLAHKQAIPFRRFCGGVGRTAQAKNRHSNGQGRWPVKSAKFILDLLKNAESNAEVKGLDVDALYISHIQVNQAQKQRRRTYRAHGRINPYMSSPCHIELILSEKEEPVKKEAETQLATSKKKGALRSGASS

SEQ ID NO: 6858 - protein, 175 aa, Unknown
  Sequence found in Organisms: Brassica napus, Brassica juncea, Brassica oleracea, Brassica rapa, Raphanus sativus
MVKYSQEPDNQTKSCKARGSDLRVHFKNTRETAHAIRKLPLLKAKRYLEDVIAHKQAIPFTRFCRGVGRTAQAKNRHSNGQGRWPAKSAQFVLDLLKNAESNAEVKGLDVDALFISHIQVNQAAKQRRRTYRAHGRINPYMSNPCHIELILSEKEESVKKEPETQLAAKSKKSSA

SEQ ID NO: 6859 - protein, 175 aa, Unknown
  Sequence found in Organisms: Brassica napus, Brassica juncea, Brassica oleracea, Brassica rapa, Raphanus sativus
MVKYSQEPDNQTKSCKARGSDLRVHFKNTRETAHAIRKLPLLKAKRYLEDVIAHKQAIPFTRFCRGVGRTAQAKNRHSNGQGRWPAKSAQFVLDLLKNAESNAEVKGLDVDALFISHIQVNQAAKQRRRTYRAHGRINPYMSNPCHIELILSEKEESVKKEPETQLAAKSKKSAA

SEQ ID NO: 6860 - protein, 175 aa, Brassica juncea
MVKYSQEPDNQTKSCKARGSDLRVHFKNTRETAHAIRKLPLLKAKRYLEDVIAHKQAIPFTRFCRGVGRTAQAKNRHSNGQGRWPAKSAQFVLDLLKNAESNAEVKGLDVDALFISHIQVNQAAKQRRRTYRAHGRINPYMSNPCHIELILSEKEESVKKEPESQLAAKSKKSSA

SEQ ID NO: 6861 - protein, 175 aa, Unknown
  Sequence found in Organisms: Brassica juncea, Brassica oleracea
MVKYSQEPDNQTKSCKARGSDLRVHFKNTRETAHAIRKLPLLKAKRYLEDVIAHKQAIPFTRFCRGVGRTAQAKNRHSNGQGRWPAKSAQFVLDLLKNAESNAEVKGLDVDALFISHIQVNQAAKQRRRTYRAHGRINPYMSNPCHIELILSEKEESVKKEPETQLAAKSKKSTA

SEQ ID NO: 6862 - protein, 174 aa, Ocimum basilicum
MVKYSREPDNSTNSCKARGSDLRVHFKNTRETAHAIRKLPLIKAKRYLEDVLAHKQAIPFTRFCGGVGRTAQAKNRHSNGQGRWPVKSAKFILDLLKNAESNAEVKGLDVDALYISHIQVNQAQKQRRRTYRAHGRINPYMSSPCHIELILSEKVESVKKEPESQLATSKPGKA

SEQ ID NO: 6863 - protein, 175 aa, Unknown
  Sequence found in Organisms: Centaurea maculosa, Cirsium arvense
MVKYSKEPENPTKSCKARGSDLRCHFKNTRETAHAIRKLPLIKAKRYLEDVLVHKQAIPFTRFCRGVGRTAQAKNRHSNGQGRWPAKSAKFILDLLKNAESNAEVKGLDVDALHISHIQVNQAQKQRRRTYRAHGRINPYMSSPCHIELTLSEKEEPVKKEPETQLAPRTKKNQA

SEQ ID NO: 6864 - protein, 175 aa, Cynara scolymus
MVKYSKEPENPTKSCKARGSDLRCHFKNTRETAHAIRKLPLIKAKRYLEDVLVHKQAIPFTRFCRGVGRTAQAKNRHSNGQGRWPAKSAKFILDLLKNAESNAEVKGLDVDALHISHIQVNQAQKQRRRTYRAHGRINPYMSSPCHIELTLSEKEEPVKKEPETQLAPRTKKNQS

SEQ ID NO: 6865 - protein, 175 aa, Solanum melongena
MVKYSNEPENPTKSCKARGSDLRAHFKNTRETAHAIRKMPLNKAKSYLEDVLAHKQAIPFTRFCRGVGRTAQAKNRHSNGQGRWPVKSAKFILDLLKNAESNAEVKGLDVDSLYITHIQVNQAQKQRRRTYRAHGRINPYMSHPCHIELVLSEKEESVKKEPETQLAPRKTKASS

SEQ ID NO: 6866 - protein, 175 aa, Flaveria ramosissima
MVKYSKEPENPTKSCKARGSDLRCHFKNTRETAHAIRKLPLVKAKRYLEDVLAHKQAIPFTRFCGGVGRTAQAKNRHSNGQGRWPAKSAKFILDLLKNAESNAEVKGLDVDALHISHIQVNQAQKQRRRTYRAHGRINPYMSSPCHIELTLSEKEEPVKKEPETQLAPRTKKNQA

SEQ ID NO: 6867 - protein, 175 aa, Flaveria ramosissima
MVKYSKEPENPTKSCKARGSDLRCHFKNTRETAHAIRKLPLIKAKRYLEDVLAHKQAIPFTRFCGGVGRTAQAKNRHSNGQGRWPAKSAKFILDLLKNAESNAEVKGLDVDALHISHIQVNQAQKQRRRTYRAHGRINPYMSSPCHIELTLSEKEEPVKKEPETQLAPRTKKNQA

SEQ ID NO: 6868 - protein, 175 aa, Gerbera hybrid cultivar
MVKYSKEPENPTKSCKARGSDLRCHFKNTRETAHAIRKLPLTKAKSYLEDVLAHKQAIPFTRFCRGVGRTAQAKNRHSNGQGRWPAKSAKFILDLLKNAESNAEVKGLDVDALHISHIQVNQAQKQRRRTYRAHGRINPYMSSPCHIELTLSEKEEPVKKEPETQLAPRTKKNRA

SEQ ID NO: 6869 - protein, 174 aa, Lactuca sativa
MVKYSKEPENPTKSCKARGSDLRCHFKNTRETAHAIRKMPLLKAKRYLEDVLVHKQAIPFTRFCRGVGRTAQAKNRHSNGQGRWPAKSAKFILDLLKNAESNAEVKGLDVDALHISHIQVNQAQKQRRRTYRAHGRINPYMSSPCHIELTLSEKEEPVKKDETQLAPRTKKNQA

SEQ ID NO: 6870 - protein, 175 aa, Lactuca sativa
MVKYSKEPDNPTKSCKARGSDLRCHFKNTRETAHAIRKLPLIKAKRYLEDVLVHKQAIPFTRFCRGVGRTAQAKNRHSNGQGRWPAKSAKFILDLLKNAESNAEVKGLDVDALHISHIQVNQAQKQRRRTYRAHGRINPYMSSPCHIELTLSEKEEPVKKEPETQLASRKTKNQA

SEQ ID NO: 6871 - protein, 175 aa, Lactuca sativa
MVKYSKEPDNPTKSCKARGSDLRCHFKNTRETAHAIRKLPLIKAKRYLEDVLVHKQAIPFTRFCRGVGRTAQAKNRHSNGQGRWPAKSAKFILDLLKNAESNAEVKGLDVDALHISHIQVNQAQKQRRRTYRAHGRINPYMSSPCHIELTLSEKEEPVKKEPETQLASRKSKNQA

SEQ ID NO: 6872 - protein, 175 aa, Nicotiana benthamiana
MVKYSREPDNPTKSCKARGASLRVHFKNTRETAHALRKMPLDKAKKYLEDVLAHKQAIPFTRFCGGVGRTAQVKHRHSNGQGRWPVKSAKIILDLLKNAESNAEVKGLDVDSLFISHIQVNQAQKQRRRTYRAHGRINPYMSHPCHVELTLSEKEESVKKEPETQLAPRKAKASS

SEQ ID NO: 6873 - protein, 174 aa, Eutrema halophilum
VKYSQEPDNQTKSCKARGSDLRVHFKNTRETAHAIRKLPLIKAKRYLEDVIAHKQAIPFTRFCRGVGRTAQAKNRHSNGQGRWPAKSAQFVLDLLKNAESNAEVKGLDVDALFISHIQVNQAAKQRRRTYRAHGRINPYMSNPCHIELILSEKEEPVKKEPETQLAAKSKKSAA

SEQ ID NO: 6874 - protein, 307 aa, Avena sativa
MERLQRIFGAGGMGQPPSDSPLLDSSEQVYISSLALLKMLKHGRAGVPMEVMGLMLGEFVDDYTVRVVDVFAMPQSGTGVSVEAVDHVFQTNMLDMLKQTGRPEMVVGWYHSHPGFGCWLSGVDINTQQSFEALNPRAVAVVIDPIQSVKGKVVIDAFRLINPQTMMLGQEPRQTTSNVGHLNKPSIQALIHGLNRHYYSIAINYRKNELEEKMLLNLHKKKWTDGLILKKFDAHSETNEQTVQEMLSLAIKYNKAVQEEDELSPEKLAIANVGRQDAKKHLEEHISNLMSSNIVQTLGTMLDTVVF

SEQ ID NO: 6875 - protein, 307 aa, Brachypodium distachyon
MERLQRIFGAGGMGQPPSDSPLLDSSEQVYISSLALLKMLKHGRAGVPMEVMGLMLGEFVDDYTVRVVDVFAMPQSGTGVSVEAVDHVFQTNMLDMLKQTGRPEMVVGWYHSHPGFGCWLSGVDINTQQSFEALNPRAVAVVIDPIQSVKGKVVIDAFRLINPQTMMLGQEPRQTTSNVGHLNKPSIQALIHGLNRHYYSIAINYRKNELEEKMLLNLHKKKWTDGLILKRFDTHSTTNEQTVQEMLSLAIKYNKAVQEEDELSPEKLAIANVGRQDAKKHLEEHVSNLMSSNIVQTLGTMLDTVVF

SEQ ID NO: 6876 - protein, 307 aa, Oryza sativa
MERLQRIFGASGMGQPPSDSPLLDSSEQVYISSLALLKMLKHGRAGVPMEVMGLMLGEFVDDYTVRVVDVFAMPQSGTGVSVEAVDHVFQTNMLDMLKQTGRPEMVVGWYHSHPGFGCWLSGVDINTQQSFEALNPRAVAVVIDPIQSVKGKVVIDAFRLINPQTMMLGQEPRQTTSNVGHLNKPSIQALIHGLNRHYYSIAINYRKNELEEKMLLNLHKKKWTDGLILKRFDTHSKTNEQTVQEMLNLAIKYNKAVQEEDELPPEKLAIANVGRQDAKKHLEEHVSNLMSSNIVQTLGTMLDTVVF

SEQ ID NO: 6877 - protein, 308 aa, Secale cereale
MERLQRIFSGATGMGQPGSDSPLLDSSEQVYISSLALLKMLKHGRAGVPMEVMGLMLGEFVDDYTVRVVDVFAMPQSGTGVSVEAVDHVFQTNMLDMLKQTGRPEMVVGWYHSHPGFGCWLSGVDINTQQSFEALNPRAVAVVIDPIQSVKGKVVIDAFRLINPQTMMLGQEPRQTTSTVGHLNKPSIQALIHGLNRHYYSIAINYRKNELEEKMLLNLHKKKWTDGLILKKFDAHSKTNEETVQEMLSLAIKYNKAVQEEDELPPEKLAIANVGRQDAKKHLEEHVSNLMSSNIVQTLGTMLDTVVF

SEQ ID NO: 6878 - protein, 307 aa, Unknown
  Sequence found in Organisms: Pennisetum glaucum, Setaria italica
MERLQRIFGASGMGQPPSDSPLLDSSEQVYISSLALLKMLKHGRAGVPMEVMGLMLGEFVDDYTVRVVDVFAMPQSGTGVSVEAVDHVFQTNMLDMLKQTGRPEMVVGWYHSHPGFGCWLSGVDINTQQSFEALNPRAVAVVIDPIQSVKGKVVIDAFRLINPQTMMLGQEPRQTTSNVGHLNKPSIQALIHGLNRHYYSIAINYRKNELEEKMLLNLHKKKWTDGLILKRFDTHSKTNEQTVQEMLNLAVKYNKAVQEEDELPPEKLAIANVGRQDAKKHLEEHVSNLMSSNIVQTLGTMLDTVVF

SEQ ID NO: 6879 - protein, 307 aa, Unknown
  Sequence found in Organisms: Zea mays, Sorghum bicolor, Triticum aestivum
MERLQRIFGASGMGQPPTDSPLLDSSEQVYISSLALLKMLKHGRAGVPMEVMGLMLGEFVDDYTVRVVDVFAMPQSGTGVSVEAVDHVFQTNMLDMLKQTGRPEMVVGWYHSHPGFGCWLSGVDINTQQSFEALNPRAVAVVIDPIQSVKGKVVIDAFRLINPQTMMLGQEPRQTTSNVGHLNKPSIQALIHGLNRHYYSIAINYRKNELEEKMLLNLHKKKWTDGLILKRFDTHSKTNEQTVQEMLNLAIKYNKAVQEEDELPPEKLAIANVGRQDAKKHLEEHVSNLMSSNIVQTLGTMLDTVVF

SEQ ID NO: 6880 - protein, 307 aa, Oryza sativa
MERLQRIFGASGMGQPPTDSPLLDSSEQVYISSLALLKMLKHGRAGVPMEVMGLMLGEFVDDYTVRVVDVFAMPQSGTGVSVEAVDHVFQTNMLDMLKQTGRPEMVVGWYHSHPGFGCWLSGVDINTQQSFEALNPRAVAVVIDPIQSVKGKVVIDAFRLINPQTMMLGQEPRQTTSNVGHLNKPSIQALIHGLNRHYYSIAINYRKNELEEKMLLNLHKKKWTDGLILKSFDTHSKTNEQTVQEMLNLAIKYNKAVQEEDELPPEKLAIANVGRQDAKKHLEEHVSNLMSSNIVQTLGTMLDTVVF

SEQ ID NO: 6881 - protein, 307 aa, Cenchrus ciliaris
MERLHRIFGASGMGQPPSDSPLLDSSEQVYISSLALLKMLKHGRAGVPMEVMGLMLGEFVDDYTVRVVDVFAMPQSGTGVSVEAVDHVFQTNMLDMLKQTGRPEMVVGWYHSHPGFGCWLSGVDINTQQSFEALNPRAVAVVIDPIQSVKGKVVIDAFRLINPQTMMLGQEPRQTTSNVGHLNKPSIQALIHGLNRHYYSIAINYRKNELEEKMLLNLHKKKWTDGLILKRFDTHSKTNEQTVQEMLNLAVKYNKAVQEEDELPPEKLAIANVGRQDAKKHLEEHVSNLMSSNIVQTLGTMLDTVVF

SEQ ID NO: 6882 - protein, 307 aa, Setaria italica
MERLQRIFGASGMGQPPTDSPLLDSSEQVYISSLALLKMLKHGRAGVPMEVMGLMLGEFVDDYTVRVVDVFAMPQSGTGVSVEAVDHVFQTNMLDMLKQTGRPEMVVGWYHSHPGFGCWLSGVDINTQQSFEALNPRAVAVVIDPIQSVKGKVVIDAFRLINPQTMMLGQEPRQTTSNVGHLNKPSIQALIHGLNRHYYSIAINYRKNELEEKMLLNLHKKKWTDGLILKRFDTHSKTNEQTVQEMLNLAVKYNKAVQEEDELPPEKLAIANVGRQDAKKHLEEHVSNLMSSNIVQTLGTMLDTVVF

SEQ ID NO: 6883 - protein, 307 aa, Pennisetum glaucum
MERLQRIFGAAGMGQPPSDSPLLDSSEQVYISSLALLKMLKHGRAGVPMEVMGLMLGEFVDDYTVRVVDVFAMPQSGTGVSVEAVDHVFQTNMLDMLKQTGRPEMVVGWYHSHPGFGCWLSGVDINTQQSFEALNPRAVAVVIDPIQSVKGKVVIDAFRLINPQTMMLGQEPRQTTSNVGHLNKPSIQALIHGLNRHYYSIAINYRKNELEEKMLLNLHKKKWTDGLILKRFDTHSKTNEQTVQEMLNLAVKYNKAVQEEDELPPEKLAIANVGRQDAKKHLEEHVANLMSSNIVQTLGTMLDTVVF

SEQ ID NO: 6884 - protein, 308 aa, Pseudoroegneria spicata
MERLQRIFSGATGMGQPGSDSSLLDSSEQVYISSLALLKMLKHGRAGVPMEVMGLMLGEFVDDYTVRVVDVFAMPQSGTGVSVEAVDHVFQTNMLDMLKQTGRPEMVVGWYHSHPGFGCWLSGVDINTQQSFEALNPRAVAVVIDPIQSVKGKVVIDAFRLINPQTMMLGQEPRQTTSNVGHLNKPSIQALIHGLNRHYYSIAINYRKNELEEKMLLNLHKKKWTDGLILKKFDTHSKTNEETVQEMLSLAIKYNKAVQEEDELPPEKLAIANVGRQDAKKHLEEHVSNLMSSNIVQTLGTMLDTVVF

SEQ ID NO: 6885 - protein, 307 aa, Panicum virgatum
MERLQRIFGASGMGPPPTDSPLLDSSEQVYISSLALLKMLKHGRAGVPMEVMGLMLGEFVDDYTVRVVDVFAMPQSGTGVSVEAVDHVFQTNMLDMLKQTGRPEMVVGWYHSHPGFGCWLSGVDINTQQSFEALNPRAVAVVIDPIQSVKGKVVIDAFRLINPQTMMLGQEPRQTTSNVGHLNKPSIQALIHGLNRHYYSIAINYRKNELEEKMLLNLHKKKWTDGLILKRFDTHSKTNEQTVQEMLNLAIKYNKAVQEEDELPPEKLAIANVGRQDAKKHLEEHVSNLMSSNIVQTLGTMLDTVVF

SEQ ID NO: 6886 - protein, 306 aa, Brachypodium distachyon
MERLQRIFSTGMGQSPSDSPLLDSSEQVYISSLALLKMLKHGRAGVPMEVMGLMLGEFVDDYTVRVVDVFAMPQSGTGVSVEAVDHVFQTNMLDMLKQTGRPEMVVGWYHSHPGFGCWLSGVDINTQQSFEALNPRAVAVVIDPIQSVKGKVVIDAFRLINPQTMMLGQEPRQTTSNVGHLNKPSIQALIHGLNRHYYSIAINYRKNELEEKMLLNLHKKKWTDGLILKRFDTHSKTNEETVQEMLSLAIKYNKAVQEEDELPPEKLAIANVGRQDAKKHLEEHVSNLMSSNIVQTLGTMLDTVVF

SEQ ID NO: 6887 - protein, 308 aa, Hordeum vulgare
MERLQRIFSGATGMGQPGTDSPLLDSSEQVYISSLALLKMLKHGRAGVPMEVMGLMLGEFVDDYTVRVVDVFAMPQSGTGVSVEAVDHVFQTNMLDMLKQTGRPEMVVGWYHSHPGFGCWLSGVDINTQQSFEALNPRAVAVVIDPIQSVKGKVVIDAFRLINPQTMMLGQEPRQTTSNVGHLNKPSIQALIHGLNRHYYSIAINYRKNELEEKMLLNLHKKKWTDGLIIKKFDTHSKTNEETVQEMLSLAIKYNKAVQEEDELPPEKLAIANVGRQDAKKHLEEHVSNLMSSNIVQTLGTMLDTVVF

SEQ ID NO: 6888 - protein, 307 aa, Avena sativa
MERLQRIFGQTGMGQPGSDSPLLDSSEQVYISSLALLKMLKHGRAGVPMEVMGLMLGEFVDDYTVRVVDVFAMPQSGTGVSVEAVDHAFQTNMLDMLKQTGRPEMVVGWYHSHPGFGCWLSGVDINTQQSFEALNPRAVAVVIDPIQSVKGKVVIDAFRLINPQTMMLGQEPRQTTSNVGHLNKPSIQALIHGLNRHYYSIAINYRKNELEEKMLLNLHKKKWTDGLILRKFDTHSKTNEETVQEMLSLAIKYNKAVQEEDELTPEKLAIANVGRQDAKKHLEEHVSNLMSSNIVQTLGTMLDTVVF

SEQ ID NO: 6889 - protein, 308 aa, Elaeis guineensis
MERLHRIFSGAGAMGHPPTDSPLLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNPRAVAVVIDPIQSVKGKVVIDAFRLINPQTMMLGQEPRQTTSNVGHLNKPSIQALIHGLNRHYYSIAINYRKNELEEKMLLNLHKKKWTDGLTLRKFDTHSKTNEQTVQEMLNLAIKYNKAVQEEDELPPEKLAIANVGRQDAKKHLEEHVSNLMSSNIVQTLGTMLDTVVF

SEQ ID NO: 6890 - protein, 307 aa, Elaeis guineensis
ERLHRIFSGAGGMGHPPTDSPLLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNPRAVAVVIDPIQSVKGKVVIDAFRLINPQTMMLGQEPRQTTSNVGHLNKPSIQALIHGLNRHYYSIAINYRKNELEEKMLLNLHKKKWTDGLTLRRFDAHSKTNEQTVQEMLNLAIKYNKAVQEEDELPPEKLAIVNVGRQDAKKHLEEHVSNLMSSNIVQTLGTMLDTVVF

SEQ ID NO: 6891 - protein, 308 aa, Phalaenopsis aphrodite
MERLHRIFSGAGAMGHPPTDSPLLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNPRAVAVVVDPIQSVKGKVVIDAFRLINPQTMMLGQEPRQTTSNLGHLNKPSIQALIHGLNRHYYSIAINYRKNELEEKMLLNLHKKKWTDGLTLRRFDAHSKTNEQTVQEMLNLAIKYNKAVQEEDELPPEKLAIANVGRQDAKKHLEEHVSNLMSSNIVQTLGTMLDTVVF

SEQ ID NO: 6892 - protein, 308 aa, Phalaenopsis aphrodite
MERLHRIFSGAGGMGHPPSDSPLLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNPRAVAVVVDPIQSVKGKVVIDAFRLINPQTMMLGQEPRQTTSNLGHLNKPSIQALIHGLNRHYYSIAINYRKNELEEKMLLNLHKKKWTDGLTLRRFDSHSKTNEQTVKEMLNLAIKYNKAVQEEDELPPEKLAIANVGRQDAKKHLEEHVSNLMSSNIVQTLGTMLDTVVF

SEQ ID NO: 6893 - protein, 308 aa, Platanus occidentalis
MERLQRIFSGAGGMGHPPPDSPLLDSSEQVYISSLALLKMLKHGRAGVPMEVMGLMLGEFVDEYTVRVVDVFAMPQSGTGVSVEAVDHVFQTSMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLQRFDAHSKTNEQTVQEMLNLAIKYNKAVQEEDELPPEKLAIANVGRQDAKKHLEEHVSNLMSSNIVQTLGTMLDTVVF

SEQ ID NO: 6894 - protein, 302 aa, Cynodon dactylon
RIFGASGMGQPPTDSPLLDSSEQVYISSLALLKMPKHGRAGVPMEVMGLMLGEFVDDYTVRVVDVFAMPQSGTGVSVEAVDHVFQTNMLDMLKQTGRPEMVVGWYHSHPGFGCWLSGVDINTQQSFEALNPRAVAVVIDPIQSVKGKVVIDAFRLINPQTMMLGQEPRQTTSNVGHLNKPSIQALIHGLNRHYYSIAINYRKNELEEKMLLNLHKKKWTDGLILKRFDTHSKTNEQTVQEMLNLAIKYNKAVQEEDELPPEKMAIANVGRQDAKKHLEEHVSNLMSSNIVQTLGTMLDTVVF

SEQ ID NO: 6895 - protein, 225 aa, Aristolochia fimbriata
MAKFSISWTVCSFVLEWVSNRCKVKPSVHFFLCRFSNIFFLQFILPVVNGNGVVMTVQAMDQCLDGRFIEMTKVGSGLPRFLAKHHGLWVDQAEGINHYFPFNTLNWVHHHCNSSLIQSLKALLSINVHTREPTAKTRMGMVPSYHHFWSASLLEHIKHVSLKYMIDGFNANARPTLRHRENINDANGILVHKLPEHQTHNLHRNPSPPVLEHLEERKRRDINLF

SEQ ID NO: 6896 - protein, 308 aa, Chelidonium majus
MERLQRILAGAGGMGHPPPDSPLLDSSEQVYISSLALLKMLKHGRAGVPMEVMGLMLGDFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLQRFDTHSKTNEQTVQEMLGLAIKYNKAVQEEDELSPEKLAIANVGRQDAKKHLEEHVSNLMSSNIVQTLGTMLDTVVF

SEQ ID NO: 6897 - protein, 308 aa, Amborella trichopoda
MERLQRIFSGAGGMGHPPPDSPLLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLQRFDVHSKTNEQTVQEMLNLAIKYNKAVQEEDELPPEKLAIANVGRQDAKKHLEEHVSNLMSSNIIQILGTMLDTVVF

SEQ ID NO: 6898 - protein, 310 aa, Persea americana
MERLQRLFAGAGGMGVGHPPPDSPLLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLILQRFDTHSKTNEQTVQEMLSLAIKYNKAVQEEDELPPEKLAIANVGRQDAKKHLEEHVSNLMSSNIIQTLGTMLDTVVF

SEQ ID NO: 6899 - protein, 308 aa, Eschscholzia californica
MERLQRILAGAGGMGHPPPDSPLLDSSEQVYISSLALLKMLKHGRAGVPMEVMGLMLGDFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLQRFDTHSKTNEQTVQEMLGLAIKYNKAVQEEDELPPEKLAIANVGRQDAKKHLEEHVSNLMSSNIVQTLGTMLDTVVF

SEQ ID NO: 6900 - protein, 309 aa, Vitis vinifera
MERLQRMFAGAGGALGHPPPDSPTLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLKRFDTHSKTNEQTVQEMLSLAIKYNKAVQEEDELPPEKLAIANVGRQDAKKHLEEHVSNLMSSNIVQTLGTMLDTVVF

SEQ ID NO: 6901 - protein, 307 aa, Ananas comosus
MERLSRIFGAGGMGHPPSDAPLLDSSEQVYISSLALLKMLKHGRAGVPMEVMGFMLGEFVDEYTVRVVDVFAIPQSGTGVSVEAVDHVFQTNMLDMLKQTGRPEMVVGWYHSHPGFGCWLSGVDINTQQSFEALNPRAVAVVVDPIQSVKGKVVIDAFRLINPQTMMLGQEPRQTTSNVGHLNKPSIQALIHGSNRHYYSIAINYRKNELEEKMLLNLHKKKWTDGLMLRRFDTHAKTNEQTVQEMLNLAIKYNKAVQEEDELPPEKLAIANVGRQDAKKHLEEHVSNLMSSNIVQTLGTMLDTVVF

SEQ ID NO: 6902 - protein, 309 aa, Tripterygium wilfordii
MERLQRIFGGGMGGMGQPHPDSPLLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLRRFDTHSKTNEQTVQDMLNLAIKYNKAVQEEDELSPEKLAIANVGRQDAKKHLEEHVSNLMSSNIVQTLGTMLDTVVF

SEQ ID NO: 6903 - protein, 308 aa, Abies balsamea
MERLQRIFSGAGGMGPPASDGPMLDSSEQVYISSLALLKMLKHGRAGVPMEVMGLMLGEFVDEYTVRVVDVFAMPQSGTGVSVEAVDHVFQTNMLDMLKQTGRQEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLERFDCHSKTNEQTVQEMLDLAIKYNKAVQEEDQLSPEKLAIANVGRQDAKKHLEEHVSNLMSSNIVQTLGTMLDTVVF

SEQ ID NO: 6904 - protein, 308 aa, Cleome spinosa
MERLQRIFGAGSGLGHPPPDSPTLDTSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLRRFDTHSKTNEQTVQEMLNLAIKYNKAVQEEDELPPEKLAIANVGRQDAKKHLEEHVSNLMSSNIVQTLGTMLDTVVF

SEQ ID NO: 6905 - protein, 308 aa, Eschscholzia californica
MERLQRILAGAGGMGHPPPDSPLLDSSEQVYISSLALLKMLKHGRAGVPMEVMGLMLGDFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLQRFDTHSKTNEQTVQEMLGLAVKYNKAVQEEDELPPEKLAIANVGRQDAKKHLEEHVSNLMSSNIVQTLGTMLDTVVF

SEQ ID NO: 6906 - protein, 309 aa, Euonymus alatus
MERLQRIFGGGMGGMGQPHPDSPLLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLRRFDSHSKTNEQTVQDMLNLAIKYNKAVQEEDELSPEKLAIANVGRQDAKKHLEEHVSNLMSSNIIQTLGTMLDTVVF

SEQ ID NO: 6907 - protein, 309 aa, Euonymus alatus
MERLQRIFGGGMGGMGQPHPDSPLLDSSEQVYISSLALLKMLKHGRAGVPMEVMGLMLGEFVDEYTVRVVDVFAMPQSGTGVSVEAVDHVFQTDMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLRRFDTHSKTNEQTVQDMLNLAIKYNKAVQEEDELSPEKLAIANVGRQDAKKHLEEHVSNLMSSNIVQTLGTMLDTVVF

SEQ ID NO: 6908 - protein, 308 aa, Elaeis guineensis
MERLHRIFSGAGGMGHPPTDSPLLDTAEQVYISSLALLKMLKHGRAGVPMEVMGLMLGEFVDEYTVRVVDVFAMPQSGTGVSVEAVDHVFQTNMLDMLKQTGRSEMVVGWYHSHPGFGCWLSGVDINTQQSFEALNPRAVAVVVDPIQSVKGKVVIDAFRLINPQTMMLGQEPRQTTSNVGHLNKPSIQALIHGLNRHYYSIAINYRKNELEEKMLLNLHKKKWTDGLTLQRFDTHSKTNEQTVQEMLNLAIKYNKAVQEEDELPPEKLAIANVGRQDAKKHLEEHVSNLMSSNIVQTLGAMLDTVVF

SEQ ID NO: 6909 - protein, 307 aa, Pseudotsuga menziesii
MERLQRIFSGAGGMGPPADGPMLDSSEQVYISSLALLKMLKHGRAGVPMEVMGLMLGEFVDEYTVRVVDVFAMPQSGTGVSVEAVDHVFQTNMLDMLKQTGRQEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLQRFDCHSKTNEQTVQEMLDLAIKYNKAVQEEDQLSPEKLAIANVGRQDAKKHLEEHVSNLMSSNIVQTLGTMLDTVVF

SEQ ID NO: 6910 - protein, 308 aa, Amborella trichopoda
MERLQRIFSGAGSMAHPPPDSPLLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLQRFDVHSKTNEQTVQEMLNLAIKYNKAVQEEDELPPEKLAIANVGRQDAKKHLEEHVSNLMSSNIIQTLGTMLDTVVF

SEQ ID NO: 6911 - protein, 112 aa, Amorphophallus konjac
MGHPPSDTPLLDSSEQVYISSLALLKMLKHGRAGVPMEVMGLMLGEFVDEYTVRVVDVFAMPQSGTGLASRLSITSSRPTCLTCSSRLADLKWWWDGITHIQALAVGFLVLT

SEQ ID NO: 6912 - protein, 308 aa, Amborella trichopoda
  misc_feature (298)..(298): Xaa can be any naturally occurring amino acid
MERLQRIFSGAGSMAHPPPDSPLLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLQRFDVHSKTNEQTVQEMLNLAIKYNKAVQEEDELPPEKLAIANVGRQDAKKHLEEHVSNLMSSNIIQXLGTMLDTVVF

SEQ ID NO: 6913 - protein, 309 aa, Phaseolus coccineus
MERLQRMFAGAGGALGHPPPDSPTLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLQHFDTHSKTNEQTVQEMLSLAIKYNKAVQEEDELPPEKLAIANVGRQDAKKHLEEHVSNLMSSNIVQTLGMMLDTVVF

SEQ ID NO: 6914 - protein, 308 aa, Cedrus atlantica
MERLQRIFSGAGGMGPPAPDGPMLDSSEQVYISSLALLKMLKHGRAGVPMEVMGLMLGEFVDEYTVRVVDVFAMPQSGTGVSVEAVDHVFQTNMLDMLKQTGRQEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLERFDCHSKTNEQTVQEMLDLAIKYNKAVQEEDQLSPEKLAIANVGRQDAKKHLEEHVSNLMSSNIVQTLGTMLDTVVF

SEQ ID NO: 6915 - protein, 309 aa, Vigna unguiculata
MERLQRMFAGAGGALGHPPPDSPTLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLRHFDTHSKTNEQTVQEMLSLAIKYNKAVQEEDELPPEKLAIANVGRQDAKKHLEEHVSNLMSSNIVQTLGMMLDTVVF

SEQ ID NO: 6916 - protein, 309 aa, Eucalyptus grandis
MERLQRMFAGAGGGLGHPPPDSPTLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLHRFDTHSKTNEQTVQEMLNLAIKYNKAVQEEDELPPEKLAIANVGRQDAKKHLEEHVSNLMSSNIVQTLGTMLDTVVF

SEQ ID NO: 6917 - protein, 309 aa, Eucalyptus grandis
MERLQRMFAGAGGGLGHPPPDSPTLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLRRFDTHSKTNEQTVQEMLNLAIKYNKAVQEEDELPPEKLAIANVGRQDAKKHLEEHVSNLMSSNIVQTLGTMLDTVVF

SEQ ID NO: 6918 - protein, 309 aa, Lotus japonicus
MERLQRMFAGAGGALGHPPPDSPTLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLHRFDTHSKTNEQTVQEMLSLAVKYNKAVQEEDELSPEKLAIANVGRQDAKKHLEEHVSNLMSSNIVQTLGMMLDTVVF

SEQ ID NO: 6919 - protein, 308 aa, Pinus pinaster
MERLQRIFSGAGGMGPPASDGPMLDSSEQVYISSLALLKMLKHGRAGVPMEVMGLMLGEFVDEYTVRVVDVFAMPQSGTGVSVEAVDHVFQTNMLDMLKQTGRQEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLQRFDCHSKTNEQTVQEMLDLAIKYNKAVQEEDQLPPEKLAIANVGRQDAKKHLEEHVSNLMSSNIVQTLGTMLDTVVF

SEQ ID NO: 6920 - protein, 308 aa, Pinus pinaster
MERLQRIFSGAGGMGTPASDGPMLDSSEQVYISSLALLKMLKHGRAGVPMEVMGLMLGEFVDEYTVRVVDVFAMPQSGTGVSVEAVDHVFQTNMLDMLKQTGRQEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLQRFDCHSKTNEETVQEMLDLAIKYNKAVQEEDQLSPEKLAIANVGRQDAKKHLEEHVSNLMSSNIVQTLGTMLDTVVF

SEQ ID NO: 6921 - protein, 308 aa, Podocarpus macrophillus
MERLQRIFSGAGGMGPPATDGPMLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLRRFDCHAKTNEQTVQEMLDLAIKYNKAVQEEDELPPEKLAIANVGRQDAKKHLEEHVSNLMSSNIVQTLGTMLDTVVF

SEQ ID NO: 6922 - protein, 309 aa, Silene vulgaris
MDRLTRMFAGAGGALGHPPPDSPTLDTSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLQRFDAHSKTNEQTVQEMLSLAIKYNKAVQEEDELSPEKLAIANVGRQDAKKHLEEHVSNLMSSNIVQTLGTMLDTVVF

SEQ ID NO: 6923 - protein, 308 aa, Picea glauca
MERLQRIFSGAGGMGPPATDGPMLDSSEQVYISSLALLKMLKHGRAGVPMEVMGLMLGEFVDEYTVRVVDVFAMPQSGTGVSVEAVDHVFQTNMLDMLKQTGRQEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLQRFDCHSKTNEQTVQEMLDLAIKYNKAVQEEDQLSPEKLAIANVGRQDAKKHLEEHVSNLMSSNIVQTLGTMLDTVVF

SEQ ID NO: 6924 - protein, 308 aa, Picea glauca
MERLQRIFSGAGGMGPPAPDGPMLDSSEQVYISSLALLKMLKHGRAGVPMEVMGLMLGEFVDEYTVRVVDVFAMPQSGTGVSVEAVDHVFQTNMLDMLKQTGRQEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLQRFDCHSKTNEQTVQEMLDLAIKYNKAVQEEDQLSPEKLAIANVGRQDAKKHLEEHVSNLMSSNIVQTLGTMLDTVVF

SEQ ID NO: 6925 - protein, 309 aa, Fragaria vesca
MERLQRMFAGAGGPLGHPPPDSPTLDSSEQVYISSLALLKMLKHGRAGVPMEVMGLMLGEFVDDYTVKVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLKRFDTHSKTNEQTVQEMLNLAVKYNKAVQEEDELPPEKLAIANVGRQDAKKHLEEHVSNLMSSNIVQTLGTMLDTVVF

SEQ ID NO: 6926 - protein, 309 aa, Trigonella foenum-graecum
MERLQRMFAGAGGTLGHPPPDSPTLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLRRFDTHSKTNEQTVQEMLSLATKYNKAVQEEDELSPEKLAIANVGRQDAKKHLEEHVSNLMSSNIVQTLGMMLDTVVF

SEQ ID NO: 6927 - protein, 309 aa, Valeriana officinalis
MERLQRMFAGAGGALGHPPPDSPTLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLQRFDTHSKTNEQTVKEMLSLAIKYNKAVQEEDELTPEKLAIANVGRQDAKKHLEEHVSNLMSSNIVQTLGTMLDTVVF

SEQ ID NO: 6928 - protein, 309 aa, Phaseolus coccineus
MERLQRMFAGAGGALGHPPPDSPTLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINGRKNELEEKMLLNLHKKKWTDGLTLQHFDTHSKTNEQTVQEMLSLAIKYNKAVQEEDELPPEKLAIANVGRQDAKKHLEEHVSNLMSSNIVQTLGMMLDTVVF

SEQ ID NO: 6929 - protein, 309 aa, Beta vulgaris
MDRLTRMFAGAGGALGHPPPDSPTLDTSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLKRFDAHSKTNEQTVQEMLNLAIKYNKAVQEEDELSPEKLAIANVGRQDAKKHLEEHVSNLMSANIVQTLGTMLDTVVF

SEQ ID NO: 6930 - protein, 309 aa, Medicago truncatula
MERLQRMFAGAGGALGHPPPDSPTLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLRRFDTHSKTNEQTVQEMLSLATKYNKAVQEEDELTPEKLAIANVGRQDAKKHLEEHVSNLMSSNIVQTLGMMLDTVVF

SEQ ID NO: 6931 - protein, 309 aa, Cicer arietinum
MERLQRMFAGAGGTLGHPPPDSPTLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLRRFDTHSKTNEQTVQEMLSLATKYNKAVQEEDELPPEKLAIANVGRQDAKKHLEEHVSNLMSSNIVQTLGMMLDTVVF

SEQ ID NO: 6932 - protein, 309 aa, Unknown
  Sequence found in Organisms: Cucumis sativus, Cucurbita pepo, Cucumis melo
MERLQRMFAGAGGSLGHPPPDSPTLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLRRFDTHSKTNEQTVQEMLNLAIKYNKAVQEEDELPPEKLAIANVGRQDAKKHLEEHVSNLMSSNIIQTLGTMLDTVVF

SEQ ID NO: 6933 - protein, 309 aa, Euphorbia peplus
MERLQRMFGGAGGGLGHPPPDSPTLDTSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLQRFDTHSKTNEQTVQEMLSLAVKYNKAVQEEDELSPEKLAIANVGRQDAKKHLEEHVSNLMSSNIVQTLGTMLDTVVF

SEQ ID NO: 6934 - protein, 309 aa, Tropaeolum majus
MERLQRMFAGAGGALGHPPPDSPTLDTSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLRRFDTHSKTNEQTVQEMLGLAIKYNKAVQEEDELSPEKLAIANVGRQDAKKHLEEHVSNLMSSNIIQTLGTMLDTVVF

SEQ ID NO: 6935 - protein, 309 aa, Cajanus cajan
MERLQRMFAGAGGALGHPPPDSPTLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLRRFDTHSKTNEQTVQEMLNLAIKYNKAVQEEDELPPEKLAIANVGRQDAKKHLEEHVSNLMSSNIVQTLGMMLDTVVF

SEQ ID NO: 6936 - protein, 311 aa, Platanus occidentalis
MERLQRMFAGAAGGLGVGHPPPDTPLLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNVGHLNKPSIQALIHGLNRHYYSIAINYRKNELEEKMLLNLHKKKWTDGLMLQRFDTHSKTNEQTVQEMLSLAIKYNKAVQEEDELPPEKLAIANVGRQDAKKHLEEHVSNLMSSNIVQTLGTMLDTVVF

SEQ ID NO: 6937 - protein, 309 aa, Papaver somniferum
MERLQRILAGAGGMGGHPPPDSPLLDSSEQVYISSLALLKMLKHGRAGVPMEVMGLMLGEFVDEYTVRVVDVFAMPQSGTGVSVEAVDPVFQTNMLDMLKQTGRPEMVVGWYHSHPGFGCWLSGVDINTQQSFEALNQRAVAVVIDPIQSVKGKVVIDAFRLINPQTMMLGQEPRQTTSNLGYLNKPSIQALIHGLNRHYYSIAINYRKNELEEKMLLNLHKKKWTDGLTLQQFDSHSKTNEQTVEEMRSLAIKYNKAVQEEDELSPEKLAIANVGRQDAKKHLEEHVNNLMSSNIIQTLGTMLDTVVF

SEQ ID NO: 6938 - protein, 194 aa, Petunia hybrida
MSGMERLQRMFAGAGGALGHPPPDSPTLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNNHLFKH

SEQ ID NO: 6939 - protein, 112 aa, Musa acuminata
MQGMERLHRIFSGAGGMGHPPPDSPQLDSAEQVYISSLALLKMLKHGRAGMPMEVMGLMLGEFVDEYTVRVVDVFAMPQSGTGVSVEAVDHVFQTNMLDMLKQTGRPEMVVG

SEQ ID NO: 6940 - protein, 141 aa, Picea glauca
MERLQRIFSGAGGMGPPAPDGPMLDSSEQVYISSLALLKMLKHGRAGVPMEVMGLMLGEFVDEYTVRVVDVFAMPQSGTGVSVEAVDHVFQTNMLDMLKQTGRQEMVVGWYHSHPGFGCWLSGVDINTQQSFEAPINGQLL

SEQ ID NO: 6941 - protein, 308 aa, Pinus taeda
MERLQRIFSGAGGMGPPASDGPMLDSSEQVYISSLALLKMLKHGRAGVPMEVMGLMLGEFVDEYTVRVVDVFAMPQSGTGVSVEAVDHVFQTNMLDMLKQTGRQEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLQRFDCHSKTNEQTVQEMLDLAIKYNKAVQEEDQLPPEKLAIANVGRQDAKKHLEEHISNLMSSNIVQTLGTMLDTVVF

SEQ ID NO: 6942 - protein, 308 aa, Pseudotsuga menziesii
MERLQRIFSGAGGMGPPATDGHMLDSSEQVYISSLALLKMLKHGRAGVPMEVMGLMLGEFVDEYTVRVVDVFAMPQSGTGVSVEAVDHVFQTNMLDMLKQTGRQEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLQRFDCHSKTNEQTVQEMLDLAIKYNKAVQEEDQLSPEKLAIANVGRQDAKKHLEEHVSNLMSSNIVQTLGTMLDTVVF

SEQ ID NO: 6943 - protein, 308 aa, Sciadopitys verticillata
MERLQRIFSGAGGMGPPATDGPMLDSSEQVYISSLALLKMLKHGRAGVPMEVMGLMLGEFVDDYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLQRFDCHAKTNEQTVQEMLDLAIKYNKAVQEEDQLPPEKLAIANVGRQDAKKHLEEHVANLMSSNIVQTLGTMLDTVVF

SEQ ID NO: 6944 - protein, 308 aa, Sciadopitys verticillata
MERLQRIFSGAGGMGPPATDGPMLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWADGLTLQRFDCHSQTNEQTVQEMLDLAIKYNKAVQEEDQLPPEKLAIANVGRQDAKKHLEEHVSNLMSSNIVQTLGTMLDTVVF

SEQ ID NO: 6945 - protein, 308 aa, Picea glauca
MERLQRIFSGAGGMGPPAPDGPMLDSSEQVYISSLALLKMLKHGRAGVPMEVMGLMLGEFVDEYTVRVVDVFAMPQSGTGVSVEAVDHVFQTNMLDMLKQTGRQEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLQRFDCHSKTNEQTVQEMLDLAIKYNKAVQEEDQLTPEKLAIANVGRQDAKKHLEEHVSNLMSSNIVQTLGTMLDTVVF

SEQ ID NO: 6946 - protein, 311 aa, Musa acuminata
MQGMERLHRIFSGAGGMGHPPPDSPQLDSAEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNPRAIAVVVDPIQSVKGKVVIDAFRLINPQTMMLGQEPRQTTSNVGHLNKPSIQALIHGLNRHYYSIAINYRKNELEEKMLLNLHKKKWTDGLILRPFDTHSKTNEQTVQEMLDLAIKYNKAVQEEDELPPEKLAIVNVGRQDAKKHLEEHVSNLMSSNIIQTLGTMLDTVVF

SEQ ID NO: 6947 - protein, 311 aa, Musa acuminata
MQGMERLHRIFSGAGGMGHPPTDSPQLDSAEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNPRAIAVVVDPIQSVKGKVVIDAFRLINPQTMMLGQEPRQTTSNVGHLNKPSIQALIHGLNRHYYSIAINYRKNELEEKMLLNLHKKKWTDGLILRPFDTHSKTNEQTVQEMLDLAIKYNKAVQEEDELPPEKLAIVNVGRQDAKKHLEEHVSNLMSSNIIQTLGTMLDTVVF

SEQ ID NO: 6948 - protein, 312 aa, Manihot esculenta
MSGMERLQRMFAGAGGALGHPPPDSPTLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLKRFDTHSKTNEQTVQEMLNLAIKYNKAVQEEDELPPEKLAIANVGRQDAKKHLEEHVSNLMSSNIVQTLGTMLDTVVF

SEQ ID NO: 6949 - protein, 312 aa, Populus trichocarpa
MSGMERLQRMFAGAGGALGHPPPDSPTLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLRRFDTHSKTNEQTVQEMLSLAIKYNKAVQEEDELPPEKLAIANVGRQDAKKHLEEHVSNLMSSNIVQTLGTMLDTVVF

SEQ ID NO: 6950 - protein, 312 aa, Euphorbia esula
MSGMERLQRMFAGAGSGLGHPPPDSPTLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLQRFDSHSKTNEQTVQEMLSLAVKYNKAVQEEDELSPEKLAIANVGRQDAKKHLEEHVSNLMSSNIVQTLGTMLDTVVF

SEQ ID NO: 6951 - protein, 309 aa, Fagopyrum esculentum
MERLQRMFAGAGGGLGHPPRDSPTLDTSEQVYISSPALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLQRFDVHSKTNEQTVQEMLSLAVKYNKAVQEEDELPPEKLAIANVGRQDAKKHLEEHVSNLMSSNIVQTLGTMLDTVVF

SEQ ID NO: 6952 - protein, 309 aa, Fagopyrum esculentum
MERLQRMFAGAGGGLGHPPPDSPTLDTSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLQRFDVHSKTNEQTVQEMLNLAVKYNKAVQEEDELPPEKLAIANVGRQDAKKHLEEHVSNLMSSNIVQTLGTMLDTVVF

SEQ ID NO: 6953 - protein, 308 aa, Sequoia sempervirens
MERLQRIFSGAGGMGPPATDGPMLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLQRFDCHAKTNEQTVQEMLDLAIKYNKAVQEEDQLPPEKLAIANVGRQDAKKHLEEHVANLMSSNIVQTLGTMLDTVVF

SEQ ID NO: 6954 - protein, 309 aa, Glycine max
MERLQRMFAGAGGALGHPPPDSPTLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLRHFDTHSKTNEQTVQEMLNLAIKYNKAVQEEDELPPEKLVIANVGRQDAKKHLEEHVSNLMSSNIVQTLGMMLDTVVF

SEQ ID NO: 6955 - protein, 309 aa, Citrullus lanatus
MERLQRMFAGAGGSLGHPPPDSPTLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLRRFDTHSKTNEQTVQEMLNLAVKYNKAVQEEDELPPEKLAIANVGRQDAKKHLEEHVSNLMSSNIIQTLGTMLDTVVF

SEQ ID NO: 6956 - protein, 292 aa, Picea glauca
IYIEKNPRFIRSSFTIYSEGETEGLGVSQGVHTRNKSRSSSHGEIAEDISGAGGMGPPAPDGPMLDSSEQVYISSLALLKMLKHGRAGVPMEVMGLMLGEFVDEYTVRVVDVFAMPQSGTGVSVEAVDHVFQTNMLDMLKQTGRQEMAVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTCNASIAILRQMNGQFRKCLILQ

SEQ ID NO: 6957 - protein, 312 aa, Unknown
  Sequence found in Organisms: Fagus grandifolia, Castanea mollissima, Quercus alba
MSGMERLQRMFAGAGGGLGHPPPDSPTLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLKRFDTHSKTNEQTVQEMLNLAIKYNKAVQEEDELPPEKLAIANVGRQDAKKHLEEHVSNLMSSNIIQTLGTMLDTVVF

SEQ ID NO: 6958 - protein, 312 aa, Unknown
  Sequence found in Organisms: Theobroma cacao, Eucalyptus grandis
MSGMERLQRMFAGAGGALGHPPPDSPTLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLRRFDTHSKTNEQTVQEMLNLAIKYNKAVQEEDELPPEKLAIANVGRQDAKKHLEEHVSNLMSSNIVQTLGTMLDTVVF

SEQ ID NO: 6959 - protein, 312 aa, Ricinus communis
MSGMERLQRMFAGAGGALGHPPPDSPTLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLKRFDTHSKTNEQTVQEMLNLAIKYNKAVQEEDELPPEKLVIANVGRQDAKKHLEEHVSNLMSSNIVQTLGTMLDTVVF

SEQ ID NO: 6960 - protein, 312 aa, Euphorbia peplus
MSGMERLQRMFAGAGGGLGHPPPDSPTLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLQRFDTHSKTNEQTVQEMLSLAVKYNKAVQEEDELSPEKLAIANVGRQDAKKHLEEHVSNLMSANIVQTLGTMLDTVVF

SEQ ID NO: 6961 - protein, 312 aa, Unknown
  Sequence found in Organisms: Ipomoea batatas, Ipomoea nil
MSGMERLQRMFAGAGGALGHPPPDSPTLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLQRFDAHSKTNEETVQEMLNLAIKYNKAVQEEDELPPEKLAIANVGRQDAKKHLEEHVSNLMSSNIVQTLGTMLDTVVF

SEQ ID NO: 6962 - protein, 312 aa, Actinidia deliciosa
MSGMERLQRMFAGAGGALGHPPVDSPTLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLQRFDAHSKTNEQTVQEMLNLAVKYNKAVQEEDELPPEKLAIANVGRQDAKKHLEEHVSNLMSSNIVQTLGTMLDTVVF

SEQ ID NO: 6963 - protein, 312 aa, Mimulus guttatus
MAGMERLHRMFAGAGGALGHPPPDSPTLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLQRFDTHSKTNEQTVQEMLSLAVKYNKAVQEEDELSPEKLAIANVGRQDAKKHLEEHVSNLMSSNIVQTLGTMLDTVVF

SEQ ID NO: 6964 - protein, 312 aa, Populus trichocarpa
MSGMERLQRMFAGAGGALGHPPPDSPTLDSSEQVYISSLALLKMLKHGRAGVPMEVMGLMLGEFVDEYTVRVVDVFAMPQSGTGVSVEAVDHVFQTNMIDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLKRFDTHSKTNEQTVQEMLNLAIKYNKAVQEEDELPPEKLAIANVGRQDAKKHLEEHVSNLMSSNIVQTLGTMLDTVVF

SEQ ID NO: 6965 - protein, 312 aa, Fragaria vesca
MSGMERLQRMFAGAGGALGHPPPDSPTLDSSEQVYISSLALLKMLKHGRAGVPMEVMGLMLGEFTDEYTVKVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLKRFDTHSKTNEQTVQEMLSLAVKYNKAVQEEDELSPEKLAIANVGRQDAKKHLEEHVSNLMSSNIVQTLGTMLDTVVF

SEQ ID NO: 6966 - protein, 312 aa, Nicotiana tabacum
MSGMERLQRMFAGAGGALGHPPPDSPTLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLQRFDAHSKTNEQTVQEMLNLAVKYNKAVQEEDELPPEKLAIANVGRQDAKKHLEEHVSNLMSSNIVQTLGTMLDTVVF

SEQ ID NO: 6967 - protein, 308 aa, Unknown
  Sequence found in Organisms: Arabidopsis thaliana, Brassica napus, Brassica juncea, Brassica oleracea, Brassica rapa, Raphanus sativus
MERLQRIFGAGGGLGHASPDSPTLDTSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRSINPQTIMLGQEPRQTTSNLGHLNKPSIQALIHGLNRHYYSIAINYRKNELEEKMLLNLHKKKWTDGLTLRRFDTHSKTNEQTVQEMLSLAAKYNKAVQEEDELSPEKLAIVNVGRQDAKKHLEEHVSNLMSSNIVQTLGTMLDTVVF

SEQ ID NO: 6968 - protein, 308 aa, Unknown
  Sequence found in Organisms: Arabidopsis lyrata, Eutrema parvulum
MERLQRIFGAGGGLGHASPDSPTLDTSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRSINPQTIMLGQEPRQTTSNLGHLNKPSIQALIHGLNRHYYSIAINYRKNELEEKMLLNLHKKKWTDGLTLRPFDTHSKTNEQTVQEMLSLAAKYNKAVQEEDELSPEKLAIVNVGRQDAKKHLEEHVSNLMSSNIVQTLGTMLDTVVF

SEQ ID NO: 6969 - protein, 307 aa, Ocimum basilicum
RLHRMFAGAGGALGHPPPDSPTLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNVGHLNKPSIQALIHGLNRHYYSIAINYRKNELEEKMLLNLHKKKWTDGLTLQRFDTHSKTNEQTVQEMLNLAIKYNKAVQEEDELPPEKLAIANVGKQDAKKHLEEHVSNLMSSNIVQTLGTMLDTVVF

SEQ ID NO: 6970 - protein, 309 aa, Catharanthus roseus
MERLQRMFAGAGGALGHAPPDSPTLDSSEQVYISSLALLKMLKHGRAGVPMEVMGLMLGDFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLQRFDTHSKTNEQTVQEMLNLAIKYNKAVQEEDELPPEKLAIANVGRQDAKKHLEEHVSNLMSSNIIQTLGTMLDTVVF

SEQ ID NO: 6971 - protein, 308 aa, Unknown
  Sequence found in Organisms: Cephalotaxus harringtonia, Taxus baccata
MERLQRIFSGAGGMGPPATDGPMLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLQRFDCHAKTNEQTVQEMLDLAVKYNKAVQEEDQLPPEKLAIANVGRQDAKKHLEEHVANLMSSNIVQTLGTMLDTVVF

SEQ ID NO: 6972 - protein, 302 aa, Chelidonium majus
ILAGAGGMGHPPPDSPLLDSSEQVYISSLALLKMLKHGRAGVPMEVMGLMLGDFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLQRFDTHSKTNEQTVQEMLGLAIKYNKAVQEEDELSPEKLAIANVGRQDAKKHLEEHVSNLMSSNIVQTLGTMLDTVVF

SEQ ID NO: 6973 - protein, 237 aa, Eucalyptus grandis
MERLQRMFAGAGGGLGHPPPDSPTLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLRHFDTF

SEQ ID NO: 6974 - protein, 309 aa, Linum usitatissimum
MERLQRMFAGAGGGLGHPPPDSPTLDTSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRSINPQTMMLGQEPRQTTSNVGHLNKPSIQALIHGLNRHYYSIAINYRKNELEEKMLLNLHKSKWTDGLTLRRFDRHSKTNEQTVQEMLKLASKYNKAVQEEDELSPEKLAIANVGRQDAKKHLEEHVFNLMSSNIVQTLGTMLDTVVF

SEQ ID NO: 6975 - protein, 309 aa, Arachis hypogaea
MERLQRMFAGAGGALGHPPPDSPTLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLQHFDTHSKTNEQTVQEMLNLAVKYNKAVQEEDELPPEKLAIANVGRQDAKKHLEEHVSNLMSSNIIQTLGMMLDTVVF

SEQ ID NO: 6976 - protein, 307 aa, Papaver somniferum
MEGLQRLLAGGMGGQPPPDSPLLDSSEQVYISSLALLKMLKHGRAGVPMEVMGLMLGEFVDEYTVRVVDVFAMPQSGTGVSVEAVDPVFQTNMLDMLKQTGRPEMVVGWYHSHPGFGCWLSGVDINTQQSFEALNQRAVAVVIDPIQSVKGKVVIDAFRLINPQTMMLGQEPRQTTSNLGYLNKPSIQALIHGLNRHYYSIAINYRKNELEEKMLLNLHKKKWTDGLTLQQFDSHSKTNEQTVEEMRSLAIKYNKAVQEEDELSPEKLAIANVGRQDAKKHLEEHVNNLMSSNIIQTLGTMLDTVIF

SEQ ID NO: 6977 - protein, 309 aa, Glycine max
MERLQRMFAGAGGALGHPPPDSPTLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLRHFDTHSKTNEQTVQEMLNLAVKYNKAVQEEDELPPEKLAIANVGRQDAKKHLEEHISNLMSSNIVQTLGMMLDTVVF

SEQ ID NO: 6978 - protein, 313 aa, Medicago truncatula
MSGMERLQRMFAGAGGALGGHPPPDSPTLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLRRFDSHSKTNEQTVQEMLSLATKYNKAVQEEDELSPEKLAIANVGRQDAKKHLEEHVSNLMSSNIVQTLGMMLDTVVF

SEQ ID NO: 6979 - protein, 309 aa, Aquilegia formosa
MERLQRILAGAGGMGGHPPPDSPIMDSSEQVYISSLALLKMLKHGRAGVPMEVMGLMLGDFVDEYTVRVVDVFAMPQSGTGVSVEAVDPVFQTKMLDMLKQTGRPEMVVGWYHSHPGFGCWLSGVDINTQQSFEQLNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLQRFDTHSKTNEQTVQEMLNLAVKYNKAVQEEDELSPEKLAIANVGRQDAKKHLEEHVSNLMSSNIVQTLGTMLDTVVF

SEQ ID NO: 6980 - protein, 312 aa, Vaccinium corymbosum
MSGMERLQRMFAGAGGALGHPPPDSPTLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLQRFDTHSKTNEQTVQEMLNLAIKYNKAVQEEDELPPEKLAIANVGRQDAKKHLEEHVSNLMSSNIIQTLGTMLDTVVF

SEQ ID NO: 6981 - protein, 312 aa, Unknown
  Sequence found in Organisms: Gossypium hirsutum, Gossypium raimondii
MSGMERLHRMFAGAGGALGHPPPDSPTLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLRRFDTHSKTNEQTVQEMLNLAIKYNKAVQEEDELPPEKLAIANVGRQDAKKHLEEHVSNLMSSNIVQTLGTMLDTVVF

SEQ ID NO: 6982 - protein, 312 aa, Helianthus annuus
MSGMERLQRMFAGAGGALGHPPPDSPTLDTSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLKLERFDAHSKTNEQTVQEMLSLAIKYNKAVQEEDKLSPEKLAIANVGRQDAKKHLEEHVSNLMSSNIIQTLGTMLDTVSF

SEQ ID NO: 6983 - protein, 312 aa, Phaseolus coccineus
MSGMERLQRMFAGAGGALGHPPPDSPTLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLRRFDSHSKTNEQTVQEMLSLASKYNKAVQEEDELPPEKLAIANVGRQDAKKHLEEHVSNLMSSNIVQTLGMMLDTVVF

SEQ ID NO: 6984 - protein, 308 aa, Brassica napus
MERLQRIFGAGGGLGHASPDSPTLDTSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRSINPQTIMLGQEPRQTTSNLGHLNKPSIQALIHGLNRHYYSIAINYRKNELEEKMLLNLHKKKWTDGLTLRPFDTHSKTNEQTVQEMLNLAAKYNKAVQEEDELSPEKLAIVNVGRQDAKKHLEEHVSNLMSSNIVQTLGTMLDTVVF

SEQ ID NO: 6985 - protein, 312 aa, Flaveria ramosissima
MSGMERLQRMFAGAGGALGHPPPDSPTLDTSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLKLERFDTHSKTNEQTVQEMLSLAIKYNKAVQEEDELSPEKLAIANVGRQDAKKHLEEHVSNLMSSNIIQTLGTMLDTVSF

SEQ ID NO: 6986 - protein, 312 aa, Actinidia deliciosa
MSGMERLQRMFAGAGGALGHPPVDSPTLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLQRFDTHSKTNEQTVQEMLNLAVKYNKAVQEEDELPPEKLAIANVGRQDAKKHLEEHVSNLMSSNIVQTLGTMLDTVVF

SEQ ID NO: 6987 - protein, 312 aa, Orobanche aegyptiaca
MAGMERLHRMFAGAGGALGHPPPDSPTLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLQRFDAHSKTNEQTVQEMLNLAGKYNKAVQEEDELTPEKLAIANVGRQDAKKHLEEHVSNLMSSNIVQTLGTMLDTVVF

SEQ ID NO: 6988 - protein, 312 aa, Arachis hypogaea
MSGMERLQRMFAGAGGALGHPPPDSPTLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLRQFDSHSKTNEQTVQEMLSLATKYNKAVQEEDELPPEKLAIANVGRQDAKKHLEEHVSNLMSSNIVQTLGMMLDTVVF

SEQ ID NO: 6989 - protein, 312 aa, Capsicum annuum
MSGMERLQRMFAGAGGALGHPPPDSPTLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLQRFDNHSKTNEQTVQEMLNLAVKYNKAVQEEDELPPEKLAIANVGRQDAKKHLEEHVSNLMSSNIVQTLGTMLDTVVF

SEQ ID NO: 6990 - protein, 312 aa, Lippia dulcis
MSGMERLHRMFAGAGGSLGHPPPDSPTLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLQRFDDHSKTNEQTVQEMLNLAVKYNKAVQEEDELSPEKLAIANVGRQDAKKHLEEHVSNLMSSNIVQTLGTMLDTVVF

SEQ ID NO: 6991 - protein, 312 aa, Unknown
  Sequence found in Organisms: Solanum tuberosum, Solanum phureja
MSGMERLQRMFAGAGGALGHPPPDSPTLDSSEQVYISSLALLKMLKHGRAGVPMEVMGLMLGDFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLALQRFDAHSKTNEQTVQEMLNLAVKYNKAVQQEDELSPEKLAIANVGRQDAKKHLEEHVSNLMSSNIVQTLGTMLDTVVF

SEQ ID NO: 6992 - protein, 308 aa, Raphanus sativus
MERLQRIFGAGGGLGHASPDSPTLDTSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRSINPQTIMLGQEPRQTTSNLGHLNKPSIQALIHGLNRHYYSIAINYRKNELEEKMLLNLHKKKWTDGLTLRRFDTHSKTNEQTVQEMLNLAAKYNKAVQEEDELSPEKLAIVNVGRQDAKKHLEEHVSNLMSSNIVQTLGTMLDTVVF

SEQ ID NO: 6993 - protein, 309 aa, Rhizophora mangle
MDRLQRMFAGAGGSLAHPPPDSPTLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLRRFDYHSKTNEQTVQEMLNLAIKYNKAVQEEDELPPEKLAIVNVGRQDSKKHLEEHVSNLMSSNIVQTLGTMLDTVVF

SEQ ID NO: 6994 - protein, 308 aa, Sequoia sempervirens
MERLQRIFSGAGGMGPPATDGPMLDSSEQVYISSLALLKMLKHGRAGVPMEVMGLMLGEFVDEYTVRVVDVFAMPQSGTGVSVEAVDHVFQTNMLDMLKQTGRQEMVVGWYHSHPGFGCWLSGVDINTQQSFEALNPRAVAVVVDPIQSVKGKVVIDAFRLINPQTMMLGQEPRQTTSNLGHLNKPSIQALIHGLNRHYYSIAINYRKNELEEKMLLNLHKKKWADGLTLQRFDCHAKTNELTVQEMLDLAVKYNKAVQEEDQLPPEKLAIANVGRQDAKKHLEEHVSNLMSSNIVQTLGTMLDTVVF

SEQ ID NO: 6995 - protein, 312 aa, Glycine max
MSGMERLQRMFAGAGGALGHPPPDSPTLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLRHFDSHSKTNEQTVQEMLSLAAKYNKAVQEEDELPPEKLAIANVGRQDAKKHLEEHVSNLMSSNIVQTLGMMLDTVVF

SEQ ID NO: 6996 - protein, 308 aa, Eutrema halophilum
MERLQRIFGAGGGLGHASPDSPTLDTSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRSINPQTIMLGQEPRQTTSNLGHLNKPSIQALIHGLNRHYYSIAINYRKNELEEKMLLNLHKKKWTDGLTLRRFDTHSQTNEQTVQEMLNLAAKYNKAVQEEDELSPEKLAIVNVGRQDAKKHLEEHVSNLMSSNIVQTLGTMLDTVVF

SEQ ID NO: 6997 - protein, 308 aa, Eutrema halophilum
MERLQRIFGAGSGLGHPSPDSPTLDTSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRSINPQTIMLGQEPRQTTSNLGHLNKPSIQALIHGLNRHYYSIAINYRKNELEEKMLLNLHKKKWADGLNLRRFDTHSKTNEQTVQEMLSLAAKYNEAVQEEDELSPEKLAIVNVGRQDAKKHLEEHVSNLMSSNIVQTLGTMLDTVVF

SEQ ID NO: 6998 - protein, 96 aa, Triphysaria pusilla
MERIHRMFAGAGGSLGHPPPDSPTLDSSEQVYISSLALLKMLKHGRAGVPMEVMGLMLGEFVDEYTVRVVDVFAMPQSGTGVSVEAVDHVFSDEYA

SEQ ID NO: 6999 - protein, 253 aa, Phalaenopsis aphrodite
MLGEFVDEYTVRVVDVFAMPQSGTGVSVEAVDHVFQTNMLDMLKQTGRPEMVVGWYHSHPGFGCWLSGVDINTQQSFEALNPRAVAVVVDPIQSVKGKVVIDAFRLINPQTMMLGQEPRQTTSNLGHLNKPSIQALIHGLNRHYYSIAINYRKNELEEKMLLNLHKKKWTDGLTLRRFDAHSKTNEQTVQEMLNLAIKYNKAVQEEDELPPEKLAIANVGRQDAKKHLEEHVSNLMSSNIVQTLGTMLDTVVF

SEQ ID NO: 7000 - protein, 304 aa, Zostera marina
MERLQRMLSGAHPPSDSPLLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGYLNKPSIQALIHGLNRHYYSIAINYRKNELEEKMLLNLHKKKWTDGLTLRRFDTHSNTNEQTVQEMLNLAIKYNKAVQEEDELPPEKLAIANVGKQDAKKHLEEHVSNLMSSNIIQTLGTMLDTVVF

SEQ ID NO: 7001 - protein, 313 aa, Trigonella foenum-graecum
MSGMERLQRMFAGAGGALGGHPPPDSPTLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLRRFDSHSKTNEQTVQEMLSLATKYNKAVQEEDELPPEKLAIANVGRQDAKKHLEEHVSNLMSSNIVQTLGMMLDTVVF

SEQ ID NO: 7002 - protein, 312 aa, Vaccinium corymbosum
MSGMERLQRMFAGAGGALGHPPPDSPTLDSAEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLQRFDTHSKTNEQTVQEMLNLAIKYNKAVQEEDELPPEKLAIANVGRQDAKKHLEEHVSNLMSSNIIQTLGTMLDTVVF

SEQ ID NO: 7003 - protein, 312 aa, Unknown
  Sequence found in Organisms: Gossypium hirsutum, Gossypium raimondii
MSGLDRLQRMFAGAGGALGHPPPDSPTLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLRRFDTHSKTNEQTVQEMLNLAIKYNKAVQEEDELPPEKLAIANVGRQDAKKHLEEHVSNLMSSNIVQTLGTMLDTVVF

SEQ ID NO: 7004 - protein, 312 aa, Ambrosia trifida
MSGMERLQRMFAGAGGALGHPPPDSPTLDTSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLKLERFDTHSKTNEQTVQEMLTLAIKYNKAVQEEDELSPEKLAIANVGRQDAKKHLEEHVSNLMSSNIIQTLGTMLDTVSF

SEQ ID NO: 7005 - protein, 312 aa, Unknown
  Sequence found in Organisms: Cirsium arvense, Carthamus tinctorius
MSGMERLQRMFAGAGGALGHPPPDSPTLDTSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNKLEEKMLLNLHKKKWTDGLTLERFDTHSKTNEQTVQEMLSLAIKYNKAVQEEDELPPEKLAIANVGRQDAKKHLEEHVSNLMSSNIIQTLGTMLDTVVF

SEQ ID NO: 7006 - protein, 312 aa, Unknown
  Sequence found in Organisms: Citrus sinensis, Citrus clementina
MSGMERLQRMFAGAGGALGHPPPDSPTLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLHRFDCHSKTNEQTVQEMLNLAVKYNKAVQEEDELPPEKLAIANVGRQDAKKHLEEHVSNLMSSNIVQTLGTMLDTVIF

SEQ ID NO: 7007 - protein, 312 aa, Vigna unguiculata
MSGMERLQRMFAGAGGALGHPPPDSPTLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLRRFDSHSKTNEQTVQEMLNLASKYNKAVQEEDELPPEKLAIANVGRQDAKKHLEEHVSNLMSSNIVQTLGMMLDTVVF

SEQ ID NO: 7008 - protein, 312 aa, Cynara scolymus
  misc_feature (10)..(10): Xaa can be any naturally occurring amino acid
MSGMERLQRXFAGAGGALGHPPPDSPTLDTSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNKLEEKMLLNLHKKKWTDGLTLERFDTHSKTNEQTVQEMLSLAIKYNKAVQEEDELPPEKLAIANVGRQDAKKHLEEHVSNLMSSNIIQTLGTMLDTVVF

SEQ ID NO: 7009 - protein, 312 aa, Flaveria ramosissima
MSGMERLQRMFAGAGGGLGHPPPDSPTLDTSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLKLERFDTHSKTNEQTVQEMLSLAIKYNKAVQEEDKLSPEKLAIANVGRQDAKKHLEEHVSNLMSSNIIQTLGTMLDTVSF

SEQ ID NO: 7010 - protein, 312 aa, Lippia dulcis
MAGMERLHRMFAGAGGALGHPPPDSPTLDSSEQVYISSLALLKMLKHGRAGVPMEVMGLMLVEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNVGHLNKPSIQALIHGLNRHYYSIAINYRKNELEEKMLLNLHKKKWTDGLTLQRFDTHSKTNEQTVQEMLNLAIKYNKAVQEEDELPPEKLAIANVGKQDAKKHLEEHVSNLMSSNIVQTLGTMLDTVVF

SEQ ID NO: 7011 - protein, 312 aa, Cajanus cajan
MSGMERLQRMFAGAGGALGHPPPDSPTLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLRHFDSHSKTNEQTVQEMLNLAAKYNKAVQEEDELPPEKLAIANVGRQDAKKHLEEHVSNLMSSNIVQTLGMMLDTVVF

SEQ ID NO: 7012 - protein, 312 aa, Sarracenia psittacina
MSGMERLQRMFAGAGGALGHPPPDSPTLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLQRFDTHSKTNEQTVQEMLNLAIKYNKAVQEEDELSPEKLAIANVGRQDAKKHLEENVSDLMSSNIIQTLGTMLDTVVF

SEQ ID NO: 7013 - protein, 312 aa, Tabernaemontana elegans
MSGMERLQRMFAGAGGALGHAPPDSPTLDSSEQVYISSLALLKMLKHGRAGVPMEVMGLMLGDFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLQRFDTHSKTNEQTVQEMLNLAIKYNKAVQEEDELPPEKLAIANVGRQDAKKHLEEHVSNLMSSNIVQTLGTMLDTVVF

SEQ ID NO: 7014 - protein, 312 aa, Tragopogon dubius
MAGMERLQRMFAGAGGALGHPPPDSPTLDTSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNKLEEKMLLNLHKKKWTDGLTLERFDTHSKTNEQTVQEMLSLAIKYNKAVQEEDKLSPEKLAIANVGRQDAKKHLEEHVSNLMSSNIIQTLGTMLDTVVF

SEQ ID NO: 7015 - protein, 312 aa, Citrullus lanatus
MSGMERLQRMFAGAGGALGHPPPDSPTLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLRRFDTHSKTNEQTIQEMLNLAIKYNKAVQEEDELPPEKLAIANVGRQDAKKHLEEHVSNLMSSNIIQTLGTMLDTVVF

SEQ ID NO: 7016 - protein, 96 aa, Pinus taeda
MNWKKRCYSIYWTDGLTLQRFDCHSKTNEQTVQEMLDLAIKYNKAVQEEDQLSPEKLAIANVGRQDAKKHLEEHVSNLMSSNIVQTLGTMLDTVVF

SEQ ID NO: 7017 - protein, 308 aa, Brassica rapa
MERLQRIFGAGGGLGHASPDSPTLDTSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRSINPQTIILGQEPRQTTSNLGHLNKPSIQALIHGLNRHYYSIAINYRKNELEEKMLLNLHKKKWTDGLTLRPFDTHSKTNEQTVQEMLNLAAKYNKAVQEEDELSPEKLAIVNVGRQDAKKHLEEHVSNLMSSNIVQTLGTMLDTVVF

SEQ ID NO: 7018 - protein, 308 aa, Brassica napus
MERLQRIFGGGGGLGHASPDSPTLDTSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRSINPQTIMLGQEPRQTTSNLGHLNKPSIQALIHGLNRHYYSIAINYRKNELEEKMLLNLHKKKWTDGLTLRPFDTHSKTNEQTVQEMLNLAAKYNKAVQEEDELSPEKLAIVNVGRQDAKKHLEEHVSNLMSSNIVQTLGTMLDTVVF

SEQ ID NO: 7019 - protein, 312 aa, Helianthus annuus
MSGMERLQRMFAGAGGALGHPPPDSPTLDTSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAIAVVVDPIQSVKGKVVIDAFRLINPQTMMLGQEPRQTTSNLGHLNKPSIQALIHGLNRHYYSIAINYRKNKLEEKMLLNLHKKKWTDGLTLERFDTHSKTNEQTVQEMLSLAIKYNKAVQEEDELPPEKLAIANVGRQDAKKHLEEHVSNLMSSNIIQTLGTMLDTVVF

SEQ ID NO: 7020 - protein, 312 aa, Helianthus annuus
MSGMERLQRMFAGAGGALGHPPPDSPTLDTSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLKLERFDAHSKTNEQTVQEMLTLAIKYNKAVQEEDKLSSEKLAIANVGRQDAKKHLEEHVSNLMSSNIIQTLGTMLDTVSF

SEQ ID NO: 7021 - protein, 312 aa, Arnica chamissonis
MSGMERLQRMFAGAGGALGHPPPDSPTLDTSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLKLERFDTHSKTNEQTVQEMLTLAIKYNKAVQEEDKLSPEKLAIANVGRQDAKKHLEEHVSNLMSSNIIQTLGTMLDTVSF

SEQ ID NO: 7022 - protein, 312 aa, Humulus lupulus
MSGMERLQRMFAGAGGALGHPPPDSPTLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLRQFDSHSKTNEETVQEMLTLAVKYNKAVQEEDELPPEKLAIANVGRQDAKKHLEEHVSNLMSSNIIQTLGTMLDTVVF

SEQ ID NO: 7023 - protein, 312 aa, Mimulus guttatus
MAGMERLHRMFAGAGGALGHPPPDSPTLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLQRFDAHSKTNEQTVQEMLKLAVKYNKAVQDEDELPPEKLAIANVGKQDAKKHLEEHVSNLMSSNIVQTLGTMLDTVVF

SEQ ID NO: 7024 - protein, 312 aa, Carica papaya
MSGMERLQRMFAGAGGALGHPPPDSPTLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLRRFDTHSKTNEQTVQEMLNLAVKYNKAVQEEDELPPEKLVIANVGRQDAKKHLEEHVSNLMSSNIIQTLGTMLDTVVF

SEQ ID NO: 7025 - protein, 312 aa, Prunus persica
MSGMERLQRMFAGAGGGLGHPPPDSPTLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLRRFDNHSKTNEQTVEEMKNLAVKYNKAVQEEDELPPEKLAIANVGRQDAKKHLEEHVSNLMSSNIVQTLGTMLDTVVF

SEQ ID NO: 7026 - protein, 312 aa, Vinca minor
MSGMERLQRMFAGAGGSLSHPPPDSPTLDSSEQVYISSLALLKMLKHGRAGVPMEVMGLMLGDFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLQRFDAHSKTNEQTVQEMLNLAIKYNKAVQEEDELPPEKLAIANVGRQDAKKHLEEHVSNLMSSNIIQTLGTMIDTVVF

SEQ ID NO: 7027 - protein, 134 aa, Secale cereale
MERLQRIFSGATGMGQLGSDSPLLDSSEQVYISSLALLKMLKHGRAGVPMEVMGLMLGEFVDDYTVRVVDVFAMPQSGTGVSVEAVDHVFQTNMLDMLKQTGRPEMVVGCTTRILDLVVGFRELTSILSRVLKL

SEQ ID NO: 7028 - protein, 308 aa, Cephalotaxus harringtonia
MERLQRIFSGASGMGAPATDGSMLDSSEQVYISSLALLKMLKHGRAGVPMEVMGLMLGDFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWADGLTLQRFDCHAKTNEQTVQEMLDLAVKYNKAVQEEDQLPPEKLAIANVGRQDAKKHLEEHVSNLMSSNIVQTLGTMLDTVVF

SEQ ID NO: 7029 - protein, 298 aa, Tripterygium wilfordii
MGGMGQPHPDSPLLDSSEQVYISSLALLKMLKHGRAGVPMEVMGLMLGEFVDEYTVRVVDVFAMPQSGTGVSVEAVDHVFQTDMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLRRFDTHSKTNEQTVQDMLNLAIKYNKAVQEEDELSPEKLAIANVGRQDAKKHLEEHVSNLMSSNIVQTLGTMLDTVVF

SEQ ID NO: 7030 - protein, 312 aa, Amsonia hubrichtii
MSGMERLQRMFAGAGGALGHAPPDSPTLDSSEQVYISSLALLKMLKHGRAGVPMEVMGLMLGDFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLQRFDTHSKTNEQTVQEMLNLAVKYNKAVQEEDELPPEKLAIANVGRQDAKKHLEEHVSNLMSSNIIQTLGTMLDTVVF

SEQ ID NO: 7031 - protein, 312 aa, Unknown
  Sequence found in Organisms: Arnica chamissonis, Flaveria ramosissima
MSGMERLQRMFAGAGGALGHPPPDSPTLDTSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAIAVVVDPIQSVKGKVVIDAFRLINPQTMMLGQEPRQTTSNLGHLNKPSIQALIHGLNRHYYSIAINYRKNKLEEKMLLNLHKKKWTDGLTLEPFDTHSKTNEQTVQEMLNLAIKYNKAVQEEDELPPEKLAIANVGRQDAKKHLEEHVSNLMSSNIIQTLGTMLDTVVF

SEQ ID NO: 7032 - protein, 312 aa, Coffea canephora
MSGMERLQRMFAGAGGALGHPPPDSPTLDSSEQVYISSLALLKMLKHGRAGVPMEVMGLMLGDFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLQRFDTHSKTNEQTVQEMLNLAIKYNKAVQEEDELPPEKLAIANVGRQDAKKHLEEHVSNLMSSNIIQTLGKMLDTVGF

SEQ ID NO: 7033 - protein, 312 aa, Guizotia abyssinica
MSGMERLQRMFAGAGGALGHPPLDSPTLDTSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAIAVVVDPIQSVKGKVVIDAFRLINPQTMMLGQEPRQTTSNLGHLNKPSIQALIHGLNRHYYSIAINYRKNKLEEKMLLNLHKKKWTDGLTLEPFDTHSKTNEQTVQEMLNLAIKYNKAVQEEDELPPEKLAIANVGRQDAKKHLEEHVSNLMSSNIIQTLGTMLDTVVF

SEQ ID NO: 7034 - protein, 312 aa, Tabernaemontana elegans
MSGMERLQRMFAGAGGSLSHPAPDSPTLDSSEQVYISSLALLKMLKHGRAGVPMEVMGLMLGDFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLQRFDTHSKTNEQTVQEMLNLAIKYNKAVQEEDELPPEKLAIANVGRQDAKKHLEEHVSNLMSSNIIQTLGTMLDTVVF

SEQ ID NO: 7035 - protein, 312 aa, Solanum lycopersicum
MSGMERLQRMFAGAGGALGHPPPDSPTLDSSEQVYISSLALLKMLKHGRAGVPMEVMGLMLGDFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLALQRFDAHSKTNEQTVQEMLNLAGKYNKAVQQEDELTPEKLAIANVGRQDAKKHLEEHVSDLMSSNIVQTLGTMLDTVIF

SEQ ID NO: 7036 - protein, 308 aa, Amorphophallus konjac
MERLQRIFSVPGAVGPPPSDSPLLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLHKPSIQALIHGLNRHYYSIAINYRKNELEEKMLLNLHKKKWTDGLTMQRFDAHSKTNEQTVQDMLSLAMRYNKAVQEEDELPPEKLAIANVGRQDAKKHLEEHVSHLMSANIIQTLGAMLDTVIF

SEQ ID NO: 7037 - protein, 302 aa, Tropaeolum majus
FAGAGGALGHPPPDSPTLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLQRFDTHSKTNEQTVQEMLTLAIKYNKAVQEEDELTPEKLAIANVGRQDAKKHLEEHVSNLMSSNIIQTLGTMLDTVVF

SEQ ID NO: 7038 - protein, 230 aa, Curcuma longa
MQGMERLHRIFSGAGGMGHPPTDSPQLDSAEQVYISSLALLKMLKRGRAGVPMEVMGLMLGEFVDEYTVRVVHVFTMPQSGTGVNVEAVDHVFQTNMLDMLKHTGRPEMVVGWYHSHPGFGCWLSGVDINIQQSCEALNPRAIAVVVDPIQSVKGKVVIDAFRLINPQTMMLGQEPRQTTSNVGHLNKPSIQALIHGLNRHYYSIAINYRKNELEEKMLLNLHKKNGQMV

SEQ ID NO: 7039 - protein, 312 aa, Fraxinus spp
MSGMERLQRMFAGAGGALGHPPPDSPTLDTSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLHKPSIQALIHGLNRHYYSIAINYRKNELEEKMLLNLHKKKWTDGLTLQRFDDHSKTNEHTVQEMLNLATKYNKAVQEEDELPPEKLAIANVGRQDAKKHLEEHVSNLMSSNIIQTLGTMLDTVVF

SEQ ID NO: 7040 - protein, 312 aa, Lactuca sativa
MSGMERLQRMFAGAGGALGHPPPDSPTLDTSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNKLEEKMLLNLHKKKWTDGLTLERFDTHSKTNEQTVQEMLGLAVKYNKAVEEEDKLSPEKLAIANVGRQDAKKHLEEHVSNLMSSNIIQTLGTMLDTVVF

SEQ ID NO: 7041 - protein, 312 aa, Lippia dulcis
MSGMERLHRMFAGAGGALGHPPPDSPTLDTSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLQRFDDHSKTNEQTVEEMLNLAIKYNKAVQEEDEMPPEKLAIANVGKQDAKKHLEEHVSNLMSSNIVQTLGTMLDTVVF

SEQ ID NO: 7042 - protein, 312 aa, Vinca minor
MSGMERLQRMFAGAGGSLSHPPPDSPTLDTSEQVYISSLALLKMLKHGRAGVPMEVMGLMLGDFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLAIQRFDAHSKTNEQTVQEMLNLAIKYNKAVQEEDELPPEKLAIANVGRQDAKKHLEEHVSNLMSSNIIQTLGTMIDTVVF

SEQ ID NO: 7043 - protein, 302 aa, Primula obconica
FAGAGGALGHPPPDSPTLDTSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLQRFDTHSKTNEHTVQEMLNLAIKYNKAVQEEDELPPEKLAIANVGRQDAKKHLEEHVSNLMSSNIVQTLGTMLDTVVF

SEQ ID NO: 7044 - protein, 309 aa, Silene vulgaris
MDRLTRMFAGAGGGLAHPPVDSPTLDTSEQIYISATALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLNKKKWTDGLTLQRFDVHSRTNEQTVQEMRNLAIKYNKAVQEEDELSPEKLAIANVGRQDAKKHLEEHVSNLMSSNIVQTLGTMLDTVVF

SEQ ID NO: 7045 - protein, 312 aa, Catharanthus roseus
MSGMERLHRMFAGAGGSLSHPPPDSPTLDSSEQVYISSLALLKMLKHGRAGVPMEVMGLMLGDFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLQRFDTHSKTNEQTVQEMLNLAMKYNKAVQEEDELPPEKLAIANVGRQDAKKHLEEHVSNLMSSNIIQTLGTMIDTVVF

SEQ ID NO: 7046 - protein, 312 aa, Cichorium intybus
MSGMERLQRMFAGAGGALGHPPPDSPTLDTSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNKLEEKMLLNLHKKKWTDGLTLERFDTHSKTNEQTVEEMLGLAVKYNKAVEEEDKLSPEKLAIANVGRQDAKKHLEEHVSNLMSSNIIQTLGTMLDTVVF

SEQ ID NO: 7047 - protein, 309 aa, Physcomitrella patens
MDSRLNRIFAGSGGGGGPHPDSPLVDSSEQVYISSLALLKMLKHGRAGVPMEVMGLMLGEFVDEYTVRVVDVFAMPQSGTGVSVEAVDPVFQTKMLDMLKQTGRPEMVVGWYHSHPGFGCWLSGVDINTQQSFEALNQRAVAVVVDPIQSVKGKVVIDAFRLINPQTMMLGQEPRQTTSNVGHLNKPSIQALIHGLNRHYYSIGINYRKNELEEKMLLNLHKKKWTDGLTLQRYDEHGKTNESTVKEMLDLAIKYNKAVQEEDQLSPEKLAIANVGRQDAKKHLEEHVSNLMSSNIVQTLGTMLDTVVF

SEQ ID NO: 7048 - protein, 308 aa, Utricularia gibba
EIHPECFAGAGGALGHPPPDSPTLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLERFDAHSKTNEQTVQEMLKLAFKYNKAVQEEDALPPEKLAIANVGKQDAKKHLEEHVSNLMSSNIAQTLGMMLDTVVF

SEQ ID NO: 7049 - protein, 309 aa, Ceratodon purpureus
MESRLHRIFAGGGAGGGPHPDSPLVDSSEQVYISSLALLKMLKHGRAGVPMEVMGLMLGEFVDEYTVRVVDVFAMPQSGTGVSVEAVDPVFQTKMLDMLKQTGRPEMVVGWYHSHPGFGCWLSGVDINTQQSFEALNQRAVAVVVDPIQSVKGKVVIDAFRLINPQTMMLGQEPRQTTSNIGHLNKPSIQALIHGLNRHYYSIGINYRKNELEEKMLLNLHKKKWTDGLTLQRYDEHGKTNESTVKEMLDLAIKYNKAVQEEDQLSPEKLAIANVGRQDAKKHLEEHVSNLMSSNIVQTLGTMLDTVVF

SEQ ID NO: 7050 - protein, 309 aa, Ceratodon purpureus
MESRLHRIFAGGGAGGGPHPDSPLVDSSEQVYISSLALLKMLKHGRAGVPMEVMGLMLGEFVDEYTVRVVDVFAMPQSGTGVSVEAVDPVFQTKMLDMLKQTGRPEMVVGWYHSHPGFGCWLSGVDINTQQSFEALNQRAVAVVVDPIQSVKGKVVIDAFRLINPQTMMLGQEPRQTTSNIGHLNKPSIQALIHGLNRHYYSIGINYRKNELEEKMLLNLHKKKWTDGLTLQRYDEHGKTNEATVKEMLDLAIKYNKAVQEEDQLSPEKLAIANVGRQDAKKHLEEHVSNLMSSNIVQTLGTMLDTVVF

SEQ ID NO: 7051 - protein, 142 aa, Gossypium hirsutum
MMLGQEPRQTTSNLGHLNKPSIQALIHGLNRHYYSIAINYRKNELEEKMLLNLHKKKWTDGLTLRRFDTHSKTNEQTIQEMLNLAIKYNKAVQEEGELPPEKLAIANVGRQDAKKHLEEHVSNLMSSNIVQTLGTMLDTVVF

SEQ ID NO: 7052 - protein, 309 aa, Physcomitrella patens
MDSRLHRIFAGGGSGGGPHPDSPLVDSSEQVYISSLALLKMLKHGRAGVPMEVMGLMLGEFVDEYTVRVVDVFAMPQSGTGVSVEAVDPVFQTKMLDMLKQTGRPEMVVGWYHSHPGFGCWLSGVDINTQQSFEALNQRAVAVVVDPIQSVKGKVVIDAFRLINPQTMMLGQEPRQTTSNVGHLNKPSIQALIHGLNRHYYSIGINYRKNELEEKMLLNLHKKKWTDGLTLQRYDEHGKTNEATVKEMLDLAIKYNKAVQEEDQLSPEKLAIVNVGRQDAKKHLEEHVSNLMSSNIVQTLGTMLDTVVF

SEQ ID NO: 7053 - protein, 295 aa, Papaver somniferum
GGHPPPDSPLLDSSEQVYISSLALLKMLKHGRAGVPMEVMGLMLGEFVDEYTVRVVDVFAMPQSGTGVSVEAVDPVFQTNMLDMLKQTGRPEMVVGWYHSHPGFGCWLSGVDINTQQSFEALNQRAVAVVIDPIQSVKGKVVIDAFRLINPQTMMLGQEPRQTTSNLGYLNKPSIQALIHGLNRHYYSIAINYRKNELEEKMLLNLHKKKWTDGLTLQQFDSHSKTNEQTVEEMRSLAIKYNKAVQEEDELSPEKLAIANVGRQDAKKHLEEHVNNLMSSNIIQTLGTMLDTVVF

SEQ ID NO: 7054 - protein, 84 aa, Marchantia polymorpha
MERLQRIFSGVGAGGGGMGGPHPDAPLVDSSEQVYISSLALLKMLKHGRAGVPMEVMGLMLGEFVDEYTVRVVDVFAMPQSGQE

SEQ ID NO: 7055 - protein, 270 aa, Artemisia annua
MSGMERIQRMLAGGGGALGHAPPDSPTLDTSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDVNTQQSFEALNQRAVAVVIDPIQSVKGKVVIDAFRTINPQTMMLGQEPRQTTSNLGHLNKPSIQALIHGLNRHYYSIAINYRKNELEEKMLLNLHKKKWTDGLTLERFDTHSKTNEVTVQEMLGLAIKYNKAVQTNCPQRN

SEQ ID NO: 7056 - protein, 312 aa, Triphysaria pusilla
MAGIERLQRMFAGAGGSLSHPPVDSPTLDTSEQVYISSLALLKMLKHGRAGVPMEVMGLMLGEFVDEYTVRVVDVFAMPQSGTGVSVEAVDPVFQTNMLDMLKQTGRPEMVVGWYHSHPGFGCWLSGVDINTQQSFEALNQRAIAVVVDPIQSVKGKVVIDAFRLINPQSMMLGQEPRQTTSNLGHLNKPSIQALIHGLNRHYYSIAINYRKNELEEKMLLNLHKKKWTDGLTLQRFDAHSKTNEKTVEEMLNLATKYNKAVQEEDEMPPEKLAIANVGKQDAKKHLEDHVSNLMSSNIVQTLGTMLDTVIF

SEQ ID NO: 7057 - protein, 314 aa, Centaurea maculosa
  misc_feature (272)..(273): Xaa can be any naturally occurring amino acid
  misc_feature (280)..(280): Xaa can be any naturally occurring amino acid
  misc_feature (285)..(285): Xaa can be any naturally occurring amino acid
MSGMERLQRMFAGAGGALGHPPPDSPTLDTSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNKLEEKMLLNLHKKKWTDGLTLERFDTHSKTNEQTVQEMLSLAIKYNKAVQRDELLRELXXGTLGAGXKEASXRARVELNVVQHHSDVGYHARHRCLLNLRC

SEQ ID NO: 7058 - protein, 295 aa, Taxus baccata
MGPPATDGPMLDSSEQVYISSLALLKMLKHGRAGVPMEVMGLMLGDFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWADGLNLQRFDCHAKTNEQTVQEMLDLAVKYNKAVQEEDQLPPEKLAIANVGRQDAKKHLEEHVSNLMSSNIVQTLGTMLDTVVF

SEQ ID NO: 7059 - protein, 287 aa, Cleome gynandra
PTLDTSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLRRFDTHSKTNEQTVQEMLNLAIKYNKAVQEEDELAPEKLAIANVGREDAKKHLEEHVSNLMSSNIVQTLGTMLDTVVF

SEQ ID NO: 7060 - protein, 291 aa, Conyza canadensis
PPDSPTLDTSEQVYISSLALLKMLKHGRAGVPMEVMGLMLGEFVDEYTVRVVDVFAMPQSGTGVSVEAVDPVFQTKMLDMLKQTGRPEMVVGWYHSHPGFGCWLSGVDINTQQSFEALNQRAVAVVIDPIQSVKGKVVIDAFRLINPQTMMLGQEPRQTTSNLGHLNKPSIQALIHGLNRHYYSIAINYRKNQLEEKMLLNLHKKKWTDGLTLERFDTHSKTNEQTVQEMLGLAVKYNKAVQEEDQLSPEKLVIANVGRQDAKKHLEEHVSNLMSSNIIQTLGTMLDTVVF

SEQ ID NO: 7061 - protein, 92 aa, Distylium racemosum
MLLNLHKKKWTDGLTLQRFDCHSRTNEQTVQEMLDLAIKYNKAVQEEDELPPEKLAIANVGRQDAKRHLEDHVSNLMSSNIVQTLGTMLDTV

SEQ ID NO: 7062 - protein, 158 aa, Secale cereale
MERLQRIFGAGGMGQPPSDSPLLDSSEQVYISSLALLKMLKHGRAGVPMEVMGLMLGEFVDDYTVRVVDVFATAAKDGTGVERRGRRPRLPDQHARHAQADRPGQKIGGRVGITLILVLVCWLSGVDINTQQSFEALEPQGSCCRDRPHPECQGEGGH

SEQ ID NO: 7063 - protein, 298 aa, Arnica chamissonis
MSGMERLQRMFAGAGGALGHPPPDSPTLDTSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAIAVVVDPIQSVKGKVVIDAFRLINPQTMMLGQEPRQTTSNLGHLNKPSIQALIHGLNRHYYSIAINYRKNKLEEKMLLNLHKKKWTDGLTLEPFDTHSKTNEQTVQEMLNLAIKYNKAVQEEDELPPEKLAIANVGRQDAKKHLEEHVSNLMSSN

SEQ ID NO: 7064 - protein, 312 aa, Selaginella moellendorffii
MERMERLQRMFSGMGGGGAGPHPDSPLVDTSEQVYISSLALLKMLKHGRAGVPMEVMGLMLGDFVDEYTVRVIDVFAMPQSGTGVSVEAVDPVFQTKMMDMLKQTGRSEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKTELEEKMLLNLHKKTWTDGLALQHFDCHSKTNEATINEMLDLAVKYNKAVQEEDKLSPEKLAIANVGRQDAKKHLEDRVSNLMSSNIVQTLGTMLDTVVF

SEQ ID NO: 7065 - protein, 299 aa, Lactuca sativa
MSGMERLQRMFAGAGGALGHPPPDSPTLDTSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNKLEEKMLLNLHKKKWTDGLTLERFDTHSKTNEQTVQEMLGLAVKYNKAVEEEDKLSPEKLAIANVGRQDAKKHLEEHVSHLMSSNI

SEQ ID NO: 7066 - protein, 316 aa, Pteridium aquilinum
ESAAYGETAADLLGRGGRGRRPVVRTLDSPLVDSSEQVYISSLALLKMLKHGRAGVPMEVMGLMLGDFVDEYTVRVVDVFAMPQSGTGVSVEAVDAVFQAKMLDMLKQTGRQEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKRKWTDGLTLERFDNHAKMNESTVQEMLDLAIKYNKAVQEEDQLPPEKLAIANVGRQDAKKHLEEHVSNLMSSNIVQTLGTMLDTVVF

SEQ ID NO: 7067 - protein, 282 aa, Ambrosia trifida
FAGAGGALGHPPPDSPTLDTSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAIAVVVDPIQSVKGKVVIDAFRLINPQTMMLGQEPRQTTSNLGHLNKPSIQALIHGLNRHYYSIAINYRKNKLEEKMLLNLHKKKWTDGLTLEPFDTHSKTNEQTVQEMLSLAIKYNKAVQEEDELPPEKLAIANVGRQDAKKHLEEHVS

SEQ ID NO: 7068 - protein, 303 aa, Ambrosia trifida
MSGMERLQRMFAGAGGALGHPPLDSPTLDTSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLKLERFDTHSKTNEQTVQEMLSLAIKYNKAVQEEDKLSPEKLAIANVGRQDDKRNISKNMSPISCRPISFRH

SEQ ID NO: 7069 - protein, 286 aa, Salvia sclarea
MAGMERLHRMFAGAGGALGHPPPDSPTLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNVGHLNKPSIQALIHGLNRHYYSIAINYRKNELEEKMLLNLHKKKWTDGLTLQRFDTHSKTNEQTVQEMLNLAIKYNKAVQEEDELPPEKLAIANVGKQDAKKH

SEQ ID NO: 7070 - protein, 246 aa, Panicum virgatum
MDRLQRIFGASGMGQPPSDSPLLDSSEQVYISSLALLKMLKHGRAGVPMEVMGLMLGEFVDDYTVRVVDVFAMPQSGTGVSVEAVDHVFQTNMLDMLKQTGRPEMVVGWYHSHPGFGCWLSGVDINTQQSFEALNPRAVAVVIDPIQSVKGKVVIDAFRLINPQTMMLGQEPRQTTSNVGHLNKPSIQALIHGLNRHYYSIAINYRKNELEEKMLLNLHKKKWTDGLILKRFDTHSKTNEQTVQKC

SEQ ID NO: 7071 - protein, 251 aa, Ambrosia trifida
MSGMERLQRMFAGAGGALGHPPPDSPTLDTSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNQRAIAVVVDPIQSVKGKVVIDAFRLINPQTMMLGQEPRQTTSNLGHLNKPSIQALIHGLNRHYYSIAINYRKNKLEEKMLLNLHKKNGLMDSRLNHLIPILKPMSRLSRKC

SEQ ID NO: 7072 - protein, 248 aa, Physcomitrella patens
MEVMGLMLVEFVDEYTVCVVNVFAMPQSGTGVSVEAVDPGFQTKMLHMLKQTGRPEMVVGWYHSHPGFGCWLSGVDINTQQSFEALNQRAVAVVVDPIQSVKGKVVIDAFRLINLQTMMLGQEPRQTTSYVGHLNKPSIQALIHGLNRHYYSIGINYQKNELEEKMLLNLRKRSGLMDYVSTSCLEMLNLAIKYNKAVQGEDQLSPEKLAIANVGRQDAKKHLEEHVSNLMSSNIVQTLGTMLDTVAF

SEQ ID NO: 7073 - protein, 262 aa, Cenchrus ciliaris
MERLHRIFGAAGMGQPPSDSPLLDSSEQVYISSLALLKMLKHGRAGVPMEVMGLMLGEFVDDYTVRVVDVFAMPQSGTGVSVEAVDHVFQTNMLDMLKQTGRPEMVVGWYHSHPGFGCWLSGVDINTQQSFEALNPRAVAVVIDPIQSVKGKVVIDAFRLINPQTMMLGQEPRQTTSNVGHLNKPSIQALIHGLNRHYYSIAINYRKNELEEKMLLNLHKKKWTDGLILKRFDTHSKTNEQTVQEMLNLAVKYNKAVQEEDE

SEQ ID NO: 7074 - protein, 111 aa, Platanus occidentalis
MEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKEKWLLMPSD

SEQ ID NO: 7075 - protein, 121 aa, Thalictrum flavum
MLKHGRAGVPMEVMGLMLGDFVDEYTVRVVDVFAMPQSGTGVSVEAVDPVFQTKMLDMLKQTGRPEMVVGWYHSHPGFGCWLSGVDINTQQSFEQLNQRAVAVVVDPIQSVKGRWSLMPSV

SEQ ID NO: 7076 - protein, 259 aa, Cleome gynandra
MEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLRRFDTHSNTNEQTVQEMLNLAIKYNKAVQEEDELPPEKLAIANVGRQDAKKHLEEHVSNLMSSNIVQTLGTMLDTVVF

SEQ ID NO: 7077 - protein, 259 aa, Cucurbita pepo
MEVMGLMLGEFVDEYTVRVVDVFAMPQSGTGVSVEAVDHVFQTNMLDMLKQTGRPEMVVGWYHSHPGFGCWLSGVDINTQQSFEALNQRAVAVVVDPIQSVKGKVVIDAFRLINPQTMMLGQEPRQTTSNLGHLNKPSIQALIHGLNRHYYSIAINYRKNELEEKMLLNLHKKKWTDGLTLRRFDTHSKTNEQTIQEMLSLAIKYNKAVQEEDELPPEKLAIANVGRQDAKKHLEEHVSNLMSSNIIQTLGTMLDTVVF

SEQ ID NO: 7078 - protein, 85 aa, Momordica charantia
MEVMGLMLGEFVDEYTVRVVDVFAMPQSGTGVSVEAVDHVFQTNMLDMLKQTGRPEMVVGWYHSHPGLGVGYLVLILIHNRVLKL

SEQ ID NO: 7079 - protein, 261 aa, Zingiber officinale
MERLHRIFSGAGGMGHPPTDSPQLDSAEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQSFEALNPRAIAVVVDPIQSVKGKVVIDAFRLINPQTMMLGQEPRQTTSNVGHLNKPSIQALIHGLNRHYYSIAINYRKNELEEKMLLNLHKKKWTDGLILRPFDTHSKTNEQTVQEMLDLAIKYNKAVQEE

SEQ ID NO: 7080 - protein, 91 aa, Pseudoroegneria spicata
  misc_feature (82)..(82): Xaa can be any naturally occurring amino acid
MAIRGIPSQREMTVEEFKEWLKQFDVDGDGRISRAELREAIRRRGGWFTTLRAGRAVRRADRDNSGFVDDAEVENLVAFAQXDLGMRISAW

SEQ ID NO: 7081 - protein, 91 aa, Secale cereale
MAIRGIPSQREMTVEEFKEWLKQFDVDGDGRISRDELREAIRRRGGWFTTLRAGRAVRRADRDNSGFVDAAEVENLVAFAQKDLGMRISAW

SEQ ID NO: 7082 - protein, 91 aa, Triticum aestivum
MAIRGVPSQREMTVAEFKEWLKQFDADGDGRISRAELREAIRSRGGWFTTLRAGRAVRRADRDKSGFVDDAEVENLVAFAQKDLGMRISAW

SEQ ID NO: 7083 - protein, 92 aa, Avena sativa
MAIIRTVPSARGMSVEEFKEWLKQFDVDGDGRISKGELREAIRRRGGWFATLRAGRAVRRADRDNSGYVDDAEIENLVAFAQKDLGMKISSW

SEQ ID NO: 7084 - protein, 90 aa, Brachypodium distachyon
MAIRGVPSAREMTVEDFKLWLKQFDVDGDGRISRGELREALRRRGGWFTTIKADRAVRRADKDNNGFVDNAEVENLIAFAQKDLGMKIST

SEQ ID NO: 7085 - protein, 379 aa, Triticum aestivum
AAVALLLAAVLCLGGGGAASASPDFDYPAAFNFGDSNSDTGGRIAAGFEPMPPPYGSTFFGAPSGRFSDGRLILDFLMDAMDMPFLNAYLDSLGAPNFRAGVNFAQAGCSITPASATSVSPFSFGLQIKQFFAFKEKVTSLLSKGDRYRRYIPQLDYFSKGLYMFDIGQNDLAGQFYSRTEDQVIASIPTILLEFETGLKTLYDQGARKFWIHNTGPLGCLPQNIDLFGKDPTQLDELHCVAKHNRAAKIFNLQLHALCTKLRGQFAGANITYIDIYSIKYALIGNYSRYGFESPTEACCGYGGPPLNYDGRVPCGQTKSVNGNLVTAKGCSDSTEYVNWDGIHYTEAANFHVTSQILTGKYSDPPFVDKTPFLIKPRF

SEQ ID NO: 7086 - protein, 289 aa, Triticum aestivum
METLLSPSALLGPLRGSRKPAAPAAVPCSRSAVSCSLKKQTQTQAGVAWRGDGDRGLGSWASFLHHGLAAAALSLALTLSPAPAPAVASEFDVLNDGPPADTYVVDDAGVLSRVTKSDVKRLARDLEARKNIRINFVTVRKLTSKADAFEYADQVLEKWYPTVEEGSNKGIVVLVTSQKEGAITGGPDFVQAVGDAILDATVSENLPVLATDEKYNEAIFSTAKRLVAAIDGLPDPGGPAFQESKRESNFKSKEETEEKRGQFTLVVGGLLVIAFVVPMAQYYAYISKK

SEQ ID NO: 7087 - protein, 286 aa, Pseudoroegneria spicata
  misc_feature (198)..(198): Xaa can be any naturally occurring amino acid
METLLSPSALLGPLRVSRKLGGPAAVPCRSAVSCSLKKQAQAQAGVAWRGDGGVGSWASFLHHGLAAAALSLALTLSPAPAPAVASEFDVLNDGPPADTYVVDDAGVLSRVTKSDVKRLARDLEARKNIRINFVTVRKLTSKADAFEYADQVLEKWYPTVEEGSNKGIVVLVTSQKEGAITGGPAFVQAVGDAILDAXVSENLPVLATDEKYNEAIFSTAKRLVAAIDGLPDPGGPAFQESKRESNFKSKEETEEKRGQFTLVVGGLLVIAFVVPMAQYYAYISKK

SEQ ID NO: 7088 - protein, 289 aa, Triticum aestivum
METLLSPSALLGPLRVSRKPAAPAAVPCSRPAVSCSLKKQAQAQAGVAWRGDGDGGVGSWASFLHHGLAAAALSLALTLSPAPAPAAASEFDVLNDGPPADTYVVDDAGVLSRVTKSDVKRLARDLEARKNIRINFVTVRKLTSKADAFEYADQVLEKWYPTVEDGSNKGIVVLVTSQKEGAITGGPAFVQAVGDAILDATVSENLPVLATDEKYNEAIFSTAKRLVAAIDGLPDPGGPAFQESKRESNFKSKEETEEKRGQFTLVVGGLLVIAFVVPMAQYYAYISKK

SEQ ID NO: 7089 - protein, 282 aa, Triticum aestivum
METLLSPSALLGPLRGSRSRKPAAPAAVSCSLKKQAQAGVAWRGDGDGGVGSWASFLHHGLAAAALSLALTLSPAPAPAAASEFDVLNDGPPADTYVVDDAGVLSRVTKSDVKRLARDLEARKNIRINFVTVRKLTSKADAFEYADQVLEKWYPTVEDGSNKGIVVLVTSQKEGAITGGPAFVQAVGDAILDATVSENLPVLATDEKYNEAIFSTAKRLVAAIDGLPDPGGPAFQESKRESNFKSKEETEEKRGQFTLVVGGLLVIAFVVPMAQYYAYISKK

SEQ ID NO: 7090 - protein, 271 aa, Triticum aestivum
KPAAPAAVPCSRSAVSCSLKKQTQTQAGVAWRGDGDRGLGSWASFLHHGLAAAALSLALTLSPAPAPAAASEFDVLNDGPPADTYVVDDAGVLSRVTKSDVKRLARDLEARKNIRINFVTVRKLTSKADAFEYADQVLEKWYPTVEEGSNKGIVVLVTSQKEGAITGGPDFVQAVGDAILDATVSENLPVLATDEKYNEAIFSTAKRLVAAIDGLPDPGGPAFQESKRESNFKSKEETEEKRGQFTLVVGGLLVIAFVVPMAQYYAYISKK

SEQ ID NO: 7091 - protein, 283 aa, Avena sativa
METLLSPSALLSPLRGSKKPAPAAVSCSLRKQTPPAQAGVAWSGDGASSVAGSWASFLHHGLAAAALSLALTLAPAPAPVAASEFDVLNDGPPADTYVVDDAGVLSRVTKSDVKRLARDLEARKNIRINFVTVRKLTSKADAFEYADQVLEKWYPTVEAGSNKGIVVLVTSQKEGAITGGPEFVKAVGDAILDATVSENLPVLATDEKYNEAIYSTAKRLVAAIDGLEDPGGPAFQESKRESNYKSKQETEEKRGQFTLVVGGLLVIAFVVPMAQYYAYISKK

SEQ ID NO: 7092 - protein, 290 aa, Brachypodium distachyon
METLLSPSALLSPALRGSSSKTTKLVPPAASCKPTTISCLLRKPQAVVASSRGDGVVGSSWVSLLQHGMAAAALSLALTLAPAPAPAVASEFDVLNDGPPADTYVVDDAGVLSRVTKSDVKRLARDLEARKNIRINFVTVRKLTSKADAFEYADQVLEKWYPTVEEGGNKGIVVLVTSQKEGAITGGPAFVQAVGDAILDATVSENLPVLATDEKYNEAIYSTAKRLVAAIDGLPDPGGPAFQESKRESNFKSKEETEEKRGQFTLVVGGLLVIAFVVPMAQYYAYISKK

SEQ ID NO: 7093 - protein, 286 aa, Cynodon dactylon
METLLSPSTLFTPLRGGSKKPSPASASSSRSVVSCTLRKQQPAALAASSHGDGARNWVSFLHHGLAAAALSLAISLAPAPAPAVASEFDVLNDGPPVDSYVVDDAGVLSRVTKSDVKRLARDLEARKNIRLNFITVRKLTSKADAFEYADQVLEKWYPTIEEGSNKGIVVLVTSQKEGAITGGPEFVKAVGDQILDATVSENLPVLATDEKYNEAIFSTAKRLAAAIDGLPDTGGPSFKENKRESNFKTKEETESKRGQFTLVVGGLLVIAFVVPMAQYYAYISKK

SEQ ID NO: 7094 - protein, 331 aa, Leymus cinereus x Leymus triticoides
  misc_feature (20)..(21): Xaa can be any naturally occurring amino acid
METLLSPSALLGPLRGSRKXXAPAAVPCRSAISCSLKKQTQAGVAWRGDGDSGVGSWASFLHHGLAAAALSLALTLAPAPAPVLASEFDVLNDGPPADTYVVDDAGVLSRVTKSDVKRLARDLEARKNIRINFVTVRKLTSKADAFEYADTVLEKWYPTVEEGSNKGIVVLVTSQKEGAITGGPAFVQAVGDAILDATVSENLPVLATDEKYNEAIFSTAKRLVAAIDGLPDPGGPAFQESKRESNFKSKEETEEKRGQFTLVVGGLLVIAFVVPMAQYYAYISKKGDHRGGLAAVAGALLLSSSSVRGGGTGGTGSCLSRSATWAGSHGL

SEQ ID NO: 7095 - protein, 299 aa, Oryza sativa
METLLSPSTLLSPLRGSKKKPASPAASASSSSSSPARSVVSCALRRQQPPPQAVAAWRGDGGRGGGVGSWATFLQHGLAAAALSLAISMAPAPAPAVASEFDVLNGGPPEDTYVVDDAGVLSRVTKSDVKRLVRDLESRKNIRINFITVRKLTSKADAFEYADQVLEKWYPTVEEGNNKGIVVLVTSQKEGAITGGPAFVQAVGDEILDSTVSENLPVLATDEKYNEAIYTTAKRLAAAIDGLPDPGGPTFKDNKRESNFKTKEETEEKRGQFTLVVGGLLVIAFVVPMAQYYAYISKK

SEQ ID NO: 7096 - protein, 287 aa, Setaria italica
METLLSPSTLFTPLRGTRSVSARSTVSCAALKKQQQAAALAASASSHGYSGSGGGRSWVSFLHHGLAAAALSLAISLGPAPAPAVASEFDVLNDGPPVDSYVVDDAGVLSRVTKSDVKRLARDLEERKNIRLNFITVRKLTSKADAFEYADQVLEKWYPTIEEGSNKGIIVLVTSQKEGAITGGPAFVQAVGDQILDATVSENLPVLATDEKYNEAIFSTAKRLAAAIDGLPDTGGPSFKENKRESNFKTKEETEEKRGQFTLVVGGLLVIAFVVPMAQYYAYVSKK

SEQ ID NO: 7097 - protein, 290 aa, Zea mays
METLLSPSTLFTLPLRGSSRRPSLAASVSSRPTVSCSSALKRPQAGAVAASSHGDGVGRNWMSFLHHGLAAAALSLAIGLTPAPAPAVASEFDVLNDGAPVDSYVVDDAGVLSRVTKSDVKRLARDLEARKNIRLNFITVRKLTSKADAFEYADQVLEKWYPTIEEGNNKGIVVLVTSQKEGAVTGGPAFIQAVGDQILDATVSENLPVLATDEKYNEAILSTAKRLAAAIDGLPDTGGPSFKENKRESNFKTKEETEEKRGQFTLVVGGLLVIAVVVPMAQYYAYVSKK

SEQ ID NO: 7098 - protein, 298 aa, Sorghum bicolor
METLLSPSTLFTPSLRGSRRPSLTASVSSRSTVVVSCALRRPQAAGAAVAATTSSSNGDGGIDVVGRSWMSFLHHGLAAAALSLAISLAPAPAPAVASEFDVLNDGPPVDSYVVDDAGVLSRVTKSDVKRLARDLEARKNIRLNFITVRKLTSKADAFEYADQVLEKWYPTIEEGNNKGIVVLVTSQKEGAVTGGPAFIQAVGDQILDATVSENLPVLATDEKYNEAIFSTARRLAAAIEGLPDTGGPSFKENKRESNFKTKEETEEKRGQFTLVVGGLLVIAFVVPMAQYYAYISKK

SEQ ID NO: 7099 - protein, 210 aa, Triticum aestivum
MSYAYLFKYIIIGDTGVGKSCLLLQFTDKRFQPVHDLTIGVEFGARMITIDNKPIKLQIWDTAGQESFRSITRSYYRGAAGALLVYDITRRETFNHLASWLEDARQHANANMTVMLIGNKCDLSHRRAVSYEEGEQFAKEHGLVFMEASAKTAQNVEEAFIKTAGTIYKKIQDGVFDVSNESYGIKVGYAVPNASGGGAGSSSQAGGCCS

SEQ ID NO: 7100 - protein, 114 aa, Triticum aestivum
MKLVRFLMKLNNETVTIELKNGTTVHGTIIGVDISMNTHLKTVKLTLKGKNPVTLDHLSVRGNNIRYYILPDSLNLETLLVEETPRVKPKKPTAGKPMGRGRSRGRGRGRGRGR

SEQ ID NO: 7101 - protein, 114 aa, Brachypodium distachyon
MKLVRFLMKLNNETVTIELKNGTTVHGTITGVDISMNTHLKTVKLTLKGKNPVTLDHLSVRGNNIRYYILPDSLNLETLLIEETPRVKPKKPTAGKPMGRGRGRGRGRGRGRGR

SEQ ID NO: 7102 - protein, 114 aa, Unknown
  Sequence found in Organisms: Festuca arundinacea, Avena sativa
MKLVRFLMKLNNETVTIELKNGTTVHGTITGVDISMNTHLKTVKLTLKGKNPVTIDHLSVRGNNIRYYILPDSLNLETLLVEETPRVKPKKPTAGKPMGRGRGRGRGRGRGRGR

SEQ ID NO: 7103 - protein, 114 aa, Panicum virgatum
MKLVRFLMKLNNETVTIELKNGTVVHGTIIGVDISMNTHLKTVKLTLKGKNPVTLDHLSVRGNNIRYYILPDSLNLETLLVEETPRVKPKKPTSGKPLGRGRGRGRGRGRGRGR

SEQ ID NO: 7104 - protein, 114 aa, Unknown
  Sequence found in Organisms: Gossypium hirsutum, Vaccinium corymbosum, Gossypium raimondii, Actinidia deliciosa
MKLVRFLMKLNNETVSIELKNGTVVHGTITGVDISMNTHLKTVKLTLKGKNPVTLDHLSVRGNNIRYYILPDSLNLETLLVEETPRVKPKKPTAGKPLGRGRGRGRGRGRGRGR

SEQ ID NO: 7105 - protein, 114 aa, Unknown
  Sequence found in Organisms: Artemisia annua, Parthenium argentatum, Helianthus annuus
MKLVRFLMKLNNETVSIELKNGTVVHGTITGVDISMNTHLKTVKLTLKGKNPVTLDHLSVRGNNIRYYILPDSLNLETLLVEETPRVKPKKPTAGKPVGRGRGRGRGRGRGRGR

SEQ ID NO: 7106 - protein, 114 aa, Cynodon dactylon
MKLVRFLMKLNNETVTIELKNGTVVHGTITGVDISMNTHLKTVKLTLKGKNPVTLDHLSVRGNNIRYYILPDSLNLETLLVEDTPRVKPKKPTAGKPLGRGRGRGRGRGRGRGR

SEQ ID NO: 7107 - protein, 114 aa, Vitis vinifera
MKLVRFLMKLNNETVSIELKNGTVVHGTITGVDISMNTHLKTVKLTLKGKNPVTLDHLSVRGNNIRYYILPDSLNLETLLVEETPRVKPKKPTAGRPMGRGRGRGRGRGRGRGR

SEQ ID NO: 7108 - protein, 114 aa, Unknown
  Sequence found in Organisms: Glycyrrhiza uralensis, Arachis hypogaea
MKLVRFLMKLNNETVSIELKNGTIVHGTITGVDISMNTHLKTVKLTLKGKNPVTLDHLSVRGNNIRYYILPDSLNLETLLVEETPRVKPKKPTAGKPLGRGRGRGRGRGRGRGR

SEQ ID NO: 7109 - protein, 114 aa, Unknown
  Sequence found in Organisms: Zea mays, Sorghum bicolor, Saccharum officinarum, Panicum virgatum
MKLVRFLMKLNNETVTIELKNGTVVHGTITGVDISMNTHLKTVKLTLKGKNPVTLDHLSVRGNNIRYYILPDSLNLETLLVEETPRVKPKKPTSGKPLGRGRGRGRGRGRGRGR

SEQ ID NO: 7110 - protein, 145 aa, Ambrosia trifida
STKALKHQKPYFPFTFSGISLILSRLSIISHNEARQVLNEAEQRDGSIELQNGTVVHGTITGVDISMNTHLKTVKLTLKGKNPVTLDHLSVRGNNIRYYILPDSLNLETLLVEETPRVKPKKPTAGKPVGRGRGRGRGRGRGRGR

SEQ ID NO: 7111 - protein, 138 aa, Cirsium arvense
MKLVRFLMKLNNETVSIELKNGTVVHGTITGVDISMNTHLKTVKLTLKGKNPVTLDHLSVRGNNIRYYILPDSLNLETLLVEETPRANQRNQLQGDRWDVEGDVGVDVVVAEAVNSLSIVVISAFVNTCIVGRLVIIF

SEQ ID NO: 7112 - protein, 114 aa, Musa acuminata
MKLVRFLMKLNNETVSIELKNGTVVHGTIIGVDISMNTHLKTVKLTVKGKNPVTLDHLSVRGNNIRYYILPDSLNLETLLVEETPRVKPKKPTAGRSMGRGRGRGRGRGRGRGR

SEQ ID NO: 7113 - protein, 114 aa, Unknown
  Sequence found in Organisms: Gossypium hirsutum, Gossypium raimondii
MKLVRFLMKLNNETVSIELKNGTVVHGTITGVDISMNTHLKTVKLTLKGKNPVTMDHLSVRGNNIRYYILPDSLNLETLLVEETPRVKPKKPTAGKPLGRGRGRGRGRGRGRGR

SEQ ID NO: 7114 - protein, 114 aa, Unknown
  Sequence found in Organisms: Gossypium hirsutum, Gossypium raimondii
MKLVRFLMKLNNETVSIELKNGTVVHGTITGVDISMNTHLKTVKLTLKGKNPVSLDHLSVRGNNIRYYILPDSLNLETLLVEETPRVKPKKPTAGKPLGRGRGRGRGRGRGRGR

SEQ ID NO: 7115 - protein, 114 aa, Unknown
  Sequence found in Organisms: Cicer arietinum, Medicago truncatula, Trigonella foenum-graecum
MKLVRFLMKLNNETVSIELKNGTIVHGTITGVDISMNTHLKTVKLTLKGKNPVTLDHLSVRGNNIRYYILPDSLNLETLLVEEAPRVKPKKPTAGKPLGRGRGRGRGRGRGRGR

SEQ ID NO: 7116 - protein, 114 aa, Acacia harpophylla
MKLVRSLMKLNNETVSIELKNGTVVHGTITGVDISMNTHLKTVKLTLKGKNPVTLDHLSVRGNNIRYYILPDSLNLETLLVEETPRVKPKKPTAGKPLGRGRGRGRGRGRGRGR

SEQ ID NO: 7117 - protein, 114 aa, Amorphophallus konjac
MKLVRFLMKLNNETVSIELKNGTVVHGTITGVDISMNTHLKTVKLTLKGKNPVTLDHLSVRGNNIRYYILPDSLNLETLLVEETPRVKPKKPTAGRPTGRGRGRGRGRGRGRGR

SEQ ID NO: 7118 - protein, 114 aa, Unknown
  Sequence found in Organisms: Amborella trichopoda, Fagus grandifolia, Liriodendron tulipifera, Elaeis guineensis, Platanus occidentalis
MKLVRFLMKLNNETVSIELKNGTVVHGTITGVDISMNTHLKTVKLTLKGKNPVTLDHLSVRGNNIRYYILPDSLNLETLLVEETPRVKPKKPTAGRPLGRGRGRGRGRGRGRGR

SEQ ID NO: 7119 - protein, 114 aa, Unknown
  Sequence found in Organisms: Ricinus communis, Euphorbia peplus, Elaeis guineensis
MKLVRFLMKLNNETVSIELKNGTIVHGTITGVDISMNTHLKTVKLTLKGKNPVTLDHLSVRGNNIRYYILPDSLNLETLLVEETPRVKPKKPTAGRPLGRGRGRGRGRGRGRGR

SEQ ID NO: 7120 - protein, 114 aa, Cichorium intybus
MKLVRFLMKLNNETVSIELKNGTVVHGTITGVDISMNTHLKTVKLTLKGKNPVSLDHLSVRGNNIRYYILPDSLNLETLLVEETPRVKPKKPTAGRPMGRGRGRGRGRGRGRGR

SEQ ID NO: 7121 - protein, 114 aa, Cynodon dactylon
MKLVRFLMKLNNETVTIELKNGTVVHGTITGVDISMNTHLKTVKLTLKGKNPVTLDHLSVRGNNIRYYILPDSLNLETLLVEDTPRVKPKKPTSGKPVGRGRGRGRGRGRGRGR

SEQ ID NO: 7122 - protein, 114 aa, Unknown
  Sequence found in Organisms: Euphorbia peplus, Euphorbia esula
MKLVRFLMKLNNETVSIELKNGTIVLGTITGVDISMNTHLKTVKLTLKGKNPVTLDHLSVRGNNIRYYILPDSLNLETLLVEETPRVKPKKPTAGKPLGRGRGRGRGRGRGRGR

SEQ ID NO: 7123 - protein, 114 aa, Euphorbia peplus
MKLVRFLMKLNNETVSIELKNGTIVLGTITGVDISMNTHLKTVKLTLKGKNPVTMDHLSVRGNNIRYYILPDSLNLETLLVEETPRVKPKKPTAGKPMGRGRGRGRGRGRGRGR

SEQ ID NO: 7124 - protein, 114 aa, Carpinus betulus
MKLVRFLMKLNNETVSIELKNGTVVHGTITGVDISMNTHLKTVKLTLKGKNPVTLDHLSVRGNNIRYYILPDSLNLETLLVEEAPRVKPKKPTAGKPLGRGRGRGRGRGRGRGR

SEQ ID NO: 7125 - protein, 114 aa, Unknown
  Sequence found in Organisms: Jatropha curcas, Nuphar advena
MKLVRFLMKLNNETVSIELKNGTVVHGTITGVDISMNTHLKTVKLTLKGKNPVTLDHLSVRGNNIRYYILPDSLNLETLLVEETPRVKPKKPTAGRPVGRGRGRGRGRGRGRGR

SEQ ID NO: 7126 - protein, 114 aa, Actinidia deliciosa
MKLVRFLMKLNNETVSIELKNGTVVHGTITGVDISMNTHLKTVKLTLKGKNPATLDHLSVRGNNIRYYILPDSLNLETLLVEETPRVKPKKPTAGKPLGRGRGRGRGRGRGRGR

SEQ ID NO: 7127 - protein, 114 aa, Glycyrrhiza uralensis
MKLVRFLMKLNNETVAIELKNGTIVHGTITGVDISMNTHLKTVKLTVKGKNPVTLDHLSVRGNNIRYYILPDSLNLETLLVEETPRVKPKKPTAGKPLGRGRGRGRGRGRGRGR

SEQ ID NO: 7128 - protein, 114 aa, Pennisetum glaucum
MKLVRFLMKLNNETVTIELKNGTVVHGTITGVDISMNTHLKTVKLTLKGKNPVTLDHLSVRGNNIRYYILPDSLNLETLLVEETPRVKPKKPATGKPLGRGRGRGRGRGRGRGR

SEQ ID NO: 7129 - protein, 114 aa, Orobanche aegyptiaca
MKLVRFLMKLNNETVSIELKNGTIVHGTITGVDISMNTHLKTVKLTLKGKNPVTMDHLSVRGNNIRYYILPDSLNLETLLVEETPRVKPKKPTAGKPLGRGRGRGRGRGRGRGR

SEQ ID NO: 7130 - protein, 114 aa, Arachis hypogaea
MKLVRFLMKLNNETVSIELKNGTIVHGTITGVDISMNTHLKTVKMTLKGKNPVTLDHLSVRGNNIRYYILPDSLNLETLLVEETPRVKPKKPTAGKPLGRGRGRGRGRGRGRGR

SEQ ID NO: 7131 - protein, 114 aa, Oryza sativa
MKLVRFLMKLNNETVTIELKNGTVVHGTITGVDISMNTHLKTVKLTLKGKNPVTLDHLSVRGNNIRYYILPDSLNLETLLVEDTPRVKAKKPTAGKPLGRGRGRGRGRGRGRGR

SEQ ID NO: 7132 - protein, 114 aa, Oryza sativa
MKLVRFLMKLNNETVTIELKNGTTVHGTITGVDISMNTHLKTVKLTLKGKNPVTFDHLSVRGNNIRYYILPDSLNLETLLVEDTPRVKAKKPTAGKPLGRGRGRGRGRGRGRGR

SEQ ID NO: 7133 - protein, 115 aa, Unknown
  Sequence found in Organisms: Medicago truncatula, Trigonella foenum-graecum
MKLVRFLMKLNNETVSIELKNGTIVHGTITGVDISMNTHLKTVKLTLKGKNPVTLDHLSVRGNNIRYYILPDSLNLETLLVEEAPRVKPKKPTAGGKPLGRGRGRGRGRGRGRGR

SEQ ID NO: 7134 - protein, 115 aa, Unknown
  Sequence found in Organisms: Zea mays, Setaria italica, Saccharum officinarum, Panicum virgatum
MKLVRFLMKLNNETVTIELKNGTVVHGTITGVDISMNTHLKTVKLTLKGKNPVTLDHLSVRGNNIRYYILPDSLNLETLLVEETPRVKPKKPTTGKPLGRGRGRGRGRGRGRGPR

SEQ ID NO: 7135 - protein, 115 aa, Carica papaya
MKLVRFLMKLNNETVSIELKNGTVVHGTITGVDISMNTHLKTVKLTLKGKNPVTLDHLSVRGNNIRYYILPDSLNLETLLVEETPRVKPKKPTAAGRPLGRGRGRGRGRGRGRGR

SEQ ID NO: 7136 - protein, 114 aa, Unknown
  Sequence found in Organisms: Musa acuminata, Rhizophora mangle
MKLVRFLMKLNNETVSIELKNGTVVHGTITGVDISMNTHLKTVKLTVKGKNPVTLDHLSVRGNNIRYYILPDSLNLETLLVEETPRVKPKKPTAGRPVGRGRGRGRGRGRGRGR

SEQ ID NO: 7137 - protein, 114 aa, Unknown
  Sequence found in Organisms: Phaseolus coccineus, Vigna unguiculata
MKLVRFLMKLNNETVSIELKNGTIVHGTITGVDISMNTHLKTVKLTLKGKNPVTLDHLSVRGNNIRYYILPDSLNLETLLVEETPKIKPKKPTAGKPLGRGRGRGRGRGRGRGR

SEQ ID NO: 7138 - protein, 114 aa, Unknown
  Sequence found in Organisms: Gossypium hirsutum, Theobroma cacao, Gossypium raimondii
MKLVRFLMKLNNETVSIELKNGTVVHGTITGVDISMNTHLKTVKLTLKGKNPVSLDHLSVRGNNIRYYILPDSLNLETLLVEETPRVKPKKPTAGRPLGRGRGRGRGRGRGRGR

SEQ ID NO: 7139 - protein, 114 aa, Unknown
  Sequence found in Organisms: Taraxacum officinale, Lactuca sativa
MKLVRFLMKLNNETVSIELKNGTVVHGTITGVDISMNTHLKTVKLTLKGKNPVSLDHLSVRGNNIRYYILPDSLNLETLLVEETPRVKPKKPTAGRPVGRGRGRGRGRGRGRGR

SEQ ID NO: 7140 - protein, 114 aa, Unknown
  Sequence found in Organisms: Hordeum vulgare, Secale cereale, Triticum aestivum
MKLVRFLMKLNNETVTIELKNGTTVHGTITGVDISMNTHLKTVKLTMKGKNPVTLDHISVRGNNIRYYILPDSLNLETLLVEDTPRVKSKKPTTGKPMGRGRGRGRGRGRGRGR

SEQ ID NO: 7141 - protein, 114 aa, Amsonia hubrichtii
MKLVRFLMKLNNETVSIELKNGTVVHGTVTGVDISMNTHLKTVKLTLKGKNPVTLDHLSVRGNNIRYYILPDSLNLETLLVEETPRVKPKKPTTGKPLGRGRGRGRGRGRGRGR

SEQ ID NO: 7142 - protein, 114 aa, Aristolochia fimbriata
MKLVRFLMKLNNETVSIELKNGTIVHGTITGVDISMNTHLKTVKLTLKGKNPVTLDHLSVRGNNIRYYILPDSLNLETLLVEETPRVKPKKPTAGRALGRGRGRGRGRGRGRGR

SEQ ID NO: 7143 - protein, 114 aa, Musa acuminata
MKLVRFLMKLNNETVSIELKNGTVVHGTIIGVDISMNTHLKTVKLTVKGKNPVTLDHLSVRGNNIRYYILPDSLNLETLLVEETPRVKPKKPTAGRSLGRGRGRGRGRGRGRGR

SEQ ID NO: 7144 - protein, 114 aa, Unknown
  Sequence found in Organisms: Citrus sinensis, Citrus clementina, Citrus sinensis
MKLVRFLMKLNNETVSIELKNGTIVHGTITGVDISMNTHLKTVKLTLKGKNPVNLDHLSVRGNNIRYYILPDSLNLETLLVEETPRVKPKKPTAGRPVGRGRGRGRGRGRGRGR

SEQ ID NO: 7145 - protein, 114 aa, Vigna unguiculata
MKLVRFLMKLNNETVSIELKNGTVVHGTITGVDISMNTHLKTVKLTLKGKNPVTLDHLSVRGNNIRYYILPDSLNLETLLVEEAPRIKPKKPTAGKPLGRGRGRGRGRGRGRGR

SEQ ID NO: 7146 - protein, 114 aa, Eucalyptus grandis
MKLVRFLMKLNNETVSIELKNGTVVHGTITGVDISMNTHLKTVKLTLKGKNPVTLDHLSVRGNNIRYYILPDSINLETLLVEETPRVKPKKPTAGRAMGRGRGRGRGRGRGRGR

SEQ ID NO: 7147 - protein, 114 aa, Unknown
  Sequence found in Organisms: Euonymus alatus, Tripterygium wilfordii
MKLVRFLMKLNNETVSIELKNGTVVHGTITGVDISMNTHLKSVKLTLKGKNPVTLDHLSVRGNNIRYYILPDSLNLETLLVEETPRVKPKKPTAGRAMGRGRGRGRGRGRGRGR

SEQ ID NO: 7148 - protein, 114 aa, Flaveria ramosissima
MKLVRFLMKLNNETVSIELKNGTVVHGTITGVDISMNTHLKTVKLTLKGKNPVTLDHMSVRGNNIRYYILPDSLNLETLLVEETPRVKPKKPTAGRPVGRGRGRGRGRGRGRGR

SEQ ID NO: 7149 - protein, 114 aa, Humulus lupulus
MKLVRFLMKLNNETVSIELKNGTVVHGTITGVDISMNTHLKTVKLTLKGKNPVTLDHLSVRGNNIRYYILPDSLNLETLLVEETPRVKPKKPTAGRAVGRGRGRGRGRGRGRGR

SEQ ID NO: 7150 - protein, 114 aa, Tropaeolum majus
MKLVRFLMKLNNETVSIELKNGTVVHGTITGVDISMNTHLKTVKLTLKGKNPVTLDHLSVRGNNIRYYILPDSLNLETLLVEETPRVKPKKATAGRPVGRGRGRGRGRGRGRGR

SEQ ID NO: 7151 - protein, 114 aa, Unknown
  Sequence found in Organisms: Nicotiana benthamiana, Nicotiana tabacum
MKLVRFLMKLNNETVSIELKNGTVVHGTITGVDVSMNTHLKAVKLTLKGKNPVTLDHLSVRGNNIRYYILPDSLNLETLLVEETPRVKPKKPTAGKPLGRGRGRGRGRGRGRGR

SEQ ID NO: 7152 - protein, 114 aa, Nuphar advena
MKLVRFLMKLNNETVTIELKNGTVVHGTITGVDISMNTHLKTVKLTLKGKNPVALDHLSVRGNNVRYYILPDSLNLETLLVEETPRVKPKKPTAGRPVGRGRGRGRGRGRGRGR

SEQ ID NO: 7153 - protein, 114 aa, Avena sativa
MKLVRFLMKLNNETVTIELKNGTTVHGTITGVDISMNTHLKTVKLTLKGKNHVTLDHISVRGNNIRYYILPDSLNLETLLVEDTPRVKAKKPTTGKPMGRGRGRGRGRGRGRGR

SEQ ID NO: 7154 - protein, 114 aa, Carica papaya
MKLVRFLMKLNNETVSIELKNGTVVHGTITGVDISMNTHLKTVKLTLKGKNPVTLDHLSVRGTNIRYYILPDSLNLETLLVEETPRVKPKKPTAGRPVGRGRGRGRGRGRGRGR

SEQ ID NO: 7155 - protein, 114 aa, Lippia dulcis
MKLVRFLMKLNNETVSIELKNGTVVNGTIIGVDISMNTHLKTVKLTLKGKNPVTMDHLSVRGNNIRYYILPDSLNLETLLVEETPRVKPKKPTAGRPIGRGRGRGRGRGRGRGR

SEQ ID NO: 7156 - protein, 114 aa, Unknown
  Sequence found in Organisms: Pinus taeda, Pseudotsuga menziesii
MKLVRFLMKLNNETVSIELKNGTVVHGTITGVDISMNTHLKTVKLTLKGKNPVTLDHLSVRGNNIRYYILPDSLNLETLLVEDTPRIKPKKPTAGKPIGRGRGRGRGRGRGRGR

SEQ ID NO: 7157 - protein, 114 aa, Plantago ovata
MKLVRFLMKLNNETVSIELKNGTVVHGTITGVDISMNTHLKTVKLTLKGKNPVTMDHLSVRGNNIRYYILPDSLNLETLLLEETPRVKPKKPTTGKPMGRGRGRGRGRGRGRGR

SEQ ID NO: 7158 - protein, 114 aa, Platanus occidentalis
MKLVRFLMKLNNETVSIELKNGTVIHGTITGVDISMNTHLKTVKLSLKGKNPVTLDHLSVRGNNIRYYILPDSLNLETLLVEETPRVKPKKPTAGRPMGRGRGRGRGRGRGRGR

SEQ ID NO: 7159 - protein, 114 aa, Unknown
  Sequence found in Organisms: Solanum lycopersicum, Solanum tuberosum, Solanum phureja
MKLVRFLMKLNNETVSIELKNGTVVHGTITGVDVSMNTHLKAVKITLKGKNPVTLDHLSVRGNNIRYYILPDSLNLETLLVEETPRVKPKKPTAGKPMGRGRGRGRGRGRGRGR

SEQ ID NO: 7160 - protein, 114 aa, Prunus persica
MKLVRFLMKLNNETVSIELKNGTVVNGTITGVDISMNTHLKTVKLTLKGKNPVTLDHLSVRGNNIRYYILPDSLNLETLLVEETPRVKPKKPTAGRPVGRGRGRGRGRGRGRGR

SEQ ID NO: 7161 - protein, 116 aa, Lotus japonicus
MKLVRFLMKLNNETVSIELKNGTIVHGTITGVDISMNTHLKTVKLTLKGKNPVTLDHLSVRGNNIRYYILPDSLNLETLLVEETPRVKPKKPTAGGKPLGRGRGRGRGRGRGRGGR

SEQ ID NO: 7162 - protein, 116 aa, Zea mays
MKLVRFLMKLNNETVTIELKNGTVVHGTITGVDISMNTHLKTVKLTLKGKNPVTLDHLSVRGNNIRYYILPDSLNLETLLVEETPRVKPKKPTTGKPLGRGRGRGRGRGRGRGPPR

SEQ ID NO: 7163 - protein, 73 aa, Phalaenopsis aphrodite
MKLVRFLMKLNNETVSIELKNGTVVHGTITGVDISMNTHLKTVKLTLRGKNPVTLDHLSVRGNNIRYVFFPTA

SEQ ID NO: 7164 - protein, 114 aa, Brachypodium distachyon
MKLVRFLMKLNNETVTIELKNGTTVHGTITGVDISMNTHLKTVKLTLKGKNHVTLDHISVRGNNIRYYILPDSLNLETLLIEDTPRVKSKKPTTGKPMGRGRGRGRGRGRGRGR

SEQ ID NO: 7165 - protein, 114 aa, Cannabis sativa
MKLVRFLMKLNNETVSIELKNGTVVHGTITGVDISMNTHLKTVKLTLKGKNPVTLDHLSVRGNNIRYYILPDSLNLETLLVEETPRVKPKKPTAGRAVGRGRGRGRGRGRARGR

SEQ ID NO: 7166 - protein, 114 aa, Allium cepa
MKLVRFLMKLNNETVSIELKNGTVIHGTITGVDISMNTHLKTVKLTLKGKNPVTLDHLSVRGNNIRYYILPDSLNLETLLVEETPRVKPKKATAGKTVGRGRGRGRGRGRGRGR

SEQ ID NO: 7167 - protein, 114 aa, Persea americana
MKLVRFLMKLNNETVSIELKNGTVVHGTITGVDISMNTHLKTVKLTLKGKNPVTLDHLSVRGNNIRYYILPDSLNLETLLVEEAPRVKPKKPTAGRSLGRGRGRGRGRGRGRGR

SEQ ID NO: 7168 - protein, 114 aa, Phaseolus coccineus
  misc_feature (103)..(103): Xaa can be any naturally occurring amino acid
MKLVRFLMKLNNETVSIELKNGTVVHGTITGVDISMNTHLKTVKLTLKGKNPVTLDHLSVRGNNIRYYILPDSLNLETLLVEEAPRIKPKKPTAGKPLGRGRXRGRGRGRGRGR

SEQ ID NO: 7169 - protein, 114 aa, Manihot esculenta
MKLVRFLMKLNNETVSIELKNGTVVHGTITGVDISMNTHLKTVKLTLKGKNPVNLDHLSVRGNNIRYYILPDSLNLETLLVEDTPRVKPKKPTAGRPLGRGRGRGRGRGRGRGR

SEQ ID NO: 7170 - protein, 115 aa, Unknown
  Sequence found in Organisms: Castanea mollissima, Quercus alba
MKLVRFLMKLNNETVSIELKNGTVVHGTITGVDISMNTHLKTVKLTLKGKNPVTLDHLSVRGNNIRYYILPDSLNLETLLVEETPRVKPKKPTAGRPLGRGRGRGRGRGRGRGGR

SEQ ID NO: 7171 - protein, 114 aa, Gossypium hirsutum
MKLVRFLMKLNNETVSIELKNGTVVHGTITGVDISMNTHLKTVKLTLKGKNPVSLDHLSVRGNNIRYYILPDSLNLETLLVEETPRVKPKKATAGRPLGRGRGRGRGRGRGRGR

SEQ ID NO: 7172 - protein, 114 aa, Unknown
  Sequence found in Organisms: Cucumis sativus, Cucumis melo, Citrullus lanatus
MKLVRFLMKLNNETVSIELKNGTVVHGTITGVDISMNTHLKAVKLTLKGKNPVTMDHLSVRGNNIRYYILPDSLNLETLLVEETPRVKPKKPTAGRPLGRGRGRGRGRGRGRGR

SEQ ID NO: 7173 - protein, 114 aa, Solanum melongena
MKLVRFLMKLNNESVSIELKNGTVVHGTITGVDVSMNTHLKAVKITLKGKNPVTLDHLSVRGNNIRYYILPDSLNLETLLVEETPRVKPKKPTAGKPMGRGRGRGRGRGRGRGR

SEQ ID NO: 7174 - protein, 114 aa, Solanum melongena
MKLVRFLMKLNNETVSIELKNGTVVHGTITGVDVSMNTHLKAVKITLKGKNPATLDHLSVRGNNIRYYILPDSLNLETLLVEETPRVKPKKPTAGKPMGRGRGRGRGRGRGRGR

SEQ ID NO: 7175 - protein, 114 aa, Fraxinus spp
MKLVRFLMKLNNETVSIELKNGTVVHGTITGVDVSMNTHLKTVKLTLKGKNPVTLDHLSVRGNTIRYYILPDSLNLETLLVEETPRVKPKKPTAGRPLGRGRGRGRGRGRGRGR

SEQ ID NO: 7176 - protein, 114 aa, Zingiber officinale
MKLVRFLMKLTNETVSIELKNGTVVHGTIIGVDISMNTHLKTVKLTVKGKNPVTLDHLSVRGNNIRYYILPDSLNLETLLVEETPRVKPKKPTAGRALGRGRGRGRGRGRGRGR

SEQ ID NO: 7177 - protein, 114 aa, Vitis vinifera
MKLVRFLMKLNNETVSIELKNGTVVHGTITGVDISMNTHLKTVKLTLKGKNPVTMDHLSVRGNNIRYYILPDSINLETLLVEETPRVKPKKPTAGRTMGRGRGRGRGRGRGRGR

SEQ ID NO: 7178 - protein, 114 aa, Nicotiana benthamiana
MKLVRFLMKLNNETVSIELKNGTVVHGTITGVDVSMNTHLKAVKITLKGKNPVTLDHLSVRGNNIRYYILPDSLNLETLLVEETPRVKPKKPTAGKPLGRGRGRGRGRGRGRGR

SEQ ID NO: 7179 - protein, 114 aa, Petunia hybrida
MKLVRFLMKLNNETVSIELKNGTVVHGTITGVDVSMNTHLKAVKLTLKGKNPVTLDHPSVRGNNIRYYILPDSLNLETLLVEETPRVKPKKPTAGKPLGRGRGRGRGRGRGRGR

SEQ ID NO: 7180 - protein, 114 aa, Petunia hybrida
MKLVRLLMKLNNETVSIELKNGTVVHGTITGVDVSMNTHLKAVKLTLKGKNPVTLDHLSVRGNNIRYYILPDSLNLETLLVEETPRVKPKKPTAGKPLGRGRGRGRGRGRGRGR

SEQ ID NO: 7181 - protein, 115 aa, Phalaenopsis aphrodite
MKLVRFLMKLNNETVSIELKNGTVVHGTITGVDISMNTHLKTVKLTLRGKNPVTLDHLSVRGNNIRYVILPDSLNLETLLVEETPRVKPKKPTAGRPMGRGRGRGRGRGGRGRGR

SEQ ID NO: 7182 - protein, 114 aa, Cajanus cajan
MKLVRFLMKLNNETVSIELKNGTIVHGTITGVDISMNTHLKAVKLTLKGKNPVTLDHLSVRGNNIRYYILPDSLNLETLLVEETPRIKPKKPTDGKPLGRGRGRGRGRGRGRGR

SEQ ID NO: 7183 - protein, 109 aa, Pseudoroegneria spicata
FLMKLNNETVTIELKNGTTVHGTIIGVDISMNTHLKTVKLTLKGKNPVTLDHLSVRGNSIRYYMLPDSLNLETLLVEETPRVKPKKPTAGKPMGRGRGRGRGRGRGRGR

SEQ ID NO: 7184 - protein, 113 aa, Secale cereale
KLVRFLMKLNNETVTIELKNGTTVHGTITGVDISMNTHLKTVKLTMKGKNPVTLDHISVRGNNIRYYILPDSLNLETLLVEDTPRVKSKKPTTGKPMGRGRGRGRGRGRGRGR

SEQ ID NO: 7185 - protein, 114 aa, Sarracenia psittacina
MKLVRFLMKLNNETVSIELKNGTVVHGTITGVDISMNTHLKTVKLTLKGKNPVTLDHLSVRGNTIRHYILPDSLNLETLLVEETPRVKPKKPTAGRPLGRGRGRGRGRGRGRGR

SEQ ID NO: 7186 - protein, 115 aa, Sorghum bicolor
MKLVRFLMKLNNETVTIELKNGTVVHGTITGVDISMNTHLKTVKLTLKGKNPVTLDHLSVRGNNIRYYILPDSLNLETLLVEETPKVKPKKPTTGKPLGRGRGRGRGRGRGRGPR

SEQ ID NO: 7187 - protein, 114 aa, Glycine max
MKLVRFLMKLNNETVSIELKNGTVVHGTITGVDISMNTHLKTVKLTLKGKNPVTLDHLSVRGNNIRYYILPDSLNLETLLVEEAPKIKPKKPTAGKPLGRGRGRGRGRGRGRGR

SEQ ID NO: 7188 - protein, 114 aa, Picea glauca
MKLVRFLMKLNNETVSIELKNGTVVHGTITGVDISMNTHLKTVKLTLKGKIPVTLDHLSVRGNNIRYYILPDSLNLETLLVEDTPRIKPKKPTAGKPIGRGRGRGRGRGRGRGR

SEQ ID NO: 7189 - protein, 114 aa, Triphysaria pusilla
MKLVRFLMKLNNESVSIELKNGTVVHGTIIGVDISMNTHLKTVKLTLKGKNPVTMDHLSVRGNNIRYYILPDSLNLETLLVEETPRVKPKKPTAGRAVGRGRGRGRGRGRGRGR

SEQ ID NO: 7190 - protein, 114 aa, Triphysaria pusilla
MKLVRFLMKLNNETVSIELKNGTVVQGTIIGVDISMNTHLKTVKLTLKGKNPVTMDHLSVRGNNIRYYILPDSLNLETLLVEETPRVKPKKPTAGRAVGRGRGRGRGRGRGRGR

SEQ ID NO: 7191 - protein, 114 aa, Tripterygium wilfordii
MKLVRFLMKLNNETVSIELKNGTVVHGTITGVDISMNTHLKSVKLTLKGKNPVTLDHLSVRGNNIRYYILPDSLNLETLLVEETPRVKPKKPTAGRAVGRGRGRGRGRGRGRGR

SEQ ID NO: 7192 - protein, 164 aa, Cucurbita pepo
MKLVRFLMKLNNETVSIELKNGTVVHGTITGVDISMNTHLKAVKLTLKGKNPVTMDHLSVRGNNIRYYILPDSLNLETLLVEETPRVKPKNQLQGSLWGVDEDEAVVVVVVVDARFVAVSNFDLRSVNTCILGKVCEFNDVKMWYSNSLSDLTCLLQCYSVVFL

SEQ ID NO: 7193 - protein, 135 aa, Euonymus alatus
MKLVRFLMKLNNETVSIELKNGTVVHGTITGVDISMNTHLKSVKLTLNGKNPVTLDHLSVRGNNIRYYILPDSLNLETLLVEETPRVKPKKPNCWESYGTWSGSGTRTRTWPWSLDIFLLNFHYVNSLYESCLVA

SEQ ID NO: 7194 - protein, 116 aa, Cajanus cajan
MKLVRFLMKLTNETVSIELKNGTIVHGTITGVDISMNTHLKTVKLTLKGKNPVTLDHLSVRGSNIRYYILPDSLNLETLLVEETPRIKPKKPTAGKPMGRGRGRGRGRGRGRGREH

SEQ ID NO: 7195 - protein, 114 aa, Unknown
  Sequence found in Organisms: Gossypium hirsutum, Gossypium raimondii
MKLVRFLMKLNNETVSIELKNGTVVHGTITGVDVSMNTHLKMVKLTLKGKNPVTLDHLSVRGNNIRYYILPDSLNLETLLVEETPRVKPKKPAAGRPLGRGRGRGRGRGRGRGR

SEQ ID NO: 7196 - protein, 111 aa, Amborella trichopoda
VRFLMKLNNETVSIELKNGTVVHGTITGVDISMNTHLKTVKLTLKGKNPVTLDHLSVRGNNIRYYILPDSLNLETLLVEETPRVKPKKPTAGRPFGRGRGRGRGRGRGRGR

SEQ ID NO: 7197 - protein, 114 aa, Persea americana
MKLVRFLMKLNNETVSIELKNGTVVHGTITGVDISMNTHLKTGKLTLKGKNPVTLDHLSVRGNNIRYYILPDSLNLETLLVEEAPRIKPKKPTAGRPLGRGRGRGRGRGRGRGR

SEQ ID NO: 7198 - protein, 115 aa, Catharanthus roseus
MKLVRFLMKLNNETVSIELKNGTVVHGTITGVDISMNTHLKTVKLTVKGKNPVTLDHLSVRGNNIRYYILPDSLNLETLLVEETPRVKPKKPTTGGRPLGRGRGRGRGRGRGRGR

SEQ ID NO: 7199 - protein, 114 aa, Euonymus alatus
MKLVRFLMKLNNETVSIELKNGTVVHGTITGVDISMNTHLKSVKLTLKGKNPLTLDHLSVRGNNIRYYILPDSLNLETLLVEETPRVKPKKPTAGRAVGRGRGRGRGRGRGRGR

SEQ ID NO: 7200 - protein, 114 aa, Hevea brasiliensis
MKLVRLIMKLNNETVSIELMNGTVVHGTITGVDISMNTHLKTVKLTLKGKNPVTLDHLSVRGNNIRYYILPDSLNLETLLVEETPRVKPKKPTAGRPLGRGRGRGRGRGRGRGR

SEQ ID NO: 7201 - protein, 114 aa, Ipomoea nil
MKLVRFLMKLNNETVSIELKNGTVVHGTITGVDVSMNTHLKTVKLTPKGKNPVTMDHLSVRGNNIRYYILPDSLNLETLLVEETPRVKPKKPTAGRAMGRGRGRGRGRGRGRGR

SEQ ID NO: 7202 - protein, 114 aa, Capsicum annuum
MKLVRFLMKLNNETVSIELKNGTVVHGTITGVDVSMNTHLKAVKITLKGKNPVTLDHLSVRGNNIRYYILPDSLNLETLLVEDTPRVKPKKPTAGKPLGRGRGRGRGRGRGRGR

SEQ ID NO: 7203 - protein, 115 aa, Populus trichocarpa
MKLVRFLMKLNNETVSIELKNGTVVHGTITGVDISMNTHLKTVKLTVKGKNPVTLDHLSVRGNNIRYYILPDSLNLETLLVEETPRVKPKKPTAGRALGGRGRGRGRGRGRGRGR

SEQ ID NO: 7204 - protein, 114 aa, Primula obconica
MKLVRFLMKLNNETVSIELKNGTVVHGTITGVDISMNTHLKTVKLTLKGKNPVSFDHLSVRGTNIRYYILPDSLNLETLLVEETPRVKPKKPAAGKPLGRGRGRGRGRGRGRGR

SEQ ID NO: 7205 - protein, 114 aa, Primula obconica
MKLVRFLMKLNNETVSIELKNGTVVHGTITGVDISMNTHLKTVKLTLKGKNPVSFDHLSVRGTNIRYYILPDSLNLETLLVEEAPRVKPKKPTAGKPLGRGRGRGRGRGRGRGR

SEQ ID NO: 7206 - protein, 115 aa, Glycine max
MKLVRFLMKLNNETVSIELKNGTIVHGTITGVDISMNTHLKTVKLTLKGKNPVTLDHLSVRGNNIRYYILPDSLNLETLLVEETPKIKPKKPTAGKPLGRGRGRGRGRGRGRGGR

SEQ ID NO: 7207 - protein, 114 aa, Tamarix hispida
MKLVRFLMKLNNETVSIELKNGTVVHGTITGVDVSMNTHLKTVKLTPKGKNPVTFDHLSVRGNNIRYYILPDSLNLETLLVEETPRVKPKKPTAGKALGRGRGRGRGRGRGRGR

SEQ ID NO: 7208 - protein, 114 aa, Zamia vazquezii
MKLVRFLMKLNNETVSIELKNGTVVHGTITGVDISMNTHLKTVKLTLKGKNPVTLDHLSVRGNNIRYYILPDSLNLETLLVEDTPRIKPRKATAGKPLGRGRGRGRGRGRGRGR

SEQ ID NO: 7209 - protein, 114 aa, Zostera marina
MKLVRFLMKLNNETVSIELKNGTVVHGTIIGVDNSMNTHLKTVKMTLKGKNPVTLDHLSVRGNNIRYYILPDSLNLETLLVEEKPRIKPSKPTAGKSMGRGRGRGRGRGRGRGR

SEQ ID NO: 7210 - protein, 112 aa, Flaveria ramosissima
MKLVRFLMKLNNETVSIELKNGTVVHGTIIGVDISMNTHLKTVKLTLKGKNPVTLDHLSVRGNNIRYYILPDSLNLETLLVEETPVSNQKTNCRETGGRGRAVDAAWSRSRP

SEQ ID NO: 7211 - protein, 116 aa, Papaver somniferum
MKLVRFLMKLNNETVSIELKNGTVVHGTIIGVDISMNTHLKTVKLTLKGKNPVTLDHLSVRGNNIRYYILPDSLNLETLLVEETPRVKPKKATTGKPVGGRGRGRGRGRGRGRGGR

SEQ ID NO: 7212 - protein, 115 aa, Rosa hybrid cultivar
MKLVRFLMKLNNETVSIELKNGTVVNGTITGVDISMNTHLKTVKLTLRGKNPVTLDHLSVRGNNIRYYILPDSLNLETLLVEETPRVKPKKPTAGRPVGRGRGRGRGRGRGRGGR

SEQ ID NO: 7213 - protein, 115 aa, Lotus japonicus
MKLVRFLMKLNNETVSIELKNGTIVHGTITGVDISMNTHLKAVKLTLKGKNPVTLDHLSVRGTNIRYYILPDSLNLETLLVEEAPRVKPKKPTAGKPLGRGRGRGRGRGRGRGGR

SEQ ID NO: 7214 - protein, 116 aa, Glycine max
MKLVRFLMKLNNETVSIELKNGTIVHGTITGVDISMNTHLKTVKLTLKGKNPVTLDHLSVRGNNIRYYILPDSLNLETLLVEETPKIKPKKPTAGKPLGRGRGRGRGRGRGRGGGR

SEQ ID NO: 7215 - protein, 79 aa, Flaveria ramosissima
MNTHLKTVKLTLKGKNPVTLDHLSVRGNNIRYYILPDSLNLETLLVEETPRVKPKKPTAGRPVGRGRGLDAGVGRGRGR

SEQ ID NO: 7216 - protein, 110 aa, Manihot esculenta
RFLMKLNNETVSIELKNGTVVHGTITGVDISMNTHLKTVKLTLKGKNPVTLDHLSVRGNNIRYYILPDSLNLETLLVEETPRVKPKKPTAGRPLGRGRGRGRGRGRGRGR

SEQ ID NO: 7217 - protein, 114 aa, Cleome spinosa
MKLVRFLMKLNNETVSIELKNGTVVHGTITGVDVSMNTHLKTVKLTLKGKNPVTLDHLSVRGNNIRYYILPDSLNLETLLVEDTPRIKPKKAAAGKPVGRGRGRGRGRGRGRGR

SEQ ID NO: 7218 - protein, 114 aa, Gossypium hirsutum
MKLVRFLMKLNNETVSIELKNGTVVHGTITGVDVSMNTHLKTVKLTLKGKNPVTLDHLSVRGNTIRYYILPDSLNLETLLVEETPRVKPKKPAAGRPLGRGRGRGRGRGRGRGH

SEQ ID NO: 7219 - protein, 114 aa, Cryptomeria japonica
MKLVRFLMKLNNETVNIELKNGTVVHGTITGVDISMNTHLKTVKLTLKGKAPVTLDHLSVRGNNIRYYILPDSLNLEALLVEDTPRIKPKKTTAGKPIGRGRGRGRGRGRGRGR

SEQ ID NO: 7220 - protein, 114 aa, Euonymus alatus
MKLVRFLMKLNNETVSIEFKNGTVVHGTITGVDVSMNTHLKSVKLTLKGKNPVTLDHLSVRGNSIRYYILPDSLNLETLLVEETPRVKPKKPTAGRAMGRGRGRGRGRGRGRGR

SEQ ID NO: 7221 - protein, 114 aa, Unknown
  Sequence found in Organisms: Euphorbia peplus, Euphorbia esula
MKLVRFLMKLNNETVSIELKNGTVVHGTITGVDISMNTHLKAVKLTLKGKNPVTMDLLSVRGNNIRYYILPDSLNLETLLVEETPRVKPKKPTAGRPLGRGRGRGRGRGRGHGR

SEQ ID NO: 7222 - protein, 114 aa, Linum usitatissimum
MKLVRFLMKLNNETVSIELKNGTVVHGTIIGVDISMNTHLKTVKLTLKGKNPVTLDHLSVRGNNIRYYILPDSLNLETLLVEETPKIKPKKAVAGRAVGRGRGRGRGRGRGRGR

SEQ ID NO: 7223 - protein, 114 aa, Gnetum gnemon
MKLVRFLMKLNNETVSIELKNGTVVHGTITGVDISMNTHLKTVKLTLKGKNPITLDHLSVRGNNIRYYILPDSLNLETLLVDDTPKIKPKKPTAGKPLGRGRGRGRGRGRGRGR

SEQ ID NO: 7224 - protein, 114 aa, Capsicum annuum
MKLVRFLMKLNNETVSIELKNGTAVHGTITGVDVSMNTHLKAVKIMLKGKNPVTLDHLSVRGNNIRYYILPDSLNLETLLVEDTPRVKPKKPTAGKPLGRGRGRGRGRGRGRGR

SEQ ID NO: 7225 - protein, 114 aa, Lippia dulcis
MKLVRFLMKLNNETVSIELKNGTVVNGTIIGVDVSMNTHLKTVKLTPKGKNPITLDHLSVRGNTIRYYILPDSLNLETLLVEETPRVKPKKPTAGRPIGRGRGRGRGRGRGRGR

SEQ ID NO: 7226 - protein, 114 aa, Sciadopitys verticillata
MKLVRFLMKLNNETVSIELKNGTIVHGTITGVDISMNTHLKTVKLTLKGKASVALDHLSVRGNNIRYYILPDSLNLETLLVEETPRIKPKKATAGKPLGRGRGRGRGRGRGRGR

SEQ ID NO: 7227 - protein, 114 aa, Sequoia sempervirens
MKLVRFLMKLNNETVNIELKNGTVVHGTITGVDISMNTHLKTVKLTLKGKAPVTLDHLSVRGNNIRYYILPDSLNLEALLVEDTPRIKPKKATAGKPIGRGRGRGRGRGRGRGR

SEQ ID NO: 7228 - protein, 114 aa, Nicotiana tabacum
MKLVRFLMKLNNETVSIELKNGTVVHGTITGVDVSMNTHLKAVKIMLKGKNPVTLGHLSVRGNNIRYYILPDSLNLETLLVEETPRVKPKKPTAGKPLGRGRGRGRGRGRGRGR

SEQ ID NO: 7229 - protein, 114 aa, Utricularia gibba
MKLVRFLMKLTNETVSLELKNGTVVHGTIIGVDVSMNTHLKTVKLTLKGKNPITLDHLSVRGNNIRYYILPDSLNLETLLVEETPRVKPKKPTTGRPVGRGRGRGRGRGRGRGR

SEQ ID NO: 7230 - protein, 114 aa, Valeriana officinalis
MKLVRFLMKLNNETVSIELKNGTVVHGTIIGVDVSMNTHLKTVKMTLKGKNPITLDHLSVRGNNIRYYILPDSINLETLLVEETPRVKPKKPTAGKALARGRGRGRGRGRGRGR

SEQ ID NO: 7231 - protein, 116 aa, Fagopyrum esculentum
MKLVRFLMKLNNETVSIELKNGTIVHGTITGVDISMNTHLKTVKLTLKGKNPVTLDHLSVRGNNIRYYILPDSLNLETLLVEETPRVKPKKPTAGRAVGRGRGRGRGRGRGGRGGR

SEQ ID NO: 7232 - protein, 116 aa, Epimedium sagittatum
MKLVRFLMKLNNETVSIELKNGTIVHGTITGVDISMNTHLKTVKLTLKGKNPVTLDHLSVRGNNIRYYILPDSLNLETLLVEETPRAKPKKAVAGRPVGRGRGRGRGRGRGRGRGR

SEQ ID NO: 7233 - protein, 116 aa, Cajanus cajan
MKLVRFLMKLNNETVSIELKNGTVVHGTITGVDISMNTHLKTVKLTLKGKNAVTLDHLSVRGNNIRCYILPDSLNLETLLVEETPRIKPKKPTAGKPLGRGRGRGRGRGRGRGGGR

SEQ ID NO: 7234 - protein, 116 aa, Eutrema halophilum
MKLVRFLMKLNNETVSIELKNGTIVHGTITGVDVSMNTHLKAVKLTLKGKNPVTLDHLSVRGNNIRYYILPDSLNLETLLVEDTPRIKPKKPTAGKVPPGGRGRGRGRGRGRGRGR

SEQ ID NO: 7235 - protein, 115 aa, Catharanthus roseus
MKLVRFLMKLNNETVSIELKNGSVVHGTITGVDISMNTHLKTVKLTPKGKNPITLDHLSVRGNNIRYYILPDSLNLETLLVEETPRVKPKKPVAGKPIGRGRGRGRGRGRGRGGR

SEQ ID NO: 7236 - protein, 115 aa, Fragaria vesca
MKLVRFLMKLNNETVSIELKNGTVVNGTITGVDISMNTHLKTVKLTLRGKNPVTLDHLSVRGNNIRYYILPDSLNLETLLVEETPRVKPKKPTAGRAVGRGRGRGRGRGRGRGGR

SEQ ID NO: 7237 - protein, 114 aa, Cephalotaxus harringtonia
MKLVRFLMKLNNETVNIELKNGTVVHGTITGVDISMNTHLKTVKLTLKGKAPVTLDHLSVRGNNIRYYILPDSLNLEALLVEDTPRIKPKKATAGKTLGRGRGRGRGRGRGRGR

SEQ ID NO: 7238 - protein, 114 aa, Cephalotaxus harringtonia
MKLVRFLMKLNNETVNIELKNGTIVHGTITGVDISMNTHLKTVKLTLKGKAPVTHDHLSVRGNNIRYYILPDSLNLEALLVEDTPRIKPKKTTAGKPIGRGRGRGRGRGRGRGR

SEQ ID NO: 7239 - protein, 114 aa, Linum usitatissimum
MKLVRFLMKLNNETVSIELKNGTVVHGTIIGVDISMNTHLKTVKMTLKGKNPVTLDHLSVRGNNIRYYILPDSLNLETLLVEETPKIKPKKAVAGRAVGRGRGRGRGRGRGRGR

SEQ ID NO: 7240 - protein, 114 aa, Unknown
  Sequence found in Organisms: Pinus pinaster, Pinus taeda
MKLVRFLMKLNNETVSIELKNGTVVHGTITGVDISMNTHLKTVKLTLKGKSPVTLDHLSVRGNNIRYYILPDSLNLETLLVEDTPKIKPKKPTAGRALGRGRGRGRGRGRGRGR

SEQ ID NO: 7241 - protein, 112 aa, Populus trichocarpa
MKLVRFLMKLNNETVSIELKNGTVVHGTITGVDISMNTHLKTVKLTVKGKNPVTLDHLSVRGNNIRYYILPDSLNLETLLIEETPKVKPKKPTAGRPLGRGRGRGRGRGRGR

SEQ ID NO: 7242 - protein, 114 aa, Silene vulgaris
MKLVRFLMKLNNETVSIELKNGTVVHGTIIGVDISMNTHLKTVKLTPKGKNPITMDHLSVRGNNIRYYILPDSLNLETLLVEETPRIKPKKAVAGRPVGRGRGRGRGRGRGRGR

SEQ ID NO: 7243 - protein, 114 aa, Silene vulgaris
MKLVRFLMKLNNETVSIELKNGTVVHGTITGVDISMNTHLKTVKLTPKGKNPLTMDHLSVRGNNIRYYILPDSLNLETLLVEETPRVKPKKAVAGRPVGRGRGRGRGRGRGRGR

SEQ ID NO: 7244 - protein, 114 aa, Valeriana officinalis
MKLVRFLMKLTSETVSIELKNGTIVHGTITGVDISMNTHLKTVKLTLKGKNPVTLDHLSVRGNNIRYYILPDSINLETLLVEETPRIKPKKPTAGKALARGRGRGRGRGRGRGR

SEQ ID NO: 7245 - protein, 116 aa, Arabidopsis lyrata
MKLVRFLMKLNNETVSIELKNGTIVHGTITGVDVSMNTHLKAVKLTLKGKNPVTLDHLSVRGNNIRYYILPDSLNLETLLVEDTPRIKPKKPTAGKLPPGRGRGRGRGRGRGRGGR

SEQ ID NO: 7246 - protein, 116 aa, Arabidopsis thaliana
MKLVRFLMKLNNETVSIELKNGTIVHGTITGVDVSMNTHLKAVKLTLKGKNPVTLDHLSVRGNNIRYYILPDSLNLETLLVEDTPRIKPKKPTAGKIPAGRGRGRGRGRGRGRGGR

SEQ ID NO: 7247 - protein, 114 aa, Helianthus annuus
MKLVRFLMKLNNEMVSIELKNGTVVHGTITGVDISMNTHLKTVKLTMNGNNPLTLDHLSVRGNNIRYYILPDSLNLETLLVEETPRVKPKKPTAGRAVGRGRGRGRGRGRGRGR

SEQ ID NO: 7248 - protein, 114 aa, Abies balsamea
MKLVRFLMKLNNETVSIELKNGTVVHGTITGVDISMNTHLKTVKLTLKGKSPVTLDHLSVRGNNIRYYILPDSLNLETLLVEDTPKIKPKRPTAGRALGRGRGRGRGRGRGRGR

SEQ ID NO: 7249 - protein, 114 aa, Arabidopsis thaliana
MKLVRFLMKLNNETVSIELKNGTVVHGTITGVDVSMNTHLKTVKMSLKGKNPVTLDHLSLRGNNIRYYILPDSLNLETLLVEDTPRVKPKKPVAGKAVGRGRGRGRGRGRGRGR

SEQ ID NO: 7250 - protein, 114 aa, Marchantia polymorpha
MKLVRFLMKLNNETVTIELKNGTIVHGTITGVDISMNTHLKTVKLTLRGKNPVPLDHLSIRGNNIRYYILPDSLNLDTLLVDDTPRVKAKKPSAGKPVGRGRGRGRGRGRGRGR

SEQ ID NO: 7251 - protein, 114 aa, Pseudotsuga menziesii
MKLVRFLMKLNNETVSIELKNGTIVHGTITGVDISMNTHLKTVKLTLKGKSPVTLDHLSVRGNNIRYYILPDSLNLETLLVEDTPKIKPKRPTAGRALGRGRGRGRGRGRGRGR

SEQ ID NO: 7252 - protein, 114 aa, Picea glauca
MKLVRFLMKLNNETVNIELKNGTVVHGTITGVDISMNTHLKTVKLTLKGKSPVTLDHLSVRGNNIRYYILPDSLNLETLLVEDTPKIKPKRPTAGRALGRGRGRGRGRGRGRGR

SEQ ID NO: 7253 - protein, 114 aa, Helianthus annuus
MKLVRFLMKLNNETVSIELKNGTVVHGTITGVDISMNTHLKTVKLTMKGKNPLTLDHLSVRGNNIRDERLPDSLNLETLLVEETPRVKPKKPTAGRAVGRGRGRGRGRGRGRGR

SEQ ID NO: 7254 - protein, 110 aa, Citrullus lanatus
RFLMKLNNETVSIELKNGTVVHGTITGVDISMNTHLKAVKLTLKGKNPVTMDHLSVRGNNIRYYILPDSLNLETLLVEETPRVKPKKPTAGMPLGRGRGRGRGRGRGRGR

SEQ ID NO: 7255 - protein, 107 aa, Antirrhinum majus
MKLNNETVSIELKNGTVVHGTITGVDISMNTHLKTVKLTLKGKNPVTMDHLSVRGNNIRYYILPDSLNLETLLVEETPRVKPKKPTAGKPLGRGRGRGRGRGRGRGR

SEQ ID NO: 7256 - protein, 114 aa, Arabidopsis lyrata
MKLVRFLMKLNNETVSIELKNGTVVHGTITGVDVSMNTHLKTVKMSLKGKNPVTIDHLSLRGNNIRYYILPDSLNLETLLVEDTPRVKPKKPVAGKAVGRGRGRGRGRGRGRGR

SEQ ID NO: 7257 - protein, 114 aa, Cedrus atlantica
MKLVRFLMKLNNETVSIELKNGTVVHGTITGVDISMNTHLKTVKLTLKGKSPITLDHLSVRGNNIRYYILPDSLNLETLLVEDTPKIKPKRPTAGRALGRGRGRGRGRGRGRGR

SEQ ID NO: 7258 - protein, 114 aa, Ceratodon purpureus
MKLVRFLMKLNNETVSIELKNGTIVHGTITGVDISMNTHLKTVKLTLKGKVPVALDHLSIRGNNIRYYILPDSLNLDTLLVDDTPRVKAKKPVAGKPVGRGRGRGRGRGRGRGR

SEQ ID NO: 7259 - protein, 107 aa, Cucurbita pepo
MKLNNETVSIELKNGTVVHGTITGVDISMNTHLKAVKLTLKGKNPVTMDHLSVRGNNIRYYILPDSLNLETLLVEETPRVKPKKPTAGKPMGRGRGRGRGRGRGRGR

SEQ ID NO: 7260 - protein, 107 aa, Heritiera littoralis
MKLNNETVSIELKNGTVVHGTITGVDISMNTHLKTVKLTLKGKNPVSLDHLSVRGNNIRYYILPDSLNLETLLVEETPRVKPKKPTAGKPLGRGRGRGRGRGRGRGR

SEQ ID NO: 7261 - protein, 114 aa, Mimulus guttatus
MKLVRFLMKLNNESVSIELKNGTVVFGTIIGVDISMNTHLKAVKLTLKGKNPVTMDHLSVRGNNIRYYILPDSLNLETLLVEETPKIKPKKPIAGRAVGRGRGRGRGRGRGRGR

SEQ ID NO: 7262 - protein, 110 aa, Tropaeolum majus
RFLMKLNNETVSIELKNGTIVHGTITGVDISMNTHLKTVKLTLKGKNPVTLDHLSVRGNNIRYYILPDSLNLETLLVEDTPRVKPKKATAGRAIGRGRGRGRGRGRGRGR

SEQ ID NO: 7263 - protein, 114 aa, Physcomitrella patens
MKLVRFLMKLNNETVSIELKNGTIVHGTITGVDISMNTHLKSVKLTLKGKVPVALDHLSVRGNNIRYYILPDSLNLDTLLVDDTPRVKVKKPVAGKPVGRGRGRGRGRGRGRGR

SEQ ID NO: 7264 - protein, 110 aa, Utricularia gibba
RFLMKLTNETVSLELKNGTVVHGTIIGVDVSMNTHLKTVKLTLKGKNPITLDHLSVRGNNIRYYILPDSLNLETLLVEETPRVKPKKPTAGRPVGRGRGRGRGRGRGRGR

SEQ ID NO: 7265 - protein, 117 aa, Triticum aestivum
  misc_feature (101)..(101): Xaa can be any naturally occurring amino acid
  misc_feature (109)..(109): Xaa can be any naturally occurring amino acid
MKLVRFLMKLNNETVTIELKNGTVVHGTITGVDISMNTHLKTVKLTLKGKNPVTLDHLSVRGNNIRYYILPDSLNLGDFAGLRKHQGSSLRSLLLGTLGRXAWPWPWAXSGSGTLAC

SEQ ID NO: 7266 - protein, 115 aa, Brassica juncea
MKLVRFLMKLNNETVSVELKNGTIVHGTITGVDVSMNTHLKAVKLTLKGKNPVALDHLSVRGNNIRYYILPDSLNLETLLVEDTPRIKPKKPTAGKIPPGGRGRGRGRGRGRGGR

SEQ ID NO: 7267 - protein, 115 aa, Beta vulgaris
MKLVRFLMKLNNETVSIELKNGTVVHGTITGVDISMNTHLKTVKLTPKGKNPLTMDHLSVRGNNIRYYILPDSLNLETLLVEEAPRVKPKKAAAGRPVGRGRGRGRGRGRGRGGR

SEQ ID NO: 7268 - protein, 115 aa, Thellungiella halophila
MKLVRFLMKLNNETVSIELKNGTVVHGTITGVDVSMNTHLKTVKMTLKGKNPVTLDHLSLRGNDIRYYILPDSLNLETLLVEDTPRVKPKKAAATGKSVGRGRGRGRGRGRGRGR

SEQ ID NO: 7269 - protein, 114 aa, Ceratodon purpureus
MKLVRFLMKLNNETVSIELKNGTIVHGTITGVDISMNTHLKTVKLTLKGKVPVALDHLSIRGNNIRYYILPDSLNLDTLLVDDAPRVKAKKPVAGKPVGRGRGRGRGRGRGRGR

SEQ ID NO: 7270 - protein, 106 aa, Cucurbita pepo
KLNNETVSIELKNGTVVHGTITGVDISMNTHLKAVKLTLKGKNPVTMDHLSVRGNNIRYYILPDSLNLETLLVEETPRVKPKKPTAGKPMGRGRGRGRGRGRGRGR

SEQ ID NO: 7271 - protein, 114 aa, Mimulus guttatus
MKLVRFLMKLNNETVSIEIKNGTVVNGTIIGVDVSMNTHLKSVKLTPKGKNPISLDHLSIRGNTIRYYILPDSLNLETLLVEETPRVKPKKPIAGKPLGRGRGRGRGRGRGRGR

SEQ ID NO: 7272 - protein, 114 aa, Physcomitrella patens
MKLVRFLMKLNNETVSIELKNGTIVHGTITGVDISMNTHLKSVKLTLKGKVPVSLDHLSIRGNNIRYYILPDSLNLDTLLVDDTPRVKAKKPVAGKPVGRGRGRGRGRGRGRGR

SEQ ID NO: 7273 - protein, 107 aa, Primula obconica
MKLNNETVSIELKNGTVVHGTITGVDISMNTHLKTVKLTVKGKNPVTLDHLSVRGTNIRYYILPDSLNLETLLVEETPRVKPKKPTAGKPLGRGRGRGRGRGRGRGR

SEQ ID NO: 7274 - protein, 114 aa, Pteridium aquilinum
MRLVRFLMKLNNETVSIELKNGTIVHGTITGVDISMNTHLKTVKLTLRGKNPVTLDHLSVRGNNIRYYILPDSLNLDTLLVDDTPKARPKRPTAGKPLGRGRGRGRGRGRGRGR

SEQ ID NO: 7275 - protein, 114 aa, Selaginella moellendorffii
MKLVRFLMKLNNETVSIELKNGTIVNGTITGVDISMNTHLKAVKLVLKGKNPVTMDHLSIRGNNIRYYILPDSLNLETLLVDDTPRVKQKKPAAGKPAGRGRGRGRGRGRGRGR

SEQ ID NO: 7276 - protein, 119 aa, Aquilegia formosa
ITYFVGLKNRFLMKLNNETVSIELKNGTVVHGTITGVDISMNTHLKTVKLTLKGKNPVTLDHLSVRGNNIRYYILPDSINLETLLVEETPRVKPKKPTAGRPMGRGRGRGRGRGRGRGR

SEQ ID NO: 7277 - protein, 118 aa, Unknown
  Sequence found in Organisms: Brassica napus, Brassica juncea, Brassica oleracea, Raphanus sativus
MKLVRFLMKLNNETVSIELKNGTVVHGTITGVDVSMNTHLKTVKMTLKGKNPVTMDHLSLRGNNIRYYILPDSLNLETLLVEDTPRVKPKKPVAGKPVGRGRGRGGRGRGGAGRGRGR

SEQ ID NO: 7278 - protein, 106 aa, Chelidonium majus
LNNETVSIELKNGTVVHGTIIGVDISMNTHLKTVKLTLKGKNPVTLDHLSVRGNNIRYYILPDSLNLETLLVEEAPRVKPKKPTAGRPMAGRGRGRGRGRGRGRGR

SEQ ID NO: 7279 - protein, 114 aa, Adiantum capillus-veneris
MRLVRFLMKLNNETVSIELKNGTIVHGTITGVDVSMNTHLKTVKLTLRGKNPVALDHLSVRGNNIRYYILPDSLNLDTLLVDDTPKVRPKKPTPGKLMGRGRGRGRGRGRGRGR

SEQ ID NO: 7280 - protein, 113 aa, Panax ginseng
SLVSPFKKLNNETVSIELPNGTVVHGTITGVDISMNTHLKTVKLTLKGKNPVTLDHLSVRGNNIRYYILPDSINLETLLVEETPRVKPKKPTAGRAIGRGRGRGRGRGRGRGR

SEQ ID NO: 7281 - protein, 114 aa, Physcomitrella patens
MKLVRFLMKLNNETVSIELKNGTIVHGTITGVDISMNTHMKSVKLTLKGKVPVALDHLSIRGNNIRYYILPDSLNLDTLLVDDTPRVKSKKPVAGKPVGRGRGRGRGRGRGRGR

SEQ ID NO: 7282 - protein, 119 aa, Musa acuminata
ASACENSSSRFLMKLNNETVSIELKNGTVVHGTITGVDISMNTHLKTVKLTVKGKNPVTLDHLSVRGNNIRYYILPDSLNLETLLVEETPRVKPKKPTAGRPVGRGRGRGRGRGRGRGR

SEQ ID NO: 7283 - protein, 118 aa, Brassica rapa
MKLVRFLMKLNNETVSIELKNGTVVHGTITGVDVSMNTHLKTVKMTLKGKNPVTMDHLSLRGNNIRYYILPDSLTLETLLVEDTPRVKPKKPVAGKPVGRGRGRGGRGRGGAGRGRGR

SEQ ID NO: 7284 - protein, 118 aa, Unknown
  Sequence found in Organisms: Brassica napus, Brassica juncea, Raphanus sativus
MKLVRFLMKLNNETVSIELKNGTVVHGTITGVDVSMNTHLKTVKMTLKGKNPVTMDHLSLRGNNIRYYILPDSLNLETLLVEDTPRLKPKKPVAGKPVGRGRGRGGRGRGGAGRGRGR

SEQ ID NO: 7285 - protein, 151 aa, Brassica rapa
MTDDKTRAKAMKTAAQFKGVSAVEIKGDHRNQIEVTGVEVNMICLTNTLRKKVAFAELVSVNKVEPPKKEDDKKKECKKPDEKKPDEKKADEKKTDEKKPEPCCCNPCYQPWPYGYGVPSSFPHPCDPYGYNFRDYTGEPFYNYGPNWRFM

SEQ ID NO: 7286 - protein, 117 aa, Brassica juncea
MKLVRFLMKLNNETVSIELKNGTVVHGTITGVDVSMNTHLKTVKMTLKGKNPVTMDHLSLRGNNIRYYILPDSLNLETLLVEDTPRVKPKKPVAGKPVGRGRGRGGRGRGGGAGRGR

SEQ ID NO: 7287 - protein, 114 aa, Antirrhinum majus
  misc_feature (1)..(1): Xaa can be any naturally occurring amino acid
  misc_feature (82)..(85): Xaa can be any naturally occurring amino acid
  misc_feature (87)..(87): Xaa can be any naturally occurring amino acid
  misc_feature (103)..(103): Xaa can be any naturally occurring amino acid
XKSCKILDEIEQRDCFYRTQDGTVVHGTIIGVDVSMNTHLKTVKLTPKGKNPITLDHLSVRGNNIRYYILPDSLNLETLLVXXXXRXKPKKPTAGKPLGRGRXRGRGRGRGRGR

SEQ ID NO: 7288 - protein, 70 aa, Eutrema halophilum
MSLKGKNPVTLDHLSLRGNNIRYYILPDSLNLETLLVEDTPRVKPKKPVAGKPVGRGRGRGRGRGRGRGR

SEQ ID NO: 7289 - protein, 106 aa, Sesamum indicum
KLNNETVSIELKNGTVVHGTITGVDISMNTHLKTVKLILKGKNPVTMDHLSVRGNNIRYYILPDSLNLETLLVEETPRVKPKKPTAGRPLGRGRGRGRGRGRGRGR

SEQ ID NO: 7290 - protein, 114 aa, Pteridium aquilinum
MRLVRFLMKLNNETVSIELKNGTIVHGTITGVDISMNTHLKTVKLTLRGKNPVSLDHLSVRGNSIRYYILPDSLNLDTLLVDDTPKVRPKRPTPGKIMGRGRGRGRGRGRGRGR

SEQ ID NO: 7291 - protein, 118 aa, Brassica rapa
MKLVRFLMKLNNETVSIELKNGTVVHGTITGVDVSMNTHLKTVKMTLKGKNPVTMDHLSLRGNTIRYYILPDSLNLETLLVEDTPRLKPKKPVAGKPVGRGRGRGGRGRGGAGRGRGR

SEQ ID NO: 7292 - protein, 106 aa, Vinca minor
LNNETVSIELKNGSVVHGTITGVDISMNTHLKTVKLTVKGKNPVTLDHLSVRGNNIRYYILPDSLNLETLLVEETPRVKPKKPTAGKPVGRGRGRGRGRGGRGRGR

SEQ ID NO: 7293 - protein, 121 aa, Cajanus cajan
NPSFYEIWNRFLMKLTNETVSIELKNGTIVHGTITGVDISMNTHLKTVKLTLKGKNPVTLDHLSVRGSNIRYYILPDSLNLETLLVEETPRIKPKKPTAGKPMGRGRGRGRGRGRGRGREH

SEQ ID NO: 7294 - protein, 118 aa, Brassica napus
MKLVRFLMKLNNETVSIELRNGTVVHGTITGVDVSMNTHLKTVKMSLKGKNPVTMDHLSLRGNNIRYYILPDSLNLETLLVEDTPRLKPKKPVAGKPVGRGRGRGGRGRGGARGGRGR

SEQ ID NO: 7295 - protein, 116 aa, Arabidopsis lyrata
WVSLRFLMKLNNETVSIELKNGTIVHGTITGVDVSMNTHLKAVKLTLKGKNPVTLDHLSVRGNNIRYYILPDSLNLETLLVEDTPRIKPKKPTAGKTPARGRGRGRGRGRSRVGGR

SEQ ID NO: 7296 - protein, 113 aa, Brassica rapa
MKLVRFLMKLNNETVSIELKNGTVVHGTITGVDVSINTHLKTVKMSLKGKNPVTMDHLSLRGNNIRYFILPDSLNLETLLVEDTPRLKPKKPVAGKPVGRGRGRGGARGGRGR

SEQ ID NO: 7297 - protein, 110 aa, Taraxacum officinale
MKLVRFLMKLNNETVSIELKNGTVVHGTITGVDISMNTHLKTVKSTLKGKNPVTLDHLSVRGNNIRYYILPDSLNLETLLVEETPRVKPKKPTAGRPVGLLVSLEMVNFG

SEQ ID NO: 7298 - protein, 91 aa, Fraxinus spp
NNETVSIELKNGTVVHGTITGVDVSMNTHLKTVKLTLKGKNPVTLDHLSVRGNTIRYCILPDSLNLETLLVEETPRVKPKKPTAGRPLGTR

SEQ ID NO: 7299 - protein, 105 aa, Amsonia hubrichtii
LNNETVSIELKNGSVVNGTITGVDISMNTHLKTVKLTPKGKNPITLDHLSVRGNNIRYYILPDSLNLETLLVEETPRVKPKKPVAGKPIGRGRGRGRGRGRGRGR

SEQ ID NO: 7300 - protein, 113 aa, Cycas rumphii
GSKEFGRGLNNETVSIELKNGTVVHGTITGVDISMNTHLKTVKLTLKGKSPVTLDHLSVRGNNIRYYILPDSLNLETLLVEDTPRIKPRKATAGKPLGRGRRRGRGRGRGRGR

SEQ ID NO: 7301 - protein, 120 aa, Mimulus guttatus
FVMKLHLIFFRFLMKLINESVSIELKNGTVVQGTIIGVDISMNTHLKAVKLTLKGKNPVSMDHLSVRGNNIRYYILPDSLNLETLLVEETPRVKPKKPIAGRALGRGRGRGRGRGRGRGR

SEQ ID NO: 7302 - protein, 118 aa, Brassica oleracea
MKLVRFLMKLNNETVSNELKNGTVVHGTITGVDVSMNTHLKTVKMSLKGKNPVTMDHLSLRGNNIRYYILPDSLNLETLLVEDTPRLKPKKPVAGKPVGRGRGRGGCGRGGARGGRGR

SEQ ID NO: 7303 - protein, 115 aa, Eutrema parvulum
ICIGSSRFLMKLNNETVSVELKNGTVVHGTITGVDVSMNTHMKTVKMSLKGKNPVTLDHLSLRGNNIRYYILPDSLNLETLLVEDTPRVKPKKPVAGKPVGGRGRGRGRGRGRGR

SEQ ID NO: 7304 - protein, 107 aa, Helianthus annuus
MKLKSETASIQLHNSTGAQGTIPGVDITMNTPLKTVKLTLQGKNPVTLDHQRVRGNHPRYYILPDSLNLETLLVEETPRVKPKKPTAGKPVGRGRGRGRGRGRGRGR

SEQ ID NO: 7305 - protein, 125 aa, Podocarpus macrophillus
MAFWKSLLTFLLFFCRFLMKLNNETVSIELKNGTIVHGTITGVDISMNTHLKTVKMTLKGKPPVAVDHLSLRGNNIRYYILPDSLNLETLLVEDTPKIKAKKATAGKPLARGRGRGRGRGRGRGR

SEQ ID NO: 7306 - protein, 106 aa, Plantago ovata
MKLVRFLMKLNNETVSIELKNGTVVHGTITGVDVSMNTHLKTVKLTPKGKNPLTLDHLSVRGNTIRYYILPDSLNLETLLIEETPRVKPRKPTTGKPLGRGRGRGR

SEQ ID NO: 7307 - protein, 101 aa, Thalictrum flavum
TVSIELKNGTVIHGTITGVDISMNTHLKTVKLTLKGKNPVTLDHLSVRGNNIRYYILPDSINLETLLVEETPRVKPKKPTAGRPVGRGRGRGRGRGRGRGR

SEQ ID NO: 7308 - protein, 120 aa, Eutrema halophilum
LTLLCFGRIRFLMKLNNETVSIELKNGTVVHGTITGVDVSMNTHLKTVKMTLKGKNPVTLDHLSLRGNNIRYYILPDSLNLETLLVEDTPRVKPKKAAATGKSVGRGRGRGRGRGRGRGR

SEQ ID NO: 7309 - protein, 122 aa, Eutrema parvulum
FDFVSGFFCRFLMKLNNETVSIELKNGTIVHGTITGVDVSMNTHLKAVKLTLKGKNPVTLDHLSVRGNNIRYYILPDSLNLETLLVEDTPRIKPKKPTAGKIPPGGRGRGRGRGRGRARGGR

SEQ ID NO: 7310 - protein, 121 aa, Eutrema parvulum
LIFLCFGRIRFLMKLNNETVSIELKNGTVVHGTITGVDVSMNTHLKTVKLTLKGKNPVTLDHLSLRGNNIRYYILPDSLNLETLLVEDTPRVKPKKAAAAGKAVGRGRGRGRGRGRGRGGR

SEQ ID NO: 7311 - protein, 120 aa, Brassica rapa
FRMGILIIRRFLMKLNNETVSVELKNGTIVHGTITGVDVSMNTHLKAVKLTLKGKNPVALDHLSVRGNNIRYYILPDSLNLETLLVEDTPRIKPKKPTAGKVPPGGRGRGRGRGRGRGGR

SEQ ID NO: 7312 - protein, 60 aa, Physcomitrella patens
FWDLWVVGGSRFLMKLNNETVSMELKNGTIVHGTITGVDISMNTHLKSVKLTLKGKVPVS

SEQ ID NO: 7313 - protein, 119 aa, Raphanus sativus
MKLVRFLMKLNNETVSVELKNGTIVHGTITGVDVSMNTHLKAVKLTLKGKNPVALDHLSVRGNNIRYYILPDSLNLETLLVEDTPRIKPKKPTAGKIPPGGRGRGRGRSWTWWSLNIMQ

SEQ ID NO: 7314 - protein, 114 aa, Lactuca sativa
MNLVTFLMKLNNQTVSIHLKNGTPVHGTITGVDINMNTHLNTVNLTLKGKNPVSLDHLSVRGNNIHYYILPDSLNLETLLMEETPRVKPKKPTARRTVGHGTGRGRGRGHKHGR

SEQ ID NO: 7315 - protein, 123 aa, Cenchrus ciliaris
MAPIPGVDISMNIHLKTVKFPLKGKNLVTLAPFSVRGNNIRYYILPDSLNLETLLVEETPRVKPKKPTSGKPLGRGRAPWSWARSGSGTLSLLPIWKLHCTHLCNVICFPICLQGVLLLRQWR

SEQ ID NO: 7316 - protein, 189 aa, Avena sativa
MAAISAAISGCCSSSCLPQSQRGLLPSTRRRHFKVTAMAPKNKVNKYDEGWSKQWFGAGIFAEGSEEASVDVFKKLEKRKVLSTVEKAGLLSKAEELGVTLSSLEKLGLLSKAEDLGLLSLVESAATVSPAVLASLSLPLLVASIATVVFVPDDTTLLVTLQTVVATLFAAVAAGLFVGSVVLDGLQED

SEQ ID NO: 7317 - protein, 189 aa, Hordeum vulgare
MAAISAAISGCCSSSCLPQSQRGLPSSARRRHFKVTAMAPKNKVNKYDDGWSKQWFGAGIFAEGSEEASVDVFKKLEKRKVLSTVEKAGLLSKAEELGVTLSSLEKLGLLSKAEDLGLLSLVESAATVSPAVLASLSLPLLVASIATVVFVPDDSTLLVTVQTVVATLFAAVSAGLFVGSVVLDGLQDD

SEQ ID NO: 7318 - protein, 189 aa, Leymus cinereus x Leymus triticoides
MAAISAAISGCCSSSCLSQSQRGLPSSARRRHFKVTAMAPKNKVNKYDDGWSKQWFGAGIFAEGSEEASVDVFKKLEKRKVLSTVEKAGLLSKAEELGVTLSSLEKLGLLSKAEDLGLLSLVESAATVSPAVLASLSLPLLVASIATVVFVPDDSTLLVALQTIVATLFAAVAAGLFVGSVVLDGLQDD

SEQ ID NO: 7319 - protein, 202 aa, Secale cereale
  misc_feature (137)..(137): Xaa can be any naturally occurring amino acid
MAAISAAISGCCSSSCLSQSQRGLPSSASRRHFKVTAMAPKNKVNKYDDGWSKQWFGAGIFAEGSEEASVDVFKKLEKRKVLSSVEKAGLLSKADELGVTLSSLEKLGLLSKAEDLGLLSLVESAATVSPAVLASLXAAAARRLHCHGRLRAGRLHPARDSPDGRRYVVRGRRCRAVRRFRRARRTAGRLAPSLCSWSMFVL

SEQ ID NO: 7320 - protein, 189 aa, Triticum aestivum
MAAISAAISGCCSSSCLSQSQRGLPSPARRRHFKVTAMAPKNKVNKYDDGWSKQWFGAGIFAEGSEEASVDVFKKLEKRKVLSSVEKAGLLSKAEELGVTLSSLEKLGLLSKAEDLGLLSLVESAATVSPAVLASLSLPLVVASIATVVFVPDDSTLLVTVQTVVATLFAAVAAGLFVGSVVLDGLQDD

SEQ ID NO: 7321 - protein, 189 aa, Triticum aestivum
MAAISAAISGWCSSSCLSQSQRGLPSPARRRHFKVTAMAPKNKVNKYDDGWSKQWFGAGIFAEGSEEASVDVFKKLEKRKVLSSVEKAGLLSKAEELGVTLSSLEKLGLLSKAEDLGLLSLVESAATVSPAVLASLSLPLLVASIATVVFVPDDSTLLVTVQTVVATLFAAVAAGLFVGSVVLDGLQDD

SEQ ID NO: 7322 - protein, 189 aa, Setaria italica
MAAIPAAISGCCSSSRLSQPAGLLPSSSRRRFKVTAMAPKKKVNRYDENWSKQWFGAGIFAEGSEEVSVDVFKKLERRKVLSTVEKAGLLSKAEELGVTLSSLEQLGLLSKAEDLGLLSLVETAAGTSPSVLASISLPLLVAAVAEVVVVPDDSVALVAVQAVVAAVLAAGAAGLFVGSVVLAGLQESD

SEQ ID NO: 7323 - protein, 190 aa, Sorghum bicolor
MAAIPAVISGCCSSSRLSQPAGLLPSTSSRRRFKVTAMAPKKKVNRYDENWSKQWFGAGLFAEGSEEVTVDVFKKLERRKVLSTVEKAGLLSKAEELGVTLSSLEQLGLLSKAEDLGLLSLVETAAGTSPSVLASVSLPLLVAAVVAVVVVPDDSAALVALQAVVATVLAAGAAGLFVGSVVLAGLQESD

SEQ ID NO: 7324 - protein, 193 aa, Setaria italica
MAAIPAAISGCCSSSRLSQPAGLLPSSSRRRFKVTAMAPKKKVNWSVRRELVEAVVRRGHLRGGERGGVGGRVQEAGAAQGAEHGGEGRPAVQGRGAGRHALLAGAAGPALQGRGPGPAQPRRDRGGHVPLRARVHLAAASRRRRRRGGRRARRLRRARRRPGRRRRRARGRGRRAVRGVRRARRPAGVGLIS

SEQ ID NO: 7325 - protein, 189 aa, Sorghum bicolor
MAAIPAVISGCCSSSRLSQPAGLLPSTSSRRRFKVTAMAPKKKVRYDENWSKQWFGAGLFAEGSEEVTVDVFKKLERRKVLSTVEKAGLLSKAEELGVTLSSLEQLGLLSKAEDLGLLSLVETAAGTSPSVLASVSLPLLVAAVVAVVVVPDDSAALVALQAVVATVLAAGAAGLFVGSVVLAGLQESD

SEQ ID NO: 7326 - protein, 189 aa, Zea mays
MAAIPAAIPGCCSSSRLPQLAGLPASTSRRRFKVTAMAPKKKVNRYDESWSKQWFGAGIFAEGSEEVSVDVFKKLERRKVLSTVEKAGLLSKAEELGLTLSSLEKLGLLSKAEDLGLLSLVETAAGTSPSVLASISLPLLVAAVAAVVVVPDDSVALVALQAVVAAVLAAGAAGLFVGSVVLAGLQESD

SEQ ID NO: 7327 - protein, 194 aa, Saccharum officinarum
RLRYPSRPTRPAISGCCSSSRLSQPAGLLPSTSRRRFKVTAMAPKKKVNRYDENWSKQWFGAGIFAEGSEEVSVDVFKKLERRKVLSTVEKAGLLSKAEELGVTLSSLEQLGLLSKAEDLGLLSLVETAAGTSPSVLASISLPLLVAAVVEVVVVPDDSVALVAVQAVVAAVLAAGAAGLFVGSVVLAGLQESD

SEQ ID NO: 7328 - protein, 643 aa, Brachypodium distachyon
MASTSSCSSRPPLLHPASRTPNPSRLPPLVSRASSSPRPLLLSFAPPARGRFRAAAVQQSDFEDGEEEWDGEVEEEYYREEEEVEEGEEMDVEAMEEEARAAAADLAARLDRELRVDGDVREKRRTMRDKTSTSKHIPDNNLPKVAIIGRPNVGKSALFNRLVGSNRAIVVDEPGVTRDRLYGRSYWGDQEFMVIDTGGVITLSKSQAGVMEELAITTTVGMDGIPLASREAAIARMPSMIEKQAVAAVEEATVLLFLVDGQAGLVAADIEIADWLRRNFSHKCIILAVNKCESPKKGQMQALEFWSLGFTPVSISAITGTGTGELLDMVCSELKNFEGLEGLDDVEEDENRVPAISIVGRPNVGKSSILNALVGEDRTIVSPVSGTTRDAIDTEFTTEDGQKFKLIDTAGIRRRAAVASAGSTTETLSVKRAFSAIRRSDVVALVVEAMACVTEQDYKIAERIEKEGKACVIVVNKWDTIPNKNNESTTHYELDVREKLRVLDWAPIVYCSAINGNSVEKIISAASLVEKERSRRLGTSILNQVVREAVAFKAPPRTRGGKRGRVYYTTQAAVRPPTFVLFVNDAKLFPEPYRRYMHKQLRSDAGFPGTPIRLLWRSRKRADKQRRKSNNTEARGSLVGASS

SEQ ID NO: 7329 - protein, 988 aa, Triticum aestivum
MHRESPEVLHTQVKSNVNKALGTTTQSVHDSNDACCATHENSFSELSISEGMTINELECRASISCIYPVNKTTQAVSVTNPGAMLHTLVDVSRQEEVGCSTSAEKRNSTENVMDVLATPYSGPPGQHKSKYVSNRIGWQGGLSYQFLSLSELQKDAQNGNGLGDSQTNSNNAHLLRCHQSNDDENIDLTSFSSFKRTVECPLNFVPQVSIGNLFRPRKAIEFADSYVGGSHLTPGKLALFACLREGPASKQQKAVKDHDDAKTIGWSISDILNKENLDKFIPATTAGLNGTVDTSDYMRRYKSSLTDGRLKDCVDLLESMEQKGLLDTKKIHHASFLSACKKQRAVMEAVRFCRLIENPKMSTFNMLLSVCANSKDFEGALQVMVLLKEAGLKPDCKLYTTLISTCAKCGKVDAMFEVFHEMVSAGIEPNVNTYGALIDGCAKAGQVAKAFGAYGIMSSKKVKPDRVVFNALISACGESGAVARAFDVLSEMTAESSESKGCKPILPDHVTVGALMKTCIQAGQADRAREVYKMLQEYSIKGTPEVYTIALRSCSLTGDLGFALKIYEDMNKIGVQPDEMFLSALVDVAGHARRADAAFEIIKDVRAKGFHVGIMAYSSCMGACCNAKDWKKALQLFEEIKAIKLIPTVPMMNALITSLCDGDQVLKAAEVLNEIKELRVRPNEITYSVLCVACERNGEAQLALDLFEQLKVDGIGLNPTIVGCLTGLCLQMFSYDLSLGNIIVRFNQGKPQIDNKWTSSAIMVFRQAITAGLLPSSDVLSQVLGCLRFPHDSSLKTTFIDNMGISCDMPHHPNTNSLLEGFGEYDIRAFSVLEEGGLLGAVASTSTKYSQIVIDARKSNIYTAEVSLLSTLKSLKHRLAAGARLPNVTILLPTEKKQVDLDEREKTLKLAGRVGQAVGSLLRRLGIKYQGEESHGRMRINGLTLRRWFNPKFTSAPSTGAPVELLPLPSRLAKGIADQQRDIRSLSL

SEQ ID NO: 7330 - protein, 55 aa, Lolium multiflorum
MAKFDPWPVFFKREWGRNWPFLAGFAVTGFLITKLTAGFTEEDLKNSKFVQEHKR

SEQ ID NO: 7331 - protein, 136 aa, Brachypodium distachyon
PGPIWPDPITILSSPSSRSRRPLRTKQHIEGEREELIRGLNPKGGEIGDEDLRPVARLLPPGVAPQLALPRRLRSHGDPHHQAHRRVHRGGPQELQVRPGAQALIRRSATRQATGTAPVLPASVLNAASQFSTSPF

SEQ ID NO: 7332 - protein, 447 aa, Sorghum bicolor
MPVGEVAARPGGGGGMVLGGGMAAAAVGGDDAVVMQLAAAEGEETVITVNCPDQAGLGCDLCRTILEFGLRITRGDVSTDGHWCFVVFWVVPRSSSIKIRWASLKNRLMSMCPSSYSIPFYPDISQPGPSQYYLLKLLSPDRKGLLHDVTHILSDLELIIHRVKVCTTPDGRVVDLFFITDGMELLHKKERQEETCSTLIATLGPSISCEVLSAEGFQQGFSSLPPKIAEELFRVELADSEICSSSLSVELKKVQTATINFDNSLSPAHTLVQIICADQKGLIYDILRTMKDCNIQIFYGRFRSDKKGSVSKGCREVDLFVKQVDGKKVMDPEKQDALRSRLRSEMLHPLRVMIVSRGPDTELLVANPVELSGKGRPRVFYDATLALKALGICIFSAEIGRQAASERQWEVYRFLLDDSKEFPLANSLTNRNRVVDRVRKTLMGCYN

SEQ ID NO: 7333 - protein, 55 aa, Brachypodium distachyon
MKTFDPWPVFFRREWRRNWPFLAGFAVTGILITKLTAGFTEEDLKNSKFVQEHRR

SEQ ID NO: 7334 - protein, 55 aa, Festuca arundinacea
MKTFDPWPVFFRREWGRNWPFLAGFAVTGILITKLTAGFTEEDLKNSKFVQEHKK

SEQ ID NO: 7335 - protein, 56 aa, Zea mays
MKTFDPWPVFFRREWKRNWPFLTGFAITGFIITKMTANFTEEDLKNSKFVQEHKKR

SEQ ID NO: 7336 - protein, 56 aa, Unknown
  Sequence found in Organisms: Sorghum bicolor, Saccharum officinarum
MKTFDPWPVFFRREWRRNWPFLTGFAITGFLITKMTANFTEEDLKNSKFVQEHKRH

SEQ ID NO: 7337 - protein, 56 aa, Panicum virgatum
MKTFDPWPVFFRREWKRNWPFLTGFAITGFLITKMTANFTEEDLKNSKFVQEHKKH

SEQ ID NO: 7338 - protein, 57 aa, Zea mays
MKTFDPWPVFFRREWKRNWPFLTGFAITGFIITKMTANFTEEDLKNSKFVQEHKKKH

SEQ ID NO: 7339 - protein, 56 aa, Pennisetum glaucum
MKTFDPWPVFFRREWRRNWPFLTGFAITGFLITKMTANFTEEDLKNSKFVQEHKKH

SEQ ID NO: 7340 - protein, 80 aa, Festuca arundinacea
  misc_feature (20)..(20): Xaa can be any naturally occurring amino acid
  misc_feature (38)..(38): Xaa can be any naturally occurring amino acid
HEATTRPRSRRAEQRGEESXESGSEMAKFDPWPVFFKXEWGRNWPFLAGFAVTGILITKLTAGFTEEDLKNSKFIQEHKR

SEQ ID NO: 7341 - protein, 90 aa, Setaria italica
ARSIPFSPPIHSPPESVKPEAEEEGDRAEATQPEMKTFDPWPVFFRREWRRNWPFLTGFAITGFLITKMTANFTEEDLKNSKFVQEHKKH

SEQ ID NO: 7342 - protein, 82 aa, Avena sativa
PSTIPLPSPQQPDLDPNHARSSKMAFLNKFDPWPVFFRREWKRNWPFLAGFAVTGILITKMTAGFTEEDLKNSQFVQEHKKH

SEQ ID NO: 7343 - protein, 62 aa, Avena sativa
DGLPEQVRPVARVLPPGVEAQLALPRGLRRHRDHHHQDDRRVHRGGPQQLQVRPGAQALRLG

SEQ ID NO: 7344 - protein, 86 aa, Avena sativa
PSTIPLPSPQQPDLDPNQTRGAERSSKMAFLNKFDPWPVFFRREWKRNWPFLAGFAVTGIIITKMTAGFTEEDLKNSKFVQAHKRH

SEQ ID NO: 7345 - protein, 65 aa, Saccharum officinarum
MKTFDPWPVFLRREWRRNWPFLTGFAITGFLITKMTANFTEEDLKKLQVRPGAQEVLTNQGKYLV

SEQ ID NO: 7346 - protein, 71 aa, Triticum aestivum
FLTRSEGGGGGAEVGDLEQAGGKGDEDVRPVAGLLPPGVEAQLALPHGFRHHRIHHHEDDGQLHRGGSQEL

SEQ ID NO: 7347 - protein, 56 aa, Zea mays
MKTFDPWPVFFHREWKRNCPFLTGFTITGFIITKMTANFTEEDLKNSKFVQEHKKR

SEQ ID NO: 7348 - protein, 64 aa, Elaeis guineensis
FRPVAGVLPPGVAPQLALPHRLRHHRFPHHQDDGQLHRGGPQELQVRPGAQEALMGPGGVVHVA

SEQ ID NO: 7349 - protein, 60 aa, Pseudoroegneria spicata
MKFFSAFDPWPVFFRREWGRNWPFLAGFAVTGTLITKLTAGFTEEDLKNSKFVQEHHKKK

SEQ ID NO: 7350 - protein, 110 aa, Triticum aestivum
APSPPAARRRRCTSSPRPRRNATRERENQILADSNPIQSNPRRRSRSKPPEMKFFSAFDPWPVFFRREWGRTWPFLAGFAVTGTLITKMTAGFTEEDLKNSKFVQAHKNK

SEQ ID NO: 7351 - protein, 96 aa, Triticum aestivum
PPSTPQRNQRERENQILADTNPIQSNPRRRSRSKPPEMKFFSAFDPWPVFFRREWGRTWPFLAGFAVTGALITKMTAGFTEEDLKNSKFVQAHKNK

SEQ ID NO: 7352 - protein, 86 aa, Triticum aestivum
RHEALFPSSPPRPRRKAPRTRSERYPPEMKFFSAFDPWPVFFRREWGRTWPFLAGFAVTGALITKMTAGFTEEDLKNSKFVQAHKK

SEQ ID NO: 7353 - protein, 94 aa, Triticum aestivum
RPRRNATRERENQILADSNPIQSNPRRRSRSKPPEMKFFSAFDPWPVFFRREWGRTWPFLAGFAVTGALITKMTAGFTEEDLKNSKFVQAHKNK

SEQ ID NO: 7354 - protein, 87 aa, Triticum aestivum
GTTPLFPSSPPRPRRKAPRTRSERYPPEMKFFSAFDPWPVFFRREWGRTWPFLAGFAVTGALITKMTAGFTEEDLKNSKFVQAHKKK

SEQ ID NO: 7355 - protein, 81 aa, Triticum aestivum
SSSPLVLPQPPEQRRRPDRPRRAAAEMARFDPWPVFFRREWARTWPFLAGFAVTGALVTKLTAGFTEEDLRASKFVQAHRR

SEQ ID NO: 7356 - protein, 61 aa, Cynodon dactylon
MKTFDPWPVFFRREWNRNWPFLTGFAITGYLIVKMTANFTEEDLKNSKFVQEHSAYKNKKH

SEQ ID NO: 7357 - protein, 51 aa, Zea mays
MKTFDPWPVFFHREWKRNCPFLTGFTITGFIITKMTANFTEEDLKNSKFVQ

SEQ ID NO: 7358 - protein, 56 aa, Zea mays
MKTFDPWPVFFHREWKRNCPFLTGFTITGFIITKMTANFTEEDLKNSNFVQEHKKR

SEQ ID NO: 7359 - protein, 342 aa, Zea mays
MKTFDPWPVFFHREWKRNCPFLTGFTITGFIITKMTANFTEEDLKNSSSFRNTRSADQPAQRELSPRTKNQAKNLWTKPPRLDACPIESKFWGTYAQHDLLSWAEAEFLHWWIPKDCPLTPSSKATICEHICSLPSAVNTFWFIYLLARETYMTRICFDSYAIVSDMSAAGLGLNKFCYAGLITAFKNKTPTTEETMAKILDFVGQSKGWQYVERVSKDIAENIMMNVLEEELYNLPTAEYVNRRGGFVFKQHTVYHVALQACAELRSKETLEALLEMFNKDNRDGSTYDAYMVMQAMRCYLRCGDIDSAVKMFEEYSSSRSPPAELYAEEELEARIRLLEV

SEQ ID NO: 7360 - protein, 145 aa, Oryza sativa
MAVELELFQKDSKGRFPWGPTKIWPTWRRGEAHLHAAAPLPNPKRDAITTTTIRFFPLRIEKKAKGPLDPPTTPRPPRRRRKRRRSRMFFSRFDPWPVFFRREWKRCWPFLTGFAVTGAIITKMTAGFTEEDLKNSKFVQAHKKH

SEQ ID NO: 7361 - protein, 78 aa, Scabiosa columbaria
LLLFSLQLIRANTKKQNQIFDMRQFDPWPVFFRREWKRNWPFLVGFAITGTLITKMTLGLTEEDAKNSKFVQRHKCRV

SEQ ID NO: 7362 - protein, 400 aa, Triticum aestivum
MASYTRPNPANPSSPAPSAPPLYPSLTMADLAPVEIPRSPASPDAPAPSDDVLLRAPGAQLHLIDRQRSHPLAAGDLSLHRIRAGDTSLAAIAALGPVQWPLARDVAAVKLDPRHYSFSFAVPASADDPAPEPLHYGLTLSAPDPRLDALLGAYTRFSAHSVAGSEGLADGVRGEVEAAAYWTAVAPNVEEYGSAVARAIASGAENVAKGILWCGVMTVDRLRWGQEVLRKRIQPGDTEAEVSPEMLRRIKRAKKVTKMSEKVATGILSGVVKLTSSVTSSLVNSKAGKKFFSLLPGEVILASLDGFGKISDAVEVAGKDVLSTSSTVTTGLVSHKYGEKAAAATNEGLDAAGHAIGTAWAVFKLRQALNPKSVLKPTSLAKSSIKAGAAELRAKSSKSK

SEQ ID NO: 7363 - protein, 401 aa, Triticum aestivum
MASYTRPNPANPSSPAPSAPPLYPSLTMADLAPPEIPRSPVSPDAPAPSDDVLLRAPGAQLHLVDRRRSHPLAAGELSLHRIRAGDTSLAAIAALGPVQWPLARDVAAVKLDPRHYSFSFAVPASPDDPAPDPLHYGLTLSVPDPRLDALLGAYTRFSAHSVAGSEGLAGGVRGEVEAAAYWTAVAPNVEEYGSAVARAIASGAENVAKGILWCGVMTVDRLRWGQEVLRKRIQPGDTEAEVSPEMLRRIKRAKKVTKMSEKVATGILSGVVKVTSYVTSSLVNSKAGKKFFSLLPGEVVLASLDGFGKISDAVEVAGKDVLSTSSTVTTGLVSHKYGEKAAAATNEGLDAAGHAIGTAWAVFKLRQALNPKSVLKPTSLAKSTVKAGAAELRAKSSSKSK

SEQ ID NO: 7364 - protein, 397 aa, Triticum aestivum
MASYNPANPSTPAPSAPPLYPSLTMADLAPPEIPRSPASPDAPPPSDDVLLRVPGAQLHLIDRQRSHPLAAGELSLHRIRAGDTSLAAIAALGAVQWPLARDVAAVKLDPRHYSFSFAVPASADDPAPDPLHYGLTLSAPDPRLDALLAAYTRFSAHSVAGSEGLAGGVRGEVEAAAYWTAVAPNVEEYGSAVARAIASGAENVARGILWCGVMTVDRLRWGQEVLRKRIQPGDTEAEVSPEMLRRIKRAKKVTKMSEKVATGILSGVVKLTSSVTSSLVNSKAGKKFFSLLPGEVILASLDGFGKISDAVEVAGKDVLSTSSTVTTGLVSHKYGEKAAAATNEGLDAAGHAIGTAWAVFKLRQALNPKSVLKPTSLAKSSIKAGAAELRSKSSKSK

SEQ ID NO: 7365 - protein, 392 aa, Secale cereale
MASYNHPNPTNPSAPPLYPSLSMADLAPVEIPRSPDAPAPSDDVLLRVPGAQLHLVDRQRSHPLAAGDLSLHRIRAGDTSLAAIAALGPVQWPLARDVAAVKLDPRHYSFSFAVPASPDDPAPDPLHYGLTLSVPDPRLDALLGAYTRFSAHSVAGSEGLADGVRGEVEAAAYWTAVAPNVEEYGSAVARAIASGAENVAKGILWCGVMTVDRLRWGQEVLRKRIQPGDTEAEVSPEMLRRIKRAKKVTKMSEKVATGILSGVVKLTSYVTSSLVNSKAGKKFFGLLPGEVVLASLDGFGKISDAVEVAGKDVLSTSSTVTTGLVSHKYGEKAAAATNEGLDAAGHAIGTAWAVFKLRQALNPKSVLKPTSLAKSSIKAGAAELRSKSSKHK

SEQ ID NO: 7366 - protein, 393 aa, Triticum aestivum
NPANPSSPAPSAPPLYPSLTMADLAPPEIPRSPASPDAPAPSDDVLLRVPGAQLHLIDRQRSHPLAAGELSLHRIRAGDTSLAAIAALGPVQWPLARDVAAVKLDPRHYSFSFAVPASADDPAPDPLHYGLTLSAPDPRLDALLGAYTRFSAHSVAGSEGLAGGVRGEVEAAAYWTAVAPNVEEYGSAVARAIASGAENVAKGILWCGVMTVDRLRWGQEVLRKRIQPGDTEAEVSPEMLRRIKRAKKVTKMSEKVATGILSGVVKLTSSVTSSLVNSKAGKKFFSLLPGEVILASLDGFGKISDAVEVAGKDVLSTSSTVTTGLVSHKYGEKAAAATNEGLDAAGHAIGTAWAVFKLRQALNPKSVLKPTSLAKSSIKAGAAELRSKSSKSK

SEQ ID NO: 7367 - protein, 465 aa, Brachypodium distachyon
MYTSMAARATSAAANLPAPPPRQCYYHLLPPAGRRSVWALSASPKKKNPWLDPFDDGPDEDFDYTGVYSGGKQDEDPRPPEDPSNPYGFLRFPMGYNPELDSLASKVRGDVRRACCVVSGGVYENVLFFPVVQLLKDRYPGVLIDVVASARGKQVYEMCKNVRYANVYDPDDDWPEPAEYTHQLGVLKNRYYDMILSTKLAGTGHALFLFMSSAREKVGYVYPNVNGAGAGLFLTEMFKPPTTNLSDGGYNMYQEMLEWLGRPGKGVPQQPIPPLRVSISKKLRGIVEDKYSRAGVEKGKFVVVHGIASDSVANMTSRGDDDCLLPLEQWAEIAKAISSQGNGLRPLFVMPHQKHREEIEDIVGRETSYLFITTPGQLTCLINDSAGVVATNTAAVQLANARDRPCVALFSSKEKAKLFLPYAEDKKSCTVVASATGKLADIDIEAVKNAVKEFEPAPSFALAQK

SEQ ID NO: 7368 - protein, 465 aa, Avena sativa
MSTYMATPMARATSTVAAANLPAPRQCYLLPGRRARLAGGAPSAKKKNPWLDPFDDGPDEDFDYTGVYSGGKQEEDPRPPEDPANPYGFLRFPMAYMPELDSLASKVRGDVRRACCVVSGGVYENVLFFPVVQLLKDRYPGVLIDVVASARGKQVYEMCKNVRYANVYDPDNEWPEPAEYTHQLGVMKNRYYDMILSTKLAGTGHALFLFMSSAREKVGYVYPNVNGAGAGLFLTEMFKPPTTNLSDGGYNMYQDMLEWLGRPAKGVPQQPTPPLKVSISKRLRAIVEDKYNRAGVEKGMYIVVHGIESDSVANMTSRGDDDCLLPLEQWAEIAKEISSGGNGLRPLFVMPHEKHREEIEEIVGQETSYLFITTPGQLTCLINDSAGVVATNTAAVQLANARDKPCVALFSSKEKARLFLPYAEERRSCTIVTSATGKLGAIDIQAVKNAVKGFQPAPSFALAQQ

SEQ ID NO: 7369 - protein, 467 aa, Setaria italica
MAATPTTTRAVAPAPAAKSPAPRQYCNHLLPSATSHRRRRGSVVARSAKKRNPWLDPFDDGPDEEFDYQGMFAGGKQEEDPRPPEDPANPYGFLRFPQGYNPELDSLASKVRGDVRRACCVVSGGVYENVLFFPVVQMLKDRYPGVLIDVVTSARGKQVYEMCKNVRYATVYDPDDDWPEPAEYTHQLGILKNRYYDLILSTRLAGIGHALFLFMSSSRDKVGYVYPNVNSVGAGLFLNEMFKAPTTNLSDGGYHMYTEMLEWIGRPAKNVPRQPTPPLRVSISKKLRAYVEGKYSRAGVEKGKYVVVHGIASDSVASMKSRGDDDCLLPLEHWAQIAKEISSDDKGLKPLFVIPHEKHREEIEEEVGEDTNILFLTTPGQLTCLINDSAGVVATNTAAVQLANARDKPCVALFSSAEKAKLFLPYVEDKGSCTVIASATGKLIDIDIEAVKKAVKDFEPAPSFALA

SEQ ID NO: 7370 - protein, 1062 aa, Hordeum vulgare
MGKGGQDEAVRPDGSGSPGPDPDVPVFPFWARTPSECLAELGVSADRGLSSDDAAARLHKYGPNELERHAPPSVWKLVLEQFNDTLVRILLAAAVVSFVLALYDGAEGGEVRATAFVEPLVIFLILIVNAVVGVWQESNAEKALEALKEIQSEHATVKRDGRWKHGLPARDLVIGDIVELRVGDKVPADMRVLQLISSTLRVEQGSLTGETSSVNKTSHKIHLEDTDIQGKECMVFAGTTIVNGSAVCVVTGTGMSTEIGKIHSQIQEASQEEDDTPLKKKLNEFGEALTAIIGVICILVWLINVKYFLTWEYVDGWPTNFKFSFEKCTYYFEIAVALAVAAIPEGLPAVITTCLALGTRKMAQKNALVRKLPSVETLGCTTVICSDKTGTLTTNQMSAVRLVAIGRWPDTLRNFKVDGTTYDPSDGKIHDWPTLNMDDNLQMIAKIAALCNDASIAHSEHQYVATGMPTEAALKVLVEKMGLPGGYTPSLDSSDLLRCCQWWNNDAKRVGTLEFDRTRKSMGVIVKKAETGKNLLLVKGAVENLLERSAYIQLLDGSVVLLDEGAKALVLSTLREMSGSALRCLGFAYKEDLADFATYDGEEHPAHKYLLDPAYYSSIESNLIFCGFVGLRDPPREEVHKAIEDCRAAGIRVMVITGDNKETAEAICREIGVFGPSENISSKSFAGKEFMALPDKKKLLRQTGGLLFSRAEPKHKQEIVRLLKEDGEVVAMTGDGVNDAPALKLADIGIAMGITGTEVAKEASDMVLADDNFSTIVSAVGEGRSIYNNMKAFIRYMISSNIGEVASIFLTSALGIPEGLIPVQLLWVNLVTDGPPATALGFNPPDKDIMKKPPRRSDDSLITPWILFRYMVIGLYVGIATVGIFIIWYTHGSFLGIDLASDGHTLVSYSQLSNWGQCPSWEGFNVSSFTAGARTFNFDENPCDYFQGGKIKATTLSLSVLVSIEMFNSLNALSEDGSLLSMPPWVNPWLLLAMSVSFGLHFLILYVPFLTQIFGIVPLSFNEWLLVVAVAFPVVLIDEVLKFVGRCLTARARKQLGKRKEE

SEQ ID NO: 7371 - protein, 1062 aa, Secale cereale
MGKGGQDEAARPDGSGSPGADPDVPVFPFWARTPSDCLAELGVSADRGLSSDDAAARLHKYGPNELERHAPPSVWKLVLEQFNDTLVRILLAAAVVSFVLALYDGAEGGEVRATAFVEPLVIFLILIVNAVVGVWQESNAEKALEALKEIQSEHATVKRDGRWSHGLPARDLVIGDIVELRVGDKVPADMRVLQLISSTLRVEQGSLTGETSSVNKTSHKIHLEDTDIQGKECMVFAGTTIVNGSAVCVVTGTGMATEIGKIHSQIQEASQEEDDTPLKKKLNEFGEALTAIIGVICILVWLINVKYFLTWEYVDGWPTNFKFSFEKCTYYFEIAVALAVAAIPEGLPAVITTCLALGTRKMAQKNALVRKLPSVETLGCTTVICSDKTGTLTTNQMSAVRLVAIGRWPDTLRNFKVDGTTYDPSDGKIHDWPTLNMDDNLQMIAKIAALCNDASIAHSEHQYVATGMPTEAALKVLVEKMGLPGGYTPSLDSSDLLRCCQWWNNDAKRVGTLEFDRTRKSMGVIVKKTETGKNLLLVKGAVENLLERSAYIQLLDGSVVLLDEGAKALVLSTLREMSGSALRCLGFAYKEDLAEFTTYDGEEHPAHKYLLDPAHYSSIESNLIFCGFVGLRDPPREEVHKAIEDCRAAGIRVMVITGDNKETAEAICREIGVFGPSENISSKSFAGKEFMALPDKKKLLRQTGGLLFSRAEPKHKQEIVRLLKEDGEVVAMTGDGVNDAPALKLADIGIAMGITGTEVAKEASDMVLADDNFSTIVSAVGEGRSIYNNMKAFIRYMISSNIGEVASIFLTSALGIPEGLIPVQLLWVNLVTDGPPATALGFNPPDKDIMKKPPRRSDDSLITPWILFRYMVIGLYVGIATVGIFIIWYTHGSFLGIDLASDGHTLVSYSQLSNWGQCPSWEGFNVSSFTAGARTFNFDDNPCDYFQGGKIKATTLSLSVLVSIEMFNSLNALSEDGSLLSMPPWVNPWLLLAMSVSFGLHFLILYVPFLTQIFGIVPLSFNEWLLVVAVAFPVVLIDEVLKFVGRCLTARARKQLGKRKEE

SEQ ID NO: 7372 - protein, 1062 aa, Oryza sativa
MGKGGQEEGKRRDGSDASGSEPAAAAFPAWARTPSECLAELGVAADRGLSSEEAAARLRRYGPNELERHAAPSVWKLVLEQFDDTLVRILLAAAVVSFVLALYDGAEGGEVGATAFVEPLVIFLILIVNAVVGVWQESNAEKALEALKEIQSEHATVKRDGRWSHGLPARDLVPGDIVELRVGDKVPADMRVLQLISSTLRVEQGSLTGETASVNKTSHKIELEDTDIQGKECMVFAGTTIVNGSAVCVVTGTGMDTEIGKIHAQIQEASQEEDDTPLKKKLNEFGEALTAIIGVICALVWLINVKYFLTWEYVDGWPRNFKFSFEKCTYYFEIAVALAVAAIPEGLPAVITTCLALGTRKMAQKNALVRKLPSVETLGCTTVICSDKTGTLTTNQMSAVKLVAIGRWPDTLRSFKVDGTTYDPSDGKINEWPSLSMDENLQMIAKIAAVCNDASIAHSEHQYVATGMPTEAALKVLVEKMGLPGGYTPSLDSSDLLRCCQWWNNAAKRVATLEFDRTRKSMGVIVKKADSGKNLLLVKGAVENLLERSGYIQLLDGSVVLLDEGAKALILSTLREMSASALRCLGFAYKEDLAEFATYDGEEHAAHKYLLDPSYYSSIESNLIFCGFVGLRDPPREEVHKAIEDCRAAGIRVMVITGDNKETAEAICREIGVFGSTEDISSKSFTGKEFMSLSDKKKLLRQTGGLLFSRAEPKHKQEIVRLLKEDGEVVAMTGDGVNDAPALKLADIGVAMGITGTEVAKEASDMVLADDNFSTIVAAVGEGRSIYDNMKAFIRYMISSNIGEVASIFLTSALGIPEGLIPVQLLWVNLVTDGPPATALGFNPPDKDIMKKPPRRSDDSLITPWILFRYMVIGMYVGIATVGVFIIWYTHGSFLGIDLAGDGHSLVSYSQLSNWGQCSSWEGFKVSPFTAGARTFNFDVNPCDYFQGGKIKATTLSLSVLVAIEMFNSLNALSEDGSLLSMPPWVNPWLLLAMSVSFGLHFLILYVPFLAQVFGIVPLSFNEWLLVIAVAFPVVLIDEVLKFVGRCLTARARKQSGKQKED

SEQ ID NO: 7373 - protein, 1061 aa, Sorghum bicolor
MGKGGQDEGKRRDGSAASGPDPAEPAFPAWARTPSECLAELGVSADRGLSSEEAAARLQRYGPNELERHAPPSVWKLVLEQFNDTLVRILLLAAVVSFVLALYDGAEGGEVGVTAFVEPLVIFLILIVNAVVGVWQESNAEKALEALKEIQSEHATVKRDGRWSHGLPARDLVPGDIVELRVGDKVPADMRVLQLISSTLRVEQGSLTGETASVNKTSHKIELEDTDIQGKECMVFAGTTVVNGSAVCVVTGTGMATEIGKIHAQIQEASQEEDDTPLKKKLNEFGEALTAIIGVICALVWLINLKYFLSWEYVDGWPRNFKFSFEKCTYYFEIAVALAVAAIPEGLPAVITTCLALGTRKMAQKNALVRKLPSVETLGCTTVICSDKTGTLTTNQMSAVKLVAIGRWPDTLRSFKVDGTTYDPTDGKIHDWPSLSMDENLQMIAKIAAVCNDASIAHSEHQYVATGMPTEAALKVLVEKMGLPGGYTPSLDSSDLLRCCQWWNNAAKRVATLEFDRTRKSMGVIVKVNSGKNLLLVKGAVENLLERCTHIQLLDGSVVLLDDGAKALILSTLRDMSASALRCLGFAYKEELAEFATYDGEEHAAHKYLLDPSYYSSIESNMIFCGFVGLRDPPREEVHRAIEDCRAAGIRVMVITGDNKETAEAICREIGVFGPHEDISSKSFTGKEFMALSDKKKLLRQQGGLLFSRAEPKHKQEIVRLLKEDGEVVAMTGDGVNDAPALKLADIGVAMGITGTEVAKEASDMVLADDNFSTIVAAVGEGRSIYNNMKAFIRYMISSNIGEVASIFLTSALGIPEGLIPVQLLWVNLVTDGPPATALGFNPPDKDIMKKPPRRSDDSLITPWILFRYMVIGLYVGVATVGIFIIWYTHGSFLGIDLASDGHTLVSYSQLSNWGQCSSWEGFKVSPFTAGARTFKFDANPCDYFQGGKIKATTLSLSVLVSIEMFNSLNALSEDGSLLSMPPWVNPWLLLAMSVSFGLHFLILYVPFLAQVFGIVPLSLNEWLLVIAVAFPVVLIDEVLKFVGRCLTARARKQSGKRKAE

SEQ ID NO: 7374 - protein, 1061 aa, Setaria italica
MGKGGQDEGKRRDGSASSGADPAAPAFPAWARTPSECLAELGVLVDRGLSSDEAAARLQRYGPNELERHAPPSVWKLVLEQFEDTLVRILLLAAVVSFVLALYDGAEGGEVGVTAFVEPLVIFLILIVNAVVGVWQESNAEKALEALKEIQSEHATVKRDGRWSHGLPARDLVPGDIVELRVGDKVPADMRVLQLISSTLRIEQGSLTGETASVNKTSHKIEMEDTDIQGKECMVFAGTTVVNGSAVCVVTGTGMATEIGKIHAQIQEASQEEDDTPLKKKLNEFGEALTAIIGVICALVWLINVKYFLSWDYVDGWPRNFKFSFEKCTYYFEIAVALAVAAIPEGLPAVITTCLALGTRKMAQKNALVRKLPSVETLGCTTVICSDKTGTLTTNQMSAVKLVAIGRWPDTLRTFKVDGTTYDPTDGQIHDWPSLSMDENLKMIAKIAAVCNDASIAHSEHQYVATGMPTEAALKVLVEKMGLPGGYTPSMDSSDLLRCCQWWNNAAKRVATLEFDRTRKSMGVIVKADSGKNLLLVKGAVENLLERCSFIQLLDGSVVLLDDGAKAIILSTLRDMSASALRCLGFAYKEDLDAFATYDGEEHAAHKYLLDPSCYSNIESKMIFCGFVGLRDPPREEVHKAIEDCRAAGIRVMVITGDNKETAEAICREIGVFGPDEDISSTSFTGKEFMALSDKKKLLRQQGGLLFSRAEPKHKQEIVRLLKEDGEVVAMTGDGVNDAPALKLADIGIAMGITGTEVAKEASDMVLADDNFSTIVAAVGEGRSIYNNMKAFIRYMISSNIGEVASIFLTSALGIPEGLIPVQLLWVNLVTDGPPATALGFNPPDKDIMKKPPRRSDDSLITPWILFRYMVIGLYVGVATVGIFIIWYTHGSFLGIDLASDGHTLVSYSQLSNWGQCSSWEGFKVSPFTAGTQTFNFDANPCDYFQGGKIKATTLSLSVLVAIEMFNSLNALSEDGSLLSMPPWVNPWLLLAMSVSFGLHFLILYVPFLAQVFGIVPLSFNEWLLVIAVAFPVVLIDEVLKFVGRCLTARARKQSGKRKAE

SEQ ID NO: 7375 - protein, 1062 aa, Zea mays
MGKGGQDEGNRRRDGSAASGPDRPAPVFPAWARTPSECLAELGVSADRGLSSEEAAARLQRHGPNELERHAPPSVWKLVLEQFNDTLVRILLLAAVVSFVLALYDGAEGGEVGLTAFVEPLVIFLILIVNAVVGVWQESNAEKALEALKEIQSEHATVRRDGRWSHGLPARDLVPGDIVELRVGDKVPADMRVLQLISSTLRVEQGSLTGETASVNKTSHKIELEDTDIQGKECMVFAGTTVVNGSAVCVVTGTGMATEIGKIHAQIQEASQEEDDTPLKKKLNEFGEALTAIIGVICALVWLINLKYFLSWEYVDGWPTNFKFSFEKCTYYFEIAVALAVAAIPEGLPAVITTCLALGTRKMAQKNALVRKLPSVETLGCTTVICSDKTGTLTTNQMSAVKLVAIGRWPDTLRSFKVDGTTYDPTDGKIHDWPSLSMDENLQMIGKIAAVCNDASIAHSEHQYVATGMPTEAALKVLVEKMGLPGGYTPSLDSSDLLRCCQWWNNAAKRVATLEFDRTRKSMGVIVKANSGKNLLLVKGAVENLLERCTHIQLLDGSVVLLDDGAKALILSTLRDMSASALRCLGFAYKDELSEFATYDGEEHAAHKYLLDPSYYSSIESNMIFCGFVGLRDPPREEVHKAIEDCRAAGIRVMVITGDNKETAEAICREIGVFGPHEDISSKSFTGKEFMGLSDKKELLRQQGGLLFSRAEPKHKQEIVRLLKEDGEVVAMTGDGVNDAPALKLADIGVAMGITGTEVAKEASDMVLADDNFSTIVAAVGEGRSIYNNMKAFIRYMISSNIGEVASIFLTSALGIPEGLIPVQLLWVNLVTDGPPATALGFNPPDKDIMKKPPRRSDDSLITPWILFRYMVIGLYVGVATVGIFIIWYTHDSFLGIDLASDGHTLVSYSQLSNWDKCSSWEGFKVSPFTAGARTFSFDANPCDYFQGGKIKATTLSLSVLVAIEMFNSLNALSEDGSLVSMPPWVNPWLLLAMSVSFGLHFLILYVPFLAQVFGIVPLSLNEWLLVVAVAFPVVLIDEVLKFVGRCLTARARKQSGKRKAE

SEQ ID NO: 7376 - protein, 1012 aa, Pennisetum glaucum
SSEEASARLQRHGPNELERHAPPSVWKLVLEQFNDTLVRILLLAAVVSFVLALYDGAEGGEVGVTAFVEPLVIFLILIVNAVVGVWQESNAEKALEALKEIQSEHATVKRDGRWSHGLPARDLVPGDIVELRVGDKVPADMRVLQLISSTLRVEQGSLTGETASVNKSSHKIESEDTDIQGKECMVFAGTTVVNGSAVCLVTGTGMATEIGKIHAQIQEASQEEDDTPLKKKLNEFGEALTAIIGVICALVWLINLKYFLSWEYVDGWPRNFKFSFEKCTYYFEIAVALAVAAIPEGLPAVITTCLALGTRKMAQKNALVRKLPSVETLGCTTVICSDKTGTLTTNQMSAVKLVAIGRWPDTLRTFKVDGTTYDPTDGQIHDWPSLSMDENLKMIAKIAAVCNDASIAHSEHQYVATGMPTEAALKVLVEKMGLPGGYTPSMDSSDLLRCCQWWNNAAKRVATLEFDRTRKSMGVIVKADSGKNLLLVKGAVENLLERCGYIQLLDGSVVLLDDGAKSLILSTLRDMSAGALRCLGFAYKEDLAEFATYDGEEHAAHKYLLDPSYYSTIESNMIFCGFVGLRDPPREEVHKAIEDCRAAGIRVMVITGDNKETAEAICREIGVFGPDDDISSKSFTGKEFMALSDNKKLLRQQGGLLFSRAEPKHKQEIVRLLKEDGEVVAMTGDGVNDAPALKLADIGVAMGITGTEVAKEASDMVLADDNFSTIVAAVGEGRSIYNNMKAFIRYMISSNIGEVASIFLTSALGIPEGLIPVQLLWVNLVTDGPPATALGFNPPDKDIMKKPPRRSDDSLITPWILFRYMVIGLYVGVATVGIFIIWYTHGSFLGIDLASDGHTLVSYSQLSNWGQCSSWEGFKVSPFTAGAQTFSFDTNPCDYFQNGKIKAMTLSLSVLVAIEMFNSLNALSEDGSLLSMPPWVNPWLLLAMSVSFGLHFLILYVPFLAQVFGIVPLSFNEWLLVIAVAFPVVLIDEVLKFVGRCLTARARKQSGKRKAE

SEQ ID NO: 7377 - protein, 924 aa, Triticum aestivum
NAEKALEALKEIQSEHATVKRDGRWKHGLPARDLVIGDIVELRVGDKVPADMRVLQLISSTLRVEQGSLTGETSSVNKTSHKIHLEDTDIQGKECMVFAGTTIVNGSAVCVVTGTGMATEIGKIHSQIQEASQEEDDTPLKKKLNEFGEALTAIIGVICILVWLINVKYFLTWEYVDGWPANFKFSFEKCTYYFEIAVALAVAAIPEGLPAVITTCLALGTRKMAQKNALVRKLPSVETLGCTTVICSDKTGTLTTNQMSAVRLVAIGRWPDTLRNFKVDGTTYDPSDGKIHDWPTLNMDDNLQMIAKIAALCNDASIAHSEHQYVATGMPTEAALKVLVEKMGLPGGYTPSLDSSDLLRCCQWWNNDAKRVGTLEFDRTRKSMGVIVKKAETGKNLLLVKGAVENLLERSAYIQLLDGSVVLLDEGAKALVLSTLREMSGSALRCLGFAYKEDLAEFATYDGEEHPAHKYLLDPAYYSSIENNLIFCGFVGLRDPPREEVHKAIEDCRAAGIRVMVITGDNKETAEAICREIGVFGPSENISSMSFAGKEFMALPDKKKILRQTGGLLFSRAEPKHKQEIVRLLKEDGEVVAMTGDGVNDAPALKLADIGIAMGITGTEVAKEASDMVLADDNFSTIVSAVGEGRSIYNNMKAFIRYMISSNIGEVASIFLTSALGIPEGLIPVQLLWVNLVTDGPPATALGFNPPDKDIMKKPPRRSDDSLITPWILFRYMVIGLYVGIATVGIFIIWYTHGSFLGIDLASDGHTLVSYSQLSNWGQCPSWEGFNVSSFTAGARTFNFDENPCDYFQGGKIKATTLSLSVLVSIEMFNSLNALSEDGSLLSMPPWVNPWLLLAMSVSFGLHFLILYVPFLTQIFGIVPLSFNEWLLVVAVAFPVVLIDEVLKFVGRCLTARARKQLGKRKEE

SEQ ID NO: 7378 - protein, 923 aa, Triticum aestivum
AEKALEALKEIQSEHATVKRDGRWKHGLPARDLVIGDIVELRVGDKVPADMRVLQLISSTLRVEQGSLTGETSSVNKTSHKIHLEDTDIQGKECMVFAGTTIVNGSAVCVVTGTGMATEIGKIHSQIQEASQEEDDTPLKKKLNEFGEALTAIIGVICILVWLINVKYFLTWEYVDGWPTNFKFSFEKCTYYFEIAVALAVAAIPEGLPAVITTCLALGTRKMAQKNALVRKLPSVETLGCTTVICSDKTGTLTTNQMSAVRLVAIGRWPDTLRNFKVDGTTYDPSDGKIHDWPTLNMDDNLQMIAKIAALCNDASIAHSEHQYVATGMPTEAALKVLVEKMGLPGGYTPSLDSSDLLRCCQWWNNDAKRVGTLEFDRTRKSMGVIVKKAETGKNLLLVKGAVENLLERSAYIQLLDGSVVLLDEGAKALVLSTLREMSGSALRCLGFAYKEDLAEFATYDGEEHPAHKYLLDPAYYSSIENNLIFCGFVGLRDPPREEVHKAIEDCRAAGIRVMVITGDNKETAEAICREIGVFGPSENISSMSFAGKEFMALPDKKKILRQTGGLLFSRAEPKHKQEIVRLLKEDGEVVAMTGDGVNDAPALKLADIGIAMGITGTEVAKEASDMVLADDNFSTIVSAVGEGRSIYNNMKAFIRYMISSNIGEVASIFLTSALGIPEGLIPVQLLWVNLVTDGPPATALGFNPPDKDIMKKPPRRSDDSLITPWILFRYMVIGLYVGIATVGIFIIWYTHGSFLGIDLASDGHTLVSYSQLSNWGQCPSWEGFNVSSFTAGARTFNFDENPCDYFQGGKIKATTLSLSVLVSIEMFNSLNALSEDGSLLSMPPLVNPWLLLAMSVSFGLHFLILYVPFLTQIFGIVPLSFNEWLLVVAVAFPVVLIDEVLKFVGRCLTARARKQLGKRKEE

SEQ ID NO: 7379 - protein, 1059 aa, Musa acuminata
MGKGGQDEGKKGGLEPPTSNFPAWARTVHECEAEFVVSAHDGLRSEEVVKLREIYGLNELSKHSGPSIWQLVLEQFNDTLVRILLVAAVVSFVLAWYDGDEGGEMGITAFVEPLVIFLILIVNAIVGVWQENNAEKALEALKEIQSEHASVRRNGELIPNLPAKELVPGDIVELKVGDKVPADMRILHLISSTVRVEQASLTGENDAVNKTNHQVESEDIDIQGKECMVFAGTTVVNGSCICLVIQTGMNTEIGKIHSQIHEASQSEDDTPLKKKLNEFGEVLTAIIGVICAVVWLINVKYFLTWEYVDGWPRNFKFSFEKCTYYFEIAVALAVAAIPEGLPAVITTCLALGTRKMAQKNALVRKLPSVETLGCTTVICSDKTGTLTTNQMSAVRLVAMGRWADTLRTFKVDGTTYNPHDGIIHDWPTSNMDANLQMIAKIAAVCNDASVNHSAHQFVTSGMPTEAALKVLVEKMGLPGGYETSSLDSDEILRCCKWWNGKAQRVATLEFDRSRKSMGVIVKSKSGTNSLLVKGAVENLLERSAYVQLLDGSVVVLDDRSKSLILDALHKMSTTALRCLGFAYTDDLAEFATYDGEDHPAHKILLDPSNYSSIETGLVFVGLVGLRDPPRSEVYKAIEDCRAAGIRVMVITGDNKETAEAICRDIGVFTPDEEIHSKSLTGKGFMSMSSSDKKTLLRQSGGLLFSRAEPKHKQEIVRLLREDGEVVAMTGDGVNDAPALKMADIGIAMGIAGTEVAKEASDMVLADDNFSSIVAAVGEGRSIYNNMKAFIRYMISSNIGEVASIFLTAALGIPEGLIPVQLLWVNLVTDGPPATALGFNPPDKDIMKKPPRRSDDSLITAWILFRYMVIGLYVGIATVGIFIIWYTHGSFMGIDFSGDGHTLVTYSQLSNWGECSSWEGFKVSPFTAGARQFTFDANPCDYFQTGKVKAMTLSLSVLVAIEMFNSLNALSEDGSLLSMPPWANPWLLLAMSISFGLHFLILYVPFLAQVFGIVPLSFKEWLLVLAVAFPVILIDEVLKFVGRHTSSSGAKNWSAKHKDE

SEQ ID NO: 7380 - protein, 1047 aa, Elaeis guineensis
KGGLERRTSAFPAWARSIQECEAEFGVSASEGLRSDEVLKRREIYGWNELEKHSGPSIWQLVLEQFNDTLVRILLVAAVVSFVLAWYDGEEGGELEITAFVEPLVIFLILIINAIVGVWQENNAEKALEALKEIQSEHAMVRRDGDLIPNLLAKELVPGDIVELRVGDKVPADMRILYLISSTLRVEQGSLTGESAAVNKTSRRVDSEDTDIQGKECMVFAGTTVVNGSCVCLVTQTGMNTEIGKIHSQIHEASQSEEDTPLKKKLNEFGEVLTAIIGVICLLVWLINVKYFFTWEYVDGWPRNFKFSFEKCTYYFEIAVALAVAAIPEGLPAVITTCLALGTRKMAQKNALVRKLPSVETLGCTTVICSDKTGTLTTNQMSAIKLLAMGRWTDTIRSFKVDGTTYDPHDGKIHDWPTGNMDANLQMIAKIAAVCNDASIARSGHHFVASGMPTEAALKVLVEKMGLPGGFDSSSLESTEILKCCQWWNEVAQRIATLEFDRIRKSMSVIVKSKSGSNSLLVKGAVENLLERSSYIQLLDGSVVLLDESSKGLILKALHEMSTNALRCLGFAYKDDLSEFATYDGEDHPAHKLLLDPSNYSSIESDLIFVGLVGLRDPPRDEVHKAIEDCRAAGIRVMVITGDNKETAEAICREIGVFGPDEDLTLKSYIGKEFMSLPDKKVLLQQSGGLLFSRAEPKHKQEIVRLLKEDGEVVAMTGDGVNDAPALKMADIGIAMGIAGTEVAKEASDMVLADDNFRTIVAAIGEGRSIYNNMKAFIRYMISSNIGEVASIFLTAALGIPEGLIPVQLLWVNLVTDGPPATALGFNPPDKDIMKKPPRRSDDSLINAWILFRYMVIGLYVGLATVGVFIIWYTHGSFMGIDLSGDGHTLVTYSQLSNWGQCSSWEGFKVNSFTAGARRFVFDTDPCEYFQAGKVKAMTLSLSVLVAIEMFNSLNALSEDGSLLSMPPWVNPWLLLAMSVSFGLHFLILYVPFLAQVFGIVPLSFNEWLLVLAVAFPVILIDEVLKFVGRCASSVGAKRWSEKHKYE

SEQ ID NO: 7381 - protein, 1059 aa, Musa acuminata
MGKGGQDERKKGGLDPPTTNFPAWARTVQECEAEFKVSAEYGLRSDEVLKRREIYGLNELEKHSGPSIWQLVLEQFNDTLVRILLVAAVVSFVLAWYDGDEGGEMGITAFVEPLVIFLILIVNAIVGVWQENNAEKALEALKEIQSEHAAVRRDGNLIPNLPAKDLLPGDIVELKVGDKVPADVRILYLISSTVRVEQASLTGENAAVNKTNHHVEHEDIDIQGKECMVFAGTTVVNGSCVCLVTQTGMNTEIGKIHSQIHEASQSEDDAPLKKKLNEFGEVLTAIIGVICALVWLINVKYFFTWEYVNGWPSNFKFSFEKCTYYFEIAVALAVAAIPEGLPAVITTCLALGTRKMAQKNALVRKLPSVETLGCTTVICSDKTGTLTTNQMSVVRLVAMGRWTDTLRSYKVDGTTYDPHDGKIYDWPASSMDVNLQMIAKIAAVCNDASITQSGHHFVTSGMPTEAALKVLVEKMGLPGGYDPSSLDSAEILRCCKWWNGIAQRVATLEFNRTRKSMGVIVKSKSGTNSLLVKGAVENLLERSTHIQLLDGSVVLLDDSSKNLIMNALREMSTNALRCLGFAYKDDLAEFSAYDGGDHPAHKLLLDPSNYASIETGLIFVGLVGLRDPPRKEVYRAIEDCRAAGIRVMVITGDNKETAEAICRDIGVFSPDEDIHLKSLTGKEFMSSNDKKAILRQNGALLFSRAEPGHKQEIVRLLKEDGEVVAMTGDGVNDAPALKMADIGIAMGIAGTEVAKEASDMVLADDNFSTIVAAVGEGRSIYNNMKAFIRYMISSNIGEVASIFLTAALGIPEGLIPVQLLWVNLVTDGPPATALGFNPPDKDIMKKPPRRSDDSLITAWILFRYMVIGLYVGIATVGIFIIWYTHGSFMGIDLSGDGHTLVTYAQLSNWGECSSWDGFKVAPFTAGSRRFTFDTNPCDYFQTGKVKAMTLSLSVLVAIEMFNSLNALSEDGSLLSMPPWVNPWLLLAMSVSFGLHFLILYVPFLAQVFGIVPLSFNEWLLVLAVALPVILIDEVLKFVGRCTSSSGARRRSASAKHKDE

SEQ ID NO: 7382 - protein, 1058 aa, Musa acuminata
MGKGGQDDGKKGVETPISNFPAWARSVQECEAEFKVSAKYGLRSDEVLTRREIYGLNELEKHSGPSIWHLVLEQFKDTLVRILLVAAVVSFVLAWCDGDEGGEMGITAFVEPLVIFLILIVNAIVGVWQENNAEKALEALKEIQSEHATVRRDGELIPNLPAKELVPGDIVELKVGDKVPADLRILHLISSTVRVEQASLTGENAAVNKTNHVVESEDIDIQGKECMVFAGTTVVNGSCVCLVTQTGMNTEIGKIHSQIHEASQSEEDTPLKKKLNEFGEVLTAIIGVICAVVWLINVKYFLTWEYVDGWPSNFKFSFEKCTYYFEIAVALAVAAIPEGLPAVITTCLALGTRKMAQKNALVRKLPSVETLGCTTVICSDKTGTLTTNQMSVVRLVAMGRWTDTLRTFKVDGTTYNPRDGKIHEWPSSDMDANLQIIAKIAAVCNDSSISQSGHHFVTSGMPTEAALKVLVEKMGLPGDCDTSLVDSDDILKCCKWWNEMAQRVATLEFDRIRKSMGVIVKSKSGTNCLLVKGAVENLLERSSYIQLLDGSVVLLDDRSKSLILDALHDMSTNQLRCLGFAYKDDLTEFATYDGEDHPAHKLLLDPSNYSSIETGLIFVGLVGLRDPPRKEVHKAIEDCRTAGIRVMVITGDNKETAEAICRDIGVFTLDEDIHSKSFTGKDFMSRSSNEKKSLLRQNGGLLFSRAEPRHKQEIVRLLKEDGEVVAMTGDGVNDAPALKMADIGIAMGIAGTEVAKEASDMVLADDNFNTIVAAVGEGRSIYNNMKAFIRYMISSNIGEVASIFLTAALGIPEGLIPVQLLWVNLVTDGPPATALGFNPPDNDIMKKPPRRSDDSLITAWILFRYMVIGLYVGIATVGIFIIWYTHGSFAGIDLSGDGHTLVTYSQLSNWGECSSWEGFKVAPFTAGARSFTFDDNPCDYFQTGKVKAMTLSLSVLVAIEMFNSLNALSEDGSLLSMPPWANPWLLLAMSISFGLHFLILYVPFLAQVFGIVPLSFNEWLLVLVVAFPVILIDEVLKFVGRCTNSSGAKRRPTKHKDE

SEQ ID NO: 7383 - protein, 692 aa, Phalaenopsis aphrodite
MGKGGQDRGRGAGAKPNSSPPSSTFPAWARTVAQCEAEFGVSADVGLTSVEVSRRLELYGLNDLENHSGPSIWQLVLEQFNDTLVRILLVAAVVSFVLAWYDGDEGGEMGITAFVEPLVIFLILIVNAVVGVWQENNAEKALEALKEIQSEHAAVKRDGELIPRLPAKELVPGDIVELRVGDKVPADMRVLHLISSTLRVEQGSLTGESAAVNKTNHKIDSEDTDIQSKVCMVFAGTTVVNGSCVCLVTQTGMNTEIGKIHSQIHEASQCEEDTPLKKKLNEFGEVLTALIGVICALVWLINVKYFLTWEYVNGWPRNFKFSFEKCTYYFEIAVALAVAAIPEGLPAVITTCLALGTRKMAAKNALVRKLPSVETLGCTTVICSDKTGTLTTNQMSAAKLVAIGRSTDSLRSFKVDGTTYDPNDGRIHDWPAGQLDQNLQMIAKISAVCNDASISRSGQHFVSTGGPTEAALKVLVEKMGLPARFDASSIGSTNTLRCCQWWNDLSPRVATLEFDRTRKSMGVIVRSKTKSNTLLVKGAVENLLERSVSVQLQDGSVVELDERTKGLILKYLHEATSSALRCLGFAYKEELEEFSTYDGENHPAHKLLLDPSNYSSIESDLIFVGFVGLRDPPRAEVHKAIEDCRAAGIRVMVITGDNKETAEAICREIGVFGPYENINLKSFTGKNFNVFT

SEQ ID NO: 7384 - protein, 260 aa, Hordeum vulgare
MPAAVVRCPLLLRRHPAAALRRSFSSSGMRSVRRAAGGGSQGRSPAYRGLLLDAGGTLLQLAQPVAETYATLGRPYGVMKSKEYIMQGFKRAFSAPWPKTLRYQGDGRPFWRIVVAEATDCTNSDYFEEVYQYYAHGDAWRLPDGAYRTLRDLKDAGVKLAVVSNFDTRLRKLLKDLNVSNMFDAIVVSSEVGYEKPAPEIFKIALEQIGVEASNAVHVGDDETADKAGANAIGLECWLWGEDVKEFSEIQRRIVAKGSR

SEQ ID NO: 7385 - protein, 260 aa, Secale cereale
MPAAAMRCPLLLGRHPAATLRHSFSSSRTRRVRRAAGGGSQGQPPAYGGLLLDAGGTLLQLAQPVAKTYAALGRPYGVMMPEKYIMEGFKRAFSAPWPKTLRYQGDGRPFWRIVVAEATDCTDNDYFEEVYQYYAHGDAWRLPDGAYRTLRDLKKAGVKLAVVSNFDTRLRKLLKDLNVSDMFDAIVVSSEVGYEKPAPEIFKIALEQIGVEASNAVHVGDDETADKAGANAIGLECWLWGDDVKKFSEIQRRIVAKGSQ

SEQ ID NO: 7386 - protein, 260 aa, Triticum aestivum
MPAAVVRCPLLLGRHPAAALRHSFSSSRTRRVRRAAGGGSQGQPPAYGGLLLDAGGTLLQLAQPVAETYATLGHPYGVRKPEKYIMEGFKRAFSAPWPKTLRYQGDGRPFWKIVVAEATDCTNNNYFEEVYQYYAHGDAWRLPGGAYRTLRDLKDSGVKLAVVSNFDTRLRKLLKDLNVSHLFDAIVVSSEVGYEKPAPEIFKIALEQIGVEASNAVHVGDDETADKAGANAIGLECWLWGEDVKEFSEIKHRIVAKGSR

SEQ ID NO: 7387 - protein, 271 aa, Oryza sativa
MPAAAAAAARGPLLHLRRNPAPRLAAARRSFSSSGMRCVSAAAGAGGGGRERRSSPAFGGLLLDAGGTLLQLARPVAQTYASLGRRYGMSKSEESIKEGFKRAFSAPWPKTLRYQGDGRPFWRIVVAEATECTNNDYFEEVYEYYAHGDAWRLPAGAYETLRDLKDAGVKLAVVSNFDTRLRKLLKDLHVSDMFDAIVVSSEVGHEKPAPEIFKRALDQIGVEASKAVHVGDDETADKAGANAIGLECWLWGQDVRTFSEIQDRILTRFPQ

SEQ ID NO: 7388 - protein, 321 aa, Triticum aestivum
RAPPASLFSGAGLGPRRSLPLSPGSSRSNGLAHESGCTSRSSLLSSAQPNTTFISPARASRHARRGDALPPPPRAAPSGRPPTLLLLLPHALCAQSRGSGGQGRSPAYGGLLLDAGGTLLQLAQPVAETYATLGRPYGVMKSQKYIMEGFKRAFSAPWPKTLRYQGDGRPFWKIVVAEATDCTNNNYFEEVYQYYAHGDAWCLPDGAYRTLHDLKDAGVKLAVVSNFDTRLRKLLKDLNVSDMFDAIVVSSEVGYEKPALEIFKIALEQIGVEARNAVHVGDDETADKAGANAIGLECWLWGEDLKEFSEIQHRIVAKRLR

SEQ ID NO: 7389 - protein, 255 aa, Triticum aestivum
MRCPLLLGRQPETALRHSFSSSRMRRVRKAAGGGGQGPPPAYGGLLLDAGGTLLQLAQPVAETYATLGRPYGVMKSEKYIMEGFKRAFSAPWPKTLRYQGDGRPFWKIVVAEATDCTNNNYFEEVYQYYAHGDAWRLPDGAYRTLRDLKDAGVKLAVVSNFDTRLRKLLKDLNVSHMFDAIVVSSEVGYEKPAPEIFKIALEQIGVEARNAVHVGDDETADKAGANAIGLECWLWGEDVKEFSEIQHRIVAKRSR

SEQ ID NO: 7390 - protein, 785 aa, Setaria italica
MLSRVPAQSPAASFKPRHSSPRSRLGLGASCKPLTATTTAPSSTRRRVSTCAASRRGFLLLAPSLAAASAVLRTLPSAAAESDDADTPSSTPAPPTDELPSPSPETEAEVEAQPEPEELPMSRVYDATVLGEPEALAGDARGRVWEKLAAARVVYLGEAELEPDPDDRALELEVVRGLSGRCADAGRGLALALEAFPCDLQQQLDQFMDGRIDGRILKLYTSHWPQELWQQYEPLLNYCRDTGIKLIACGTPLEVKKTVQADGIRALTKAEREAYAPPAGSGFISGFMFSSGRSLIDKISSMDDSLFGTTSYLLEQARAVDDYTISQIITKELNDGDLSRLLIVVTGASHVMYGPRGSGVPGRISKKVPKKDQVVVLLDPESQVIRREGELPIADFLWYSAAKPCTRNCFDRAEIARVMNAAGRRTKALPQDLQKGIDLGVVSPEILQNFFDLEKYPLMAELIHRFQGFRERLLADPKFLQRLAIEEAISITTTLLAQYERRKERFFEEIDYVLTDTIRGSVVDFFTVWLPAPTISVLQFADDGSGRSLEFVRGLLGSLPDNAFQKNILGQDWSIKQRIAAVLVGGLKLASVGFISSVGAGVSSDLVYAARGIVKPSEKVEAGRKRSPIWKSAAVYSCFLGTSANLRYQIIAGLVEYRLGESLVTYYNQPLIAGLLSFVARTLNSYWGTQQWVDLARYTGLQKSEEKPPGEASTPPESWLQKSEEKPPSGEASTPPELGLQKSEEKPPSSEASTPPELADLDGCTIEGHNLDDSSNNTNESRGPS

SEQ ID NO: 7391 - protein, 510 aa, Sorghum bicolor
MMAAEPSPSVPSTAADDLETLALDSSSSSAAATASASTDPLLRPPTSPTAASDDHFVIDDFLDEDDFSTTPSPSVVRPPRAARGDAASPVFAKITVSDPKKHAEPSGGGAAGVIPGSGSYFSYLITTRFAGGGGEVRVRRRFRDVVALADRLAAAHRGLFVPARPDKSVLEGQVIQRHDFVSQRCAALQRYLCRLAAHPIVGQSPDLRTFLTEPGAIPAFQGEAPRYWTSTVNAAAPLVPTKAGRDLFGMFKGLKQTLVNGLVATKPPPVEQETDTEFLAHKARFEDLQQQLTTTSQQAEALVKAQDDLRETTGHLGMTLIKLAKFEREQATCNSLRRRAGEIHSFANSVLKMSRSQIKLNSEIVKHLGSIHEYLEMMISVHHAFTDRSNALHYVQSLSADLFSLHTRAGRLESSSARDMGHEWSTYQKVEGLKETIRSAEAAKSDALREYESIKENNKIEIKRFDKERRHDLIEMLKGFVVTQVSYSDHFANMWTKVTEETEVYANRSN

SEQ ID NO: 7392 - protein, 509 aa, Zea mays
MMAAEPSPSVPSTAAEDMETLALDSSSSSAAATASASDPLLRPPTSPTAAASDDPFVIDDFLDEDDFTAPPPSVAGPPPAVLGDAASPVFPKITVSDPKKHAEPSGGGAAGVIPGSGSYFSYLITTRFAGGGGEVRVRRRFRDVVALADGLAAAHRGLFVPARPDKSVLEGQVLQRHNFVSQRCAALQRYLCRLAAHPIVGQSPGLRTFLTEPGAIPAFQSEAPRYWTTTVNAAAPMVQMKAGRDLFGMFKGLKQTMVNGMVATKPPPVEQETDTEFLAHKARFEDLQQQLTTTSQQAEALVKAQDGYRETTGHLGMTLIKLAKFEREQATCNSLRRRSGEIHNFANSVLKMSRSQIKLNSEIVKHLGSIHEYLEMMISVHHAFTDRSNALHYVQILSADLFSLHIRARRLESSSARDMGHEWSTYQKVEGLKETIRSAEAAKSDAVREYESIKENNKIEIKRFDKERRHDFIEMLKGFVITQVSYSDHFANMWTKVTEETEVYANRSS

SEQ ID NO: 7393 - protein, 561 aa, Zea mays
MMAAEPSPSVPSTAADALETLALDSSSSSAAATASTSTDPLLRPPTSPTAAASDDPFVIDDFDEDDFSTAPAPNVARQPRAARGDAASPVFAKITVSDPKKHAEPSGGGAAGVIPGSGSYFSYLITTRLAGGGGEVRVRRRFRDVVTLADRLAAAHRGLFVPARPDKSVLEGQVMQRHDFVSQRCAALQRYLRRLAVHPIVGHSPDLRTFLTEPGAVPAFQGEPPRYWTTTLNAAAPLVPTKARRDLFGMFKGLKQTVVNGLVATKPPPVEQETDTEFLAHKARFDDLQQQLTITSQQAEALVKAQDDLRETTGHLGMTLIKLAKFEREQATCNSLRRRAGEIHNFANSVLKMSRSQIKLNSEMVKHLGSIHEYLEMMISVHHAFTDRSNALYYVQSLSADLFSLHTRAGGLESSSARDMGHEWSTYQKVEGLKEAIRSAEAAKSDAVREYESIKENNMIEIKRFDKERRHDFIEMLKGFVVTQVSYSDHFANMWTKFDYLCRRVLFNNLLKLHEYTVYTRTALHRLLELRRGREGGESIGFEVVTLDGRTGPLSSRKVSR

SEQ ID NO: 7394 - protein, 87 aa, Saccharum officinarum
MASRWVRPEVYPLFAAMGVAVGICGFQLFRNITGNPEVRVNKAGRAAGVLENHEEGRRYAMHGLRSFVHDKTPEIMPAINKFFTEPK

SEQ ID NO: 7395 - protein, 87 aa, Zea mays
MASRWVRPEVYPLFAAMGVAVGICGFQLFRNITGNPEVRVNKAGRAAGVLENHEEGRRYAMHGLRSFVHDKTPEIMPAINKFFTDPK

SEQ ID NO: 7396 - protein, 87 aa, Zea mays
MASRWVRPEVYPLFAATGVAVGICGFQLFRNITGNPEVRVNKAGRAAGVLENHEEGRRYAMHGLRSFVHDKTPEIMPAVNKFFTDPK

SEQ ID NO: 7397 - protein, 87 aa, Pennisetum glaucum
MASRWVRPEVYPLFAAMGVAVGICGFQLFRNITGNPEVRVNKAGRAAGVLENHEEGRRYAMHGLRSFVHDKTPEIMPSINKFFTEPK

SEQ ID NO: 7398 - protein, 87 aa, Panicum virgatum
MASRWVRPEVYPLFAAMGVAVGICGFQLFRNITGNPEVRVNKAGRAAGVLENHEEGRRYAMHSLRSFVHDKTPEIMPAINKFFTEPK

SEQ ID NO: 7399 - protein, 87 aa, Panicum virgatum
MASRWVRPEVYPLFAAMGVAVGICGFQLFRNITGNPEVRVNKAGRAAGVLENHEEGRRYAMHSLRSFVHDKTPEIMPSINKFFTEPK

SEQ ID NO: 7400 - protein, 87 aa, Panicum virgatum
MASRWVRPEVYPLFVAMGVAVGICGFQLFRNITGNPEVRVNKAGRAAGVLENHEEGRRYAMHSLRSFVHDKTPEIMPAINKFFTEPK

SEQ ID NO: 7401 - protein, 87 aa, Triticum aestivum
MASRWVRPEVYPLFAAMGVAVGICGFQLFRNITGNPEVRVNKAGRAAGVLENHEEGRRYAMHGLRSFVHEKTPEIMPAINKFFTDPK

SEQ ID NO: 7402 - protein, 87 aa, Cynodon dactylon
MASRWVRPEVYPLFAAMGVAVGICGFQLVRNITGNPEVRVNKAGRAAGVLENHEEGRRYAMHSLRSFVHDKTPEIMPAINKFFTDPK

SEQ ID NO: 7403 - protein, 87 aa, Sorghum bicolor
MANRWVRPEVYPLFAAMGVAVGICGFQLFRNITGNPEVRVNKAGRAAGVLENHEEGRRYAMHGLRSFVHEKTPEIMPAINKFFTDPK

SEQ ID NO: 7404 - protein, 122 aa, Pennisetum glaucum
SGPCEEGSCSAVATPASTFPILLRRRGRLAVRRAADSDGQPLGPTRGVPAVRGDGRGRRHLRVSALQEHHRQPGRNKAGRAAGVLENHEEGRRYAMHGLRSFVHDKTPEIMPSINKFFTEPK

SEQ ID NO: 7405 - protein, 89 aa, Oryza sativa
MASSRWVRPEVYPLFAAMGVAVGICGFQLFRNITGNPEVRVNKVGRAAGVLENHEEGRRYAEHGLRNYVRDKTPEIMPAINKFFTEPTK

SEQ ID NO: 7406 - protein, 76 aa, Momordica charantia
PLFAATGVAVGICGFQLFRNITGNPEVRVNKAGRAAGVLENHEEGRRYAMHGLRSFVHDKTPEIMPAINKFFTEPK

SEQ ID NO: 7407 - protein, 88 aa, Brachypodium distachyon
MAASKWVRPEVYPLFAATGVAVGICAFQLLRNITGNPEVRVSKVGRAAGVLDNHEEGRRYAEHGLRSFVRDKTPEIMPGINKFFTDPK

SEQ ID NO: 7408 - protein, 87 aa, Unknown
  Sequence found in Organisms: Pseudoroegneria spicata, Secale cereale, Triticum aestivum
MASKWVRPEVYPLFAATGVAIGICAFSLLRNITGNPEVRVNKMGRAAGVLENHEEGRRYAEHGLRAYVQDKTPEIMPGINKFFTSPK

SEQ ID NO: 7409 - protein, 88 aa, Lolium multiflorum
MAASKWVRPEVYPLFAATGVAVGICFFSLFRNITGNPEVRVSKVGRAAGVLENHEEGRRYAEHGLRAFVQNKTPEIMPGINKFFTDPK

SEQ ID NO: 7410 - protein, 88 aa, Avena sativa
MAASKWVRPEVYPLFAATGVAVGICVFSLFRNITGNPEVRVSKVGRAAGVLENHEEGRRYAEHGLRAFVQNKTPEIMPGINKFFTGPK

SEQ ID NO: 7411 - protein, 88 aa, Avena sativa
MAASKWVRPEVYPLFAATGVAVGICVFSLFRNITGNPEVRVSKVGRAAGVLENHEEGRRYAEHGLRAFVQNKTPEIMPGINKFFTDPK

SEQ ID NO: 7412 - protein, 87 aa, Hordeum vulgare
MASKWVRPEVYPLFAATGVAIGICAFSLLRNITGNPEVRVSKMGRAAGVLENHEEGRRYAEHGLRAYVQDKTPEIMPGINKFFTSPK

SEQ ID NO: 7413 - protein, 87 aa, Leymus cinereus x Leymus triticoides
MASKWVRPEVYPLFAATGVAIGICAFSLLRNITGNPEVRVSKIGRAAGVLENHEEGRRYAEHGLRAYVQDKTPEIMPGINKFFTSPK

SEQ ID NO: 7414 - protein, 90 aa, Secale cereale
MASKWVRPEVYPLFAATGVAIGICAFSLLRNITGNPEVRVNKMGRQLECLRTMRKGGATPSTASEPMCRTRPLRSCQESTSSSPARNEAL

SEQ ID NO: 7415 - protein, 88 aa, Festuca arundinacea
  misc_feature (61)..(61): Xaa can be any naturally occurring amino acid
  misc_feature (70)..(70): Xaa can be any naturally occurring amino acid
MAASKWVRPEVYPLFAATGVAVGICFFSLFRNITGNPEVRVSKVGRAAGVLENHEEGRRYXEHGLRAFVXNKTPEIMPGINKFFTDPK

SEQ ID NO: 7416 - protein, 93 aa, Triticum aestivum
MASKWVRPEVYPLFAATGVAIGICAFSLLRNITGNPEVRVNKMGRAAGVLENHEEGRRYAEHGLRAYVQDKTPKIMPGINNSSPAQNEHFICL

SEQ ID NO: 7417 - protein, 85 aa, Secale cereale
SKWVRPEVYPLFAATGVAIGICAFSLLRNITGNPEVRVNKMGRAAGVLENHEEGRRYAEHGLRAYVQDKTPEIMPGINKFFTSPK

SEQ ID NO: 7418 - protein, 87 aa, Saccharum officinarum
MASRWVRPEVYPLFAAMGVCVCICRFQLFRNITGNPDVRVNTAGRAAGVLENHEEGRRDAMHGLKGFVHDKTCDSMPAISKFFSESK

SEQ ID NO: 7419 - protein, 158 aa, Triticum aestivum
MAFSEAQEELVLRSWKAMKPDSESIALKFFLRIFEIAPAAKPMFPFLRDAGEDAPLESHPKLKAHAVTVFVMACESATQLRKTGDVKVREATLRRLGATHVRAGVADAHFEVVKTALLDTIEGAVPEMWTPEMKAAWEEAYDQLAAAIKEEMKLAAAA

SEQ ID NO: 7420 - protein, 500 aa, Panicum virgatum
MAQLPSGSVEAELVPTLSSLEPVYGEGSQLDEARLRFARLGDRFQAVHGARPALFARSPGRVNLIGEHIDYEGYSVLPMAIRQDMIVAIRKADGGQVRVANVDDKYPVCVYPADPDKEIDIKNHKWGHYFMCGYKGVYEYCRSKGIDLGKPVALDVVVDGTVPQGSGLSSSAAFVCSATIAIMGVLEKNFPKKEVAQFTCLSERHIGTQSGGMDQAISIMAKPGFAELIDFNPIHATDVQLPRGGTFVIAHCLAESKKAETAATNYNNRVVECRLAAIVLAIKLGMDAKKAVSSVTTLSDVEGLCVSFAGNEGSSDPGVAVKKLLLEEPYTAEEIEKITGESLTSIFKSSQTSLDVIKAAKHYKLFQRASHVYSEARRVYAFRDTVSSKLSEEDKLKKLGDLMNESHYSCSVLYECSCPELEELVKICRDHGALGARLTGAGWGGCAVALVKEPIVPQFILNLKEMFYKSRIDRGVIKQTDLGLYVFASKPSSGAAIFKL

SEQ ID NO: 7421 - protein, 502 aa, Sorghum bicolor
MATLPGSAPAEAAELVPTLSSLEPVYGAGAQLDEARLRFARLGDRFHAVYGARPALFARSPGRVNLIGEHIDYEGYSVLPMAIRQDMIVAIRRADGGQVRVANVDDKYPLCVYPADPDKEIDIKNHKWGHYFMCGYKGVYEYCRSNGIDLGKPVALDVVVDGTVPQGSGLSSSAAFVCSATIAIMGVLEKNFPKKEVAQFTCLSERHIGTQSGGMDQAISIMAKPGFAELIDFNPIHATDVQLPPGGTFVIAHCLAESKKAETAATNYNNRVVECRLAAIVLAIKLGMDRKKAVSSVTTLSDVEGLCVSFAGKEGSSDPAIAVKKLLHENPYTAEEIEKITGESLTSVFQSSQTSLDVIKAAKHYKLFQRATHVYSEARRVYAFRDTVSSKLSEEDKLKKLGDLMNESHYSCSVLYECSCPELEELVKVCRDNGALGARLTGAGWGGCAVALVKEPIVPQFILNLKEMYYKSRIERGVIQQGDLGLYVFASKPSSGAAILTL

SEQ ID NO: 7422 - protein, 422 aa, Zea mays
MAIRQDMIVAIRRANGAQVRVANVDDKYPLCVYPADPDKEIDVKNHKWGHYFMCGYKGVYEYCRSKGIDLGKPVALDVVVDGTVPQGSGLSSSAAFVCSATIAIMGILDKNFPKKEVAQFTCLSERHIGTQSGGMDQAISIMAKPGFAELIDFNPIHATDVQLPSGGTFVIAHCLAESKKAETAATNYNNRVVECRLAAIVLAIKLGMDRKKAISSVTTLSDVEGLCVSFAGREGSSDPAVAVKKLLHEDPYTAGEIEKITGEGLTSVFQGSQTSLDVIKAAKHYKLFQRATHVYSEARRVYAFRDTVSSKLSEEGKLKKLGDLMNESHYSCSVLYECSCPELEELVKVCRDNGALGARLTGAGWGGCAVALVKEPIVPQFILKLKEMYYKSRIDRGVIKQGDVGLYVFASKPSSGAAILRL

SEQ ID NO: 7423 - protein, 362 aa, Avena sativa
MAQVVVAVGGEDVLGAGELVPALTSLEPVYGEGSPLDEARLRFDRLGDRVGELYGARPALFARSPGRVNLIGEHIDYEGYSVLPMAIRQDMIVAIRKADGGQVRVANVDDKYPTCVYPADPNKEIDIKNHKWGHYFMCGYKGVYEYARSKGIDMGEPVALDVVVDGTVPQGSGLSSSAAFVCSATIAIMGILEKNFPKKEVAQFTCQSERHIGTQSGGMDQAISIMAKPGFAELIDFNPIKATDVQLPPGGTFVIAHCLAESKKAETAATNYNNRVVECRLAAIVLAIKLGMATTKALSSVTTLSDVEGLCVSFAGKECSSDPGVAVKNLLHEEPYTTEEIEKITGESLSSVFQGSQTSWMS

SEQ ID NO: 7424 - protein, 506 aa, Oryza sativa
MAARVPGGGGAAAAAEAEVVPTFSSLEPIYGDGSPLDEARLRLARLADKFHAVYAARPALFARSPGRVNLIGEHIDYEGYSVLPMAIRQDMIVAIRRAEGKEVRVANVDDKYPICVYPADPDKEIDIKNHKWGHYFMCGYKGVYEYCRSKGIDMGGPVGLDVVVDGTVPTGSGLSSSAAFVCSATIAIMGVLEKNFPKKEVAQFTCQSERHIGTQSGGMDQAISIMAKPGFAELIDFNPIHATDVQLPPGGTFVIAHCLAESKKAETAATNYNNRVVECRLAAIVLAIKLGMETKKAVSSVTTLSDVEGLCVSFAGKEGSSDPGVAVKKLLHEESYTTEEIEKITGQSLTSIFQSSQTSLDVLRAAKHFKLFQRAFHVYSEARRVYAFRDTVLSKLSAEDMLQKLGDLMNESHYSCSVLYECSCPELEELVKVCRDNGALGARLTGAGWGGCAVALVKEGIVPQFILNLKETYYKSRIDRGVINQKDLGLYVFASKPSSGAAIFKL

SEQ ID NO: 7425 - protein, 505 aa, Pseudoroegneria spicata
  misc_feature (153)..(153): Xaa can be any naturally occurring amino acid
MATKEAKVVPADGVDEDLIPALSSLEPVYGAGSALDEARLRFARLGDRFRALYAAGPALFARSPGRVNLIGEHIDYEGYSVLPMAIRQDMIVAIRRADGGLVRVANVDDKYATCVYPADPDKEIDIKNHKWGHYFMCGYKGVYEYARSKGIDXGEPVALDVVVDGTVPQGSGLSSSAAFVCSATIAIMGILGKNFPKKDVAQFTCQSEHHIGTQSGGMDQAISIMAKPGFAELIDFNPIKATDVQLPSGGTFVIAHCLAESKKAETAATNYNNRVVECRLAAIVLAIKLGMDIKKAITSVTTLSDVEGLCVSFAGKEGSSDPGVAVKKLLHEEPYTLEEIEKITGQSLATVFQSSQTSLDVLRAAKHFKLFQRASHVYSEARRVYAFRDTVLSKVSEEGMLKKLGDLMNDSHHSCSVLYECSCPELEELVKVCRDNGALGARLTGAGWGGCAVALVKEGIVPQFILNLKEKYYKSRIDRGVIKQSDLGLYVFASKPSSGAAILKL

SEQ ID NO: 7426 - protein, 510 aa, Triticum aestivum
MATKEAKVVPAGDVDAAVDGEDLVPVLASLEPVYGAGSALDEARLRFARLADRFRALYAAGPALFARSPGRVNLIGEHIDYEGYSVLPMAIRQDMIVAIRRADGGLVRVANVDDKYATCVYPADPDKEIDIKNHKWGHYFMCGYKGVYEYARSKGIDMGEPVALDVVVDGTVPQGSGLSSSAAFVCSATIAIMGILGKNFPKKEVAQFTCKSERHIGTQSGGMDQAISIMAKPGFAELIDFNPIKATDVQLPSGGTFVIAHCLAESKKAETAATNYNNRVVECRLAAIVLAIKLGMDTKKAVTSVTTLSDVEGLCVSFAGKEGSSDPGVAVKKLLHEEPYTLVEIEKITGQSLATVFQSSQTSLDVLRAAKHFKLFQRASHVYSEARRVYAFRDTVLSKLSDEGMLKKLGDLMNDSHHSCSVLYECSCPELEELVKVCRDNGALGARLTGAGWGGCAVALVKEGIVPQFILNLKEKYYKSRIDRGVIKQSDLGLYVFASKPSSGAAILRL

SEQ ID NO: 7427 - protein, 510 aa, Triticum aestivum
MATKEAKVVPAGDVDAAVDGEDLVPVLASLEPVYGAGSALDEARLRFARLADRFRALYAAGPALFARSPGRVNLIGEHIDYEGYSVLPMAIRQDMIVAIRRADGGLVRVANVDDKYATCVYPADPDKEIDIKNHKWGHYFMCGYKGVYEYARSKEIDMGEPVALDVVVDGTVPQGSGLSSSAAFVCSATIAIMGILGKNFPKKEVAQFTCQSERHIGTQSGGMDQAISIMAKPGFAELIDFNPIKATDVQLPSGGTFVIAHCLAESKKAETAATNYNNRVVECRLAAIVLAIKLGMDTKKAVTSVTTLSDVEGLCVSFAGKEGSSDPGVAVKKLLHEEPYTLVEIEKITGQSLATVFQSSQTSLDVLRAAKHFKLFQRASHVYSEARWVYAFRDTVLSKLSDEGMLKKLGDLMNDSHHSCSVLYECSCPELEELVKVCRDNGALGARLTGAGWGGCAVALVKEGIVPQFILNLKEKYYKSRIDRGVIKQSDLGLYVFASKPSSGAAILRL

SEQ ID NO: 7428 - protein, 400 aa, Secale cereale
MSTTSTPPAPTPPTPTRKLTSRTTSGATTLCCGYKGVYEYARSKGIDMGEPVGLDVVVDGTVPQGSGLSSSAAFVCSATIAIMGILGKNFPKKEVAQFTCQSERHIGTQSGGMDQAISIMAKPGFAELIDFNPIKATDVQLPSGGTFVIAHCLAESKKAETAATNYNNRVVECRLAAIVLAIKLGMDTKKAVTSVTTLSDVEGLCVSFAGKEGSADPGVAVKKLLHEEPYTLEEIEKITGQSLATVFQSSQTSLDVLRAAKHFKLFQRASHVYSEARRVYAFRDTVLSKLSDEGMLKKLGDLMNDSHHSCSVLYECSCPELEELVKVCRDNGALGARLTGAGWGGCVVALVKEGIVPQFILNLKEKYYKSRIDRGVIKQSDLGLYVFASKPSSGAAILRL

SEQ ID NO: 7429 - protein, 500 aa, Brachypodium distachyon
MAHLAGGGGDELVPTLSSLETVYGAGEEEEEEARVRFGRLGDRFRALYSASPALFARSPGRVNLIGEHIDYEGYSVLPMAIRQDMIVAISKAAHGQVRVANVEDKYAACVYPADPDKEIDIKNHKWGHYFMCGYKGVYEYGRSKGIDMGEPVGLDVVVDGTVPLGSGLSSSAAFVCSATIAIMGILEKNFPKKEVAQFTCQSERHIGTQSGGMDQAISIMAKPGFAELIDFNPIKATDVQLPQGGTFVIAHCLAESKKAETAATNYNNRVVECRLAAIVLAIKLGMDTNKAISSVTTLSDVEGLCVSFAGKEGSSDPVVAVKKLLHEEPYTTEEIEKIVGKSLASAFESSPTSLDVLRAAKQFKLFQRAAHVYSEARRVYAFRDTVSSKLSEEDMLKKLGNLMNDSHYSCSVLYECSCPELEELVKVCRDNGALGARLTGAGWGGCAVALVKESIVPQFILSLKEKYYKSRIDRGVVKQSELGLYVFASKPSSGAAILKL

SEQ ID NO: 7430 - protein, 514 aa, Triticum aestivum
MATREAKATKEAKVVPAGDADADGEELVPALASLEPVYGAGPALDEARLRFARLADRFRALYSAGPALFARSPGRVNLIGEHIDYEGYSVLPMAIRQDMIVAIRRADAGLVRVANVDDKYATCVYPADPDKEIDIKNHKWGHYFMCGYKGVYEYARSKGIDMGEPVALDVVVDGTVPQGSGLSSSAAFVCSATIAIMGILGKNFPKKEVAQFTCQSERHIGTQSGGMDQAISIMAKPGFAELIDFNPIKATDVQLPSGGTFVIAHCLAESKKAETAATNYNNRVVECRLAAIVLAIKLGMDTKKAVTSVTTLSDVEGLCVSFAGKEGSSDPGVAVKKLLHEEPYTLEEIEKITGQSLATVFQSSQTSLDVLRAAKHFKLFQRASHVYSEARWVYAFRDTVLSKLSDEGMLKKLGDLMNDSHHSCSVLYECSCPELEELVKVCRDNGALGARLTGAGWGGCAVALVKEGIVPQFILNLKEKYYKSRVDRGVIKQSDLGLYVFASKPSSGAAILRL

SEQ ID NO: 7431 - protein, 505 aa, Secale cereale
MATKEAKVVPAGDVDEEMIPALAALEPVYGAGPALEEARRRFARLADRFRALYSADPALFARSPGRVNLIGEHIDYEGYSVLPMAIRQDMIVAIRRADGGLVRVANVDDKYATCLYPADPDKEIDIKNHKWGHYFMCGYKGVYEYARSKGIDMGEPVGLDVVVDGTVPQGSGLSSSAAFVCSATIAIMGILGKNFPKKEVAQFTCQSERHIGTQSGGMDQAISIMAKPGFAELIDFNPIKATDVQLPSGGTFVIAHCLAESKKAETAATNYNNRVVECRLAAIVLAIKLGMDTKKAVTSVTTLSDVEGLCVSFAGKEGSADPGVAVKKLLHEEPYTLEEIEKITGQSLATVFQSSQTSLDVLRAAKHFKLFQRASHVYSEARRVYAFRDTVLSKLSEEGMLKKLGDLMNDSHHSCSVLYECSCPELEELVKVCRDNGALGARLTGAGWGGCVVALVKEGIVPQFILNLKEKYYKSRIDRGVIKQSDLGLYVFASKPSSGAAILRL

SEQ ID NO: 7432 - protein, 505 aa, Secale cereale
MATKEAKVVPAGDVDEEMIPALAALEPVYGAGPALEEARRRFARLDDRFRALYAAGPALFARSPGRVNLIGEHIDYEGYSVLPMAIRQDMIVAIRRADGGLVRVANVDDKYATCLYPADPDKEIDIKNHKWGHYFMCGYKGVYEYARSKGIDMGEPVALDVVVDGTVPQGSGLSSSAAFVCSATIAIMGILGKNFPKKEVAQFTCQSERHIGTQSGGMDQAISIMAKPGFAELIDFNPIKATDVQLPSGGTFVIAHCLAESKKAETAATNYNNRVVECRLAAIVLAIKLGMDTKKAVTSVTTLSDVEGLCVSFAGKEGSADPGVAVKKLLHEEPYTLEEIEKITGQSLATVFQSSQTSLDVLRAAKHFKLFQRASHVYSEARRVYAFRDTVLSKLSEEGMLKKLGDLMNDSHHSCSVLYECSCPELEELVKVCRDNGALGARLTGAGWGGCVVALVKEGMVPQFILSLKEKYYKSRIDRGVIKQSDLGLYVFASKPSSGAAILRL

SEQ ID NO: 7433 - protein, 505 aa, Secale cereale
MATKEAKVVPAGDVDEEMIPALAALEPVYGAGPALEEARRRFARLDDRFRALYAAGPALFARSPGRVNLIGEHIDYEGYSVLPMAIRQDMIVAIRRADGGLVRVANVDDKYATCAYPADPNKEIDIKNHKWGHYFMCGYKGVYEYARSKGIDMGEPVALDVVVDGTVPQGSGLSSSAAFVCSATIAIMGILGKNFPKKEVAQFTCQSERHIGTQSGGMDQAISIMAKPGFAELIDFNPIKATDVQLPSGGTFVIAHCLAESKKAETAATNYNNRVVECRLAAIVLAIKLGMDTKKAVTSVTTLSDVEGLCVSFAGKEGSADPGVAVKKLLHEEPYTLEEIEKITGQSLATVFQSSQTSLDVLRAAKHFKLFQRASHVYSEARRVYAFRDTVLSKLSEEGMLKKLGDLMNDSHHSCSVLYECSCPELEELVKVCRDNGALGARLTGAGWGGCVVALVKEGIVPQFILSLKEKYYKSRIDRGVIKQSDLGLYVFASKPSSGAAILRL

SEQ ID NO: 7434 - protein, 512 aa, Hordeum vulgare
MEMATATKEGKAAKVVPAGGEDEELIPALASLEPVYGAGPALDEARLRFARLADRFRSLYAAGPALFARSPGRVNLIGEHIDYEGYSVLPMAIRQDMIVAIRRADGGLVRVASVDDKYATCAYPADPDKEIDIKNHKWGHYFMCGYKGVYEYARSKGIDMGEPVALDVVVDGTVPQGSGLSSSAAFVCSATIAIMGILGKNFPKKEVAQFTCKSERHIGTQSGGMDQAISIMAKPGFAELIDFNPIKATDVQLPSGGTFVIAHCLAESKKAETAATNYNNRVVECRLAAIVLAIKLGMDAKKAITSVTTLSDVEGLCVSFAGKEGSSDPGVAVKKLLHEDPYTLEEIEKITGQSLATVFQSSQTSLDVLRAAKHFKLFQRASHVYSEARRVYAFKDTVLSKLSDEGMLKKLGDLMNDSHHSCSVLYECSCPELEELVKVCRDNGALGARLTGAGWGGCAVALVKEGIVPQFILNLKEKYYKSRIDRGVIKQSDIGLYVFASKPSSGAAILRL

SEQ ID NO: 7435 - protein, 304 aa, Secale cereale
MATKEAKVVPAGDVDEEMIPALAALEPVYGAGPALEEARRRFARLADRFRALYSADPALFARSPGRVNLIGEHIDYEGYSVLPMAIRQDMIVAIRRADGGLVRVANVDDKYATCLYPADPDKEIDIKNHKWGHYFMCGYKGVYEYARSKGIDMGEPVALDVVVDGTVPQGSGLSSSAAFASSATIAIMGILGKNFPKKEVAQFTCQSERHIGTQSGGMDQAISIMAKPGFAELIDFNPIKATDVQLPSGGTFVIAHCLAESKKAETAATNYNNRVVECRLAAIVLAIKLGMDNKKGCHICYDPL

SEQ ID NO: 7436 - protein, 474 aa, Hordeum vulgare
GPALDEARLRFARLADRFRSLYAAGPALFARSPGRVNLIGEHIDYEGYSVLPMAIRQDMIVAIRRADGGLVRVASVDDKYATCAYPADPDKEIDIKNHKWGHYFMCGYKGVYEYARSKGIDMGEPVALDVVVDGTVPQGSGLSSSAAFVCSATIAIMGILGKNFPKKEVAQFTCKSERHIGTQSGGMDQAISIMAKPGFAELIDFNPIKATDVQLPSGGTFVIAHCLAESKKAETAATNYNNRVVECRLAAIVLAIKLGMDAKKAITSVTTLSDVEGLCVSFAGKEGSSDPGVAVKKLLHEDPYTLEEIEKITGQSLATVFQSSQTSLDVLRAAKHFKLFQRASHVYSEARRVYAFKDTVLSKLSDEGMLKKLGDLMNDSHHSCSVLYECSCPELEELVKVCRDNGALGARLTGAGWGGCAVALVKEGIVPQFILNLKEKYYKSRIDRGVIKQSDIGLYVFASKPSSGAAILRL

SEQ ID NO: 7437 - protein, 526 aa, Secale cereale
QSRGESKLLPLEPPERDRERGDGDQGGQGGSRRRRRRGDDPGAGRAGAGVRRGAALEEARRRFARLDDRFRALYAAGPALFARSPGRVNLIGEHIDYEGYSVLPMAIRQDMIVAIRRADGGLVRVANVDDKYATCAYPADPNKEIDIKNHKWGHYFMCGYKGVYEYARSKGIDMGEPVALDVVVDGTVPQGSGLSSSAAFVCSATIAIMGILGKNFPKKEVAQFTCQSERHIGTQSGGMDQAISIMAKPGFAELIDFNPIKATDVQLPSGGTFVIAHCLAESKKAETAATNYNNRVVECRLAAIVLAIKLGMDTKKAVTSVTTLSDVEGLCVSFAGKEGSADPGVAVKKLLHEEPYTLEEIEKITGQSLATVFQSSQTSLDVLRAAKHFKLFQRASHVYSEARRVYAFRDTVLSKLSEEGMLKKLGDLMNDSHHSCSVLYECSCPELEELVKVCRDNGALGARLTGAGWGGCVVALVKEGIVPQFILNLKEKYYKSRIDRGVIKQSDLGLYVFASKPSSGAAILRL

SEQ ID NO: 7438 - protein, 440 aa, Triticum aestivum
RVNLIGEHIDYEGYSVLPMAIRQDMIVAIRRADGGLVRVANVDDKYATCVYPADPDKEIDIKNHKWGHYFMCGYKGVYEYARSKGIDMGEPVALDVVVDGTVPQGSGLSSSAAFVCSATIAIMGILGKNFPKKEVAQFTCQSERHIGTQSGGMDQAISIMAKPGFAELIDFNPIKATDVQLPSGGTFVIAHCLAESKKAETAATNYNNRVVECRLAAIVLAIKLGMDTKKAVTSVTTLSDVEGLCVSFAGKEGSSDPGVAVKKLLHEEPYTLEEIEKITGQSLATVFQSSQTSLDVLRAAKHFKLFQRASHVYSEARRVYAFRDTVLSKLSDEGMLKKLGDLMNDSHHSCSVLYECSCPELEELVKVCRDNGALGARLTGAGWGGCAVALVKEGIVPQFILNLKEKYYKSRIDRGVIKQSDLGLYVFASKPSSGAAILRL

SEQ ID NO: 7439 - protein, 195 aa, Pennisetum glaucum
MVHVNFYRNYGKTFKKPRRPYEKERLDAELKLVGEYGLRCKRELWRVQYALSRIRNAARHLLTLDEKNPRRIFEGEALLRRMNRYGLLAEGQNKLDYVLALTAENFLARRLQTLVFKAGMAKSIHHARVLIKQRHIRVGRQIVNVPSFMVRVESEKHIDFSLSSPFGGGPPGRVKRKNQKKATGGGGDGGDEDEE

SEQ ID NO: 7440 - protein, 195 aa, Unknown
  Sequence found in Organisms: Saccharum officinarum, Panicum virgatum
MVHVSFYRNYGKTFKKPRRPYEKERLDAELKLVGEYGLRCKRELWRVQYALSRIRNAARHLLTLDEKNPRRIFEGEALLRRMNRYGLLAEGQNKLDYVLALTAENFLARRLQTLVFKAGMAKSIHHARVLIKQRHIRVGRQIVNVPSFMVRVESEKHIDFSLSSPFGGGPPGRVKRKNQKKASGGGGDGGDEDEE

SEQ ID NO: 7441 - protein, 195 aa, Sorghum bicolor
MVHVSFYRNYGKTFKKPRRPYEKERLDAELKLVGEYGLRCKRELWRVQYALSRIRNAARHLLTLDEKNPRRIFEGEALLRRMNRYGLLAEGQNKLDYVLALTAENFLARRLQTLVFKAGMAKSIHHARVLIKQRHIRVGRQIVNVPSFMVRVESEKHIDFSLSSPFGGGPPGRVKRKNLKKASGGGGDGGDEDEE

SEQ ID NO: 7442 - protein, 129 aa, Pennisetum glaucum
MVHVNFYRNYGKTFKKPRRPYEKERLDAELKLVGEYGLRCKRELWRVQYALSRIRNAARHLLTLDEKNPRRIFEGEALLRRMNRYGLLAEGQTSLITSLPSLLRTSSQGAFRLLSSRLAWPSPSTMLVS

SEQ ID NO: 7443 - protein, 195 aa, Triticum aestivum
MVHVSFYRNYGKTFKKPRRPYEKERLDAELKLVGEYGLRCKRELWRVQYALSRIRNAARHLLTLDEKNPRRIFEGEALLRRMNRYGLLAEGQNKLDYVLALTAENFLARRLQTLVFKAGMANSIHHARVLIKQRHIRVGRQIVNVPSFMVRVESEKHIDFSLSSPFGGGPPGRVKRKNLKKASGGGGDGGDEDEE

SEQ ID NO: 7444 - protein, 195 aa, Eragrostis curvula
MVHVNFYRNYGKTFKKPRRPYEKERLDAELKLVGEYGLRCKRELWRVQYALSRIRNAARHLLTLDEKNPRRIFEGEALLRRMNRYGLLAEGQNKLDYVLALTAENFLARRLQTLVFKAGMAKSIHHARVLIRQRHIRVGRQIVNVPSFMVRVESEKHVDFSLTSPFGGGPPGRVKRKNQKKASGGGGDGGDEDEE

SEQ ID NO: 7445 - protein, 194 aa, Zea mays
MVHVNFYRNYGKTFKKPRRPYEKERLDAELKLVGEYGLRCKRELWRVQYALSRIRNAARHLLTLDEKNPRRIFEGEALLRRMNRYGLLAEGQNKLDYVLALTAENFLARRLQTLVFKAGMAKSIHHARVLIKQRHIRVGRQIVNVPSFMVRVESEKHIDFSLSSPFGGGPAGRVKRKNQKKASGGGDAGDEDEE

SEQ ID NO: 7446 - protein, 195 aa, Brachypodium distachyon
MVHVNFYRNYGKTFKKPRRPYEKERLDAELKLVGEYGLRCKRELWRVQYALSRIRNAARHLLTLDEKNPRRIFEGEALLRRMNRYGLLAEGQNKLDYVLALTAENFLARRLQTLVFKAGMAKSIHHARVLIRQRHIRVGRQIVNVPSFMVRVESEKHIDFSLTSPFGGGQPGRVKRKNQKKASGGGDAGGDEDEE

SEQ ID NO: 7447 - protein, 82 aa, Pennisetum glaucum
MVHVNFYRNYGKTFKKPRRPYEKERLDAELKLVGEYGLRCKRELWRVQYALSRIRNAARHCGHDLTRRTPAVSLRVRRCSAA

SEQ ID NO: 7448 - protein, 195 aa, Lolium multiflorum
MVHVNFYRNYGKTFKKPRRPYEKERLDAELKLVGEYGLRCKRELWRVQYALSRIRNAARHLLTLDEKNPRRIFEGAALLRRMNRYGLLAEGQDKLDYVLALTAENFLARRLQTLVFKAGMAKSIHHARVLIRQRHIRVGRQIVNVPSFMVRVESEKHIDFSLTSPFGGGPAGRVKRKNQKKASGGGDAGGDEDEE

SEQ ID NO: 7449 - protein, 195 aa, Oryza sativa
MVHVSFYRNYGKTFKKPRRPYEKERLDAELKLVGEYGLRCKRELWRVQYALSRIRNNARHLLTLDEKNPRRIFEGEALLRRMNRYGLLADGQNKLDYVLALTVENFLARRLQTLVFKAGMAKSIHHARVLIRQRHIRVGRQIVNIPSFMVRVESEKHIDFSLTSPFGGGPPGRVKRKNQKKASGGGGDGEEEDEE

SEQ ID NO: 7450 - protein, 195 aa, Unknown
  Sequence found in Organisms: Hordeum vulgare, Pseudoroegneria spicata, Secale cereale, Triticum aestivum
MVHVNFYRNYGKTFKKPRRPYEKERLDAELKLVGEYGLRCKRELWRVQYALSRIRNAARHLLTLDEKNPRRIFEGAALLRRMNRYGLLAEGQDKLDYVLALTAENFLARRLQTLVFKAGMAKSIHHARVLIRQRHIRVGRQIVNVPSFMVRVESEKHIDFSLTSPFGGGPAGRVKRKNQKKASGGGDAGGDEEEE

SEQ ID NO: 7451 - protein, 195 aa, Leymus cinereus x Leymus triticoides
MVHVNFYRNYGKTFKKPRRPYEKERLDAELKLVGEYGLRCKRELWRVQYALSRIRNAARHLLTLDEKNPRRIFEGAALLRRMNRYGLLAVGQDKLDYVLALTAENFLARRLQTLVFKAGMAKSIHHARVLIRQRHIRVGRQIVNVPSFMVRVESEKHIDFSLTSPFGGGPAGRVKRKNQKKASGGGDAGGDEDEE

SEQ ID NO: 7452 - protein, 195 aa, Avena sativa
MVHVNFYRNYGKTFKKPRRPYEKERLDAELKLVGEYGLRCKRELWRVQYALSRIRNAARHLLTLDEKNPRRIFEGAALLRRMNRYGLLAEGQDKLDYVLALTAENFLARRLQTLVFKAGMAKSIHHARVLIRQRHIRVGRQIVNVPSFMVRVESEKHIDFSLTSPFGGGLPGRVKRKNLKKASGGGDAGGDEDEE

SEQ ID NO: 7453 - protein, 65 aa, Secale cereale
MVHVNFYRNYGKTFKKPRRPYEKERLDAELKLVGEYGLRCKRELWRVQYALSRIRNAARHLRHTG

SEQ ID NO: 7454 - protein, 195 aa, Brachypodium distachyon
MVHVNFYRNYGKTFKKPRRPYEKERLDAELKLVGEYGLRCKRELWRVQYALSRIRNNARHLLTLDEKNPRRIFEGEALLRRMNRYGLLADGQNKLDYVLALTVENFLARRLQTLVFKAGMAKSIHHARVLIRQRHIRVGKQIVNIPSFMVRVDSEKHIDFSLTSPFGGGNPGRVKRKNQKKASGGGGGGEEEDEE

SEQ ID NO: 7455 - protein, 194 aa, Setaria italica
MVHVSFYRNYGKTFKKPRRPYEKERLDAELKLVGEYGLRCKRELWRVQYALSRIRNAARELLTLDEKNPRRIFEGEALLRRMNRYGLLGEGQNKLDYVLALTVENFLQRRLQTIVFKNGMAKSIHHARVLIRQRHIRVGRQLVNIPSFMVRVESEKHIDFSLTSPLGGGPAGRVKRKNQNKATGGGGDAEEDEE

SEQ ID NO: 7456 - protein, 194 aa, Pennisetum glaucum
MVHVSFYRNYGKTFKKPRRPYEKERLDAELKLVGEYGLRCKRELWRVQYALSRIRNAARELLTLDEKNPRRIFEGEALLRRMNRYGLLGEGQNKLDYVLALTVENFLQRRLQTIVFKNGMAKSIHHARVLIRQRHIRVGRQLVNIPSFMVRVDSEKHIDFSLTSPLGGGEPGRVKRKNQKKATGGGGDGDEDEE

SEQ ID NO: 7457 - protein, 194 aa, Setaria italica
MVHVSFYRNYGKTFKKPRRPYEKERLDAELKLVGEYGLRCKRELWRVQYALSRIRNAARELLTLDEKNPRRIFEGEALLRRMNRYGLLGEGQNKLDYVLALTVENFLQRRLQTIVFKNGMAKSIHHARVLIRQRHIRVGRQLVNIPSFMVRVDSEKHVDFSLTSPLGGGEPGRVKRKNQNKASGGGGDGDEDEE

SEQ ID NO: 7458 - protein, 194 aa, Panicum virgatum
MVHVSFYRNYGKTFKKPRRPYEKERLDAELKLVGEYGLRCKRELWRVQYALSRIRNAARELLTLDEKNPRRIFEGEALLRRMNRYGLLGEGQNKLDYVLALTVENFLQRRLQTIVFKNGMAKSIHHARVLIRQRHIRVGRQLVNIPSFMVRVDSEKHIDFSLTSPLGGGEPGRVKRKNQKKASGGGGDGDEDEE

SEQ ID NO: 7459 - protein, 194 aa, Pennisetum glaucum
MVHVNFYRNYGKTFKKPRRPYEKERLDAELKLVGEYGLRCKRELWRVQYALSRIRNAARELLTLDEKNPRRIFEGEALLRRMNRYGLLGEGQNKLDYVLALTVENFLQRRLQTIVFKNGMAKSIHHARVLIRQRHIRVGRQLVNIPSFMVRVESEKHIDFSLTSPLGGGPAGRVKRKNQKKASGGGGDGEEDEE

SEQ ID NO: 7460 - protein, 194 aa, Sorghum bicolor
MVHVSFYRNYGKTFKKPRRPYEKERLDAELKLVGEYGLRCKRELWRVQYALSRIRNAARELLTLDEKNPRRIFEGEALLRRMNRYGLLGEGQNKLDYVLALTVENFLQRRLQTIVFKNGMAKSIHHARVLIRQRHIRVGRQLVNIPSFMVRVESEKHIDFSLTSPLGGGPAGRVKRKNQKKASGGGDDGEDDDE

SEQ ID NO: 7461 - protein, 194 aa, Saccharum officinarum
MVHVSFYRNYGKTFKKPRRPYEKERLDAELKLVGEYGLRCKRELWRVQYALSRIRNAARELLTLDEKNPRRIFEGEALLRRMNRYGLLGEGQNKLDYVLALTVENFLQRRLQTIVFKNGMAKSIHHARVLIRQRHIRVGRQLVNIPSFMVRVESEKHIDFSLTSPLGGGPAGRVKRKNQKKASGGGGDGEEDDE

SEQ ID NO: 7462 - protein, 194 aa, Panicum virgatum
MVHVSFYRNYGKTFKKPRRPYEKERLDAELKLVGEYGLRCKRELWRVQYALSRIRNAARELLTLDEKNPRRIFEGEALLRRMNRYGLLGEGQNKLDYVLALTVENFLQRRLQTIVFKNGMAKSIHHARVLIRQRHIRVGRQLVNIPSFMVRVESEKHIDFSLTSPLGGGPAGRVKRKNQKKASGGGGDGEDDEE

SEQ ID NO: 7463 - protein, 193 aa, Zea mays
MVHVNFYRNYGKTFKKPRRPYEKERLDAELKLVGEYGLRCKRELWRVQYALSRIRNAARELLTLDEKNPRRIFEGEALLRRMNRYGLLGEGQNKLDYVLALTVENFLQRRLQTIVFKNGMAKSIHHARVLIRQRHIRVGRQLVNIPSFMVRVDSEKHIDFSLTSPLGGGEPGRVKRKNQKKASGGGGDDEEEE

SEQ ID NO: 7464 - protein, 193 aa, Zea mays
MVHVNFYRNYGKTFKKPRRPYEKERLDAELKLVGEYGLRCKRELWRVQYALSRIRNAARELLTLDEKNPRRIFEGEALLRRMNRYGLLGEGQNKLDYVLALTVENFLQRRLQTIVFKNGMAKSIHHARVLIRQRHIRVGRQLVNIPSFMVRVESEKHIDFSLTSPLGGGPAGRVKRKNQKKASGGGDAEEDEE

SEQ ID NO: 7465 - protein, 194 aa, Sorghum bicolor
MVHVSFYRNYGKTFKKPRRPYEKERLDAELKLVGEYGLRCKRELWRVQYALSRIRNAARELLTLDEKNPRRIFEGEALLRRMNRYGLLGEGQNKLDYVLALTVENFLQRRLQTIVFKNGMAKSIHHARVLIRQRHIRVGRQLVNIPSFMVRVESEKHIDFSLTSPLGGGPAGRVKRKNQKKASGGGDDGEEDDE

SEQ ID NO: 7466 - protein, 193 aa, Saccharum officinarum
MVHVSFYRNYGKTFKKPRRPYEKERLDAELKLVGEYGLRCKRELWRVQYALSRIRNAARELLTLDEKNPRRIFEGEALLRRMNRYGLLGEGQNKLDYVLALTVENFLQRRLQTIVFKNGMAKSIHHARVLIRQRHIRVGRQLVNIPSFMVRVDSEKHIDFSLTSPLGGGEPGRVKRKNSKKASGGGGDDEEEE

SEQ ID NO: 7467 - protein, 194 aa, Panicum virgatum
MVHVSFYRNYGKTFKKPRRPYEKERLDAELKLVGEYGLRCKRELWRVQYALSRIRNAARELLTLDEKNPRRIFEGEALLRRMNRYGLLGEGQNKLDYVLALTVENFLQRRLQTIVFKNGMAKSIHHARVLIRQRHIRVGRQLVNIPSFMVRVESEKHIDFSLTSPLGGGPAGRVKRKNQKKASGGGDDGEDDEE

SEQ ID NO: 7468 - protein, 102 aa, Eragrostis curvula
  misc_feature (18)..(18): Xaa can be any naturally occurring amino acid
MVHVNFYRNYGKTFKKPXRPYEKERLDAELKLVGEYGLRCKRELWRVQYALGRIRNAARELLTLDEKNPRRIFEGEALLRRMNRMVSLVRARTSLIMSLRSL

SEQ ID NO: 7469 - protein, 197 aa, Curcuma longa
MVHVSFYRNYGKTFKKPRRPYEKERLDAELKLVGEYGLRCKRELWRVQYALSRIRNAARELLTLDEKNPRRIFEGEALLRRMNRYGLLEEGQNKLDYVLALTVENFLERRLQTLVFKSGMAKSIHHARVLIRQRHIRVGRQVVNIPSFMVRVDSAKHIDFSLTSPFGGGRPGRVKRKNQKAAAKKAAGGDGDDDDEE

SEQ ID NO: 7470 - protein, 197 aa, Solanum melongena
MVHVSFYRNYGKTFKKPRRPYEKERLDAELKLVGEYGLRCKRELWRVQYALSRIRNAARMLLTLDEKDPRRIFEGEALLRRMNRYGLLDESQNKLDYVLALTVENFLERRLQTLVFKTGMAKSIHHARVLIRQRHIRVGRQVVNVPSFMVRVDSQKHIDFSLTSPFGGGRPGRVKRKNQKSAAKKAAGGDGDDEDEE

SEQ ID NO: 7471 - protein, 197 aa, Fraxinus spp
MVHVSFYRNYGKTFKKPRRPYEKERLDAELKLVGEYGLRCKRELWRVQYALSRIRNAARNLLTLDEKDPRRIFEGEALLRRMNRYGLLDESQNKLDYVLALTVENFLERRLQTLVFKAGMAKSIHHARVLIRQRHIRVGRQVVNVPSFMVRVDSQKHIDFSLTSPFGGGRPGRVKRKNQKAAAKKASGGDGDEEDEE

SEQ ID NO: 7472 - protein, 195 aa, Brachypodium distachyon
MVHVNFYRNYGKTFKKPRRPYEKERLDAELKLVGEYGLRCKRELWRVQYALSRIRNAARELLTLDEKSPRRIFEGEALLRRMNRYGLLAEDQNKLDYVLALTVENFLQRRLQTIVFKNGMAKSIHHARVLIRQRHIRVGRQLVNIPSFMVRVATEKHIDFSLTSPLGGGPAGRVKRKNQKKASGGGGGDGDEEEE

SEQ ID NO: 7473 - protein, 195 aa, Brachypodium distachyon
MVHVNFYRNYGKTFKKPRRPYEKERLDAELKLVGEYGLRCKRELWRVQYALSRIRNAARELLTLDEKSPRRIFEGEALLRRMNRYGLLAEDQNKLDYVLALTVENFLQRRLQTIVFKNGMAKSIHHARVLIRQRHIRVGRQLVNIPSFMVRVDTEKHIDFSLTSPLGGGEPGRVKRKNQKKASGGGGGDGDEEEE

SEQ ID NO: 7474 - protein, 230 aa, Musa acuminata
MVHVSFYRNYGKTFKKPRRPYEKERLDAELKLVGEYGLRCKRELWRVQYALSRIRNAARDLLTLDEKNPRRIFEGEALLRRMNRYGLLEEGQNKLDYVLALTVENFLERRLQTLVFKSGMAKSIHHARVLIRQRHIRVGRQVVNIPSFMVRVDSAKHIDFSLTSPFGGGRPGRVKRKNQKAAAKKQLEATATRMMRNEQYALDISFPCDHHHMDDFDVSAFWDIGAIFIF

SEQ ID NO: 7475 - protein, 197 aa, Musa acuminata
MVHVSFYRNYGKTFKKPRRPYEKERLDAELKLVGEYGLRCKRELWRVQYALSRIRNAARDLLTLDEKNPRRIFEGEALLRRMNRYGLLEEGQNKLDYVLALTVENFLERRLQTLVFKSGMAKSIHHARVLIRQRHIRVGRQVVNIPSFMVRVDSAKHIDFSLTSPFGGGRPGRVKRRNQKAAAKKAAGGDGDEEDEE

SEQ ID NO: 7476 - protein, 197 aa, Musa acuminata
MVHVSFYRNYGKTFKKPRRPYEKERLDAELKLVGEYGLRCKRELWRVQYALSRIRNAARDLLTLDEKNPRRIFEGEALLRRMNRYGLLEEGQNKLDYVLALTVENFLERRLQTLVFKSGMAKSIHHARVLIRQRHIRVGRQVVNIPSFMVRVDSAKHIDFSLTSPFGGGRPGRVKRKNQKAAAKKAAGGDGDEDDEE

SEQ ID NO: 7477 - protein, 197 aa, Capsicum annuum
MVHVNFYRNYGKTFKKPRRPYEKERLDAELKLVGEYGLRCKRELWRVQYALSRIRNAARMLLTLDEKDPRRIFEGEALLRRMNRYGLLDESQNKLDYVLALTVENFLERRLQTLVFKTGMAKSIHHARVLIRQRHIRVGRQVVNVPSFMVRVDSQKHIDFSLTSPFGGGRPGRVKRKNQTAATKKASGGDGDEEDEE

SEQ ID NO: 7478 - protein, 197 aa, Unknown
  Sequence found in Organisms: Manihot esculenta, Hevea brasiliensis
MVHVSFYRNYGKTFKKPRRPYEKERLDAELKLVGEYGLRCKRELWRVQYALSRIRNAARMLLTLDEKNPRRIFEGEALLRRMNRYGLLDESQNKLDYVLALTVENFLERRLQTLVFKSGMAKSIHHARVLIRQRHIRVGRQVVNIPSFMVRVDSQKHIDFSLTSPFGGGRPGRVKRKNQRAANKKSSGGDGDEEDEE

SEQ ID NO: 7479 - protein, 196 aa, Curcuma longa
MVHVSFYRNYGKTFKKPRRPYEKERLDAELKLVGEYGLRCKRELWRVQYALSRIRNAARELLTLDEKNPRRIFEGEALLRRMNRYGLLEEGQNKLDYVLALTVENFLERRLQTLVFKSGMAKSIHHARVLIRQRHIRVGRQVVNIPSFMVRVDSAKHIDFSLTSPFGGGRPGRVKRKNQKAAAKKAAGGDDEEDEE

SEQ ID NO: 7480 - protein, 197 aa, Solanum melongena
MVHVSFYRNYGKTFKKPRRPYEKERLDAELKLVGEYGLRCKRELWRVQYALSRIRNAARMLLTLDEKDPRRIFEGEALLRRMNRYGLLDESQNKLDYVLALTVENFLERRLQTLVFKTGMAKSIHHARVLIRQRHIRVGRQVVNVPSFMVRVDSQKHIDFSLTSPFGGGRPGRVKRKNQKAAAKKAGGGDGDEDDEE

SEQ ID NO: 7481 - protein, 197 aa, Hevea brasiliensis
MVHVSFYRNYGKTFKKPRRPYEKERLDAELKLVGEYGLRCKRELWRVQYALSRIRNAARMLLTLDEKNPRRIFEGEALLRRMNRYGLLDESQNKLDYVLALTVENFLERRLQTLVFKSGMAKSIHHARVLIRQRHIRVGRQVVNIPSFMVRVDSQKHIDFSLTSPFGGGRPGRVKRKNQRAASKKASGGDGDEEDEE

SEQ ID NO: 7482 - protein, 197 aa, Actinidia deliciosa
MVHVSFYRNYGKTFKKPRRPYEKERLDAELKLVGEYGLRCKRELWRVQYALSRIRNAARMLLTLDEKNPRRIFEGEALLRRMNRYGLLEESQNKLDYVLALTVENFLERRLQTLVFKTGMAKSIHHARVLIKQRHIRVGRQVVNIPSFMVRVDSQKHIDFSLTSPLGGGRPGRVKRKNQKAAAKKAAGGDGDDQDEE

SEQ ID NO: 7483 - protein, 197 aa, Petunia hybrida
MVHVSFYRNYGKTFKKPRRPYEKERLDAELKLVGEYGLRCKRELWRVQYALSRIRNAARMLLTLDEKDPRRIFEGEALLRRMNRYGLLDESQNKLDYVLALTVENFLERRLQTLVFKTGMAKSIHHARVLIRQRHIRVGRQVVNVPSFMVRVDSQKHIDFSLTSPFGGGRPGRVKRKNQKSAAKKAAGGDGDEEDEE

SEQ ID NO: 7484 - protein, 197 aa, Populus trichocarpa
MVHVSFYRNYGKTFKKPRRPYEKERLDAELKLVGEYGLRAKRELWRVQYALSRIRNAARMLLTLDEKNQRRIFEGEALLRRMNRYGLLEESQNKLDYVLALTVENFLERRLQTLVFKAGMAKSIHHARVLIKQRHIRVGRQVVNIPSFMVRVDSQKHIDFSLTSPFGGGRPGRVKRKNQKAASKKAAGGDGDEEDEE

SEQ ID NO: 7485 - protein, 194 aa, Eragrostis curvula
  misc_feature (9)..(9): Xaa can be any naturally occurring amino acid
  misc_feature (134)..(134): Xaa can be any naturally occurring amino acid
  misc_feature (142)..(142): Xaa can be any naturally occurring amino acid
  misc_feature (147)..(148): Xaa can be any naturally occurring amino acid
MVHVNFYRXYGKTFKKPRRPYEKERLDAELKLVGEYGLRCKRELWRVQYALSRIRNAARELLTLDEKNPRRIFEGEALLRRMNRYGLLGEGQNKLDYVLALTIENFLQRRLQTIVFKNGMAKSIHHARVLIRQXHIRVGRQXVNIPXXMVRLESEKHIDFSLTSPLGGGPAGRVKRKNQKKASGGGGDGEEDEE

SEQ ID NO: 7486 - protein, 197 aa, Musa acuminata
MVHVSFYRNYGKTFKKPRRPYEKERLDAELKLVGEYGLRCKRELWRVQYALSRIRNAARDLLTLDEKNPRRIFEGEALLRRMNRYGLLEEGQNKLDYVLALTVENFLERRLQTLVFKSGMAKSIHHARVLIRQRHIRVGRQVVNIPSFMVRVDSAKHIDFSLTSPFGGGRPGRVKRRNQKAAAKKAAGGDGDEDDEE

SEQ ID NO: 7487 - protein, 197 aa, Musa acuminata
MVHVSFYRNYGKTFKKPRRPYEKERLDAELKLVGEYGLRCKRELWRVQYALSRIRNAARDLLTLDEKNPRRIFEGEALLRRMNRYGLLEEGQNKLDYVLALTVENFLERRLQTLVFKSGMAKSIHHARVLIRQRHIRVGRQVVNIASFMVRVDSAKHIDFSLTSPFGGGRPGRVKRKNQKAAAKKATGGDGDEDDEE

SEQ ID NO: 7488 - protein, 197 aa, Beta vulgaris
MVHVCFYRNYGKTFKKPRRPYEKERLDAELKLVGEYGLRNKRELWRVQYVLSRIRNAARHLLTLDEKNPRRIFEGEALLRRMHRHGLLDEGQNKLDYVLALTVENFLERRLQTLVFKSGMAKSIHHARVLIKQRHIRVGRQVVNIPSFMVRVDSQKHIDFSLSSPFGGGRPGRVKRKNQKAAAKKAAGGDGDEEDEE

SEQ ID NO: 7489 - protein, 197 aa, Unknown
  Sequence found in Organisms: Gossypium hirsutum, Gossypium raimondii
MVHVSFYRNYGKTFKKPRRPYEKERLDAELRLVGEYGLRCKRELWRVQYALSRIRNAARDLLTLDEKNPRRIFEGEALLRRMNRYGLLDESQNKLDYVLALTVENFLERRLQTLVFKTGMAKSIHHARVLIRQRHIRVGRQVVNIPSFMVRVDSQKHIDFSLTSPFGGGRPGRVKRKNQRAAAKKAAGGDGDEEDEE

SEQ ID NO: 7490 - protein, 197 aa, Amaranthus tuberculatus
MVHVSFYRNYGKTFKKPRRPYEKERLDAELKLVGEYGLRNKRELWRVQYVLSRIRNAARHLLTLDEKNPRRIFEGEALLRRMNRYGLLDEGQNKLDYVLALTVENFLERRLQTLVFKSGMAKSIHHARVLIRQRHIRVGRQVVNIPSFMVRLDSQKHIDFSLTSPFGGGRPGRVKRKNQKAAAKKAAGGDGDEEDEE

SEQ ID NO: 7491 - protein, 197 aa, Manihot esculenta
MVHVSFYRNYGKTFKKPRRPYEKERLDAELKLVGEYGLRCKRELWRVQYALSRIRNAARMLLTLDEKNPRRIFEGEALLRRMNRYGLLDESQNKLDYVLALTVENFLERRLQTLVFKSGMAKSIHHARVLIRQRHIRVGRQVVNIPSFMVRVDSQKHIDFSLTSPFGGGRPGRVKRKNQRAASKKASGGDGDEDDEE

SEQ ID NO: 7492 - protein, 197 aa, Manihot esculenta
MVHVSFYRNYGKTFKKPRRPYEKERLDAELKLVGEYGLRCKRELWRVQYALSRIRNAARMLLTLDEKNPRRIFEGEALLRRMNRYGLLDESQNKLDYVLALTVENFLERRLQTLVFKSGMAKSIHHARVLIRQRHIRVGRQVVNIPSFMVRVDSQNHIDFSLTSPFGGGRPGRVKRKNQRAASKKASGGDGDEEDEE

SEQ ID NO: 7493 - protein, 196 aa, Ricinus communis
MVHVSFYRNYGKTFKKPRRPYEKERLDAELKLVGEYGLRCKRELWRVQYALSRIRNAARMLLTLDEKNQRRIFEGEALLRRMNRYGLLDESQNKLDYVLALTVENFLERRLQTLVFKSGMAKSIHHARVLIRQRHIRVGRQVVNIPSFMVRVDSQKHIDFSLTSPFGGGRPGRVKRKNQRAASKKNSGDGEEEDEE

SEQ ID NO: 7494 - protein, 197 aa, Fraxinus spp
MVHVSFYRNYGKTFKKPRRPYEKERLDAELKLVGEYGLRCKRELWRVQYALSRIRNAARNLLTLDEKDPRRIFEGEALLRRMNRYGLLDESQNKLDYVLALTVENFLERRLQTLVFKAGMAKSIHHARVLIRQRHIRVGRQVVNVPSFMVRVDSQKHIDFSLTSPFGGGRPGRVKRRNQKAAAKKASGGDGDEDDEE

SEQ ID NO: 7495 - protein, 197 aa, Fraxinus spp
MVHVSFYRNYGKTFKKPRRPYEKERLDAELKLVGEYGLRCKRELWRVQYALSRIRNAARNLLTLDEKDPRRIFEGEALLRRMNRYGLLDESQNKLDYVLALTVENFLERRLQTCVFKAGMAKSIHHARVLIRQRHIRVGRQVVNVPSFMVRVDSQKHIDFSLTSPFGGGRPGRVKRKNQKAAAKKASGGDGDEDDEE

SEQ ID NO: 7496 - protein, 197 aa, Zingiber officinale
  misc_feature (58)..(58): Xaa can be any naturally occurring amino acid
MVHVSFYRNYGKTFKKPRRPYEKERLDAELKLVGEYGLRCKRELWRVQYALSRIRNAXRELLTLDEKNPRRIFEGEALLRRMNRYGLLGEGQNKLDYVLALTVENFLERRLQTLVFKSGMAKSIHHARVLIRQRHIRVGRQVVNIPSFMVRVDSAKHIDFSLTSPFGGGRPGRVKRKNQKAAAKKAAGGDGDEDDEE

SEQ ID NO: 7497 - protein, 197 aa, Ipomoea batatas
MVHVSFYRNYGKTFKKPRRPYEKERLDAELKLVGEYGLRCKRELWRVQYALSRIRNNARMLLTLDEKDPRRIFEGDALLRRMNRYGLLDESQNKLDYVLALTVENFLERRLQTLVFKAGMAKSIHHARVLIRQKHIRVGRQVVNVPSFMVRVDSQKHIDFSLSSPFGGGRPGRVKRKNQKAAAKKAAGGDGDEEDEE

SEQ ID NO: 7498 - protein, 197 aa, Lactuca sativa
MVHVSFYRNYGKTFKKPRRPYEKERLDAELKLVGEYGLRCKRELWRVQYALSRIRNAARMLLTLEEKDPRRIFEGEALMRRMNRYGLLDESQNKLDYVLALTVENFLERRLQTLVFKTGMAKSIHHARVLIKQRHIRVGRQVVNVPSFMVRVDSQKHIDFSLTSPFGGGRPGRVKRKNQKAAAKKASGGDGDEEDEE

SEQ ID NO: 7499 - protein, 197 aa, Olea europaea
MVHVSFYRNYGKTFKKPRRPYEKERLDAELKLVGEYGLRCKRELWRVQYALSRIRNAARNLLTLDEKDPRRIFEGEALLRRMNRYGLLDESQNKLDYVLALTVENFLERRLQTLVFKAGMAKSIHHARVLIRQRHIRVGRQVVNVPSFMVRVDSQKHIDFSLTSPFGGGRPGRVKRKNQKAAAKKASGGDGDEEDKK

SEQ ID NO: 7500 - protein, 197 aa, Capsicum annuum
MVHVSFYRNYGKTFKKPRRPYEKERLDAELKLVGEYGLRCKRELWRVQYALSRIRNAARMLLTLDDKDPRRIFEGEALLRRMNRYGLLDESQNKLDYVLALTVENFLERRLQTLVFKTGMAKSIHHARVLIRQRHIRVGRQVVNVPSFMVKVDSQKHIDFSLSSPFGGGRPGRVKRKNQKAAAKKAAGGDGDEEDEE

SEQ ID NO: 7501 - protein, 197 aa, Ananas comosus
MVHVSFYRNYGKTFKKPRRPYEKERLDAELKLVGEYGLRCKRELWRVQYALSRIRNAARELLTLDEKNPRRIFEGEALLRRMNRYGLLGENQNKLDYVLALTVENFLERRLQTIVFKTGMAKSIHHARVLIRQRHIRVGRQLVNIPSFMVRVDSEKHIDFSLTSPFGGGRPGRVKRKNMKNAAKKAAGGDGDEEDEE

SEQ ID NO: 7502 - protein, 197 aa, Populus trichocarpa
MVHVSFYRNYGKTFKKPRRPYEKERLDAELKLVGEYGLRAKRELWRVQYALSRIRNAARMLLTLDEKNSRRIFEGEALLRRMNRYGLLEESQNKLDYVLALTVENFLERRLQTLVFKAGMAKSIHHARVLIKQKHIRVGRQVVNIPSFMVRVDSQKHIDFSLTSPFGGGRPGRVKRKNQKSAAKKASGGDGDEEDEE

SEQ ID NO: 7503 - protein, 197 aa, Populus trichocarpa
MVHVSFYRNYGKTFKKPRRPYEKERLDAELKLVGEYGLRAKRELWRVQYALSRIRNAARMLLTLDEKNPRRIFEGEALLRRMNRYGLLEENQNKLDYVLALTVENFLERRLQTLVFKAGMAKSIHHARVLIKQRHTRVGRQVVNIPSFMVRVDSQKHIDFSLTSPLGGGRPGRVKRKNQKAAAKKATGGDGDEEDEE

SEQ ID NO: 7504 - protein, 197 aa, Solanum lycopersicum
MVHVSFYRNYGKTFKKPRRPYEKERLDAELKLVGEYGLRCKRELWRVQYALSRIRNAARMLLTLDEKDPRRIFEGEALLRRMNRYGLLDESQNKLDYVLALTVENFLERRLQTLVFKTGMAKSIHHARVLIRQRHIRVGRQVVNVASFMVRVDSQKHIDFSLTSPFGGGRPGRVKRKNQKSAAKKAAGGDGDEEDEE

SEQ ID NO: 7505 - protein, 197 aa, Utricularia gibba
MVHVSFYRNYGKTFKKPRRPYEKERLDAELKLVGEYGLRCKRELWRVQYALSRIRNNARDLLTLDEKDPRRIFEGEALLRRMNRYGLLDESQNKLDYVLALTVENFLERRLQTLVFKAGMAKSIHHARVLIRQRHIRVGRQVVNVPSFMVRVDSQKHIDFSLTSPFGGGRPGRVKRRNQKAAAKKASGGDGDEEDEE

SEQ ID NO: 7506 - protein, 152 aa, Gerbera hybrid cultivar
MVHVNFYRNYGKTFKKPRRPYEKERLDAELKLVGEYGLRCKRELWRVQYALSRIRNAARMLLTLEEKDPRRIFEGEALMRRMNRYGLLDESQNKLDYVLALTVENFLERRLQTLVFKTGMAKSIHHARVLIKQRHIQGGKASGECTIVHGES

SEQ ID NO: 7507 - protein, 195 aa, Unknown
  Sequence found in Organisms: Festuca arundinacea, Lolium multiflorum, Avena sativa
MVHVNFYRNYGKTFKKPRRPYEKERLDAELKLVGEYGLRCKRELWRVQYALSRIRNAARELLTLDEKNPRRIFEGAALLRRMNRYGLLSEDQNKLDYVLALTVENFLQRRLQTIVFKNGMAKSIHHARVLIRQRHIRVGRQLVNIPSFMVRVDTEKHVDFSLTSPLGGGEPGRVKRKNQKKAAGGGGGDGDEEEE

SEQ ID NO: 7508 - protein, 199 aa, Cirsium arvense
MVHVNFYRNYGKTFKKPRRPYEKERLDAELKLVGEYGLRCKRELWRVQYALSRIRNAARMLLTLDEKDPRRIFEGEALLRRMNRYGLLDESQNKLDYVLALTVENFLERRLQTLVFKTGMAKSIHHARVLIRQRHIRVGRQVVNVASFMVRVDSQKHIDFSLTSPFGGGRPGRVKRKNQKAAAKKASGGGGDGDEEDED

SEQ ID NO: 7509 - protein, 197 aa, Flaveria ramosissima
MVHVSFYRNYGKTFKKPRRPYEKERLDAELKLVGEYGLRCKRELWRVQYALSRIRNAARMLLTLEEKDPRRIFEGEALMRRMNRYGLLDESQNKLDYVLALTVENFLERRLQTLVFKTGMAKSIHHARVLIKQRHIRVGRQVVNVPSFMVRVDSQKHIDFSLTSPFGGGRPGRVKRKNQKAAAKKAAGGDADEDEEE

SEQ ID NO: 7510 - protein, 198 aa, Tabernaemontana elegans
MVHVSFYRNYGKTFKKPRRPYEKERLDAELKLVGEYGLRCKRELWRVQYALSRIRNNARMLLTLDEKDPRRIFEGEALLRRMNRYGLLDEGQNKLDYVLALTVENFLERRLQTLVFKTGMAKSIHHARVLIRQRHIRVGRQVVNVPSFLVRVDSQKHIDFSLTSPFGGGRPGRVKRRNQKAAAKKAAGGGDGDEEDEE

SEQ ID NO: 7511 - protein, 198 aa, Triphysaria pusilla
MVHVSFYRNYGKTFKKPRRPYEKERLDAELKLVGEYGLRCKRELWRVQFALSRIRNNARDLLTLDEKDPRRIFEGEALLRRMNRYGLLDESQNKLDYVLALTVENFLERRLQTLVFKAGMAKSIHHARVLIRQRHIRVGRQVVNVPSFMVRVDSQKHIDFSLTSPFGGGRPGRVKRKNQKAAAKKASGGGDGDEDDEE

SEQ ID NO: 7512 - protein, 197 aa, Beta vulgaris
MVHVCYYRNYGKTFKKPRRPYEKERLDAELKLVGEYGLRNKRELWRVQYVLSRIRNAARHLLTLDEKNPRRIFEGEALLRRMNKHGLLDEGQNKLDYVLALTVENFLERRLQTLVFKSGMAKSIHHARVLIRQRHIRVGRQVVNVPSFMVRVDSQKHIDFSLTSPFGGGRPGRVKRKNQKAAAKKAAGGDGDDEDEE

SEQ ID NO: 7513 - protein, 197 aa, Vaccinium corymbosum
MVHVNFYRNYGKTFKKPRRPYEKERLDAELKLVGEYGLRCKRELWRVQYALSRIRNAARMLLTLDEKNQRRIFEGEALLRRMNRYGLLNENQNKLDYVLALTVENFLERRLQTLVFKAGMAKSIHHARVLIRQRHIRVGRQVVNVPSFMVRLDSQKHIDFSLTSPLGGGRPGRVKRKNQKAAAKKASGGDGDEEDEE

SEQ ID NO: 7514 - protein, 197 aa, Unknown
  Sequence found in Organisms: Gossypium hirsutum, Gossypium raimondii
MVHVSFYRNYGKTFKKPRRPYEKERLDAELRLVGEYGLRCKRELWRVQYALSRIRNAARDLLTLDEKNPRRIFEGEALLRRMNRYGLLDESQNKLDYVLALTVENFLERRLQTLVFKTGMAKSIHHARVLIRQRHIRVGRQVVNIPSFMVRVDSQKHIDFSLTSPFGGGRPGRVKRKNQRAAAKKAAGGDGDEDDEE

SEQ ID NO: 7515 - protein, 197 aa, Unknown
  Sequence found in Organisms: Gossypium hirsutum, Gossypium raimondii
MVHVSFYRNYGKTFKKPRRPYEKERLDAELRLVGEYGLRCKRELWRVQYALSRIRNAARDLLTLDEKNPRRIFEGEALLRRMNRYGLLDESQNKLDYVLALTVENFLERRLQTLVFKTGMAKSIHHARVLIRQRHIRVGRQVVNIPSFMVRVDSQKHIDFSLTSPFGGGRPGRVKRKNQRAAAKKAAGGDGDDEEDE

SEQ ID NO: 7516 - protein, 197 aa, Acacia harpophylla
MVHVSFYRNYGKTFKKPRRPYEKERLDAELKLVGEYGLRCKRELWRVQYALSRIRNNARELLTLDEKNPRRIFEGEALLRRMFRYGLLDESQNKLDYVLALTVENFLERRLQTLVFKSGMAKSIHHARVLIRQRHIRVGRQVVNIPSFMVRVDSQKHIDFSLTSPFGGGRPGRVKRKNQRAAAKKAAGGDGDEEDEE

SEQ ID NO: 7517 - protein, 197 aa, Amsonia hubrichtii
MVHVSFYRNYGKTFKKPRRPYEKERLDAELKLVGEYGLRCKRELWRVQYVLSRIRNAARNLLTLDEKDPRRIFEGEALLRRMNRYGLLDESQNKLDYVLALTVENFLERRLQTLVFKTGMAKSIHHARVLIRQRHIRVGRQVVNVPSFMVRVDSQKHIDFSLTSPFGGGRPGRVKRKNMKAAAKKAAGGDGEEEDEE

SEQ ID NO: 7518 - protein, 197 aa, Aristolochia fimbriata
MVHVSFYRNYGKTFKKPRRPYEKERLDAELKLVGEYGLRCKRELWRVQYALSRIRNAARELLTLDEKNPRRIFEGEALLRRMNRYGLLDESQNKLDYVLALTVENFLERRLQTLVFKAGMAKSIHHARVLIRQRHIRVGRQVVNIPSFLVRVDSQKHIDFSLTSPLGGGRPGRVKRKNQKAAAKKAAGGDGDEEDED

SEQ ID NO: 7519 - protein, 197 aa, Fagus grandifolia
MVHVSFYRNYGKTFKKPRRPYEKERLDHELRLVGEYGLRCKRELWRVQYALSRIRNAARELLTLDEKNPRRIFEGEALLRRMNRYGLLDESQNKLDYVLALTVENFLERRLQTLVFKSGMAKSIHHARVLIRQRHIRVGRQVVNIPSFMVRVDSQKHIDFSLTSPFGGGRPGRVKRKNQKAAAKKASGGDGDEEDEE

SEQ ID NO: 7520 - protein, 197 aa, Theobroma cacao
MVHVSFYRNYGKTFKKPRRPYEKERLDAELRLVGEYGLRCKRELWRVQYALSRIRNAARDLLTLDEKNPRRIFEGEALLRRMNRYGLLDESQNKLDYVLALTVENFLERRLQTLVFKAGMAKSIHHARVLIRQRHVRVGRQVVNIPSFMVRVDSQKHIDFSLTSPFGGGRPGRVKRRNQRAAAKKAAGGDGDEEDEE

SEQ ID NO: 7521 - protein, 196 aa, Ricinus communis
MVHVNFYRNYGKTFKKPRRPYEKERLDAELKLVGEYGLRCKRELWRVQYALSRIRNAARMLLTLDEKNPRRIFEGEALLRRMNRYGLLDESQNKLDYVLALTVENFLERRLQTLVFKSGMAKSIHHARVLIRQRHIRVGRQVVNIPSFMVRVDSQKHIDFSLTSPFGGGRPGRVKRKNQRAASKKSGGDGDEEEED

SEQ ID NO: 7522 - protein, 197 aa, Ricinus communis
MVHVSFYRNYGKTFKKPRRPYEKERLDAELKLVGEYGLRCKRELWRVQYALSRIRNAARMLLTLDEKNPRRIFEGEALLRRMNRYGLLEESQNKLDYVLALTVENFLERRLQTLVFKSGMAKSIHHARVLIRQRHIRVGRQVVNIPSFMVRIDSQKHIDFSLTSPFGGGRPGRVKRRNQRAASKKASGGDGDEEDEE

SEQ ID NO: 7523 - protein, 196 aa, Cleome gynandra
MVNVSFYRNYGKTFKKPRRPYEKERLDAELKLVGEYGLRCKRELWRVQYALSRIRNAARDLLTLDEKNPRRIFEGEALLRRMNKYGLLDESQNKLDYVLALTVENFLERRLQTLVFKSGMAKSIHHARVLIRQRHIRVGRQVVNIPSFMVRVDSQKHIDFSLTSPFGGGRPGRVKRRNEKAGAKKAGGDGDDEDEE

SEQ ID NO: 7524 - protein, 197 aa, Unknown
  Sequence found in Organisms: Flaveria ramosissima, Tragopogon dubius
MVHVSFYRNYGKTFKKPRRPYEKERLDAELKLVGEYGLRCKRELWRVQYALSRIRNAARMLLTLEEKDPRRIFEGEALMRRMNRYGLLDESQNKLDYVLALTVENFLERRLQTLVFKTGMAKSIHHARVLIKQRHIRVGRQVVNVPSFMVRVDSQKHIDFSLTSPFGGGRPGRVKRKNQKAAAKKAAGGDADEEDEE

SEQ ID NO: 7525 - protein, 192 aa, Fraxinus spp
MVHVSFYRNYGKTFKKPRRPYEKERLDAELKLVGEYGLRCKRELWRVQYALSRIRNAARNLLTLDEKDPRRIFEGEALLRRMNRYGLLDESQNKLDYVLALTVENFLERRLQTLVFKAGMAKSIHHARVLIRQRHIRVGRQVVNVPSFMVRVDSQKHIDFSLTSPFGGGRPGRVKRKNQKAAAKKASGGDGG

SEQ ID NO: 7526 - protein, 197 aa, Carpinus betulus
MVHVSFYRNYGKTFKKPRRPYEKERLDAELKLVGEYGLRCKRELWRVQYALSRIRNNARMLLTLDEKNPRRIFEGEALLRRMNRYGLLDESQNKLDYVLALTVENFLERRLQTLVFKSGMAKSIHHARVLIRQRHIRVGRQVVNIASFMVRVDSQKHIDFSLTSPFGGGRPGRVKRKNQKAAAKKAGGGDADEEDEE

SEQ ID NO: 7527 - protein, 197 aa, Carpinus betulus
MVHVSFYRNYGKTFKKPRRPYEKERLDHELRLVGEYGLRCKRELWRVQYALSRIRNAARELLTLDEKNPRRIFEGEALLRRMNRYGLLDESQNKLDYVLALTVENFLERRLQTLVFKSGMAKSIHHARVLIRQRHIRVGRQVVNIASFMVRVDSQKHIDFSLTSPFGGGRPGRVKRKNQKAAAKKAGGGDGDEEDEE

SEQ ID NO: 7528 - protein, 197 aa, Ipomoea nil
MVHVSFYRNYGKTFKKPRRPYEKERLDAELKLVGEYGLRCKRELWRVQYALSRIRNNARMLLTLDEKDPRRIFEGDALLRRMNRYGLLDESQNKLDYVLALTVENFLERRLQTLVFKAGMAKSIHHARVLIRQRHIRVGRQVVNVPSFMVRLDSQKHIDFSLTSPFGGGRPGRVKRKNQKAAAKKAAGGDGDEEDEE

SEQ ID NO: 7529 - protein, 197 aa, Ipomoea nil
MVHVNFYRNYGKTFKKPRRPYEKERLDAELKLVGEYGLRCKRELWRVQYALSRIRNNARMLLTLDEKDPRRIFEGDALLRRMNRYGLLDESQNKLDYVLALTVENFLERRLQTLVFKAGMAKSIHHARVLIRQKHIRVGRQVVNVPSFMVRVDSQKHIDFSLSSPFGGGRPGRVKRKNQKAAAKKASGGDGDEEDEE

SEQ ID NO: 7530 - protein, 197 aa, Actinidia deliciosa
MVHVSYYRNYGKTFKKPRRPYEKERLDAELKLVGEYGLRCKRELWRVQYALSRIRNAARMLLTLDEKNPRRIFEGEALLRRMNRYGLLDESQNKLDYVLALTVENFLERRLQTLVFKTGMAKSIHHARVLIRQRHIRVGRQVVNVPSFMVRVDSQKHIDFSLTSPLGGGRPGRVKRKNMKAAAKKAAGGDGDEEDEE

SEQ ID NO: 7531 - protein, 197 aa, Unknown
  Sequence found in Organisms: Momordica charantia, Citrullus lanatus
MVHVSFYRNYGKTFKKPRRPYEKERLDAELKLVGEYGLRCKRELWRVQYALSRIRNNARMLLTLDEKNPRRIFEGEALLRRMNRYGLLDESQNKLDYVLALTVENFLERRLQTLVFKSGMAKSIHHARVLIRQRHIRVGRQVVNIPSFMVRVDSQKHIDFSLTSPFGGGRPGRVKRKNQKAAAKKAAGGDGDEEDED

SEQ ID NO: 7532 - protein, 197 aa, Olea europaea
MVHVSFYRNYGKTFKKPRRPYEKERLDAELKLVGEYGLRCKRELWRVQYALSRIRNAARNLLTLDEKDPRRIFEGEALLRRMNRYGLLDESQNKLDYVLSLTVENFLERRLQTCVFKAGMAKSIHHARVLIRQRHIRVGRQVVNVPSFMVRVDSQKHIDFSLTSPFGGGRPGRVKRKNQKAAAKKASGGDGDEDDEE

SEQ ID NO: 7533 - protein, 197 aa, Capsicum annuum
MVHVNFYRNYGKTFKKPRRPYEKERLDAELKLVGEYGLRCKRELWRVQYALSRIRNAARMLLTLDEKDPRRIFEGEALLRRMNRYGLLDESQNKLDYVLALTVENFLERRLQTLVFKTGMAKSIHHARVLIRQRHIRVGRQVVNVPSFMVRVDSQKHIDFSLTSPFGGGRPGRVKRKNQKAAVKKAAGGDGDEEDDE

SEQ ID NO: 7534 - protein, 197 aa, Populus trichocarpa
MVHVNFYRNYGKTFKKPRRPYEKERLDAELKLVGEYGLRAKRELWRVQYALSRIRNAARMLLTLDEKNPRRIFEGEALLRRMNRYGLLEENQNKLDYVLALTVESFLERRLQTLVFKAGMAKSIHHARVLIKQRHIRVGRQAVNIPSFMVRVDSQKHIDFSLTSPLGGGRPGRVKRKNQKAAAKKASGGDGDEEDEE

SEQ ID NO: 7535 - protein, 197 aa, Unknown
  Sequence found in Organisms: Solanum tuberosum, Solanum phureja
MVHVSFYRNYGKTFKKPRRPYEKERLDAELKLVGEYGLRCKRELWRVQYALSRIRNAARMLLTLDEKDSRRIFEGEALLRRMNRYGLLDESQNKLDYVLALTVENFLERRLQTLVFKTGMAKSIHHARVLIRQRHIRVGRQVVNVASFMVRVDSQKHIDFSLTSPFGGGRPGRVKRKNQKSAAKKAAGGDGDEEDEE

SEQ ID NO: 7536 - protein, 197 aa, Unknown
  Sequence found in Organisms: Solanum tuberosum, Solanum phureja
MVHVNFYRNYGKTFKKPRRPYEKERLDAELKLVGEYGLRCKRELWRVQYALSRIRNAARMLLTLDEKDPRRIFEGEALLRRMNRYGLLDESQNKLDYVLALTVENFLERRLQTLVFKTGMAKSIHHARVLIRQRHIRVGRQVVNVASFMVRVDSQKHIDFSLTSPFGGGRPGRVKRKNQKSAAKKAAGGDGDEEDEE

SEQ ID NO: 7537 - protein, 197 aa, Tabernaemontana elegans
MVHVSFYRNYGKTFKKPRRPYEKERLDAELKLVGEYGLRCKRELWRVQYVLSRIRNAARNLLTLDEKDPRRIFEGEALLRRMNRYGLLDESQNKLDYVLALTVENFLERRLQTLVFKTGMAKSIHHARVLIRQRHIRVGRQVVNVPSFMVRVDSQKHIDFSLTSPFGGGRPGRVKRKNTKAAAKKAAGGDGDEEDEE

SEQ ID NO: 7538 - protein, 197 aa, Solanum lycopersicum
MVHVSFYRNYGKTFKKPRRPYEKERLDAELKLVGEYGLRCKRELWRVQYALSRIRNAARMLLTLDEKDPRRIFEGEALLRRMNRYGLLDESQNKLDYVLALTVENFLERRLQTLVFKTGMAKSIHHARVLIRQRHIRVGRQVVNVASFMVRVDSQKHIDFSLTSPFGGGRPGRVKRKNQKSAAKKAAGGDGDEDDEE

SEQ ID NO: 7539 - protein, 195 aa, Avena sativa
MVHVNFYRNYGKTFKKPRRPYEKERLDAELKLVGEYGLRCKRELWRVQYALSRIRNAARELLTLDEKNPRRIFEGAALLRRMNRYGLLSEDQNKLDYVLALTVENFLQRRLQTIVFKNGMAKSIHHARVLIRQRHIRVGRQLVNIPSFMVRVDTEKHVDFSLTSPLGGGEPGRVKRKNLKKAAGGGGGDGDEEEE

SEQ ID NO: 7540 - protein, 195 aa, Avena sativa
MVHVNFYRNYGKTFKKPRRPYEKERLDSELKLVGEYGLRCKRELWRVQYALSRIRNAARELLTLDEKNPRRIFEGEALLRRMNRYGLLAEDQNKLDYVLALTVENFLQRRLQTIVFKNGMAKSIHHARVLIRQRHIRVGKQLVNIPSFMVRVDTEKHVDFSLTSPLGGGLPGRVKRKNQKKASGGGGGDGEEEEE

SEQ ID NO: 7541 - protein, 198 aa, Lippia dulcis
MVHVNFYRNYGKTFKKPRRPYEKERLDAELKLVGEYGLRCKRELWRVQYALSRIRNNARNLLTLDEKDPRRIFEGEALLRRMNRYGLLDESQNKLDYVLALTVENFLERRLQTLVFKAGMAKSIHHARVLIRQRHIRVGRQVVNVPSFMVRVDSQKHIDFSLTSPFGGGRPGRVKRRNQKAAAKKASGGGDGDEDDEE

SEQ ID NO: 7542 - protein, 197 aa, Carthamus tinctorius
MVHVPFYRNYGKTFKKPRRPYEKERLDAELKLVGEYGLRCKRELWRVQYALSRIRNAARMLLTLEEKDPRRIFEGEALMRRMNRYGLLDESQNKLDYVLALTVENFLERRLQTLVFKTGMAKSIHHARVLIKQRHIRVGRQVVNVPSFMVRVDSQKHIDFSLTSPFGGGRPGRVKRKNQKAAAKKAAGGDADEDEEE

SEQ ID NO: 7543 - protein, 198 aa, Sarracenia psittacina
MVHVNFYRNYGKTFKKPRRPYEKERLDAELKLVGEYGLRCKRELWRVQYALSRIRNAARMLLTLDEKNPRRIFEGEALLRRMNRYGLLDESQNKLDYVLALTVENFLERRLQTLVFKTGMAKSIHHARVLIRQRHIRVGRQVVNIPSFLVRVDSQKHIDFSLTSPLGGGRPGRVKRRNQKAATKKAAGGGDGDEEDEE

SEQ ID NO: 7544 - protein, 198 aa, Triphysaria pusilla
MVHVSFYRNYGKTFKKPRRPYEKERLDAELKLVGEYGLRCKRELWRVQFALSRIRNNARDLLTLDEKDPRRIFEGEALLRRMNRYGLLDESQNKLDYVLALTVENFLERRLQTLVFKAGMAKSIHHARVLIRQRHIRVGRQVVNVPSFMVRVDSQKHIDFSLTSPFGGGRPGRVKRKNQKAAAKKVSGGGDGDEDDDE

SEQ ID NO: 7545 - protein, 153 aa, Sarracenia psittacina
MRVQYALSRIRNAARMLLTLDEKNPRRIFEGEALLRRMNRYGLLDESQNKLDYVLALTVENFLERRLQTLVFKTGMAKSIHHARVLIRQRHIRVGRQVVNIPSFMVRVDSQKHIDFSLTSPLGGGRPGRVKRKNQKAAAKKVSGGDGDEEDEE

SEQ ID NO: 7546 - protein, 197 aa, Cannabis sativa
MVHVNFYRNYGKTFKKPRRPYEKERLDAELKLVGEYGLRCKRELWRVQYVLSRIRNNARMLLTLDEKNPRRIFEGEALLRRMNRYGLLDESQNKLDYVLALTVENFLERRLQTLVFKSGMAKSIHHARVLIRQRHIRVGRQVVNIPSFMVRVDSQKHIDFSLTSPFGGGRPGRVKRKNQKAAAKKASGGDGDEEDEE

SEQ ID NO: 7547 - protein, 197 aa, Gossypium raimondii
MVHVSFYRNYGKTFKKPRRPYEKERLDAELRLVGEYGLRCKRELWRVQYALSRIRNAARDLLTLDEKNPRRIFEGEALLRRMNRYGLLDESQNKLDYVLALTVENFLERRLQTLVFKTGMAKSIHHARVLIRQRHIRVGRQVVNIPSFMVRVDSQKHIDFSLTSPFGGGRPGRVKRKNQRAAAKKAAGGDGDEEEDE

SEQ ID NO: 7548 - protein, 197 aa, Unknown
  Sequence found in Organisms: Artemisia annua, Cichorium intybus, Taraxacum officinale, Flaveria ramosissima, Helianthus annuus, Tragopogon dubius
MVHVSFYRNYGKTFKKPRRPYEKERLDAELKLVGEYGLRCKRELWRVQYALSRIRNAARMLLTLEEKDPRRIFEGEALMRRMNRYGLLDESQNKLDYVLALTVENFLERRLQTLVFKTGMAKSIHHARVLIKQRHIRVGRQVVNVPSFMVRVDSQKHIDFSLTSPFGGGRPGRVKRKNQKAAAKKAAGGDADEDDEE

SEQ ID NO: 7549 - protein, 197 aa, Helianthus annuus
MVHVSFYRNYGKTFKKPRRPYEKERLDAELKLVGEYGLRCKRELWRVQYALSRIRNAARMLLTLEEKDPRRIFEGEALMRRMNRYGLLDESQNKLDYVLALTVENFLERRLQTLVFKTGMAKSIHHARVLIKQRHIRVGRQVVNVPSFMVRVDSQKHIDFSLTSPFGGGRPGRVKRKNQKAAAKKAAGGDADQDDEE

SEQ ID NO: 7550 - protein, 197 aa, Amsonia hubrichtii
MVHVSFYRNYGKTFKKPRRPYEKERLDAELKLVGEYGLRCKRELWRVQYVLSRIRNAARNLLTLDEKDPRRIFEGEALLRRMNRYGLLDESQNKLDYVLALTVENFLERRLQTLVFKTGMAKSIHHARVLIRQRHIRVGRQVVNVPSFMVRVDSQKHIDFSLTSPFGGGRPGRVKRKNMKAAAKKAAGGDGDEEEEE

SEQ ID NO: 7551 - protein, 197 aa, Catharanthus roseus
MVHVSFYRNYGKTFKKPRRPYEKERLDAELKLVGEYGLRCKRELWRVQYVLSRIRNAARNLLTLDEKDPRRIFEGEALLRRMNRYGLLDEGQNKLDYVLALTVENFLERRLQTLVFKSGMAKSIHHARVLIRQRHIRVGKQVVNVPSFMVRVDSQKHIDFSITSPFGGGRPGRVKRKNMKAAAKKASGGDGDEEDEE

SEQ ID NO: 7552 - protein, 197 aa, Unknown
  Sequence found in Organisms: Centaurea maculosa, Cirsium arvense
MVHVPFYRNYGKTFKKPRRPYEKERLDAELKLVGEYGLRCKRELWRVQYALSRIRNAARMLLTLEEKDPRRIFEGEALMRRMNRYGLLDESQNKLDYVLALTVENFLERRLQTLVFKTGMAKSIHHARVLIKQRHIRVGRQVVNVPSFMVRVDSQKHIDFSLTSPFGGGRPGRVKRKNQKAAAKKAAGGDADEEDEE

SEQ ID NO: 7553 - protein, 197 aa, Unknown
  Sequence found in Organisms: Castanea mollissima, Quercus alba
MVHVVFYRNYGKTFKKPRRPYEKERLDHELRLVGEYGLRCKRELWRVQYALSRIRNAARELLTLDEKNPRRIFEGDALLRRMNRYGLLDESQNKLDYVLALTVENFLERRLQTLVFKSGMAKSIHHARVLIRQRHIRVGRQVVNIPSFMVRVDSQKHIDFSLASPFGGGRPGRVKRKNQKAAAKKASGGDGGEEDEE

SEQ ID NO: 7554 - protein, 197 aa, Unknown
  Sequence found in Organisms: Cichorium intybus, Taraxacum officinale, Flaveria ramosissima, Lactuca sativa
MVHVSFYRNYGKTFKKPRRPYEKERLDAELKLVGEYGLRCKRELWRVQYALSRIRNAARMLLTLEEKDPRRIFEGEALMRRMNRYGLLDESQNKLDYVLALTVENFLERRLQTLVFKTGMAKSIHHARVLIKQRHIRVGRQVVNVPSFMVRVDSQKHIDFSLTSPFGGGRPGRVKRKNQKAAAKKASGGDADEDDEE

SEQ ID NO: 7555 - protein, 197 aa, Coffea canephora
MVHVSFYRNYGKTFKKPRRPYEKERLDAELRLVGEYGLRCKRELWRVQYALSRIRNAARNLLTLDEKDPRRVFEGEALLRRMNRYGLLDESQNKLDYVLALTVENFLERRLQTLVFKTGMAKSIHHARVLIRQRHIRVGRQVVNVPSFMVRVDSQKHIDFSLTSPFGGGRAGRVKRKNQKAAAKKAAGGDGDEEDEE

SEQ ID NO: 7556 - protein, 197 aa, Gossypium hirsutum
MVHVSFYRNYGKTFKKPRRPYEKERLDAELRLVGEYGLRCKRELWRVQYALSRIRNAARDLLTLDEKNPRRIFEGEALLRRMNRYGLLDESQNKLDYVLALTVENFLERRLQTLVFKTGMAKSIHHARVLIRQRHIRVGRQVVNIPSFMVRVDSQKHIDFSLISPFGGGRPGRVKRKNQRAAAKKAAGGDGDEEEDE

SEQ ID NO: 7557 - protein, 197 aa, Unknown
  Sequence found in Organisms: Cucumis sativus, Cucurbita pepo, Cucumis melo, Citrullus lanatus
MVHVSFYRNYGKTFKKPRRPYEKERLDAELKLVGEYGLRCKRELWRVQYALSRIRNNARMLLTLDEKNPRRIFEGEALLRRMNRYGLLDESQNKLDYVLALTVENFLERRLQTLVFKSGMAKSIHHARVLIRQKHIRVGRQVVNIPSFMVRVDSQKHIDFSLTSPFGGGRPGRVKRKNQKAAAKKAAGGDGDEEDED

SEQ ID NO: 7558 - protein, 197 aa, Cynara scolymus
MVHVNFYRNYGKTFKKPRRPYEKERLDAELKLVGEYGLRCKRELWRVQYALSRIRNAARMLLTLDEKDPRRIFEGEALLRRMNRYGLLDESQNKLDYVLALTVENFLERRLQTLVFKTGMAKSIHHARVLIRQRHIRVGRQVVNVASFMVRVDSQKHIDFSLTSPFGGGRPGRVKRKNQKAAAKKASGGDGDEEDED

SEQ ID NO: 7559 - protein, 197 aa, Eschscholzia californica
MVHVNFYRNYGKTFKKPRRPYEKERLDAELKLVGEYGLRCKRELWRVQYALSRIRNAARMLLTLDEKNPRRIFEGEALLRRMNRYGLLDESQNKLDYVLALTVENFLERRLQTLVFKSGMAKSIHHARVLIRQRHIRVGRQVVNIPSFMVRVDSQKHIDFSLTSPLGGGRPGRVKRRNMKAAAKKAGGGDGDDEDED

SEQ ID NO: 7560 - protein, 197 aa, Euphorbia peplus
MVHVSFYRNYGKTFKKPRRPYEKERLDAELKLVGEYGLRCKRELWRVQYALSRIRNAARMLLTLDEKNPRRIFEGEALLRRMNRYGLLDESQNKLDYVLALTVENFLERRLQTLVFKSGMAKSIHHARVLIRQRHIRVGRQAVNIPSFMVRVDSQKHIDFSLTSPLGPGRPGRVKRRNQRAANKKASGGDGDEEDEE

SEQ ID NO: 7561 - protein, 197 aa, Fagopyrum esculentum
MVHVSYYRNYGKTFKKPRRPYEKERLDAELKLVGEYGLRCKRELWRVQYALSRIRNNARHLLTLDEKNSRRIFEGEALLRRMNRYGLLDESQNKLDYVLSLTVENFLERRLQTLVFKSGMAKSIHHARVLIRQRHIRVGRQVVNIPSFMVRVDSQKHIDFSLTSPFGGGRPGRVKRKNQKAAAKKASGGDGDEEDEE

SEQ ID NO: 7562 - protein, 196 aa, Flaveria ramosissima
MVKVSFYRNYGKTFKKPRRPYEKERLDAELKLVGEYGLRCKRELWRVQYALSRIRNAARMLLTLEEKDPRRIFEGEALMRRMNRYGLLDESQNKLDYVLALTVENFLERRLQTLVFKTGMAKSIHHARVLIKQRHIRVGRQVVNVPSFMVRVDSQKHIDFSLTSPFGGGRPGRVKRKNQKAAAKKAAGGDADEDDE

SEQ ID NO: 7563 - protein, 196 aa, Zingiber officinale
  misc_feature (47)..(47): Xaa can be any naturally occurring amino acid
  misc_feature (51)..(51): Xaa can be any naturally occurring amino acid
MVHVSFYRNYGKTFKKPRRPYEKERLDAELKLVGEYGLRCKRELWRXQYAXSRIRNAARELLTLDEKNPRRIFEGEPLLRRMNRYGLLNEGQNKLDYVLALTVENFLERRLQTLVFKSGMAKSIHHARVLIRQRHIRVGRQVVNIPSFMVRVDSGKHIDFSLMSPFGGGRPGRVKRKNQKAAAKKAAGGDDEEDEE

SEQ ID NO: 7564 - protein, 197 aa, Humulus lupulus
MVHVNFYRNYGKTFKKPRRPYEKERLDAELKLVGEYGLRCKRELWRVQYVLSRIRNNARMLLTLDEKNPRRIFEGEALLRRMNRYGLLDESQNKLDYVLALTVENFLERRLQTLVFKSGMAKSIHHARVLIRQRHIRVGRQVVNIPSFMVRVDSQKHIDFSLTSPFGGGRPGRVKRKNQKAAAKKAAGGDGDEEDEE

SEQ ID NO: 7565 - protein, 197 aa, Ipomoea nil
MVHVNFYRNYGKTFKKPRRPYEKERLDAELKLVGEYGLRCKRELWRVQYALSRIRNNARMLLTLDEKDPRRIFEGDALLRRMNRYGLLDESQNKLDYVLALTVENFLERRLQTLVFKAGMAKSIHHARVLIRQKHIRVGRQVVNVPSFLVRVDSQKHIDFSLSSPFGGGRPGRVKRKNQKAAAKKAAGGDGDEEDEE

SEQ ID NO: 7566 - protein, 197 aa, Ipomoea nil
MVHVSFYRNYGKTFKKPRRPYEKERLDAELKLVGEYGLRCKRELWRVQYALSRIRNNARMLLTLDEKDPRRIFEGDALLRRMNRFGLLDESQNKLDYVLALTVENFLERRLQTLVFKAGMAKSIHHARVLIRQRHIRVGRQVVNVPSFMVRLDSQKHIDFSLTSPFGGGRPGRVKRKNQKAAAKKAAGGDGDEEDEE

SEQ ID NO: 7567 - protein, 197 aa, Actinidia deliciosa
MVHVSYYRNYGKTFKKPRRPYEKERLDAELKLVGEYGLRCKRELWRVQYALSRIRNAARMLLTLDEKNPRRIFEGEALLRRMNRYGLLDESQNKLDYVLALTVENFLERRLQTLVFKTGMAKSIHHARVLIRQRHIRVGRQVVNVASFMVRVDSQKHIDFSLTSPLGGGRPGRVKRKNTKAAAKKAAGGDGDEEDEE

SEQ ID NO: 7568 - protein, 197 aa, Liriodendron tulipifera
MVHVSFYRNYGKTFKKPRRPYEKERLDAELKLVGEYGLRCKRELWRVQYALSRIRNAARELLTLDEKNPRRIFEGEALLRRMNRYGLLDESQNKLDYVLALTVENFLERRLQTLVFKSGMAKSIHHARVLIRQRHIRVGRQVVNIPSFMVRVDSQKHIDFSLTSPLGGGRPGRVKRRNQKAAAKKASGGDGDEEDED

SEQ ID NO: 7569 - protein, 197 aa, Elaeis guineensis
MVHVSFYRNYGKTFKKPRRPYEKERLDAELKLVGEYGLRCKRELWRVQYSLSRIRNAARELLTLDEKNPRRIFEGEALLRRMNRYGLLDENQNKLDYVLALTVENFLERRLQTLVFKSGMAKSIHHARVLIRQRHIRVGRQVVNIPSFLVRVDSAKHIDFSLTSPFGGGRPGRVKRKNQKAAAKKAAGGDGDEDDEE

SEQ ID NO: 7570 - protein, 197 aa, Phalaenopsis aphrodite
MVHVSFYRNYGKTFKKPRRPYEKERLDAELKLVGEYGLRCKRELWRVQYALSRIRNAARELLTLDEKNPKRIFEGEALLRRMFRYGLLEEGQNKLDYVLALTVENFLERRLQTQVFKSGMAKSIHHARVLIRQRHIRVGRQVVNIPSFMVRVDSAKHIDFSLTSPFGGGRPGRVKRKNQRAAAKKAAGGDAEEEDEE

SEQ ID NO: 7571 - protein, 197 aa, Phalaenopsis aphrodite
MVHVSFYRNYGKTFKKPRRPYEKERLDAELKLVGEYGLRCKRELWRVQYALSRIRNAARELLTLDEKNPKRIFEGEALLRRMFRYGLLEEGQNKLDYVLALTVENFLERRLQTQVFKSGMAKSIHHARVLIRQRHIRVGRQVVNIPSFMVRVDSAKHIDFSLTSPFGGGRPGRVKRKNQRAAAKKAAGGDGDEEDED

SEQ ID NO: 7572 - protein, 197 aa, Lippia dulcis
MVHVNFYRNYGKTFKKPRRPYEKERLDAELKLVGEYGLRCKRELWRVQYALSRIRNNARMLLTLDEKDPRRIFEGEALLRRMNRYGLLDESQSKLDYVLALTVENFLERRLQTLVFKAGMAKSIHHARVLIRQRHIRVGRQVVNVPSFMVRVDSQKHIDFSLTSPFGGGRPGRVKRRNQKAAAKKASGGDGDEEDEE

SEQ ID NO: 7573 - protein, 197 aa, Platanus occidentalis
MVHVNFYRNYGKTFKKPRRPYEKERLDAELKLVGEYGLRCKRELWRVQYALSRIRNAARELLTLDEKNPRRIFEGEALLRRMNRYGLLDESQNKLDYVLALTVENFLERRLQTLVFKSGMAKSIHHARVLIRQRHIRVGRQVVNIPSFMVRVDSQKHIDFSLTSPLGGGRPGRVKRKNQMAAAKKAAGGDGDEEDED

SEQ ID NO: 7574 - protein, 197 aa, Sarracenia psittacina
MVHVSFYRNYGKTFKKPRRPYEKERLDAELKLVGEYGLRCKRELWRVQYALSRIRNAARMLLTLDEKNPRRIFEGEALLRRMNRYGLLDESQNKLDYVLALTVENFLERRLQTLVFKTGMAKSIHHARVLIRQRHIRVGRQVVNIPSFLVRVDSQKHIDFSLTSPLGGGRPGRVKRRNQKAAAKKAAGGDGDEEDEE

SEQ ID NO: 7575 - protein, 197 aa, Silene vulgaris
MVHVNFYRNYGKTFKKPRRPYEKERLDAELKLVGEYGLRNKRELWRVQYVLSRIRNAARHLLTLDEKNPRRIFEGEALLRRMNRYGLLEEGQNKLDYVLALTVENFLERRLQTQVFKSGMAKSIHHARVLIKQKHIRVGRQVVNVASFMVRVDSQKHIDFSLTSPFGGGRPGRVKRKNQKAAAKKASGGDGDEDDEE

SEQ ID NO: 7576 - protein, 197 aa, Solanum phureja
MVHVNFYRNYGKTFKKPRRPYEKERLDAELKLVGEYGLRCKRELWRVQYALSRIRNAARMLLTLDEKDSRRIFEGEALLRRMNRYGLLDESQNKLDYVLALTVENFLERRLQTLVFKTGMAKSIHHARVLIRQRHIRVGRQVVNVASFMVRVDSQKHIDFSLTSPFGGGRPGRVKRKNQKSAAKKAAGGDGDEEDEE

SEQ ID NO: 7577 - protein, 197 aa, Euphorbia esula
MVHVSFYRNYGKTFKKPRRPYEKERLDAELKLVGEYGLRCKRELWRVQYALSRIRNAARMLLTLDEKNPRRIFEGEALLRRMNRYGLLDESQNKLDYVLALTVENFLERRLQTLVFKSGMAKSIHHARVLIRQRHIRVGRQAVNIPSFMVRVDSQKHIDFSLTSPLGPGRPGRVKRRNQRAASKKASGGDGDEEDEE

SEQ ID NO: 7578 - protein, 197 aa, Nicotiana tabacum
MVHVAFYRNYGKTFKKPRRPYEKERLDAELKLVGEYGLRCKRELWRVQYALSRIRNAARMLLTLDEKDPRRIFEGEALLRRMNRYGLLDESQNKLDYVLSLTVENFLERRLQTLVFKTGMAKSIHHARVLIRQRHIRVGRQVVNVPSFMVRLDSQKHIDFSLISPFGGGRPGRVKRKNQKAAAKKASGGDGDEEDEE

SEQ ID NO: 7579 - protein, 197 aa, Nicotiana tabacum
MVHVAFYRNYGKTFKKPRRPFEKERLDAELKLVGEYGLRCKRELWRVQYALSRIRNAARMLLTLDEKDPRRIFEGEALLRRMNRYGLLDESQNKLDYVLSLTVENFLERRLQTLVFKTGMAKSIHHARVLIRQRHIRVGRQVVNVPSFMVRVDSQKHIDFSLTSPFGGGRPGRVKRKNQKAAAKKASGGDGDEEDEE

SEQ ID NO: 7580 - protein, 197 aa, Triphysaria pusilla
MVHVSFYRNYGKTFKKPRRPYEKERLDAELKLVGEYGLRCKRELWRVQFALSRIRNNARDLLTLDEKDPRRIFEGEALLRRMNRYGLLDESQNKLDYVLALTVENFLERRLQTLVFKAGMAKSIHHARVLIRQRHIRVGRQVVNVPSFMVRVDSQKHIDFSLTSPFGGGRPGRVKRKNQKAAAKKAGGGGDEEEDED

SEQ ID NO: 7581 - protein, 196 aa, Cleome gynandra
MVNVSFYRNYGKTFKKPRRPYEKERLDAELKLVGEYGLRCKRELWRVQYALSRIRNAARDLLTLDEKNPRRIFEGEALLRRMNKYGLLDESQNKLDYVLALTVENFLERRLQTLVFKSGMAKSIHHARVLIRQRHIRVGRQVVNIPSFMVRVDSQKHIDFSLTSPFGGGRPGRVKRRNEKAGAKKAGGDGDEEDEE

SEQ ID NO: 7582 - protein, 195 aa, Parthenium argentatum
MVHVPFYRNYGKTFKKPRRPYEKERLDAELKLVGEYGLRCKRELWRVQYALSRIRNAARMLLTLEEKDPRRIFEGEALMRRMNRYGLLDESQNKLDYVLALTVENFLERRLQTLVFKTGMAKSIHHARVLIKQRHIRVGRQVVNVPSFMVRVDSQKHIDFSLTSPFGGGRPGRVKRKNQKAAAKKAAGGDDDEDD

SEQ ID NO: 7583 - protein, 266 aa, Zea mays
MVPRDRAHSAAAATAPPTEKPVQGPIQNNKCEKKAPKKVHKSEREKRKRDKQNDLFGELGNMLEPDRQNNGKACILSDTTRILKDLLSQVESLRKENNTLKNESHYVALERNELLDETNMIRGEISDLQNEMRMRLEDNSIWSHDTSRPNLTAPHPATTVFTLQHSPHPQVIATMTLPLQQPAVVEQSYAAPRRELQLFPEAAPTEDTEPPQNEGTSNHVMRPQARYPPAMTTLPGHVYPVLPRVEDEQRSSGTTGSREEGGVGNR

SEQ ID NO: 7584 - protein, 198 aa, Unknown
  Sequence found in Organisms: Centaurea maculosa, Cirsium arvense, Carthamus tinctorius
MVHVNFYRNYGKTFKKPRRPYEKERLDAELKLVGEYGLRCKRELWRVQYALSRIRNAARMLLTLEEKDPRRIFEGEALLRRMNRYGLLDESQNKLDYVLALTVENFLERRLQTLVFKTGMAKSIHHARVLIRQRHIRVGRQVVNVASFMVRVDSQKHIDFSLTSPFGGGRPGRVKRKNQKAAAKKASGGDGGDEEDED

SEQ ID NO: 7585 - protein, 198 aa, Centaurea maculosa
  misc_feature (185)..(185): Xaa can be any naturally occurring amino acid
MVHVNFYRNYGKTFKKPRRPYEKERLDAELKLVGEYGLRCKRELWRVQYALSRIRNAARMLLTLEEKDPRRIFEGEALMRRMNRYGLLDESQNKLDYVLALTVENFLERRLQTLVFKTGMAKSIHHARVLIKQRHIRVGRQVVNVPSFMVRVDSQKHIDFSLTSPFGGGRPGRVKRKNQKAAAKXAAGGGDADEDDEE

SEQ ID NO: 7586 - protein, 198 aa, Prunus persica
MVHVSFYRNYGKTFKKPRRPYEKERLDAELKLVGEYGLRCKRELWRVQYALSRIRNAARELLTLDEKSPRRIFEGEALLRRMNRYGLLEETQNKLDYVLALTVENFLERRLQTLVFKTGMAKSIHHARVLIRQRHIRVGRQVVNIPSFMVRVDSQKHIDFSITSPLGGGRPGRVKRRNQKAAAKKAAGGGDGDEEDEE

SEQ ID NO: 7587 - protein, 198 aa, Triphysaria pusilla
MVHVSFYRNYGKTFKKPRRPYEKERLDAELKLVGEYGLRCKRELWRVQFALSRIRNNARDLLTLDEKDPRRIFEGEALMRRMNKYGLLDESQNKLDYVLALTVENFLERRLQTLVFKAGMAKSIHHARVLIRQRHIRVGRQVVNVPSFMVRVDSQKHIDFSLTSPFGGGRPGRVKRKNQKAAAKKASGGGDGDEDDEE

SEQ ID NO: 7588 - protein, 216 aa, Triphysaria pusilla
MVHVSFYRNYGKTFKKPRRPYEKERLDAELKLVGEYGLRCKRELWRVQFALSRIRNNARDLLTLDEKDPRRIFEGEALMRRMNKYGLLDESQNKLDYVLALTVENFLERRLQTLVFKAGMAKSIHHARVLIRQRHIRVGRQVVNVPSFMVRVDSQKHIDFSLTSPFGGGRPGRVKRKNQKAAAKKASGGGDGDEDDNGGSVFLSVIVIRTIKKQCV

SEQ ID NO: 7589 - protein, 197 aa, Unknown
  Sequence found in Organisms: Phaseolus coccineus, Vigna unguiculata
MVHVSFYRNYGKTFKKPRRPYEKERLDAELKLVGEYGLRCKRELWRVQYALSRIRNNARNLLTLDEKNPRRIFEGEALLRRMFRYGLLDETQNKLDYVLALTVENFLERRLQTLVFKSGMAKSIHHARVLIRQRHIRVGRQVVNIPSFMVRVDSQKHIDFSLTSPLGGGRPGRVKRKNQKAAAKKAAGGDGDEEDED

SEQ ID NO: 7590 - protein, 197 aa, Unknown
  Sequence found in Organisms: Gossypium hirsutum, Gossypium raimondii
MVHVSFYRNYGKTFKKPRRPYEKERLDAELRLVGEYGLRCKRELWRVQYALSRIRNAARDLLTLDEKNPRRIFEGEALLRRMNRYGLLDESQNKLDYVLALTVENFLERRLQTLVFKTGMAKSIHHARVLIRQRHIRVGRQVVNIPSFMVRVDSQKHIDFSLTSPFGGGRPGRVKRKNQRAAAKKAAGRDGDEEEDE

SEQ ID NO: 7591 - protein, 88 aa, Secale cereale
MVHVNFYRNYGKTFKKPRRPYEKERLDAELKLVGEYGLRCKRELWRVQYALSRIRNAARHYEGIGLMRDPAYLEALLSPSHEPLWSPC

SEQ ID NO: 7592 - protein, 197 aa, Helianthus annuus
MVHVSFYRNYGKTFKKPRRPYEKERLDAELKLVGEYGLRCKRELWRVQYALSRIRNAARMLLTLEEKDPRRIFEGEALMRRMNRYGLLDESQNKLDYVLALTVENFLERRLQTLVFKTGMAKSIHHARVLIKQRHIRVGRQVVNVPSFMVRVDSQKHIDFSLTSPFGGGRPGRVKRRNQKAAAKKAAGGDADEDDEE

SEQ ID NO: 7593 - protein, 197 aa, Helianthus annuus
MVHVSFYRNYGKTFKKPRRPYEKERLDAELKLVGEYGLRCKRELWRVQYALSRIRNAARMLLTLEEKDPRRIFEGEALMRRMNRYGLLDESQNKLDYVLALTVENFLERRLQTLVFKTGMAKSIHHARVLIKQRHIRVGRQVVNVPSFMVRVDSQKHIDFSLTSPFGGGRPGRAKRKNQKAAAKKAAGGDADEDDEE

SEQ ID NO: 7594 - protein, 197 aa, Amborella trichopoda
MVHVSFYRNYGKTFKKPRRPYEKERLDAELKLVGEYGLRCKRELWRVQYALSRIRNAARELLTLDEKNPKRIFEGEALLRRMNRYGLLDESQNKLDYVLALTVENFLERRLQTLVFKSGMAKSIHHARVLIRQRHIRVGRQVVNIPSFMVRVDSQKHIDFSLTSPLGGGRPGRVKRKNLKAASKKAAGGDGDEEDED

SEQ ID NO: 7595 - protein, 197 aa, Unknown
  Sequence found in Organisms: Ambrosia trifida, Cirsium arvense, Cynara scolymus, Parthenium argentatum
MVHVPFYRNYGKTFKKPRRPYEKERLDAELKLVGEYGLRCKRELWRVQYALSRIRNAARMLLTLEEKDPRRIFEGEALMRRMNRYGLLDESQNKLDYVLALTVENFLERRLQTLVFKTGMAKSIHHARVLIKQRHIRVGRQVVNVPSFMVRVDSQKHIDFSLTSPFGGGRPGRVKRKNQKAAAKKAAGGDADEDDEE

SEQ ID NO: 7596 - protein, 196 aa, Antirrhinum majus
MVHVNVYRNYGKTFKKPRRPYEKERLDAELRLVGEYGLRCKRELWRVQYALSRIRNAARNLLTLDEKDPRRIFEGEALLRRMNRYGLLDESQNKLDYVLALTVENFLERRLQTLVFKAGMAKSIHHARVLIRQRHIRVGRQVVNVASFMVRVDSQKHIDFSLTSPFGGGRAGRVKRKNQKAAAKKSGGGDEEEDEE

SEQ ID NO: 7597 - protein, 197 aa, Arnica chamissonis
MVNVPFYRNYGKTFKKPRRPYEKERLDAELKLVGEYGLRCKRELWRVQYALSRIRNAARMLLTLDEKDPRRIFEGEALMRRMNRYGLLDESQNKLDYVLALTVENFLERRLQTLVFKTGMAKSIHHARVLIKQRHIRVGRQVVNVPSFMVRVDSQKHIDFSLTSPFGGGRPGRVKRKNQKAAAKKAAGGDADEDDEE

SEQ ID NO: 7598 - protein, 197 aa, Unknown
  Sequence found in Organisms: Arnica chamissonis, Cynara scolymus, Guizotia abyssinica
MVHVNFYRNYGKTFKKPRRPYEKERLDAELKLVGEYGLRCKRELWRVQYALSRIRNAARMLLTLEEKDPRRIFEGEALMRRMNRYGLLDESQNKLDYVLALTVENFLERRLQTLVFKTGMAKSIHHARVLIKQRHIRVGRQVVNVPSFMVRVDSQKHIDFSLTSPFGGGRPGRVKRKNQKAAAKKAAGGDADEDDEE

SEQ ID NO: 7599 - protein, 197 aa, Persea americana
MVHVSFYRNYGKTFKKPRRPYEKERLDAELKLVGEYGLRCKRELWRVQYALSRIRNAARELLTLDEKNPRRIFEGEALLRRMNRHGLLDESQNKLDYVLALTVENFLERRLQTLVFKSGMAKSIHHARVLIRQRHIRVGRQVVNIPSFMVRVDSQKHIDFSLTSPLGGGRAGRVKRKNQKAAAKKASGGDGDEEDED

SEQ ID NO: 7600 - protein, 116 aa, Ocimum basilicum
MNRYGLLDESQNKLDYVLALTVENFLERRLQTLVFKAGMAKSIHHARVLIRQRHIRVGRQVVNVPSFLVRVDSQKHIDFSLTSPFGGGRPGRVKRRNQKAAAKKASGGDGDEDDEE

SEQ ID NO: 7601 - protein, 197 aa, Ocimum basilicum
MVHVSFYRNYGKTFKKPRRPYEKERLDAELKLVGEYGLRCKRELWRVQYALSRIRNNARNLLTLDEKDPRRIFEGEALLRRMNRYGLLDESQNKLDYVLALTVENFLERRLQTLVFKAGMTKSIHHARVLIRQRHIRVGRQVVNVPSFLVRVDSQKHIDFSLTSPFGGGRPGRVKRRNQKAAAKKASGGDGDEDDEE

SEQ ID NO: 7602 - protein, 197 aa, Fagus grandifolia
MVHVSFYRNYGKTFKKPRRPYEKERLDAELKLVGEYGLRCKRELWRVQYALSRIRNNARMLLTLDEKNPRRIFEGEALLRRMNRYGLLDESQNKLDYVLALTVENFLERRLQTLVFKSGMAKSIHHARVLIRQRHIRVGRQVVNIPSFLVRVDSQKHIDFSLTSPFGGGRPGRVKRRNQKAAAKKASGGDADEEDEE

SEQ ID NO: 7603 - protein, 197 aa, Theobroma cacao
MVHVSFYRNYGKTFKKPRRPYEKERLDAELRLVGEYGLRCKRELWRVQYALSRIRNAARDLLTLDEKNPRRIFEGEALLRRMNRHGLLDESQNKLDYVLALTVENFLERRLQTLVFKAGMAKSIHHARVLIRQRHIRVGRQVVNIPSFMVRVDSQKHIDFSLTSPFGGGRPGRVKRRNQRAAAKKAAGGDGDEEEDE

SEQ ID NO: 7604 - protein, 81 aa, Catharanthus roseus
MVHVSFYRNYGKTFKKPRRPYEKERLDAELKLVGEYGLRCKRELWRVQYALSRIRNNARMLLTLDEKDPRDYLRVKPFCVG

SEQ ID NO: 7605 - protein, 197 aa, Cedrus atlantica
MVHVSFYRNYGKTFKKPRRPYEKERLDAELKLVGEYGLRNKRELWRVQYTLSRIRNAARMLLTLDEKNPRRIFEGEALLRRMNRYGLLDETQNKLDYVLALTVENFLERRLQTLVFKSGMAKSIHHARVLIRQRHIRVGRQVVNIPSFMVRVDSQKHIDFSLTSPLGGGRPGRVKRKNMKAASKKAAGGDGEEEDEE

SEQ ID NO: 7606 - protein, 197 aa, Gossypium hirsutum
MVHVSFYRNYGKTFKKPRRPYEKERLDAELRLVGEYGLRCKRELWRVQYALSRIRNAARDLLTLDEKNPRRIFEGEALLRRMNRYGLLDESQNKLDYVLALTVENFLERRLQTLVFKTGMAKSIHHARVLIRQRHIRVGRQVVNIPSFMVRVDSQKHIDFSLTSPFGGGRPGRVKRRNQRAAAKKAAGGDGDEEEDE

SEQ ID NO: 7607 - protein, 197 aa, Cucurbita pepo
MVHVSFYRNYGKTFKKPRRPYEKERLDAELKLVGEYGLRCKRELWRVQYALSRIRNNARMLLTLDEKNPRRIFEGEALLRRMNRYGLLDESQNKLDYVLALTVENFLERRLQTLVFKSGMAKSIHHARVLIRQKHIRVGRQVVNIPSFMVRVDSQKHIDFSLTSPFGGGRPGRVKRRNQKAAAKKAAGGDGDEEDED

SEQ ID NO: 7608 - protein, 135 aa, Cucurbita pepo
MVHVSFYRNYGKTFKKPRRPYEKERLDAELKLVGEYGLRCKRELWRVQYALSRIRNNARMLLTLDEKNPRRIFEGEALLRRMNRYGLWMRVRTSSIMSWPLLWRISLSVVSKLSCSSLVWLSLSIMLECSSGRSI

SEQ ID NO: 7609 - protein, 197 aa, Eucalyptus grandis
MVHVSFYRNYGKTFKKPRRPYEKERLDAELKLVGEYGLRCKRELWRVQYVLSRIRNNARMLLTLDEKNPRRIFEGEALLRRMNRYGLLDESQNKLDYVLALTVENFLERRLQTLVFKSGMAKSIHHARVLIRQRHIRVGRQVVNIPSFMVRVDSQKHIDFSLTSPFGGGRPGRVKRKNTKAASKKASGGDGEEEDED

SEQ ID NO: 7610 - protein, 197 aa, Flaveria ramosissima
MVHVSFYRNYGKTFKKLRRPYEKERLDAELKLVGEYGLRCKRELWRVQYALSRIRNAARMLLTLEEKDPRRIFEGEALMRRMNRYGLLDESQNKLDYVLALTVENFLERRLQTLVFKTGMAKSIHHARVLIKQRHIRVGRQVVNVPSFMVRVDSQKHIDFSLTSPFGGGRPGRVKRKNQKAAAKKAAGGDADEDDEE

SEQ ID NO: 7611 - protein, 197 aa, Flaveria ramosissima
MVKVSFYRNYGKTFKKPRRPYEKERLDAELKLVGEYGLRCKRELWRVQYALSRIRNAARMLLTLEEKDPRRIFEGEALMRRMNRYGLLDESQNKLDYVLALTVENFLERRLQTLVFKTGMAKSIHHARVLIKQRHIRVGRQVVNVPSFMVRVDSQKHIDFSLTSPFGGGRPGRVKRKNQKAAAKKAAGGDADEDDEE

SEQ ID NO: 7612 - protein, 197 aa, Flaveria ramosissima
MVHVSFYRNYGKTFKKPVRPYEKERLDAELKLVGEYGLRCKRELWRVQYALSRIRNAARMLLTLEEKDPRRIFEGEALMRRMNRYGLLDESQNKLDYVLALTVENFLERRLQTLVFKTGMAKSIHHARVLIKQRHIRVGRQVVNVPSFMVRVDSQKHIDFSLTSPFGGGRPGRVKRKNQKAAAKKAAGGDADEDDEE

SEQ ID NO: 7613 - protein, 138 aa, Flaveria ramosissima
MLLTLEEKDPRRIFEGEALMRRMNRYGLLDESQNKLDYVLALTVENFLERRLQTLVFKTGMAKSIHHARVLIKQRHIRVGRQVVNVPSFMVRVDSQKHIDFSLTSPFGGGRPGRVKRKNQKAATKKAAGGDADEDDEE

SEQ ID NO: 7614 - protein, 197 aa, Heritiera littoralis
MVHVSFYRNYGKTFKKPRRPYEKERLDAELRLVGEYGLRCKRELWRVQYALSRIRNAARDLLTLDEKNPRRIFEGEALLRRMNRYGLLDESQNKLDYVLALTVENFLERRLQTLVFKSGMAKSIHHARVLIRQRHIRVGRQVVNIPSFMVRVDSQKHIDFSLTSPFGGGRPGRVKRRNQRAAAKKAAGGDGDEEEDE

SEQ ID NO: 7615 - protein, 197 aa, Carpinus betulus
MVHVSFYRNYGKTFKKPRRPYEKERLDAELKLVGEYGLRCKRELWRVQYALSRIRNNARMLLTLDEKNPRRIFEGEALLRRMNRYGLLDESQNKLDYVLALTVENFLERRLQTLVFKSGMAKSIHHARVLIRQRHIRVGRQVVNIASFMVRVDSQKHIDFSLTSPFGGGRPGRVKRRNQKAAAKKTAGGDGDEEEEE

SEQ ID NO: 7616 - protein, 197 aa, Mesembryanthemum crystallinum
MVHVNYYRNYGKTFKKPRRPYEKERLDAELKLVGEYGLRNKRELWRVQYVLSGIRNAARHLLTLDEKNPRRIFEGEALLRRMNMYGLLDEGQNKLDYVLALTVENFLERRLQTLVFKSGMAKSIHHARVLIRQRHIRVGRQVVNVPSFMVRVDSQKHIDFSLTSPFGGGRPGRVKRKNQKSAAKKASGGDGDEDDEE

SEQ ID NO: 7617 - protein, 197 aa, Mesembryanthemum crystallinum
MVHVNFYRNYGKTFKKPRRPYEKERLDAELKLVGEYGLRNKRELWRVQYVLSGIRNAARHLLTLDEKNPRRIFEGEALLRRMNRYGLLEEGQNKLDYVLALTVENFLERRLQTLVFKSGMAKSIHHARVLIRQKHIRVGRQVVNIPSFMVRLDSQKHIDFSLTSPFGGGRPGRVQRKNQKAAAKKAGGGDGDDDDEE

SEQ ID NO: 7618 - protein, 197 aa, Unknown
  Sequence found in Organisms: Glycine max, Glycyrrhiza uralensis, Cajanus cajan
MVHVSFYRNYGKTFKKPRRPYEKERLDAELKLVGEYGLRCKRELWRVQYALSRIRNNARNLLTLDEKNPRRIFEGEALLRRMFRYGLLDETQNKLDYVLALTVENFLERRLQTLVFKSGMAKSIHHARVLIRQRHIRVGRQVVNIPSFMVRVDSQKHIDFSLTSPLGGGRPGRVKRKNQRAAAKKAAGGDGDEEDED

SEQ ID NO: 7619 - protein, 197 aa, Liriodendron tulipifera
MVHVSFYRNYGKTFKKPRRPYEKERLDAELKLVGEYGLRCKRELWRVQYALSRIRNAARELLTLDEKNPRRIFEGEALLRRMNRYGLLDESQNKLDYVLALTVENFLERRLQTLVFKSGMAKSIHHARVLIRQRHIRVGRQVVNIPSFMVRVDSQKHIDFSLTSPLGGGRPGRVKRRNQKAAAKKASGGDGDEDDED

SEQ ID NO: 7620 - protein, 197 aa, Lotus japonicus
MVHVSFYRNYGKTFKKPRRPYEKERLDAELKLVGEYGLRCKRELWRVQYALSRIRNNARNLLTLDEKNPRRIFEGEALLRRMFRYGLLDETQNKLDYVLALTVENFLERRLQTLVFKSGMAKSIHHARVLIRQRHIRVGRQVVNIPSFMVRVDSQKHIDFSLTSPLGGGRPGRVKRKNQKAAAKKASGGDGDEEDED

SEQ ID NO: 7621 - protein, 197 aa, Tropaeolum majus
MVHVNFYRNYGKTFKKPRRPYEKERLDAELKLVGEYGLRCKRELWRVQYALSRIRNAARELLTLDEKNPRRIFEGEALLRRMNRYGLLDESQSKLDYVLALTVENFLERRLQTLVFKSGMAKSIHHARVLIRQRHIRVGRQVVNIPSFMVRMDSQKHIDFSLTSPFGGGRPGRVKRRNMRAASKKASGGDGDDEDEE

SEQ ID NO: 7622 - protein, 197 aa, Elaeis guineensis
MVHVSFYRNYGKTFKKPRRPYEKERLDAELKLVGEYGLRAKRELWRVQYALSRIRNAARELLTLDEKNPRRIFEGEALLRRMNRYGLLDENQNKLDYVLALTVENFLERRLQTQVFKSGMAKSIHHARVLIRQRHIRVGRQVVNIPSFMVRVDSAKHIDFALNSPFGGGRPGRVKRKNQKAAAKKAAGGDGDEEDED

SEQ ID NO: 7623 - protein, 197 aa, Platanus occidentalis
MVHVNFYRNYGKTFKKPRRPYEKERLDAELKLVGEYGLRCKRELWRVQYALSRIRNAARELLTLDEKNPRRIFEGEALLRRMNRYGLLDESQNKLDYVLALTVENFLERRLQTLVFKSGMAKSIHHARVLIRQRHIRVGRQVVNIPSFMVRMDSQKHIDFSLTSPLGGGRPGRVKRKNQKAAAKKAAGGDGDEEDED

SEQ ID NO: 7624 - protein, 197 aa, Platanus occidentalis
MVHVNFYRNYGKTFKKPRRPYEKERLDAELKLVGEYGLRCKRELWRVQYALSRIRNAARELLTLDEKNPRRIFEGEALLRRMNRYGLLDESQNKLDYVLALTVENFLERRLQTLVFKSGMAKSIHHARVLIRQRHIRVGRQVVNIPSFMVRMDSQKHIDFSLTSPLGGGRPGRVKRKNQKAAAKKAAGGDGEEEDED

SEQ ID NO: 7625 - protein, 197 aa, Carthamus tinctorius
MVHVNFYRNYGKTFKKPRRPYEKERLDAELKLVGEYGLRCKRELWRVQYALSRIRNAARMLLTLEEKDPRRIFEGEALMRRMNRYGLLDESQNKLDYVLALTVENFLERRLQTLVFKTGMAKSIHHARVLIKQRHIRVGRQVVNVPSFMVRVDSQKHIDFSLTSPFGGGRPGRVKRKNQKAAAKKAAGGDAEEDDEE

SEQ ID NO: 7626 - protein, 197 aa, Scabiosa columbaria
MVHVNFYRNYGKTFKKPRRPYEKERLDAELKLVGEYGLRCKRELWRVQYALSRIRNAARMLLTLDEKDPRRIFEGEALLRRMNRHGLLDESQNKLDYVLALTVENFLERRLQTLVFKTGMAKSIHHARVLIRQRHIRVGRQVVNVPSFMVRVDSQKHIDFSLTSPFGGGRPGRVKRRNQKAAAKKAAGGDGEEEDED

SEQ ID NO: 7627 - protein, 197 aa, Silene vulgaris
MVHVNFFRNYGKTFKKPRRPYEKERLDAELKLVGEYGLRNKRELWRVQYVLSRIRNAARHLLTLDEKNPRRIFEGEALLRRMNRYGLLEEGQNKLDFVLALTVENFLERRLQTQVFKSGMAKSIHHARVLIKQKHIRVGRQVVNVPSFMVRVDSQKHIDFSLTSPFGGGRPGRVKRKNQKAAAKKASGGDGDEEDED

SEQ ID NO: 7628 - protein, 197 aa, Taxus baccata
MVHVSFYRNYGKTFKKPRRPYEKERLDAELKLVGEYGLRNKRELWRVQYTLSRIRKAARMLLTLDEKNPRRIFEGEALLRRMNRYGLLDESQNKLDYVLALTVENFLERRLQTLVFKAGMAKSIHHARVLIRQRHIRVGRQVVNIPSFMVRVDSQKHIDFSLTSPLGGGRPGRVKRKNMKAASKKAAGGDGEEEDEE

SEQ ID NO: 7629 - protein, 197 aa, Nicotiana tabacum
MVHVAFYRNYGKTFKKPRRPFEKERLDAELKLVGEYGLRCKRELWRVQYALSRIRNAARMLLTLDEKDPRRIFEGEALLRRMNRYGLLDESQNKLDYVLSLTVENFLERRLQTLVFKTGMAKSIHHARVLIRQRHIRVGRQVVNVPSFMVRLDSQKHIDFSLTSPFGGGRPGRVKRKNQKAAAKKASGGDGDEEDEE

SEQ ID NO: 7630 - protein, 197 aa, Triphysaria pusilla
MVHVSFYRNYGKTFKKPRRPYEKERLDAELKLVGEYGLRCKRELWRVQFALSRIRNNARDLLTLDEKDPRRIFEGEALLRRMNRYGLLDESQNKLDYVLALTVENFLERRLQTLVFKAGMAKSIHHARVLIRQRHIRVGRQVVNVPSFMVRVDSQKHIDFSLTSPFGGGRAGRVKRKNQKAAAKKAGGGGDEEEDED

SEQ ID NO: 7631 - protein, 197 aa, Tripterygium wilfordii
MVHVNFYRNYGKTFKKPRRPYEKERLDAELKLVGEYGLRCKRELWRVQYALSRIRNAARMLLTLDEKNTRRIFEGEALLRRMNRYGLLDESQNKLDYVLALTVENFLERRLQTLVFKSGMAKSIHHARVLIRQRHIRVGRQVVNIPSFMVRVDSQKHIDFSLTSPFGGGRAGRVKRKNMKAAAKKAAGGDGDEEDEE

SEQ ID NO: 7632 - protein, 197 aa, Utricularia gibba
MVHVSFYRNYGKTFKKPRRPYEKERLDAELKLVGEYGLRCKRELWRVQYALSRIRNNARDLLTLDEKDSRRIFEGEALLRRMNRYGLLDESQNKLDYVLALTVENFLERRLQTLVFKAGMAKSIHHARVLIRHRHIRVGRQVVNVPSFMVRVDSQKHIDFSLTSPFGGGRPGRVKRRNQKAASKKASGGDDDEEDEE

SEQ ID NO: 7633 - protein, 197 aa, Juglans hindsii x Juglans regia
MVHVSFYRNYGKTFKKPRRPYEKERLDAELKLVGEYGLRCKRELWRVQYALSRIRNNARMLLTLDEKNPRRIFEGEALLRRMNRYGLLDESQNKLDYVLALTVENFLERRLQTLVFKSGMAKSIHHARVLIRQKHIRVGRQVVNIPSFMVRVDSQKHIDFSLTSPFGGGRPGRVKRRNQKSAAKKAAGGDADEEDEE

SEQ ID NO: 7634 - protein, 193 aa, Euphorbia peplus
VSFYRNYGKTFKKPRRPYEKERLDAELKLVGEYGLRCKRELWRVQYALSRIRNAARMLLTLDEKNPRRIFEGEALLRRMNRYGLLDESQNKLDYVLALTVENFLERRLQTLVFKSGMAKSIHHARVLIRQRHIRVGRQVVNIPSFMVRVDSQKHIDFSLTSPFGGGRPGRVKRRNQRAASKKASGDGDEEDEE

SEQ ID NO: 7635 - protein, 196 aa, Euphorbia peplus
MVHVNFYRNYGKTFKKPRRPYEKERLDAELKLVGEYGLRCKRELWRVQYALSRIRNAARMLLTLDEKNPRRIFEGEALLRRMNRYGLLDESQNKLDYVLALTVENFLERRLQTLVFKSGMAKSIHHARVLIRQRHIRVGRQAVNIPSFMVRVDSQKHIDFSLTSPLGPGRPGRVKRRNQKAASKKASGDGDEEDEE

SEQ ID NO: 7636 - protein, 195 aa, Pseudoroegneria spicata
MVHVNFYRNYGKTFKKPRRPYEKERLDAELKLVGEYGLRAKRELWRVQYALSRIRNAARELLTLDEKNPRRIFEGAALLRRMNRYGLLSEEQNKLDYVLALTVENFLQRRLQTIVFKNGMAKSIHHARVLIRQRHIRVGKQLVNIPSFMVRVDTEKHVDFSLTSPLGGGPAGRVKRKNQKKASGGGGDDGEEEED

SEQ ID NO: 7637 - protein, 133 aa, Ambrosia trifida
MLLTLEEKDPRRIFEGEALMRRMNRYGLLDESQNKLDYVLALTVENFLERRLQTLVFKTGMAKSIHHARVLIKQRHIRVGRQVVNVPSFMVRVDSQKHIDFSLTSPFGGGRPGRVKRKNQKAAAKKAAGGDAD

SEQ ID NO: 7638 - protein, 197 aa, Guizotia abyssinica
MVHVPFYRNYGKTFKKPRRPYEKERLDAELKLVGEYGLRCKRELWRVQYALSRIRNAARMLLTLDEKDPRRIFEGEALMRRMNRYGLLDESQNKLDYVLALTVENFLERRLQTLVFKTGMAKSIHHARVLIKQRHIRVGRQVVNVASFMVRVDSQKHIDFSLTSPFGGGRPGRVKRKNQKAAAKKAAGGADDEDDEE

SEQ ID NO: 7639 - protein, 197 aa, Mimulus guttatus
MVHVCFYRNYGKTFKKPRRPYEKERLDAELKLVGEYGLRCKRELWRVQYALSRIRNNARNLLTLDEKDPRRIFEGEALMRRMNKYALLDESQNKLDYVLALTVENFLERRLQTLVFKAGMAKSIHHARVLIRQRHIRVGRQVVNVPSFMVRVDSQKHIDFSLTSPFGGGRPGRVKRRNQKSASKKASGGDGDEDEEE

SEQ ID NO: 7640 - protein, 198 aa, Quercus alba
MVHVAFYRNYGKTFKKPRRPYEKERLDAELRLVGEYGLRCKRELWRVQYALSRIRNNARMLLTLDEKNQRRIFEGEALLRRMNRYGLLDESQNKLDYVLALTVENFLERRLQTLVFKSGMAKSIHHARVLIRQKHIRVGRQVVNIPSFMVRVDSQKHIDFSLNSPFGGGRPGRVKRRNQKSAAKKAAGGDGGDEDEEE

SEQ ID NO: 7641 - protein, 198 aa, Valeriana officinalis
MVHVNFYRNYGKTFKKPRRPYEKERLDAELKLVGEYGLRCKRELWRVQYALSRIRNAARMLLTLDEKDQRRIFEGEALLRRMNRYGLLDESQNKLDYVLALTVENFLERRLQTLVFKAGMAKSIHHARVLIRQRHIRVGRQVVNVPSFMVKLDSQKHIDFSLTSPFGGGRPGRVKRRNQKSAAKKAAGGGDGDEEDED

SEQ ID NO: 7642 - protein, 197 aa, Unknown
  Sequence found in Organisms: Glycine max, Phaseolus coccineus, Vigna unguiculata
MVHVSFYRNYGKTFKKPRRPYEKERLDAELKLVGEYGLRCKRELWRVQYALSRIRNNARNLLTLDEKNPRRIFEGEALLRRMFRYGLLDETQNKLDYVLALTVENFLERRLQTLVFKSGMAKSIHHARVLIKQRHIRVGRQVVNIPSFLVRVDSQKHIDFSLTSPLGGGRPGRVKRRNQRAAAKKAAGGDGDEEDED

SEQ ID NO: 7643 - protein, 197 aa, Phaseolus coccineus
MVHVSFYRNYGKTFKKPRRPYEKERLDAELKLVGEYGLRCKRELWRVQYALSRIRNNARNLLTLDEKNPRRIFEGEALLRRMFRYGLLDETQNKLDYVLALTVENFLERRLQTLVFKSGMAKSIHHARVLIKQRHIRVGRQVVNIPSFLVRVDSQKHIDFSLTSPLGGGRPGRVKRRNQRAAAKKASGGDGDEEDED

SEQ ID NO: 7644 - protein, 197 aa, Vaccinium corymbosum
MVHVNYYRNYGKTFKKPRRPYEKERLDAELKLVGEYGLRCKRELWRVQYALSRIRNAARMLLTLDEKNQRRIFEGEALLRRMNRYGLLDESQNKLDYVLALTVENFLERRLQTLVFKTGMAKSIHHARVLIRQRHIRVGRQVVNVPSFMVRLDSQKHIDFSLTSPLGGGRPGRVKRKNMKAAAKKAAGGDGDEEDEE

SEQ ID NO: 7645 - protein, 197 aa, Abies balsamea
MVHVSFYRNYGKTFKKPRRPYEKERLDAELKLVGEYGLRNKRELWRVQYTLSRIRNAARMLLTLDEKNPRRIFEGEALLRRMNRYGLLDETQTKLDYVLALTVENFLERRLQTLVFKSGMAKSIHHARVLIRQRHIRVGRQVVNIPSFMVRVDSQKHIDFSLTSPLGGGRPGRVKRKNLKAASKKAAGGDGEEEDEE

SEQ ID NO: 7646 - protein, 197 aa, Ambrosia trifida
MVHVPFYRNYGKTFKKPRRPYEKERLDAELKLVGEYGLRCKRELWRVQYALSRIRNAARMLLTLEEKDPRRIFEGEALMRRMNRYGLLDESQNKLDYVLALTVENFLERRLQTLVFKTGMAKSIHHARVLIKQRHIRVGRQVVNVPSFMVRVDSQKHIDFSLTSPFGGGRPGRVKRRNQKAAAKKAAGGDADEDDEE

SEQ ID NO: 7647 - protein, 197 aa, Ambrosia trifida
MVHVPFYRNYGKTFKKPRRPYEKERLDAELKLVGEYGLRCKRELWRVQYALSRIRNAARMLLTLEEKDPRRIFEGEALMRRMNRYGLLDESQNKLDYVLALTVENFLERRLQTLVFKTGMAKSIHHARVLIKQRHIRVGRQVVNVASFMVRVDSQKHIDFSLTSPFGGGRPGRVKRKNQKAAAKKAAGGDADEDDEE

SEQ ID NO: 7648 - protein, 197 aa, Arnica chamissonis
MVHVNFYRNYGKTFKKPRRPYEKERLDAELKLVGEYGLRCKRELWRVQYALSRIRNAARMLLTLEEKDPRRIFEGEALMRRMNRYGLLDESQNKLDYVLALTVENFLERRLQTLVFKTGMAKSIHHARVLIKQRHIRVGRQVVNVPSFMVRVDSQKHIDFSLTSPFGGGRPGRVKRKNQKAAAKKAAGADADEDDEE

SEQ ID NO: 7649 - protein, 197 aa, Cephalotaxus harringtonia
MVHVSFYHNYGKTFKKPRRPYEKERLDAELKLVGEYGLRNKRELWRVQYTLSRIRNAARMLLTLDEKNSRRIFEGEALLRRMNRYGLLDEGQDKLDYVLALTVENFLERRLQTLVFKAGMAKSIHHARVLIRQRHIRVGRQVVNIPSFMVRVDSQKHIDFSLTSPLGGGRPGRVKRKNMKAASKKAAGGDGEEEDEE

SEQ ID NO: 7650 - protein, 197 aa, Cleome spinosa
MVNVSFYRNYGKTFKKPRRPYEKERLDAELKLVGEYGLRCKRELWRVQYALSRIRNAARDLLTLDEKNPRRIFEGEALLRRMNKYGLLDESQNKLDYVLALTVENFLERRLQTLVFKSGMAKSIHHARVLIRQRHIRVGRQLVNIPSFMVKVDSQKHIDFSLTSPFGGGRPGRVKRRNEKAGAKKAGGGDGDEEDEE

SEQ ID NO: 7651 - protein, 197 aa, Gossypium hirsutum
MVHVSFYRNYGKTFKKPRRPYEKERLDAELRLVGEYGLQCKRELWRVQYALSRIRNAARDLLTLDEKNPRRIFEGEALHRRMNRYGLLDESQNKLDYVLALTVENFLERRLQTLVFKTGMAKSIHHARVLIGQRHIRVGRQVVNIPSFMVRVDSQKHIDFSLTSPFGGGRPGRVKRKNQIAAAKKAAGGDGDEEEDE

SEQ ID NO: 7652 - protein, 196 aa, Cryptomeria japonica
MVHVSFYRNYGKTFKKPRRPYEKERLDAELKLVGEYGLRNKRELWRVQYALSRIRNAARMLLTLDEKNPRRIFEGEALLRRMNRYGLLDESQNKLDYVLALTVENFLERRLQTLVFKSGMAKSIHHARVLIRQRHIRVGRQVVNIPSFMVRVDSQKHIDFSLTSPLGGGRPGRVKRKNMKAASKKAAGGDEEEDED

SEQ ID NO: 7653 - protein, 197 aa, Eschscholzia californica
MVHVNFYRNYGKTFKKPRRPYEKERLDAELKLVGEYGLRCKRELWRVQYALSRIRNAARMLLTLDEKNPRRIFEGEALLRRMNRYGLLDESQNKLDYVLALTVENFLERRLQTLVFKSGMAKSIHHARVLIRQRHIRVGRQVVNIPSFMVRVDSQKHIDFSLTSPLGGGRAGRVKRRNLRAASKKAGGGDGDEEDED

SEQ ID NO: 7654 - protein, 197 aa, Eschscholzia californica
MVHVNFYRNYGKTFKKPRRPYEKERLDAELKLVGEYGLRCKRELWRVQYALSRIRNAARMLLTLDEKNPRRIFEGEALLRRMNRYGLLDESQNKLDYVLALTVENFLERRLQTLVFKSGMAKSIHHARVLIRQRHIRVGRQVVNIPSFMVRVDSQKHIDFSLTSPLGGGRAGRVKRRNQKAASKKAAGGDGDEEDED

SEQ ID NO: 7655 - protein, 197 aa, Eschscholzia californica
MVHVNFYRNYGKTFKKPRRPYEKERLDAELKLVGEYGLRCKRELWRVQYALSSIRNAARMLLTLDEKNPRRIFEGEALLRRMNRYGLLDESQNKLDYVLALTVENFLERRLQTLVFKSGMAKSIHHARVLIRQRHIRVGRQVVNIPSFMVRVDSQKHIDFSLTSPLGGGRAGRVKRRNQKAAAKKAGGGDGDEEDED

SEQ ID NO: 7656 - protein, 197 aa, Eucalyptus grandis
MVHVSFYRNYGKTFKKPRRPYEKERLDAELKLVGEYGLRCKRELWRVQYVLSRIRNNARMLLTLDEKNPRRIFEGEALLRRMNRYGLLDESQNKLDYVLALTVENFLERRLQTLVFKSGMAKSIHHARVLIRQRHIRVGRQVVNIASFMVRVDSQKHIDFSLTSPFGGGRPGRVKRKNTKAAAKKASGGDGDEEDED

SEQ ID NO: 7657 - protein, 197 aa, Eucalyptus grandis
MVHVSFYRNYGKTFKKPRRPYEKERLDAELKLVGEYGLRCKRELWRVQYVLSRIRNNARMLLTLDEKNPRRIFEGEALLRRMNRYGLLDESQNKLDYVLALTVENFLERRLQTLVFKSGMAKSIHHARVLIRQRHIRVGRQVVNIPSFMVRVDSQKHIDFSLTSPFGGGRAGRVKRKNLKSAAKKASGGDGDEEDED

SEQ ID NO: 7658 - protein, 197 aa, Fagopyrum esculentum
MVHVSYYRNYGKTFKKPRRPYEKERLDAELKLVGEYGLRCKRELWRVQYALSRIRNNARHLLTLDEKDTKRIFEGEALLRRMNRYGLLDESQNKLDYVLSLTVENFLERRLQTLVFKSGMAKSIHHARVLIRQKHIRVGRQVVNIPSFMVRVDSQKHIDFSLNSPFGGGRPGRVKRKNQKAAAKKASGGDGEDEDEE

SEQ ID NO: 7659 - protein, 197 aa, Panax ginseng
MVHVNFYRNYGKTFKKPRRPYEKERLDAELKLVGEYGLRCKRELWRVQYALSRIRNAARNLLTLDEKDPRRIFEGEALLRRMNRYGLLDESQNKLDYVLALTVENFLERRLQTLVFKTGMAKSIHHARVLIRQRHIRVGRQVVNVASFMVRVDSQKHIDFSLTSPFGGGRPGRVKRRNQKAAAKKAAGRAGDEEEED

SEQ ID NO: 7660 - protein, 197 aa, Guizotia abyssinica
MVHVPFYRNYGKTFKKPRRPYEKERLDAELKLVGEYGLRCKRELWRVQYALSRIRNAARMLLTLEEKDQRRIFEGEALMRRMNRYGLLDESQNKLDYVLALTVENFLERRLQTLVFKTGMAKSIHHARVLIKQRHIRVGRQVVNVPSFMVRVDSQKHIDFSLTSPFGGGRPGRVKRKNQKAAAKKAAGGDADEDDEE

SEQ ID NO: 7661 - protein, 197 aa, Ipomoea batatas
MVHVSFYRNYGKTFKKPRRPYEKERLDAELKLVGEYGLRCKRELWRVQYALSRIRNNARMLLTLDEKDPRRIFEGDALLRRMNRYGLLDESQNKLDYVLALTVENFLERRLQTLVFKAGMAKSIHHARVLIRQRHIRVGRQVVNVPSFMVRLDSQKHIDFSLTSPFGGGRPGRVNRKNHKAAAKKAAGGDGDEEDEQ

SEQ ID NO: 7662 - protein, 197 aa, Ipomoea nil
MVHVNFYRNYGKTFKKPRRPYEKERLDAELKLLGEYGLRCKRELWRVQYALSRIRNNARMLLTLDEKDPRRIFEGDALLRRMNRYGLLDESQNKLDYVLALTVENFLERRLQTLVFKAGMAKSIHHARVLIRQKHIRVGRQVVNVPSFLVRMDSQKHIDFSLSSPFGGGRPGRVKRKNQKAAAKKASGGDGDEEDEE

SEQ ID NO: 7663 - protein, 197 aa, Actinidia deliciosa
  misc_feature (5)..(5): Xaa can be any naturally occurring amino acid
  misc_feature (71)..(71): Xaa can be any naturally occurring amino acid
  misc_feature (152)..(152): Xaa can be any naturally occurring amino acid
  misc_feature (155)..(155): Xaa can be any naturally occurring amino acid
MVHVXFYRNYGKTFKKPRRPYEKERLDAELKLVGEYGLRCKRELWRVQYALSRIRNAARMLLTLDEKNPRXIFEGEALLRRMNRYGLLEENQNKLDYVLALTVENFLERRLQTLVFKTGMAKSIHHARVLIRQKHIRVGRQVVNIPSFMVRXDSXKHIDFSLTSPLGGGRPGRVKRKNQKAAANKAAGGDGDEEDEE

SEQ ID NO: 7664 - protein, 197 aa, Glycyrrhiza uralensis
MVHVSFYRNYGKTFKKPRRPYEKERLDAELKLVGEYGLRCKRELWRVQYALSRIRNNARNLLTLDEKNPRRIFEGEALLRRMFRYGLLDETQNKLDYVLALTVENFLERRLQTLVFKSGMAKSIHHARVLIRQRHIRVGRQVVNIPSFMVRVDSQKHIDFSLTSPLGGGRPGRVKRKNLRAAAKKASGGDGDEEDED

SEQ ID NO: 7665 - protein, 197 aa, Tropaeolum majus
MVHVNFYRNYGKTFKKPRRPYEKERLDAELKLVGEYGLRCKRELWRVQYALSRIRNAARELLTLDEKNPRRIFEGEALLRRMNRYGLLDESQSKLDYVLALTVENFLERRLQTLVFKSGMAKSIHHARVLIRQRHIRVGRQVVNIPSFMVRMDSQKHIDFSLTSPFGGGRPGRVKRRNMRAASKKASGGDGDEEDEE

SEQ ID NO: 7666 - protein, 197 aa, Nicotiana benthamiana
MVHVAFYRNYGKTFKKPRRPYEKERLDAELKLVGEYGLRCKRELWRVQYALSRIRNAARMLLTLDEKDPRRIFEGEALMRRMNRYGLLDESQNKLDYVLSLTVENFLERRLQTLVFKTGMAKSIHHARVLIRQRHIRVGRQVVNVPSFMVRLDSQKHIDFSLTSPFGGGRPGRVKRKNQKAAAKKASGGDGDEDDEE

SEQ ID NO: 7667 - protein, 197 aa, Elaeis guineensis
MVHVSFYRNYGKTFKKPRRPYEKERLDAELKLVGEYGLRCKRELWRVQYVLSRIRNAARELLTLDEKNPRRIFEGEALLRRMNRFGLLDENQNKLDYVLALTVENFLERRLQTQVFKSGMAKSIHHARVLIRQRHIRVGRQLVNIPSFMVRVDSAKHIDFALNSPFGGGRPGRVKRKNQKAAAKKAAGGDGDEEDED

SEQ ID NO: 7668 - protein, 197 aa, Carica papaya
MVNVSFYRNYGKTFKKPRRPYEKERLDAELKLVGEYGLRCKRELWRVQYALSRIRNAARELLTLDEKNPRRIFEGEALLRRMNRYGLLDESQNKLDYVLALTVENFLERRLQTLVFKSGMAKSIHHARVLIRQKHIRVGRQVVNIPSFIVRVDSQKHIDFSLTSPFGGGRPGRVKRKNMRAAAKKAAGGDGDEEEEE

SEQ ID NO: 7669 - protein, 197 aa, Arachis hypogaea
MVHVSFYRNYGKTFKKPRRPYEKERLDAELKLVGEYGLRCKRELWRVQYALSRIRNNARTLLTLDEKNPRRIFEGEALLRRMFRYGLLDETQNKLDYVLALTVENFLERRLQTLVFKSGMAKSIHHARVLIRQRHIRVGRQVVNIPSFMVRVDSQKHIDFSLTSPLGGGRPGRVKRRNQRAAAKKASGGDGDEEDED

SEQ ID NO: 7670 - protein, 197 aa, Pisum sativum
MVHVSFYRNYGKTFKKPRRPYEKERLDAELKLVGEYGLRCKRELWRVQYALSRIRNNARNLLTLDEKNPRRIFEGEALLRRMFRYGLLDETQNKLDYVLALTVENFLERRLQTLVFKSGMAKSIHHARVLIRQRHIRVGRQVVNIPSFMVRVDSQKHIDFSLTSPLGGGRPGRVKRKNLKAAAKKASGGDGDEEDED

SEQ ID NO: 7671 - protein, 197 aa, Lippia dulcis
MVHVSFYRNYGKTFKKPRRPYEKERLDAELKLVGEYGLRCKRELWRVQYALSRIRNNARNLLTLDEKDPRRIFEGEALLRRMNRYGLLDESQNKLDYVLSLTVENFLERRLQTLVFKAGMAKSIHHARVLIRQRHTRVGRQVVNVASFLVRVDSQKHIDFSLTSPFGGGRPGRVKRKNQKAAAKKASGGDGDEDDEE

SEQ ID NO: 7672 - protein, 197 aa, Podocarpus macrophillus
MVHVSFYRNYGKTFKKPRRPYEKERLDAELKLVGEYGLRNKRELWRVQYTLSRIRNAARMLLTLDEKNPRRIFEGEALLRRMNRYGLLDESQNKLDYVLALTVENFLERRLQTLVFKSGMAKSIHHARVLIRQRHIRVGRQVVNIPSFMVRVDSQKHIDFSLTSPLGGGRPGRVKRKNMKAASKKAAGGDAEEEDEE

SEQ ID NO: 7673 - protein, 197 aa, Papaver somniferum
MVHVNVYRNYGKTFKKPRRPYEKERLDAELKLVGEYGLRCKRELWRVQYALSRIRNAARELLTRDEKDPRRIFEGEALLRRMNRYGLLDESQNKLDYVLALTVENFLERRLQTLVFKSGMAKSIHHARVLIRQRHIRVGRQVVNIPSFMVRVESQKHIDFSLTSPLGGGRPGRVKRRNQKAAAKKAAGGDGDEEDEE

SEQ ID NO: 7674 - protein, 197 aa, Salvia sclarea
MVHVSFYRNYGKTFKKPRRPYEKERLDAELKLVGEYGLRCKRELWRVQYALSRIRNNARNLLTLDEKDPRRIFEGEALLRRMNKYALLDESQNKLDYVLSLTVENFLERRLQTLVFKAGMAKSIHHARVLIRQRHIRVGRQVVNVPSFLVRVDSQKHIDFSLTSPFGGGRPGRVKRKNQKAAAKKASGGDGDEDDEE

SEQ ID NO: 7675 - protein, 197 aa, Scabiosa columbaria
MVHVNFYRNYGKTFKKPRRPYEKERLDAELKLVGEYGLRCKRELWRVQYALSRIRNAARMLLTLDEKDPRRIFEGEALLRRMNRHGLLDESQNKLDYVLALTVENFLERRLQTLVFKTGMAKSIHHARVLIRQRHIRVGRQVVNVPSFMVRVDSQKHIDFSLTSPFGGGRPGRVKRRNQKAAAKKAAGGDGEEEEED

SEQ ID NO: 7676 - protein, 197 aa, Senecio madagascariensis
MVHVNFYRNYGKTFKKPRRPYEKERLDAELKLVGEYGLRCKRELWRVQYALSRIRNAARMLLTLEEKDPRRIFEGEALMRRMNRYGLLDESQNKLDYVLALTVENFLERRLQTLVFKTGMAKSIHHARVLIKQRHIRVGRQVVNVASFMVRVDSQKHIDFSLTSPFGGGRPGRVKRKNQKAAAKKASGGDADEDDEE

SEQ ID NO: 7677 - protein, 197 aa, Sequoia sempervirens
MVHVSFYRNYGKTFKKPRRPYEKERLDAELKLVGEYGLRNKRELWRVQYALSRIRNAARMLLTLDEKNSRRLFEGEALLRRMNRYGLLDESQNKLDYVLALTVENFLERRLQTLVFKSGMAKSIHHARVLIRQRHIRVGRQVVNIPSFMVRMDSQKHIDFSLTSPLGGGRPGRVKRKNMKAASKKAAGGDGEDEDEE

SEQ ID NO: 7678 - protein, 197 aa, Camellia sinensis
MVHVNFYRNYGKTFKKPRRPYEKERLDAELKLVGEYGLRCKRELWRVQYALSRIRNAARMLLTLDEKNPRRIFEGEALLRRMNRYGLLDESQNKLDYVLALTVENSLERRLQTLVFKTGMAKSIHHARVLIRQRHIRVGRQVVNIASFMVRVDSQKHIDFSLTSPLGGGRPGRVKRRNQKAAAKKASGGDGDEEDEE

SEQ ID NO: 7679 - protein, 197 aa, Nicotiana tabacum
MVHVAFYRNYGKTFKKPRRPYEKERLDAELKLVGEYGLRCKRELWRVQYALSRIRNAARMLLTLDEKDPRRIFEGEALMRRMNRYGLLDESQNKLDYVLSLTVENFLERRLQTLVFKTGMAKSIHHARVLIRQRHIRVGRQVVNVPSFMVRLDSQKHIDFSLTSPFGGGRPGRVKRKNQKSAAKKASGGDGDEDDEE

SEQ ID NO: 7680 - protein, 197 aa, Tripterygium wilfordii
MVHVNFYRNYGKTFKKPRRPYEKERLDAELKLVGEYGLRCKRELWRVQYALSRIRNAARMLLTLDEKNTRRIFEGEALLRRMNRFGLLDESQNKLDYVLALTVENFLERRLQTLVFKSGMAKSIHHARVLIRQRHIRVGRQVVNIPSFMVRVDSQKHIDFSLTSPFGGGRAGRVKRKNMKAAAKKAAGGDGDEEDEE

SEQ ID NO: 7681 - protein, 189 aa, Bupleurum chinense
MVHVNFYRNYGKTFKKPRRPYEKERLDAELKLVGEYGLRCKRELWRVQYALSRIRNAARNLLTLEEKDPRRIFEGEALLRRMNRYGLLDESQNKLDYVLALTVENFLERRLQTLVFKTGMAKSIHHARVLIRQRHIRVGRQVVNVPSFMVRVDSQKHIDFSLTSPFWRRPSRPSEAKEHEGSFKEAIRW

SEQ ID NO: 7682 - protein, 150 aa, Epimedium sagittatum
MVHVSFYRNYGKTFKKPRRPYEKERLDAELKLVGEYGLRCKRELWRVQYALSRIRNNARMLLTLDEKNSRRIFEGEALLRRMNRYGLLDEGQNKLDYVLALTVENFLERRLQTLVFKSGMAKSIHHARVLIRQRHIRVGRTGREYPILHG

SEQ ID NO: 7683 - protein, 223 aa, Guizotia abyssinica
MIHVPFYRNYGKTFKKPRRPYEKERLDAELKLVGEYGLRCKRELWRVQYALSRIRNAARMLLTLDEKDPRRIFEGEALMRRMNRYGLLDESQNKLDYVLALTVENFLERRLQTLVFKTGMAKSIHHARVLIKQRHIRVGRQVVNVASFMVRVDSQKHIDFSLTSPFGGGRPGRVKRKNQKAAAKKRQVVMLTKTTKKSCHGHQGISSFIFSSYQTWLFNLFRT

SEQ ID NO: 7684 - protein, 143 aa, Lippia dulcis
MVHVSFYRNYGKTFKKPRRPYEKERLDAELKLVGEYGLRCKRELWRVQYALSRIRNNARNLLTLDEKDPRRIFEGEALLRRMNRYGLLDESQNKLDYVLSLTVENFLERRLTNSCLQGGYGQVHPPRQSSNQAEAYKSWKASC

SEQ ID NO: 7685 - protein, 188 aa, Vaccinium corymbosum
MGRLLRSLAVLMRRSVLDAELKLVGEYGLRCKRELWRVQYALSRIRNAARMLLTLDEKNPRRIFEGEALLRRMYRYGLLDENQNKLDYVLALTVENFLERRLQTLVFKTGMAKSIHHARVLIRQRHIRVGRQVVNIASFMVRLDSQKHIDFSLTSPLGGGRPGRVKRKNQKAAAKKAAGGDGDEEDEE

SEQ ID NO: 7686 - protein, 195 aa, Hordeum vulgare
MVHVNFYRNYGKTFKKPRRPYEKERLDAELKLVGEYGLRAKRELWRVQYALSRIRNAARELLTLDEKSPRRIFEGAALLRRMNRYGLLSEDQNKLDYVLALTVENFLQRRLQTIVFKNGMAKSIHHARVLIRQRHIRVGKQLVNIPSFMVRVDTEKHVDFSLTSPLGGGPAGRVKRKNQKKASGGGGDEGEEEED

SEQ ID NO: 7687 - protein, 189 aa, Cirsium arvense
MVHVPFYRNYGKTFKKPRRPYEKERLDAELKLVGEYGLRCKRELWRVQYALSRIRNAARMLLTLEEKDPRRIFEGEALMRRMNRYGLLDESQNKLDYVLALTVENFLERRLQTLVFKTGMAKSIHHARVLIKQRHIRVGRQVVNVPSFMVRVDSQKHIDFSLTSPFGGGRPGRVKRKNQKAAAKKASGG

SEQ ID NO: 7688 - protein, 195 aa, Leymus cinereus x Leymus triticoides
MVHVNFYRNYGKTFKKPRRPYEKERLDAELKLVGEYGLRAKRELWRVQYALSRIRNAARELLTLDEKNPRRIFEGAALLRRMNRYGLLSEEQNKLDYVLALTVDNFLQRRLQTIVFKNGMAKSIHHARVLIRQRHIRVGKQLVNIPSFMVRVDTEKHVDFSLTSPLGGGPAGRVKRKNQKKASGGGGDDGEEEED

SEQ ID NO: 7689 - protein, 197 aa, Trifolium pratense
MVHVSFYRNYGKTFKKPRRPYEKERLDAELKLVGEYGLRCKRELWRVQYALSRIRNNARNLLTLDEKNPRRIFEGEALLRRMFRYGLLDETQNKLDYVLALTVENFLERRLQTLVFKSGMAKSIHHARVLIRQKHIRVGRQVVNIPSFLVRVDSQKHIDFSLTSPFGGGRPGRVKRKNLNAAAKKASGGAGDEEDED

SEQ ID NO: 7690 - protein, 197 aa, Unknown
  Sequence found in Organisms: Aquilegia formosa, Thalictrum flavum
MVHVSFYRNYGKTFKKPRRPYEKERLDAELKLVGEYGLRCKRELWRVQYALSRIRNNARNLLTLDEKNPRRIFEGEALLRRMNRYGLLDESQNKLDYVLALTVENFLERRLQTLVFKSGMAKSIHHARVLIRQRHIRVGRQVVNIPSFMVRVDSQKHIDFSLTSPLGGGRPGRVKRRNMKAAAKKASGGDGDEEEED

SEQ ID NO: 7691 - protein, 197 aa, Ambrosia trifida
MVHVPFYRNYGKTFKKPRRPYEKERLDAELKLVGEYGLRCKRELWRVQYALSRIRNAARMLLTLEEKDPRRIFEGEALMRRMNRYGLLDESQNKLDYVLALTVENFLERRLQTLVFKTGMAKSIHHARVLIKQRHIRVGRQVVNVASFMVRVDSQKHIDFSLTSPFGGGRPGRVKRRNQKAAAKKAAGGDADEDDEE

SEQ ID NO: 7692 - protein, 197 aa, Cedrus atlantica
MVHVSFYRNYGKTFKKPRRPYEKERLDAELKLVGEYGLRNKRELWRVQYTLSRIRNAARMLLTLDEKNPRRIFEGEALLRRMNRYGLLDETQNKLDYVLALTVENFLERRLQTLVFKSGMAKSIHHARVLIRQRHIRVGRQVVNIPSFMVRVDSQKHIDFSLTSPLGGGRPGRVKRKNMKAASKKAGGEDGEEEDDD

SEQ ID NO: 7693 - protein, 197 aa, Centaurea maculosa
  misc_feature (180)..(180): Xaa can be any naturally occurring amino acid
  misc_feature (189)..(189): Xaa can be any naturally occurring amino acid
MVHVPFYRNYGKTFKKPRRPYEKERLDAELKLVGEYGLRCKRELWRVQYALSRIRNAARMLLTLEEKDPRRIFEGEALMRRMNRYGLLDESQNKLDYVLALTVENFLERRLQTLVFKTGMAKSIHHARVLIKQRHIRVGRQVVNVPSFMVRLDSQKHIDFSLTSPFGGGRPGRVKRKNQXAAAKKASGXDADEDDEE

SEQ ID NO: 7694 - protein, 197 aa, Chelidonium majus
MVHVNVYRNYGKTFKKPRRPYEKERLDAELKLVGEYGLRCKRELWRVQYALSRIRNAARMLLTLDEKNPRRIFEGEALLRRMNRYGLLDESQNKLDYVLALTVENFLERRLQTLVFKSGMAKSIHHARVLIRQRHIRVGRQVVNIPSFMVRLDSQKHIDFSLTSPLGGGRPGRVKRRNQKAAAKKAAGGDGDEEDED

SEQ ID NO: 7695 - protein, 197 aa, Cicer arietinum
MVHVSFYRNYGKTFKKPRRPYEKERLDAELKLVGEYGLRCKRELWRVQYALSRIRNNARNLLTLDEKNPRRIFEGEALLRRMFRYGLLDETQNKLDYVLALTVENFLERRLQTLVFKSGMAKSIHHARVLIRQRHIRVGRQVVNIPSFMVRVDSQKHIDFSLTSPLGGGRPGRVKRRNLKAAAKKAAGGDGDEEDED

SEQ ID NO: 7696 - protein, 197 aa, Cycas rumphii
MVHVSFYRNYGKTFKKPRRPYEKERLDAELKLVGEYGLRNKRELWRVQYSLSRIRNAARMLLTLDEKNPRRIFEGEALLRRMNRYGLLDESQNKLDYVLALTVENFLERRLQTLVFKSGMAKSIHHARVLIRQRHIRVGRQVVNIPSFLVRVDSQKHIDFSLTSPLGGGRPGRVKRKNLKAASKKASGGDGEEEDED

SEQ ID NO: 7697 - protein, 192 aa, Panax ginseng
MVHVNFYRNYGKTFKKPRRPYEKERLDAELKLVGEYGLRCKRELWRVQYALSRIRNAARNLLTLDEKDPRRIFEGEALLRRMNRYGLLDESQNKLDYVLALTVENFLERRLQTLVFKTGMAKSIHHARVLIRQRHIRVGRQVVNVASFMVRVDSQKHIDFSLTSPFGGGRPGRVKRRNQKAAAKKAAGGDGG

SEQ ID NO: 7698 - protein, 197 aa, Gnetum gnemon
MVHVSFYRNYGKTFKKPRRPYEKERLDAELKLVGEYGLRNKRELWRVQYTLSRIRNAARTLLTLDEKNPKRIFEGEALLRRMNRYGLLDETQNKLDYVLALTVENFLERRLQTLVFKSGMAKSIHHARVLIRQRHIRVGRQVVNIPSFMVRVDSQKHIDFSLTSPLGGGRPGRVKRKNMKAASKKAAGGDGEEEDDE

SEQ ID NO: 7699 - protein, 197 aa, Vitis vinifera
MVHVSFYRNYGKTFKKPRRPYEKERLDAELKLVGEYGLRCKRELWRVQYVLSRIRNNARMLLTLDEKNPRRIFEGEALLRRMNRYGLLDESQNKLDYVLALTVENFLERRLQTLVFKSGMAKSIHHARVLIRQRHIRVGRQVVNIPSFLVRMDSQKHIDFSLTSPLGGGRPGRVKRKNQKAAAKKAAGGDGDEEDED

SEQ ID NO: 7700 - protein, 197 aa, Lotus japonicus
MVHVSFYRNYGKTFKKPRRPYEKERLDAELKLVGEYGLRCKRELWRVQYALSRIRNNARNLLTLDEKNPRRIFEGEALLRRMFRYGLLDETQNKLDYVLALTVENFLERRLQTLVFKSGMAKSIHHARVLIRQRHIRVGRQVVNIPSFMVRMDSQKHIDFSLTSPLGGGRPGRVKRKNMKAAAKKAAGGDGDEEDED

SEQ ID NO: 7701 - protein, 197 aa, Unknown
  Sequence found in Organisms: Pinus pinaster, Pinus taeda
MVHVNFYRNYGKTFKKPRRPYEKERLDAELKLVGEYGLRNKRELWRVQYTLSRIRNAARMLLTLDEKNPRRIFEGEALLRRMNRYGLLDETQSKLDYVLALTVENFLERRLQTLVFKSGMAKSIHHARVLIRQRHIRVGRQVVNIPSFMVRVDSQKHIDFSLTSPLGGGRPGRVKRKNLKAASKKAAGGDGEEEDEE

SEQ ID NO: 7702 - protein, 197 aa, Tropaeolum majus
MVHVNFYRNYGKTFKKPRRPYEKERLDAELKLVGEYGLRAKRELWRVQYALSRIRNAARELLTLDEKNPRRIFEGEALLRRMNRYGLLDESQSKLDYVLALTVENFLERRLQTLVFKSGMAKSIHHARVLIRQRHIRVGRQVVNIPSFMVRMDSQKHIDFSLTSPFGGGRPGRVKRRNMRAASKKASGGDGDEEDEE

SEQ ID NO: 7703 - protein, 197 aa, Carica papaya
MVNVSSYRNCGKTFKKPRRPYEKERLDAELKLVGEYGLRCKRELWRIQYALSRIRNAARELLTLDEKNPRRIFEGEALLRRMNRYGLLDESQNKLDYVLALTVENFLERRLQTLVFKSGMAKSIHHARVLIRQKHIRVGRQVVNIPSFMVRVDSQKHIDFSLTSPFGGGRPGRVKRKNMRAAAKKAGGGDGDEEEEE

SEQ ID NO: 7704 - protein, 197 aa, Pisum sativum
MVHVSFYRNYGKTFKKPRRPYEKERLNAELKLVGEYGLRCKRELWRVQYALSRIRNNARNLLTLDEKNPRRIFEGEALLRRMFRYGLLDETQNKLDYVLALTVENFLERRLQTLVFKSGMAKSIHHARVLIRQRHIRVGRQVVNIPSFMVRVDSQKHIDFSLTSPLGGGRPGRVKRKNLKAAAKKASGGDGDEEDED

SEQ ID NO: 7705 - protein, 197 aa, Pseudotsuga menziesii
MVHVVFYRNYGKTFKKPRRPYEKERLDAELKLVGEYGLRNKRELWRVQYTLSRIRNAARMLLTLDEKNPRRIFEGEALLRRMNRYGLLDETQSKLDYVLALTVENFLERRLQTLVFKSGMAKSIHHARVLIRQRHIRVGRQVVNIPSFMVRVDSQKHIDFSLTSPLGGGRPGRVKRKNMKAASKKAAGGDGEEEDEE

SEQ ID NO: 7706 - protein, 197 aa, Picea glauca
MVHVVFYRNYGKTFKKPRRPYEKERLDAELKLVGEYGLRNKRELWRVQYTLSRIRNAARMLLTLDEKNPRRIFEGEALLRRMNRYGLLDETQSKLDYVLALTVENFLERRLQTLVFKSGMAKSIHHARVLIRQRHIRVGRQVVNIPSFMVRVDSQKHIDFSLTSPLGGGRPGRVKRKNLKAASKKAAGGDGEEEDEE

SEQ ID NO: 7707 - protein, 197 aa, Fragaria vesca
MVHVVFYRNYGKTFKKPRRPYEKERLDAELKLVGEYGLRCKRELWRVQYALSRIRNAARELLTLDEKNPRRIFEGEALLRRMNRYGLLEESQNKLDYVLALTVENFLERRLQTQVFKSGMAKSIHHARVLIRQRHIRVGRQVVNIPSFMVRIDSEKHIDFAITSPLGGGRPGRVKRRNQKAAAKKAAGGDGDEEDEE

SEQ ID NO: 7708 - protein, 196 aa, Taxus baccata
MVHVSFYRNYGKTFKKPRRPYEKERLDAELKLVGEYGLRNKRELWRVQYTLSRIRKAARMLLTLDEKNPRRIFEGEALLRRMNRYGLLDESQNKLDYVLALTVENFLERRLQTLVFKAGMAKSIHHARVLIRQRHIRVGRQVVNIPSFMVRVDSQKHIDFSLTSPLGGGRPGRVKRKNMKAASKKAAGGDEEEDEE

SEQ ID NO: 7709 - protein, 100 aa, Vaccinium corymbosum
MVHVNFYRNYGKTFKKPRRPYEKERLDAELKLVGEYGLRCKRELWRVQYALSRIRNAARMLLTLDEKILAGSLRVRRFYAGCIGMDFWMRTRTSLIMSWL

SEQ ID NO: 7710 - protein, 206 aa, Fagopyrum esculentum
IVGREVSGSHGARFLLSQLWQTFKKPRRPYEKERLDAELKLVGEYGLRCKRELWRVQYALSRIRNNARHLLTLDEKDTKRIFEGEALLRRMNRYGLLDESQNKLDYVLSLTVENFLERRLQTLVFKSGMAKSIHHARVLIRQKHIRVGRQVVNIPSFMVRVDSQKHIDFSLNSPFGGGRPGRVKRKNQKAAAKKASGGDGEDEDEE

SEQ ID NO: 7711 - protein, 109 aa, Juglans hindsii x Juglans regia
MVHVSFYHNYGKTFKKPRRPYEKERLDHELKLVGEYGLRCKRELWRVQYALSCIRNAARELLTLDEKNPRRIFEGEALLRRMNRYGLLDESQNKLDYVLALTVENFLER

SEQ ID NO: 7712 - protein, 195 aa, Secale cereale
MVHVNFYRNYGKTFKKPRRPYEKERLDAELKLVGEYGLRAKRELYRVQYALSRIRNAARELLTLDEKNPRRIFEGAALLRRMNRYGLLTEEQNKLDYVLALTVDNFLQRRLQTIVFKNGMAKSIHHARVLIRQRHIRVGKQLVNIPSFMVRVDTEKHVDFSLTSPLGGGQPGRVKRKNQKKAAGGGGDDGEEEED

SEQ ID NO: 7713 - protein, 195 aa, Zingiber officinale
  misc_feature (11)..(12): Xaa can be any naturally occurring amino acid
  misc_feature (24)..(25): Xaa can be any naturally occurring amino acid
  misc_feature (50)..(50): Xaa can be any naturally occurring amino acid
MVHVSFYRNYXXTFKKPRRPYEKXXLDAELKLVGEYGLRCKRELWRVQYXLSRIRNAARELLTLDEKNPRRIFEGEALLRRMNRYGLLGEGQNKLDYVLALTVENFLERRLQTIVFKSGMAKSIHHARVLIRQRHIRVGRQVVNIPSFMVRVDSAKHIDFSLTSPFGGGRPGRVKRKNQKAAAKKAAGGEEEDEE

SEQ ID NO: 7714 - protein, 195 aa, Triticum aestivum
MVHVNFYRNYGKTFKKPRRPYEKERLDAELKLVGEYGLRAKRELYRVQYALSRIRNAARELLTLDEKNPRRIFEGAALLRRMNRYGLLTEEQNKLDYVLALTVDNFLQRRLQTIVFKNGMAKSIHHARVLIRQRHIRVGKQLVNIPSFMVRVDTEKHVDFSLTSPLGGGQPGRVKRKNQKKASGGGGDDGEEEED

SEQ ID NO: 7715 - protein, 197 aa, Vinca minor
MVHVSFYRNYGKTFKKPRRPYEKERLDAELKLVGEFGLRCKRELWRVQYALSRIRNNARMLLTLDEKDPRRIFEGEALLRRMKRYGLLEEGQDKLDYVLALSVENFLERRLQTLVFKAGMAKSIHHARVLIRQRHIRVGKQVVNVPSFMVRLDSQKHIDFSITSPFGGGRPGRVKRKNTKAAAKKASGGGGDEEDEE

SEQ ID NO: 7716 - protein, 197 aa, Unknown
  Sequence found in Organisms: Medicago truncatula, Trigonella foenum-graecum
MVHVAFYRNYGKTFKKPRRPYEKERLDAELKLVGEYGLRCKRELWRVQYALSRIRNNARTLLTLDEKNPRRIFEGEALLRRMFKHGLLDETQNKLDYVLALTVENFLERRLQTLVFKSGMAKSIHHARVLIRQRHIRVGRQVVNIPSFMVRVDSQKHIDFSLTSPFGGGLPGRVKRKNLKAAAKKASGGDGDEEDED

SEQ ID NO: 7717 - protein, 197 aa, Rosa hybrid cultivar
MVHVVFYRNYGKTFKKPRRPYEKERLDAELKLVGEYGLRCKRELWRVQYALSRIRNAARELLTLDEKNPRRIFEGEALLRRMNRFGLLEESQNKLDYVLALTVENFLERRLQTQVFKSGMAKSIHHARVLIRQRHIRVGRQVVNIPSFMVRIDSEKHIDFAITSPLGGGRPGRVKRRNQKAAAKKAAGGDGDEEDEE

SEQ ID NO: 7718 - protein, 197 aa, Antirrhinum majus
MVHVVFYRNYGKTFKKPRRPYEKERLDAELRLVGEYGLRCKRELWRVQYALSRIRNAARNLLTLEEKDPRRIFEGDALMRRMNRYGLLDESQNKLDYVLALTVENFLERRLQTLVFKAGMAKSIHHARVLIRQKHIRVGRQVVNVPSFMVRVDSQKHIDFSLTSPFGGGRPGRVKRRNQKSAAKKASGGDGDEDDEE

SEQ ID NO: 7719 - protein, 197 aa, Antirrhinum majus
  misc_feature (151)..(151): Xaa can be any naturally occurring amino acid
MVHVVFYRNYGKTFKKPRRPYEKERLDAELRLVGEYGLRCKRELWRVQYALSRIRNAARNLLTLEEKDPRRIFEGDALMRRMNRYGLLDESQNKLDYVLALTVENFLERRLQTLVFKAGMAKSIHHARVLIRQKHIRVGRQVVNVPSFMVXVDSQKHIDFSLTSPFGGGRPGRVKRRNQKSAAKKASGGDGDEEDEE

SEQ ID NO: 7720 - protein, 197 aa, Malus domestica
MVHVVHYRNYGKTFKKPRRPYEKERLDAELKLVGEYGLRAKRELWRVQYSLSRIRNAARELLTLDEKNPRRIFEGEALLRRMNRYGLLDESQNKLDYVLALTVENFLERRLQTLVFKTGMAKSIHHARVLIRQRHIRVGRQVVNIPSFMVRVDSQKHIDFSLTSPLGGGRPGRVKRRNQKAAAKKAAGGDGDEEEEE

SEQ ID NO: 7721 - protein, 197 aa, Malus domestica
MVHVVHYRNYGKTFKKPRRPYEKERLDAELKLVGEYGLRAKRELWRVQYSLSRIRNAARELLTLDEKNPRRIFEGEALLRRMNRYGLLDESQNKLDYVLALTVENFLERRLQTLVFKSGMAKSIHHARVLIRQRHIRVGRQLVNIPSFMVRVDSQKHIDFSLTSPLGGGRPGRVKRRNQKAAAKKAAGGDGDEEEEE

SEQ ID NO: 7722 - protein, 197 aa, Unknown
  Sequence found in Organisms: Castanea mollissima, Quercus alba
MVHVVFYRNYGKTFKKPRRPYEKERLDAELRLVGEYGLRCKRELWRVQYALSRIRNNARMLLTLDEKNSRRIFEGEALLRRMNRYGLLDESQNKLDYVLALTVENFLERRLQTLVFKSGMAKSIHHARVLIRQKHIRVGRQVVNIPSFMVRVDSQKHIDFSLTSPFGGGRPGRVKRRNQKAAAKKAAGGDADEEDEE

SEQ ID NO: 7723 - protein, 197 aa, Cirsium arvense
MVHVPFYRNYGKTFKKPRRPYEKERLDAELKLVGEYGLRCKRELWRVQYALSCIRNAARMLLTLEEKDPRRIFEGEALMRRMNRYGLLDESQNKLDYVLALTVENFLERRLQTLVFKTGMAKSIHHARVLIKQRHIRVGRQVVNVPSFMVRLDSQKHIDFSLTSPFGGGRPGRVKRKNQKAAAKKASAGDVDEDDEE

SEQ ID NO: 7724 - protein, 197 aa, Unknown
  Sequence found in Organisms: Citrus sinensis, Citrus clementina
MVHVSFYRNYGKTFKKPRRPYEKERLDAELRLVGEYGLRCKRELWRVQYALSRIRNAARDLLTLDEKNPRRIFEGEALLRRMHRYGFLEESQNKLDYVLALTVENFLERRLQTLVFKSGMAKSIHHARVLIRQRHIRVGRQLVNIPSFVVRVDSQKHIEFSLTSPFGGGRPGRVKRRNIKAAAKKAAGGDGDEEDEE

SEQ ID NO: 7725 - protein, 197 aa, Cleome spinosa
MVNVSYYRNYGKTFKKPRRPYEKERLDAELKLVGEYGLRNKRELWRVQYALSRIRNAARDLLTLDEKNPKRIFEGEALLRRMNRYGLLDESQNKLDYVLALTVENFLERRLQTLVFKSGMAKSIHHARVLIRQRHIRVGKQLVNIPSFMVRVDSQKHIDFALTSPFGGGRPGRVRRKNEKAASKKASGGDGDDEDEE

SEQ ID NO: 7726 - protein, 197 aa, Vitis vinifera
MVHVSFYRNYGKTFKKPRRPYEKERLDAELKLVGEYGLRCKRELWRVQYVLSRIRNNARMLLTLDEKNPRRIFEGEALLRRMNKYGLLDESQNKLDYVLALTVENFLERRLQTLVFKSGMAKSIHHARVLIRQRHIRVGRQVVNIPSFMVRVESQKHIDFANTSPLGGGRPGRVKRKNLKAAAKKAAGGDGDEEDED

SEQ ID NO: 7727 - protein, 197 aa, Unknown
  Sequence found in Organisms: Pinus pinaster, Pinus taeda
MVHVNFYRNYGKTFKKPRRPYEKERLDAELKLVGEYGLRNKRELWRVQYTLSRIRNAARMLLTLDEKNPRRIFEGEALLRRMNRYGLLDETQSKLDYVLALTVENFLERRLQTLVFKSGMAKSIHHARVLIRQRHIRVGRQVVNIPSFMVRVDSQKHIDFSLTSPLGGGRPGRVKRKNMKAASKKAGGEDGEEEDDE

SEQ ID NO: 7728 - protein, 197 aa, Mimulus guttatus
MVHVCFYRNYGKTFKKPRRPYEKERLDAELKLVGEYGLRCKRELWRVQYALSRIRNNARMLLTLDEKDPKRIFEGEALLRRMNKYALLDESQNKLDYVLALTVENFLERRLQTLVFKAGMAKSIHHARVLIRQRHIRVGRQVVNVPSFMVRVDSQKHIDFSLTSPFGGGRPGRVKRKNQKAASKKSGGGGEEEEDED

SEQ ID NO: 7729 - protein, 197 aa, Lippia dulcis
MVHVNFYRNYGKTFKKPRRPYEKERLDAELKLVGEYGLRAKRELWRVQYALSRIRNNARMLLTLDEKDPRRIFEGEALLRRMNRFGLLDESQSKLDYVLALTVENFLERRLQTLVFKAGMAKSIHHARVLIRQRHIRVGRQVVNVPSFMVRVDSQKHIDFSLTSPFGGGRPGRVKRRNQKAAAKKAGGGGDEEEDED

SEQ ID NO: 7730 - protein, 196 aa, Lippia dulcis
MVHVNFYRNYGKTFKKPRRPYEKERLDAELKLVGEYGLRCKRELWRVQYALSRIRNNARNLLTLDEKDPRRIFEGESLLRRMNRYGLLDESQNKLDYVLSLTVENFLERRLQTLVFKAGMAKSIHHARVLIRQRHIRVGRQVVNVASFLVRVDSQKHIDFSLTSPFGGGRAGRVMRKNQKAAAKKAGGGDDEEDEE

SEQ ID NO: 7731 - protein, 197 aa, Papaver somniferum
MVHFAVYRNYGKTFKKPRRPYEKERLDAELKLVGEYGLRCKRELWRVQYALSRIRNAARNLLTLDEKDPRRIFEGEALLRRMNRYGLLEESQNKLDYVLALTVENFLERRLQTLVFKSGMAKSIHHARVLIRQRHIRVGRQVVNIPSFMVRVDSQKHIDFSLTSPLGGGRPGRVKRRNQKAAAKKAAGGDGDEEDED

SEQ ID NO: 7732 - protein, 197 aa, Papaver somniferum
MVHFAVYRNYGKTFKKPRRPYEKERLDAELKLVGEYGLRCKRELWRVQYALSRIRNAARMLLTLDEKNSRRIFEGEALLRRMNRYGLLDESQNKLDYVLALTVENFLERRLQTLVFKSGMAKSIHHARVLIRQRHIRVGRQVVNIPSFMVRVESQKHIDFSLTSPLGGGRPGRVKRRNQKAAAKKAAGGDGDEQDED

SEQ ID NO: 7733 - protein, 197 aa, Papaver somniferum
MVHFAVYRNYGKTFKKPRRPYEKERLDAELKLVGEYGLRCKRELWRVQYALSRIRNAARMLLTLDEKNSRRIFEGEALLRRMNRYGLLDESQNKLDYVLALTVENFLERRLQTLVFKSGMAKSIHHARVLIRQRHIRVGRQVVNIPSFMVRVDSQKHIDFSLTSPLGGGRPGRVKRRNQKAAAKKAAGGDGDEEDED

SEQ ID NO: 7734 - protein, 197 aa, Papaver somniferum
MVHFAVYRNYGKTFKKPRRPYEKERLDAELKLVGEYGLRCKRELWRVQYALSRIRNAARNLLTLDEKDPRRIFEGEALLRRMNRYGLLEESQNKLDYVLALTVENFLERRLQTLVFKSGMAKSIHHARVLIRQRHIRVGRQVVNIPSFMVRVDSQKHIDFSLTSPLGGGRPGRVKRRNQKVAAKKAAGGDGDEEDED

SEQ ID NO: 7735 - protein, 196 aa, Sequoia sempervirens
MVHVSFYRNYGKTFKKPRRPYEKERLDAELKLVGEYGLRNKRELWRVQYALSRIRNAARMLLTLDEKNSRRLFEGEALLRRMNRYGLLDESQNKLDYVLALTVENFLERRLQTLVFKSGMAKSIHHARVLIRQRHIRVGRQVVNIPSFMVRVDSQKHIDFSLTSPLGGGRPGRVKRKNMKAASKKAAGGDEEEDED

SEQ ID NO: 7736 - protein, 197 aa, Tripterygium wilfordii
MVHVVFYRNYGKTFKKPRRPYEKERLDAELKLVGEYGLRCKRELWRVQYALSRIRNAARMLLTLDEKNSRRIFEGEALLRRMNRYGLLDESQNKLDYVLALTVESFLERRLQTLVFKSGMAKSIHHARVLIRQRHIRVGRQVVNIPSFMVRLDSQKHIDFSLTSPFGGGRAGRVKRKNMKAAAKKASGGDGDEDDEE

SEQ ID NO: 7737 - protein, 197 aa, Vinca minor
MVHVSFYRNYGKTFKKPRRPYEKERLDAELKLVGEYGLRCKRELWRVQYALSRIRNAARNLLTLDEKDSRRIFEGEALLRRMHRYGLLEESQNKLDYVLALTVENFLERRLQTLVFKGGMAKSIHHARVLIRQRHIRVGKQVVNVPSFMVRVDSQKHIDFSITSTFGGGRPGRVKRRNMKAAAKKATGGDGDEEDEE

SEQ ID NO: 7738 - protein, 197 aa, Vinca minor
MVHVSFYRNYGKTFKKPRRPYEKERLDAELKLVGEFGLRCKRELWRVQYALSRIRNNARMLLTLDEKDPRRIFEGEALLRRMKRYGLLEEGQDKLDYVLALSVENFLERRLQTLVFKAGMAKSIHHARVLIRQRHIRVGKQVVNVPSFMVRLDSQKHIDFSITSPFGGGRPGRVKRKNTKAAAKKASGGDGDEEDEE

SEQ ID NO: 7739 - protein, 197 aa, Vinca minor
MVHVSFYRNYGKTFKKPRRPYEKERLDAELKLVGEYGLRCKRELWRVQYALSRIRNAARNLLTLDEKDSRRIFEGEALLRRMHRYGLLEESQNKLDYVLALTVENFLERRLQTLVFKGGMAKSIHHARVLIRQRHIRVGKQVVNVPSFMVRVDSQKHIDFSITSTFGGGRPGRVKRRNMKAAAKKASGGDGDEEDEE

SEQ ID NO: 7740 - protein, 197 aa, Zamia vazquezii
MVHVSFYRNYGKTFKKPRRPYEKERLDAELKLVGEYGLRNKRELWRVQYSLSRIRNAARMLLTLDEKNPRRIFEGEALLRRMNRYGLLDESQSKLDYVLALTVENFLERRLQTLVFKSGMAKSIHHARVLIRQRHIRVGRQVVNIPSFLVRVDSQKHIDFSLTSPLGGGRPGRVKRKNLKAASKKASGGDGEEEDED

SEQ ID NO: 7741 - protein, 138 aa, Ambrosia trifida
MLLTLEEKDPRRIFEGEALMRRMNRYGLLDESQNKLDYVLALTVENFLERRLQTLVFKTGMAKSIHHARVLIKQRHIRVGRQVVNVPSFMVRVDSQKHIDFSLTSPFGGGRPGRVKRRNQKAAAKKAAGGDADEDDEE

SEQ ID NO: 7742 - protein, 195 aa, Pteridium aquilinum
MVHVSFYRNYGKTFKKPRRPYEKERLDAELKLVGEYGLRNKRELWRVQYALSRIRNNARMLLTLDEKNSRRIFEGEALLRRMFRYGLLEESQNKLDYVLALTVENFLERRLQTLVFKSGMAKSIHHARVLIKQRHIRVGKQVVNVASFLVRVDSQKHIDFALSSPFGGGRPGRVKRRNMKAASKKAAGGDEEEEE

SEQ ID NO: 7743 - protein, 130 aa, Gnetum gnemon
MVHVSFYRNYGKTFKKPRRPYEKERLDAELKLVGEYGLRNKRELWRVQYSLSRIRNAARMLLTLDEKNPRQIFEGEALLRRMNRYGLLDETQNKLDYVLALTVENFLERRLQLWSLSLEWQINTSCPCPY

SEQ ID NO: 7744 - protein, 197 aa, Abies balsamea
MVHVSFYRNYGKTFKKPRRPYEKERLDAELKLVGEYGLRNKRELWRVQYTLSRIRNAARMLLTLDEKNPRRIFEGEALLRRMNRYGLLDETQTKLDYVLALTVENFLERRLQTLVFKSGMAKSIHHARVLIRQRHIRVGRQVVNIPSFMVRVDSQKHIDFSLTSPLGGGRPGRVKRKNMKAASKKAGGEDAEEEDDD

SEQ ID NO: 7745 - protein, 197 aa, Arabidopsis lyrata
MVNVRFYRNYGKTFKKPRRPYEKERLDAELKLVGEYGLRCKRELWRVQYTLSRIRNAARELLTLDEKNPRRIFEGEALLRRMNRYGLLDESQNKLDYVLALTVENFLERRLQTIVFKSGMAKSIHHARVLIRQRHIRVGRQLVNIPSFMVRVESQKHVDFSLTSPFGGGRPGRVKRRNERAGAKKAAGGDGDEDDEE

SEQ ID NO: 7746 - protein, 197 aa, Arabidopsis thaliana [sequence omitted]

SEQ ID NO: 7747 - protein, 196 aa, Distylium racemosum
MVHVSFYRNYGKTFKKPRRPYEKERLDAELKLVGEYGLRNKRELWRVQYALSRIRNAARMLLTLEEKNSRRIFEGEALLRRMNRYGLLDESQNKLDYVLALTVENFLERRLQTLVFKSGMAKSIHHARVLIRQRHIRVGRQVVNIPSFLVRVDSQKHIDFSLTSPLGGGRPGRVKRKNMKAASKKAAGGDEEEDED

SEQ ID NO: 7748 - protein, 194 aa, Zingiber officinale
  misc_feature (103)..(103): Xaa can be any naturally occurring amino acid
  misc_feature (116)..(117): Xaa can be any naturally occurring amino acid
VSFYRNYGKTFRKPRRPYEKERLDAELKLVGEYGLRCKRELWRVQYALSRIRNAARELLTLDEKNPRRIFEGEALLRRMNRYGLLEEGQNKLDYVLALTVENXLERRLQTLVFKSXXAKSIHHARVLIRQRHIRVGRQVVNIPSFMVRMDSAKHIDFSLTSPFGGGRPGRVKRRNQKAATKKAAGGDGDEDDEE

SEQ ID NO: 7749 - protein, 197 aa, Mimulus guttatus
MVHVCVYRNYGKTFKKPRRPYEKERLDAELKLVGEYGLRCKRELWRVQYALSRIRNNARMLLTLDEKDPKRIFEGEALLRRMNRYGLLDESQSKLDYVLALTVENFLERRLQTLVFKAGMAKSIHHARVLIRQKHIRVGRQVVNVPSFMVRMDSQKHIDFSLTSPFGGGRPGRVKRRNQKSASKKASGGDGDEDDEE

SEQ ID NO: 7750 - protein, 197 aa, Nuphar advena
MVHVSFYRNYGKTFKKPRRPYEKERLDAELKLVGEYGLRCKRELWRVQYALSRIRNAARELLTLDEKNERRIFEGDALLRRMNQYGLLDESQNKLDYVLALTVENFLERRLQTLVFKSGMAKSIHHARVLIRQRHIRVGRQVVNIPSFLVRVDSQKHIDFSLTSPLGGGRPGRLKRKNLKAASKKAAGGDGDEEDED

SEQ ID NO: 7751 - protein, 198 aa, Raphanus sativus
MVQVRFYRNYGKTFKKPRRPYEKERLDAELKLVGEYGLRCKRELWRVQYALSRIRNAARELLTLDEKNPRRIFQGEALLRRMNTNGLLDESQNKLDYVLALTVENFLERRLQTLVFKSGMAKSIHHARVLIRQRHIRVGRQLVNIPSFMVKVDSQKHIDFSLTSPFGGGRPGRVKRRNERAGAKKAGGGGDGDEDDEE

SEQ ID NO: 7752 - protein, 197 aa, Rosa hybrid cultivar
MVHVVFYRNYGKTFKKPRRPYEKERLDAELKLVGEYGLRCKRELWRVQYALSRIRNAARELLTLDEKNPRRIFEGEALLRRMNRFGLLEESQNKLDYVLALTVENFLERRLQTQVFKSGMAKSIHRARVLIRQRHIRVGRQVVNIPSFMVRIDSEKHIDFAITSPLGGGRPGRVKRRNQKAAAKKAAGGDGDEEDEE

SEQ ID NO: 7753 - protein, 197 aa, Sciadopitys verticillata
MVHVNFYRNYGKTFKKPRRPYEKERLDAELKLVGEYGLRNKRELWRVQYTLSRIRNAARMLLTLDEKNHRRIFEGEALLRRMNRYGLLDESQNKLDYVLALTVENFLERRLQTLVFKSGMAKSIHHARVLIRQRHIRVGRQVVNIPSFMVRVDSQKHIDFSLTSPLGGGRHGRVKRKNTKAASKKAAGGDAEEEDEE

SEQ ID NO: 7754 - protein, 198 aa, Selaginella moellendorffii
MVNVSFYRNYGKTFKKPRRPFEKERLDAELKLVGEYGLRNKRELWRLQYVLSRIRNAARHLLTLDEKNPRRIFEGDALLRRMHRYGLLEEGQNKLDYVLALTVENFLERRLQTLVFKAGMAKSIHHARVLVRQRHIRVGKQMVNVPSFLVRVESQKHIDFALTSPFGGGGPGRVKRKNMKAASKKASGGGDGDEEEEE

SEQ ID NO: 7755 - protein, 198 aa, Selaginella moellendorffii
MVHVCVYRNYGKTFKKPRRPFEKERLDAELKLVGEYGLRNKRELWRVQYVLSRIRNASRHLLTLDEKNPRRIFEGEALLRRMHRYGLLEEGQNKLDYVLALTVENFLERRLQTLVFKAGMAKSIHHARVLVRQRHIRVGKQMVNVPSFLVRVESQKHIDFALTSPFGGGGPGRVKRKNTKAASKKAAGGGDGDEEEEE

SEQ ID NO: 7756 - protein, 197 aa, Picea glauca
MVHVNFYRNYGKTFKKPRRPYEKERLDAELKLVGEYGLRNKRELWRVQYTLSRIRNAARMLLTLDEKNPRRIFEGEALLRRMNRYGLLDESQSKLDYVLALTVENFLERRLQTLVFKSGMAKSIHHARVLIRQRHIRVGRQVVNIPSFMVRVDSQKHIDFSLTSPLGGGRPGRVKRKNMKAASKKAGGEDGEEEDDD

SEQ ID NO: 7757 - protein, 198 aa, Fragaria vesca
MVHVVFYRNYGKTFKKPRRPYEKERLDAELKLVGEYGLRCKRELWRVQYALSRIRNNARMLLTLDEKNPRRIFEGEALLRRMNRYGLLEEGQNKLDYVLALTVENFLERRLQTVVFKKGLAKSIHHARVLIRQRHIRVGRQVVNIPSFMVRCDSEKHIDFAITSPLGGGGPGRVKRRNLKAAAKKASGGGDGDEEDEE

SEQ ID NO: 7758 - protein, 197 aa, Tamarix hispida
  misc_feature (59)..(59): Xaa can be any naturally occurring amino acid
MVHVAFYRNYGKTFKKPRRPYEKERLDAELKLVGEYGLRCKRELWRVQYHLSRIRNNAXHLLTLDEKNPRRIFEGEALMRRMVRYGLLEESQNKLDYVLALTVENFLERRLQTLVFKSGMAKSIHHARVLIRQRHIRVGRQVVNVPSFLVRVDSAKHIDFSLTSPYGGGRPGRVKRRNMKAAAKKAAGGDGDEEDEE

SEQ ID NO: 7759 - protein, 198 aa, Eutrema halophilum
MVQVRFYRNYGKTFKKPRRPYEKERLDAELKLVGEYGLRCKRELWRVQYALSRIRNAARDLLTLDEKNPRRIFEGEALLRRMNRSGLLDESQNKLDYVLALTVENFLERRLQTIVFKSGMAKSIHHARVLIRQRHIRVGRQLVNIPSFMVKVDSQKHIDFSLTSPFGGGRPGRVKRRNERAGAKKASGGGDGDEDDEE

SEQ ID NO: 7760 - protein, 198 aa, Thellungiella halophila
  misc_feature (85)..(85): Xaa can be any naturally occurring amino acid
MVQVRFYRNYGKTFKKPRRPYEKERLDAELKLVGEYGLRCKRELWRVQYALSRIRNAARDLLTLDEKNPRRIFEGEALLRRMNRXGLLDESQNKLDYVLALTVENFLERRLQTIVFKSGMAKSIHHARVLIRQRHIRVGRQLVNIPSFMVKVDSQKHIDFSLTSPFGGGRPGRVKRRNERAGAKKASGGGDGDEDDEE

SEQ ID NO: 7761 - protein, 197 aa, Vinca minor
MVHVSFYRNYGKTFKKPRRPYEKERLDAELKLVGEYGLRCKRELWRVQYALSRIRNAARNLLTLDEKDSRRIFEGEALLRRMHRYGLLEDAQNKLDYVLALTVENFLERRLQTLVFKGGMAKSIHHARVLIRQRHIRVGKQVVNVPSFMVRVDSQKHIDFSITSTFGGGRPGRVKRRNMKAAAKKAAGGDGEEEDEE

SEQ ID NO: 7762 - protein, 171 aa, Helianthus annuus
MLELKLVGEYGLRCKRERWRVQYALSRIRNAARMLLTLEEKDPRRIVEGEALMRRMNRYDLLDESQNKLDYVLALTVENFLERRLQTLVFKTGMAKSIHHARVLIKQRHIRVGRQVVNVPSFMVRVDSQKHIDFSLTSPFGGGRPGRVKRKNQKAAAKKASGGDADEDDEE

SEQ ID NO: 7763 - protein, 160 aa, Euphorbia peplus
MVHVSFYRNYGKTFKKPRRPYKKERLDAKLKLVGEYGLRCKKELWRVQYALSRIKNAARMLLTLDEKNPRRIFEGEALLRRMNRYGLLNESQNKLDYVLALTVENFLERRLQTLVFKSGMAKSIHHARVLIRQRHIRVGRQAVNIPSFMVRVDSQKHIDF

SEQ ID NO: 7764 - protein, 83 aa, Thalictrum flavum
MVHVSFYRNYGKTFKKPRRPYEKERLYAELKLVGEYGLRCKRELWRVQYALSRIRNNARNLLTLDEKNPRRIFEGEVFIEKNE

SEQ ID NO: 7765 - protein, 114 aa, Allium cepa
MHRYGLLDDEQNKLDYVLALTVENFLERRLQTLVFKSGMAKSIHHARVLIRQRHISVGKQVVNIPSFMVRVESAKHIDFSRNSPLGGGRDGRVKRRNKKAAAKKDGGDEEEEED

SEQ ID NO: 7766 - protein, 187 aa, Ambrosia trifida
MVHVPFYRNYGKTFKKPRRPYEKERLDAELKLVGEYGLRCKRELWRVQYALSRIRNAARMLLTLEEKDPRRIFEGEALMRRMNRYGLLDESQNKLDYVLALTVENFLERRLQTLVFKTGMAKSIHHARVLIKQRHIRVGRQVVNVPSFMVRVDSQKHIDFSLTSPFGGGRPGRVKRKNQKAAAKKAA

SEQ ID NO: 7767 - protein, 187 aa, Fagus grandifolia
MVHVSFYRNYGKTFKKPRRPYEKERLDAELKLVGEYGLRCKRELWRVQYALSRIRNNARMLLTLDEKNSRRIFEGEALLRRMNRYGLLDESQNKLDYVLALTVENFLERRLQTLVFKSGMAKSIHHARVLIRQRHIRVGRQVVNIPSFMVRVDSQKHIDFSLTSPFGGGRPGRVKRRNQKAATKRLR

SEQ ID NO: 7768 - protein, 178 aa, Petunia hybrida
MVHVSFYRNYGKTFKKPRRPYEKERLDAELKLVGEYGLRCKRELWRVQYALSRIRNAARMLLTLDEKDPRRIFEGEALLRRMNRYGLLDESQNKLDYVLALTVENFLERRLQTLVFKTGMAKSIHHARVLIRQRHIRVGRQVVNVPSFMVRVDSQKHIDFSLTSPFGGGRPGRVKRKN

SEQ ID NO: 7769 - protein, 197 aa, Trifolium pratense
  misc_feature (15)..(15): Xaa can be any naturally occurring amino acid
MVHVSYYRNYGKTFXKPRRPYEKERLDAELKLVGEYGLRCKRELWRVQYALSRIRNNARNLLTLDEKNPRRIFEGEALLRRMFKHGLLDETQNKLDYVLALTVENFLERRLQTLVFKSGMAKSIHHARVLIRQRHIRVGRQVVNIPSFMVRVDSQKHIDFSLTSPFGGGLPGRVKRKNAKAAAKKASGGSGDEEDED

SEQ ID NO: 7770 - protein, 197 aa, Linum usitatissimum
MVHVSFYRNYGKTFKKPRRPYEKERLDSELKLVGEYGLRAKRELWRVQYALSRIRNAARMLLTLDEKNPRRIFEGEALLRRMNRYGLLDESQNKLDYVLALTVENFLERRLQTLVFKSGMAKSIHHARVLIRQKHIRVGRQVVNIPSFMVRLDSQKHIDFSISSPFGGGRAGRVKRKNMAASSKKQAGGGSDDEGAE

SEQ ID NO: 7771 - protein, 197 aa, Medicago truncatula
MVHVAFYRNYGKTFKKPRRPYEKERLDAELKLVREYGLRCKRELWRVQYALSRIRNNSRTLLTLDEKNPRRIFEGEALLRRMFKHGLLDETQNKLDYVLALTVENFLERRLQTLVFKSGMAKSIHHARVLIRQRHIRVGRQVVNIPSFMVRVDSQKHIDFSLTSPFGGGLPGRVKRKNLKAAAKKASGGDGDEEDED

SEQ ID NO: 7772 - protein, 197 aa, Medicago truncatula
MVKVAFYRNYGKTFKKPRRPYEKERLDAELKLVGEYGLRCKRELWRVQYALSRIRNNARNLLTLDEKNPRRIFEGEALLRRMFKHGLLDETQNKLDYVLALTVENFLERRLQTLAFKSGMAKSIHHARVLIRQRHIRVGRQVVNIPSFMVRVDSQKHIDFSLTSPFGGGLPGRVKRKNLKAAAKKASGGDGDEEDED

SEQ ID NO: 7773 - protein, 197 aa, Unknown
  Sequence found in Organisms: Brassica napus, Brassica oleracea, Brassica rapa
MVQVRFYRNYGKTFKKPRRPYEKERLDAELKLVGEYGLRCKRELWRVQYTLSRIRNAARELLTLDEKNPRRIFQGEALLRRMNKNGLLDESQNKLDYVLALTVENFLERRLQTIVFKSGMAKSIHHARVLIRQRHIRVGRQLVNIPSFMVKVESQKHIDFSLTSPFGGGRPGRVKRRNERAGAKKAGGGGGDEDDEE

SEQ ID NO: 7774 - protein, 197 aa, Brassica napus
MVQVRFYRNYGKTFKKPRRPYEKERLDAELKLVGEYGLRCKRELWRVQYTLSRIRNAARELLTLDEKNPRRIFQGEALLRRMNKNGLLDESQNKLDYVLALTVENFLERRLQTIVFKSGMAKSIHHARVLIRQRHIRVGRQLVNIPSFMVKVESQKHIDFSLTSPFGGGRPGRVKRRNERAGAKKAGGVGGDEDDEE

SEQ ID NO: 7775 - protein, 196 aa, Cephalotaxus harringtonia
MVHVSFYHNYGKTFKKPRRPYEKERLDAELKLVGEYGLRNKRELWRVQYTLSRIRNAARMLLTLEEKNSRRIFEGEALLRRMNRYGLLDESQNKLDYVLALTVENFLERRLQTLVFKSGMAKSIHHARVLIRQRHIRVGRQVVNIPSFMVRVDSQKHIDFSLTSPLGGGRPGRVKRKNMKAASKKAAGGDEEEDEE

SEQ ID NO: 7776 - protein, 198 aa, Unknown
  Sequence found in Organisms: Chelidonium majus, Papaver somniferum
MVHFAVYRNYGKTFKKPRRPYEKERLDAELKLVGEYGLRCKRELWRVQYALSRIRNAARMLLTLEEKNPRRIFEGDALLRRMNRYGLLDESQNKLDYVLALTVENFLERRLQTLVFKSGMAKSIHHARVLIRQRHIRVGRQVVNVPSFMVRLDSQKHIDFSLTSPLGGGRPGRVKRRNQKAAAKKAAGGGDADEEDED

SEQ ID NO: 7777 - protein, 197 aa, Cleome spinosa
MVNVNYYRNYGKTFKKPRRPYEKERLDAELKLVGEYGLRNKRELWRVQYALSRIRNAARDLLTLDEKNPKRIFEGEALLRRMNRFGLLDESQNKLDYVLALTVENFLERRLQTLVFKSGMAKSIHHARVLIRQRHIRVGKQLVNIPSFMVRVDSQKHIDFALTSPFGGGRPGRVRRKNEKAASKKASGGDGDDEDEE

SEQ ID NO: 7778 - protein, 197 aa, Cleome spinosa
MVNVSYYRNYGKTFKKPRRPYEKERLDAELKLVGEYGLRNKRELWRVQYALSRIRNAARDLLTLDEKNPKRIFEGEALLRRMNRYGLLDESQNKLDYVLALTVENFLERRLQTLVFKSGMAKSIHHARVLIRQRHIRVGKQLVNIPSFMVRVDSQKHIDFALTSPFGGGRPGRVRRKNEKAASKKASGGDGDEDDEE

SEQ ID NO: 7779 - protein, 196 aa, Adiantum capillus-veneris
MVHVSFYRNYGKTFKKPRRPYEKERLDAELKLVGEYGLRNKRELWRVQYALSRIRNNARMLLTLDEKNPRRIFEGEALLRRMFRYGLLDESQNKLDYVLALTVENFLERRLQTLVFKSGMAKSIHHARVLIKQRHIRVGKQVVNVASFLVRVDSQKHIDFALSSPFGGGRPGRVKRRNMKAASKKAAGGEEEEDED

SEQ ID NO: 7780 - protein, 197 aa, Prunus persica
MVHVSFYRNYGKTFKKPRRPYEKERLDAELKLVGEYGLRCKRELWRVQYALSRIRNNARMLLTLDEKNPRRIFEGEALLRRMNRYGLLEEGQNKLDYVLALTVENFLERRLQTIVFKTGMAKSIHHARVLIRQRHIRVGRQVVNISSFLVRCDSEKHIDFSLTSPLGAGRPGRVKRRNMKAAAKKAAGGDADEEDED

SEQ ID NO: 7781 - protein, 196 aa, Pteridium aquilinum
MVHVSFYRNYGKTFKKPRRPYEKERLDAELKLVGEYGLRNKRELWRVQYALSRIRNNARMLLTLDEKNSRRIFEGEALLRRMFRYGLLEESQNKLDYVLALTVENFLERRLQTLVFKSGMAKSIHHARVLIKQRHIRVGKQVVNVASFLVRVDSQKHIDFALSSPFGGGRPGRVKRRNMKAATKKAGGGEEEEDED

SEQ ID NO: 7782 - protein, 196 aa, Sciadopitys verticillata
MVHVNFYRNYGKTFKKPRRPYEKERLDAELKLVGEYGLRNKRELWRVQYTLSRIRNAARMLLTLDEKNHRRIFEGEALLRRMNRYGLLDESQNKLDYVLALTVENFLERRLQTLVFKSGMAKSIHHARVLIRQRHIRVGRQVVNIPSFLVRVDSQKHIDFSLTSPLGGGRPGRVKRKNMKAASKKAAGGDEEEDED

SEQ ID NO: 7783 - protein, 116 aa, Cyamopsis tetragonoloba
MFRYGLLDETQNKLDYVLALTVENFLERRLQTLVFKTGMAKSIHHARVLIRQRHIRVGRQVVNIPSFMVRVDSQKHIDFSLTSPLGGGRPGRVKRKNLRAAAKKAAGGDGDEEDED

SEQ ID NO: 7784 - protein, 62 aa, Brassica napus
APGEITLLLVFWWQAHSSHGASQVYRNYGKTFKKPRRPYEKERLDAELKLVGEYGLRCKREL

SEQ ID NO: 7785 - protein, 71 aa, Secale cereale
MVHVNFYRNYGKTFKKPRRPYEKERLDAELKLVGEYGLRCKRELWRVQYALSRIRNAARHWGYADERSRVS

SEQ ID NO: 7786 - protein, 183 aa, Gerbera hybrid cultivar
MVHVNFYRNYGKTFKKPRRPYEKERLDAELKLVGEYGLRCKRELWRVQYALSRIRNAARMLLTLEEKDPRRIFEGEALMRRMNRYGLLDESQNKLDYVLALTVENFLERRLQTLVFKTGMAKSIHHARVIIKQRHIRVGRQVVNVPSFMVRVDSQKHIDFSLTSPFGGGRPGRVKRKNQKAAA

SEQ ID NO: 7787 - protein, 197 aa, Epimedium sagittatum
MVHVSYYRNYGKTFKKPRRPYEKERLDAELKLVGEYGLRCKRELWRVQYALSRIRNNARMLLTLDEKNPRRIFEGEALLRRMFRYGLLDESQSKLDYVLALTVENFLERRLQTLVFKSGMAKSIHHARVLIRQRHIRVGRQVVNIPSFMVRMDSQKHIDFSLTSPLGGGRPGRVKRRNQKAAAKKAAGGAGDEEEED

SEQ ID NO: 7788 - protein, 189 aa, Arnica chamissonis
MVNVPFYRNYGKTFKKPRRPYEKERLDAELKLVGEYGLRCKRELWRVQYALSRIRNAARMLLTLEEKDPRRIFEGEALMRRMNRYGLLDESQNKLDYVLALTVENFLERRLQTLVFKTGMAKSIHHARVLIKQRHIRVGRQVVNVPSFMVRVDSQKHIDFSLTSPFGGGRPGRVKRKNQKAAAKKAAGG

SEQ ID NO: 7789 - protein, 197 aa, Pteridium aquilinum
MVHVSFYRNYGKTFKKPRRPYEKERLDAELKLVGEYGLRNKRELWRVQYALSRIRNNARMLLTLDEKNSRRIFEGEALLRRMFRYGLLEESQNKLDYVLALTVENFLERRLQTLVFKSGMAKSIHHARVLIKQRHIRVGKQVVNVASFLVRVDSQKHIDFALSSPFGGGRPGRVKRRNLKAASKKASGGGEEEEDED

SEQ ID NO: 7790 - protein, 197 aa, Cleome spinosa
MVNVSYYRNYGKTFKKPRRPYEKERLDAELKLVGEYGLRNKRELWRVQYALSRIRNAARDLLTLDEKNPKRIFEGEALLRRMNRFGLLDESQNKLDYVLALTVENFLERRLQTLVFKSGMAKSIHHARVLIRQRHIRVGKQLVNIPSFMVRVDSQKHIDFALTSPFGGGRPGRVRRKNEKAASKKTSGGDGDEDDEE

SEQ ID NO: 7791 - protein, 196 aa, Pteridium aquilinum
MVHVSFYRNYGKTFKKPRRPYEKERLDAELKLVGEYGLRNKRELWRVQYALSRIRNNARMLLTLDEKNSRRIFEGEALLRRMFRYGLLEESQNKLDYVLALTVENFLERRLQTLVFKSGMAKSIHHARVLIKQRHIRVGKQVVNVASFLVRVDSQKHIDFALSSPFGGGRPGRVKRRNMKAASKKAAGGEEEEDED

SEQ ID NO: 7792 - protein, 197 aa, Zostera marina
MVHVSFYRNYGKTFKKPRRPYEKERLDAELKLVGEYGLRCKRELWRVQYALSRIRNAAKELLKLDDKNEKRIFEGEALLRRMHRYGLLEETQNKLDYVLALTVENFLERRLQTLVFKSGMAKSIHHARVLIRQRHIRVGRQVVNIPSFMVRMDSQKHIDFSLISPFGGGRPGRVKRRNQKAAAKKASGGGDAEEDED

SEQ ID NO: 7793 - protein, 198 aa, Brassica juncea
MVQVRFYRNYGKTFKKPRRPYEKERLDAELKLVGEYGLRCKRELWRVQYTLSRIRNAARELLTLDEKNPRRIFQGEALLRRMNKNGLLDESQNKLDYVLALTVENFLERRLQTIVFKSGMAKSIHHARVLIRQRHIRVGRQLVNIPSFMVKVDSQKHIDFSLTSPFGGGRPGRVKRRNERAGAKKAGGGGDGDEDDEE

SEQ ID NO: 7794 - protein, 116 aa, Medicago truncatula
MVHVAFYRNYGKTFKKPRRPYEKERLDAELKLVGEYGLRCKRELWRVQYALSRIRNNARTLLTLDEKNPRRIFEGEALLRRMFKHGLLDETQNKLDYVLALTVENFLECRLQTLCV

SEQ ID NO: 7795 - protein, 197 aa, Euonymus alatus
MVHVNFYRNYGKTFKKPRRPYEKERLDAELTLVGEYGLRCKRELWRVQYALSRIRNNARMLLTLDEKNTRRLFEGEALLRRMNTYGLLDEGKNKLDHVLALTVEKFLERRLQTLVFKSGMAKSIHHARVLIRQRHIRVGRQVVNIPSFMVKVDSQKHIDFSLTSPFGGGRPGRVKRKNLKAAAKKASGGAGDEEDEE

SEQ ID NO: 7796 - protein, 197 aa, Euonymus alatus
MVHVNFYRNYGKTFKKPRRPYEKERLDAELTLVGEYGLRCKRELWRVQYALSRIRNNARMLLTLDEKNTRRMFEGEALLRRMNTYGLLDEGKNKLDHVLALTVEKFLERRLQTLVFKSGMAKSIHHARVLIRQRHIRVGRQVVNIPSFMVKVDSQKHIDFSLTSPFGGGRPGRVKRKNLKAAAKKASGGAGDEEDEE

SEQ ID NO: 7797 - protein, 197 aa, Brassica juncea
VQVRFYRNYGKTFKKPRRPYEKERLDAELKLVGEYGLRCKRELWRVQYTLSRIRNAARELLTLDEKNPRRIFQGEALLRRMNKNGLLDESQNKLDYVLALTVENFLERRLQTIVFKSGMAKSIHHARVLIRQRHIRVGRQLVNIPSFMVKVDSQKHIDFSLTSPFGGGRPGRVKRRNERAGAKKAGGGGDGDEDDEE

SEQ ID NO: 7798 - protein, 138 aa, Cannabis sativa
MLLTLDEKNPRRIFEGEALLRRMNRYGLLDESQNKLDYVLALTVENFLERRLQTLVFKSGMAKSIHHARVLIRQRHIRVGRQVVNIPSFMVRVDSQKHIDFSLTSPFGGGRPGRVKRKNQKAAAKKASGGDGDEEDEE

SEQ ID NO: 7799 - protein, 197 aa, Amorphophallus konjac
MVHVSFYRNYGKTFKKPRRPYEKERLDQELKLVGEYGLRCKRELWRVQYALSRIRNAAKELLKLDEKDEKRIFEGEALLRRMNRYGFLDESQNKLDYVLALTPEHFLERRLQTLVFKSGMAKSIHHARVLIRQRHIRVGRQVVNIPSFMVRVDSQKHIDFSLTSPLGGGRPGRVKRKNMKAAAKKAAGGDDDEEDEE

SEQ ID NO: 7800 - protein, 197 aa, Amorphophallus konjac
MVHVSFYRNYGKTFKKPRRPYEKERLDQELKLVGEYGLRAKRELWRVQYTLSRIRNAAKELLKLDEKDEKRIFEGEALLRRMNRYGLLDESQNKLDYVLSLTPENFLERRLQTLVFKAGMAKSIHHARVLIRQRHIRVGRQVVNIPSFMVRVDSQKHIDFSLTSPLGGGRPGRVKRKNAKAAAKKAAGGDDDEEDEE

SEQ ID NO: 7801 - protein, 197 aa, Amorphophallus konjac
MVHVSFYRNYGKTFKKPRRPYEKERLDQELKLVGEYGLRCKRELWRVQYALSRIRNAAKELLKLDEKDEKRIFEGEALLRRMNRYGLLDESQNKLDYVLALTPEHFLERRLQTLVFKSGMAKSIHHARVLIRQRHIRVGRQVVNIASFMVRVDSQKHIDFSLTSPLGGGRPGRVKRKNQKAAAKKAAGGDDDEDDEE

SEQ ID NO: 7802 - protein, 195 aa, Vaccinium corymbosum
  misc_feature (185)..(185): Xaa can be any naturally occurring amino acid
  misc_feature (194)..(194): Xaa can be any naturally occurring amino acid
MVHVNFYRNYGKTFKKPRRPYEKERLDAELKLVGEYGLRCKRELWRVQYALSRIRNAARMLLTLDEKNPRRIFEGEALLRRMYRYGLLDENQNKLDYVLALTVENFLERRLQTLVFKTGMAKSIHHARVLIRQRHIRVGRQVVNIASFMVRLDSQKHIDFSLTSPLGGGRPGRVKRKNQKAAAKXLLGEMAMRXM

SEQ ID NO: 7803 - protein, 173 aa, Petunia hybrida
MVHVSFYRNYGKTFKKPRRPYEKERLDAELKLVGEYGLRCKRELWRVQYALSRIRNAARMLLTLDEKDPRRIFEGEALLRRMNRYGLLEENQNKLDYVLALTVENFLERRLQTLVFKTGMAKSIHHARVLIRQRHIKVGRQVVNVPSFMVRVDSQKHIDFSLTSALGVGVLEE

SEQ ID NO: 7804 - protein, 200 aa, Utricularia gibba
MVHVAFYRNYGKTFKKPRRPFEKERLDAELKLVGEYGLRSKRELWRVQYALSRIRNNARELLTMDEKSTRRIFEGEALLRRMNRYGLLDETQNKLDFVLALTVENFLERRLQTLVFKTGLAKSIHHARVLIRQRHIRVGKQIVNIPSFLVRLDSQKHIDFATSSPFGGGPPGRVKRKNQKSKKGGGGGDDDGEGDEEEEE

SEQ ID NO: 7805 - protein, 198 aa, Ceratodon purpureus
MVHVAHFRNYGKTFKKPRRPFEKERLDAELKLVGEYGLRNKRELWRVQYALSRIRNNARMLLTLDEKNTRRIFEGEALLRRMNRYGLLDESQNKLDYVLALTVENFLERRLQTLVFKSGMAKSIHHARVLIRQRHIRVGRQMVDVPSFMVRVDSQKHIDFSLTSTFGGGRPGRVKRKNTKAASKKASGGDDDEEEDDE

SEQ ID NO: 7806 - protein, 198 aa, Ceratodon purpureus
MVHVASFRNYGKTFKKPRRPFEKERLDAELKLVGEYGLRNKRELWRVQYALSRIRNNARMLLTLDEKNTRRIFEGEALLRRMNRYGLLDESQNKLDYVLALTVENFLERRLQTLVFKSGMAKSIHHARVLIKQRHIRVGKQIVDVASFMVRVDSQKHVDFSLSSPLGGGRPGRVKRKNMKAASKKASGGDDDEEEDDE

SEQ ID NO: 7807 - protein, 197 aa, Euonymus alatus
MVHVNFYRNYGKTFKKPRRPYEKERLESELKLVGEYGLRCKRELLRVQYALSRIRNAARMLLTLDEKNSRRIFEGEALLRRMHKYGLLDESLNKLDHVLALTVENFLERRLQTLVFKSGMAKSIHHARVLIRQRHIRVGRQVVNIPSFMVMVDSQKHIDFSLTSPFGGGRPGRVKRKNLKAAAKKAAGGAGDEEDEE

SEQ ID NO: 7808 - protein, 198 aa, Physcomitrella patens
MVHVASFRNYGKTFKKPRRPFEKERLDAELKLVGEYGLRNKRELWRVQYALSRIRNNARMLLTLDEKNTRRIFEGEALLRRMNRYGLLDENQSKLDYVLALTVENFLERRLQTLVFKSGMAKSIHHARVLIKQRHIRVGKQIVDVPSFMVRVDSQKHVDFALSSPLGGGRPGRVKRKNMKAASKKASGGDDDEDEDDE

SEQ ID NO: 7809 - protein, 138 aa, Cannabis sativa
MLLTLDEKNPRRIFEGEALLRRMNRYGLLDESQNKLDYVLALTVENFLERRLQTLVFKSGMAKSIHHARVLIRQRHIRVGRQVVNIPSFMVRVDSQKHIDFSLTSPFGGGRPGRVKRKNQKAAAKKASGGDGDEEEEE

SEQ ID NO: 7810 - protein, 198 aa, Physcomitrella patens
MVHVASFRNYGKTFKKPRRPFEKERLDAELKLVGEYGLRNKRELWRVQYALSRIRNNARMLLTLDEKNTRRIFEGEALLRRMNRYGLLDENQSKLDYVLALTVENFLERRLQTLVFKSGMAKSIHHARVLIKQRHIRVGKQIVDVPSFMVRVDSQKHVDFALSSPLGGGRPGRVKRKNMKAASKKASGGDDDEEEDDE

SEQ ID NO: 7811 - protein, 187 aa, Ambrosia trifida
GKTFKKPRRPYEKERLDAELKLVGEYGLRCKRELWRVQYALSRIRNAARMLLTLEEKDPRRIFEGEALMRRMNRYGLLDESQNKLDYVLALTVENFLERRLQTLVFKTGMAKSIHHARVLIKQRHVRVGRQVVNVPSFMVRVDSQKHIDFSLTSPFGGGRPGRVKRKNQKAATKNAVGGDADEDDEE

SEQ ID NO: 7812 - protein, 184 aa, Manihot esculenta
FKKPRRPYEKERLDAELKLVGEYGLRCKRELWRVQYALSRIRNAARMLLTLDEKNPRRIFEGEALLRRMNRYGLLDESQNKLDYVLALTVENFLERRLQTLVFKSGMAKSIHHARVLIRQRHIRVGRQVVNIPSFMVRVDSQKHIDFSLTSPFGGGRPGRVKRKNQRAASKKASGGDGDEEDEE

SEQ ID NO: 7813 - protein, 197 aa, Orobanche aegyptiaca
MVHVSHYRNFGKTFKKPRRPYEKERLDAELRLVGEYGLRCKRELWRVQYALSRIRNNARELLTLDEKDPRRIFEGEALLRRMNRYGLLEESQNKLDYVLSLSVENFLERRLQTIVFKAGLAKSIHHARVMIRQRHIRVSKQVVNVPSFMVKVDSQKHIDYSLTSPFGGGRPGRVKRKNLKAAAKKATGGDGDEEDEE

SEQ ID NO: 7814 - protein, 187 aa, Carica papaya
GKTFKKPRRPYEKERLDAELKLVGEYGLRCKRELWRVQYALSRIRNAARELLTLDEKNPRRIFEGEALLRRMNRYGLLDESQNKLDYVLALTVENFLERRLQTLVFKSGMAKSIHHARVLIRQKHIRVGRQVVNVPSFLVRIDSQKHIDFSLTSPFGGGRPGRVKRKNMRAAAKKAAGGDGDEEDEE

SEQ ID NO: 7815 - protein, 197 aa, Physcomitrella patens
MVHVASFRNYGKTFKKPRRPFEKERLDAELKLVGEYGLRNKRELWRVQYALSRIRNNARMLLTLDEKNTRRIFEGEALLRRMNRYGLLDENQSKLDYVLALTVENFLERRLQTIVFKSGMAKSIHHARVLIKQRHIRVGKQIVDVPSFMVRVDSQKHVDFALSSPLGGGRPGRVKRKNMKAASKKASGGDDEEEDDE

SEQ ID NO: 7816 - protein, 196 aa, Plantago ovata
MVHVVFYRNYGKTFKKPRRPYEKERLDAELRLVGEYGLRCKRELWRVQYALSRIRNAARHLLTLDEKDPRRIFEGEALLRRMNKFGLLEESKLNLDFVLALTVESFLERRLQTIVFKAGMAKSIHHARVLIRQKHIRVGRQVVNVPSFMVRVDSQKHVDFSLTSPFGGGRAGRVKRKNQKAAAKKSGGGDEEEDED

SEQ ID NO: 7817 - protein, 176 aa, Euphorbia peplus
MVHVSFYRNYRKTFKKPRRPYEKERLDAELKLVGEYGLRCKRELWRVQYALSRIRNAARMLLTLDEKNPRRIFEGEALLRRMNRYGLLDESQNKLDYVLALTVENFLERRLQTLVFKSGMAKSIHHARMLIRQRHIRVGRQVVNIPSFMVRVDSQKHIDFSLTSPFGSGRPGRVKR

SEQ ID NO: 7818 - protein, 177 aa, Sorghum bicolor
MVHVSFYRNYGKTFKKPRRPYEKERLDAELKLVGEYGLRCKRELWRVQYALSRIRNAARELLTLDEKNPRRIFEGENKLDYVLALTVENFLQRRLQTIVFKNGMAKSIHHARVLIRQRHIRVGRQLVNIPSFMVRVDSEKHIDFSLTSPLVGGEPGRVKRKNSKKASGGGGDDEEEE

SEQ ID NO: 7819 - protein, 72 aa, Secale cereale
MVHVNFYRNYGKTFKKPRRPYEKERLDAELKLVGEYGLRCKRELWRVQYALSRIRNAARHWGTTDDERSRVS

SEQ ID NO: 7820 - protein, 195 aa, Distylium racemosum
MVHVSFYRNYGKTFKKPRRPYEKERLDAELKLVGEYGLRNKRELWRVQYTLSRIRNAARMLLTLEEKNPRRIFEGEALLRRMNRYGLLDESQNKLDYVLALTVENFLERRLQTLVFKSGMAKSIHHARVLIRQRHIRVGRQVVNIPSFLVRVDSQKHIDFSLTSPLGGGRPGRVKRKNMKAASKKASWWRCGRGG

SEQ ID NO: 7821 - protein, 199 aa, Primula obconica
MVHVPYYRNYGKTFKKPRRPYEKERLDAELKFLGEYGLRCKRELWRVQYALSRIRNNARMLLTLDEKNPRRIFEGEALLRRMNRYGLLKEDQNKLDYVLALTVESFLERRLQTQVFKTGMAKSIHHARVLIKQKHIRVGRQVVNVPSFMVRLDSQKHIDFSLTSPLGGGRPGRVKRRNVKNASKKPSGGDADEEEEGDS

SEQ ID NO: 7822 - protein, 198 aa, Physcomitrella patens
MVHVASFRNYGKTFKKPRRPFEKERLDAELKLVGEYGLRNKRELWRVQYALSRIRNNARMLLTLDEKNTRRIFEGEALLRRMNRYGLLDESQCKLDYVLALTVENFLERRLQTLVFKSGMAKSIHHARVLIKQRHIRVGKQIVDVPSFMVRLDSQKHVDFALSSPLGGGRPGRVKRKNMKAASKKASGGDDDEEEDDE

SEQ ID NO: 7823 - protein, 198 aa, Marchantia polymorpha
MVHVAVYRNYGKTFKKPRRPFEKERLDAELKLVGEYGLRNKRELWRVQYALSKIRNNARTLLTLDEKNTRRIFEGEALLRRMNRYGLLDESQTKLDYVLALTVENFLERRLQTLVFKSGMAKSIHHARVLIKQRHIRVGKQIVDVPSFLVRVDSQKHIDFALSSPLGGGRPGRVKRRNMKAASKKAAGGDGDEEEEDE

SEQ ID NO: 7824 - protein, 116 aa, Cajanus cajan
MFRYGLLDETQNKLDYVLALTVENFLERRLQTLVFKSGMAKSIHHARVLIRQRHIRVGRQVVNIPSFMVRVDSQKHIDFSLTSPLGGGRPGRVKRKNQRAAAKKAAGGDGDEEDED

SEQ ID NO: 7825 - protein, 194 aa, Linum usitatissimum
MVHVAYFRNYGKTFKKPRRPYEKERLDAELKLVGEYGLRAKRELWRVQYALSRIRNAARMLLTLDEKNPRRIFEGEALLRRMNKYGLLDESQNKLDYVLALTVENFLERRLQTLVFKSGMAKSIHHARVLIRQKHIRVGRQVVNIPSFMVRLDSQKHIDFSLTSPFGNSDIQGRVKRKNMKAASSKKDDAADED

SEQ ID NO: 7826 - protein, 176 aa, Castanea mollissima
MVHVAFYRNYGKTFKKPRRPYEKERLDAELKLVGEYGLRCKRELWRVQYALSRIRNNARMLLTLDEKNSRRIFEGEALLRRMNRYGLLDESQNKLDYVLALTVENFLERRLQTLVFKSGMAKSIHHARVLIRQKHIRVGRQVVNIPSFMVRVDSQKHIDFSLNSPFGGGRPGRVKR

SEQ ID NO: 7827 - protein, 179 aa, Euphorbia peplus
MVHVSFYRNYGKTFKKPRRPYEKERLDAKLKLVGEYGLRCKRELWRVQYALSRIKNAARMLLTLDEKNPRRIFEGEALLRRMNRYGLLDESQNKLDYVLALTVENFLERRLQTLVFKSGMAKSIHHARVLIRQRHIRVGRQAVNIPSFMVRVDSQKHIDFSLTSPLGPGRPGRVKKKEP

SEQ ID NO: 7828 - protein, 174 aa, Parthenium argentatum
MVHVPFYRNYGKTFKKPRRPYEKERLDAELKLVGEYGLRCKRELWRVQYALSRIRNAARMLLTLEEKDPRRIFEGEALMRRMNRYGLLDESQNKLDYVLALTVENFLERRLQTLVFKTGMAKSIHHARVLIKQRHIRVGRQVVNVPSFMVRVDSQKHIDFSLTSPFGGGRPGRV

SEQ ID NO: 7829 - protein, 198 aa, Physcomitrella patens
MVHVASFRNYGKTFKKPRRPFEKERLDAELKLVGEYGLRNKRELWRVQYVLSRIRNNARMLLTLDEKNTRRIFEGEALLRRMNRYGLLDESQCKLDYVLALTVENFLERRLQTLVFKSGMAKSIHHARVLIKQRHIRVGKQIVDVPSFMVRLESQKHVDFALSSPLGGGRPGRVKRKYMKAASKKASGGDDEDEEDDE

SEQ ID NO: 7830 - protein, 198 aa, Unknown
  Sequence found in Organisms: Thellungiella halophila, Eutrema halophilum
MVHVCYYRNYGKTFKGPRRPYEKERLDSELKLVGEYGLRNKRELWRVQYALSRIRNAARDLLTLDEKNPKRIFEGEALLRRMNRYGLLDESQNKLDYVLALTVENFLERRLQTIVFKSGMAKSIHHSRVLIRQRHIRVGKQLVNIPSFMVRLDSQKHIDFALTSPFGGGRPGRVKRRNEKSASKKASGGGDADADDEE

SEQ ID NO: 7831 - protein, 72 aa, Oryza sativa
MNRYGLLGEGQNKLDYVLALTVENFLQCRLQTIVFKNGTVKSIHHDHVLIRQHHIRVGRQLVNIPLFMVRLD

SEQ ID NO: 7832 - protein, 169 aa, Triticum aestivum
DAELKLVGEYGLRCKRELWRVQYALSRIRNNARHLLTLDEKNPRRIFEGEALLRRMNRYGLLADGQNKLDYVLALTVENFLARRFQTLVFKAGMAKSIHHARVLIRQRHIRVGRQIVNIPSFMVRVESEKHIDFSLTSPFGGGPPGRVKRKNQKKASGGGGDGEEEDEE

SEQ ID NO: 7833 - protein, 100 aa, Brassica napus
MVQVRFYRNYGKTFKKPRRPYEKERLDAELKLVGEYGLRCKRELWRVQYTLSRIRNAARELLTLDEKNPRRIFQGEALLRRMNKNGLLDESQNSSTTFLL

SEQ ID NO: 7834 - protein, 198 aa, Arabidopsis thaliana
MVHVCYYRNYGKTFKGPRRPYEKERLDSELKLVGEYGLRNKRELWRVQYSLSRIRNAARDLLTLDEKSPRRIFEGEALLRRMNRYGLLDESQNKLDYVLALTVENFLERRLQTIVFKSGMAKSIHHSRVLIRQRHIRVGKQLVNIPSFMVRLDSQKHIDFALTSPFGGGRPGRVKRRNEKSASKKASGGGDADGDDEE

SEQ ID NO: 7835 - protein, 198 aa, Marchantia polymorpha
MVHVAVYRNYGKTFKKPRRPFEKERLDAELKLVGEYGLRNKRELWRVQYALSKIRNNARQLLTLDEKNTRRIFEGEALLRRMNRYGLLDESQSKLDYVLALTVENFLERRLQTLVFKSGMAKSIHHARVLIKQRHIRVGKQIVDVPSFLVRVDSQKHVDFALSSPLGAGRPGRVKRRNMKAASKKAAGGDGDEEEDEE

SEQ ID NO: 7836 - protein, 202 aa, Eutrema parvulum
VLKILILSVEFDFADGKTFKKPRRPYEKERLDAELKLVGEYGLRCKRELWRVQYALSRIRNAARELLTLDEKNPRRIFQGEALLRRMNKNGLLDESQNKLDYVLALTVENFLERRLQTIVFKSGMAKSIHHARVLIRQRHIRVGRQLVNIPSFMVKVDSQKHIDFSLTSPFGGGRPGRVKRRNERAGAKKAGGGDGDEDDEE

SEQ ID NO: 7837 - protein, 197 aa, Orobanche aegyptiaca
MVHVSVYRNYGKTFKKPRRPYEKERLDAELRLVGEYGLRCKRELWRVQYALSRIRNNARELLTLDEKDPRRIFEGEALLRRMNKYGLLDESQKKLDYVLSITVENFLERRLQTIVFKAGLAKSIHHARVMIRHRHIRVSRQVVNVPSFMVRVDSQKHIDYALTSPLGGGRPGRVKRKNLKAAAKKASGGDGDEDDEE

SEQ ID NO: 7838 - protein, 172 aa, Ambrosia trifida
MVHVPFYRNYGKTFKKPRRPYEKERLDAELKLVGEYGLRCKRELWRVQYALSRIRNAARMLLTLEEKDPRRIFEGEALMRRMNRYGLLDESQNKLDYVLALTVENFLERRLQTLVFKTGMAKSIHHARVLIKQRHIRVGRQVVNVPSFMVRVDSQKHIDFSLTSPFGGGRPG

SEQ ID NO: 7839 - protein, 176 aa, Salvia sclarea
MVHVSFYRNYGKTFKKPRRPYEKERLDAELKLVGEYGLRCKRELWRVQYALSRIRNNARNLLTLDEKDPRRIFEGEALLRRMNKYALLDESQNKLDYVLSLTVENFLERRLQTLVFKAGMAKSIHHARVLIRQRHIRVGRQVVNVPSFLVRVDSQKHIDFSLTSPFGGGRAGRVKT

SEQ ID NO: 7840 - protein, 174 aa, Euphorbia esula
  misc_feature (29)..(29): Xaa can be any naturally occurring amino acid
  misc_feature (55)..(55): Xaa can be any naturally occurring amino acid
MVHVSFYRNYGKTFKKPRRPYEKERLDAXLKLVGEYGLRCKRELWRVQYALSRIXNAARMLLTLDEKNPRRIFEGEALLRRMNRYGLLDESQNKLDYVLALTVENFLERRLQTLVFKSGMAKSIHHARVLIRQRHIRVGRQAVNIPSFMVRVDSQKHIDFSLTSPLGPGRPGRV

SEQ ID NO: 7841 - protein, 198 aa, Arabidopsis lyrata
MVHVCYYRNYGKTFKGPRRPYEKERLDSELKLVGEYGLRNKRELWRVQYSLSRIRNAARDLLTLDEKSPKRIFEGEALLRRMNRYGLLDESQNKLDYVLALTVENFLERRLQTIVFKSGMAKSIHHSRVLIRQRHIRVGKQLVNIPSFMVRLDSQKHIDFALTSPFGGGRPGRVKRRNEKSASKKASGGGDADGDDEE

SEQ ID NO: 7842 - protein, 197 aa, Brassica juncea
MVHVCYYRNYGKTFKGPRRPFEKERLDSELKLVGEYGLRNKRELWRVQYSLSRIRNAARDLLTLDEKNPKRIFEGEALLRKMNRYGLLDESQNKLDYVLALTVENFLERRLQTIVFKSGMAKSIHHSRVLIRQRHIRVGKQLVNIPSFMVRLDSQKHIDFALTSPFGGGRPGRVKRRNEKSASKKASGGDGDGDDEE

SEQ ID NO: 7843 - protein, 182 aa, Brassica nigra
VQVRFYRNYGKTFKKPRRPYEKERLDAELKLVGEYGLRCKRELWRVQYTLSRIRNAARELLTLDEKNPRRIFQGEALLRRMNKNGLLDESQNKLDYVLALTVENFLERRLQTIVFKSGMAKSIHHARVLIRQRHIRVGRQLVNIPSFMVKVDSQKHIDFSLTSPFGGGRPGRVKRRNERAGA

SEQ ID NO: 7844 - protein, 190 aa, Unknown
  Sequence found in Organisms: Brassica napus, Chlamydomonas reinhardtii
MPKIGFYRNYGKTFKKPRRPYEKERLDAELKLVGEYGLRNKRELWRVQMVLSKIRNAARVLLTLDEKDPKRIFEGNALMRRMNRYGLLNESQDKLDYVLALTPQDFLERRLQTLVFKQGLAKSIHHARVLIRQRHIRVGKQVVNVPSFMVRVDSQKHIDFALTSPFGGGRPGRVKRKNAKKGGDGGEDDE

SEQ ID NO: 7845 - protein, 215 aa, Cirsium arvense
MVHVNFYRNYGKTFKKPRRPYEKERLDAELKLVGEYGLRCKRELWRVQYALSRIRNAARMLLTLEEKDPRRIFEGEALMRRMNRYGLLDESQNKLDYVLALTVENFLERRLQTLVFKTGMAKSIHHARVLIKQRHIRVGRQVVNVPSFMVRVDSQKHIDFSLTSPFGGGRPGRVKRKNQKAAAKKAAGGGDADEDDEEMSTKVGYFLYLCFVPYK

SEQ ID NO: 7846 - protein, 169 aa, Jatropha curcas
MVHVSFYRNYGKTFKKPRRPYEKERLDAELKLVGEYGLRCKRELWRVQYALSRIRNAARMLLTLDEKNPRRIFEGEALLRRMNRYGLLDESQNKLDYVLALTVENFLERRLQTLVFKSGMAKSIHHARVLIRQRHIKVGRQVVNIPSFMVRVDSQKHIDFSLTSPFGGG

SEQ ID NO: 7847 - protein, 186 aa, Primula obconica
NYGKTFKKPRRPYEKERLDAELKLVGEYGLRCKRELWRVQYALSRIRNNARMLLTLDEKNPRRIFEGEALLRRMNRYGLLKEDQNKLDYVLALTVESFLERRLQTQVFKTGMAKSIHHARVLIKQKHIRVGRQVVNVASFMVRMDSQKHVDFSLTSPLGAGRPGRVKRKNAKRASGGGEAVEERED

SEQ ID NO: 7848 - protein, 190 aa, Volvox carteri
MPKIGFYRNYGKTFKKPRRPYEKERLDAELKLVGEYGLRNKRELWRVQMVLSKIRNAARVLLTLEEKDPKRIFEGNALMRRMNRYGLLSESQDKLDYVLALTPQDFLERRLQTLVFKQGLAKSIHHARVLIRQRHIRVGKQVVNVPSFMVRVDSQKHIDFALTSPFGGGRPGRVKRKNAKKGGDGGDDDE

SEQ ID NO: 7849 - protein, 698 aa, Sorghum bicolor
MGFDGLVVVSDPYLQRRFTQADLRVLQTQYAALRDASPNGRLRIRDLPAAISSVRGRGAVRGRDAEKENSAPEPGPGLGLTDEEWASVLKAVARADEKPHQDASFELFLRVYAEMQLRLKAASGGGAGRAGGIARSSSSSAVAFLTAATTTLLHTISESEKASYVGHINAYLAEDPFLKTALPIDPATDHIFHVTKDGVLLCKLINLAVPGTIDERAINTKRVLNLWEKNENHTLCLNSAKAIGCTVVNIGTQDLAEGRPHLVLGLISQIIKIQLLADVNLKSTPQLVELVEDSKEMEELMSLSPEKILLRWMNFQLKKGGFQKTVTNFSSDIKDSEAYACLLNVLAPECSAKPSAMSVKDLLHRARLILEHADRMGCKRYLTPKDIVDGLPNLNLAFVAHIFQKRNGLSKQMKQVSFVDGLSDDAQVSREERSFRLWINSLGISTYINNVFEDLRNGWVLLEVIDKIAPGSVNWKMANRPPIKLPFRKVENCNQVLKIGKELKFSLVNIAGNDIVQGNKKLILAFLWQLMRYNILQLLKNLRFHSNGKEITDNDILAWANKKVKDSGKHHSHMQSFKDKSLSSGTFFLDLLSAVEPRVVNWSLVTKGEKDEEKQMNASYIISVARKLGCSIFLLPEDILEVNQKMMLTLTASIMYWYLKRPTSHSLDSENGSSCETTSITTSDDSASESSIDDNTTR

SEQ ID NO: 7850 - protein, 695 aa, Zea mays
MGFDGLVVVSDPYLQRRFTQAELRALQAQYAALRDASPNGRLRMRDLPAAISGVRGAAKSRDAEKENSAPEPGPCHGLTDEEWASVLKAVARADEKPHQDASFELFLRVYAEMQLRLKAVSVCSGRAGGIVRSSSSSAVAFLTAATTTLLHTISESEKASYVGHINAYLADDPSLKSALPIDPATDHIFHITKDGVLLCKLINLAVPGTIDERAINTKRVLNLWEKNENHTLCLNSAKAIGCTVVNIGTQDLAEGRPHLVLGLISQIIKIQLLANVNLKSTPQLVELVEDSKEMEELMSLSPEKILLRWMNFQLKKAGFQKRVTNFSSDIKDSEAYACLLNVLAPECSAKPSAMSVKDLLHRARLILEHADRMGCKRYLTPKDIVDGLPNLNLAFVAHIFQKRNGLSKQMKQVSFVDGLSDDAQVSREERSFRLWINSLGISTYINNVFEDLRNGWVLLEVIDKIAPGSVNWKMANRPPIKLPFRKVENCNQVLKIGKELKFSLVNIAGNDIVQGNKKLILAFLWQLMRYNILQLLKNLRFHSNGKEITDNDILAWANKKVKDSGKHHSYMQSFKDKSLSSGTFFLDLLSAVEPRVVNWSLVTKGEKDEEKQMNASYIISVARKLGCSIFLLPEDILEVNQKMMLTLTASIMYWYLKRPTSQSLDSENGSSCETTSITTSDDSASESSIDDNTTR

SEQ ID NO: 7851 - protein, 695 aa, Oryza sativa
MGLDGLVVVSDPYLQRRFSQADLRALQAQYAALRDAAPSGRLRLRDLPAALSSAGVGAGKGGDAEKENSAPAAAQLTEEEWASVLKAVARADERPHQGVGFELFLRVYAEMQLRLKGAAAGKKAGGGGGGIARSSSSSAAAFLTAATTTLLHTISESEKASYVGHINAYLAEDPFLNTALPIDPATDHLFHLTKDGVLLCKLINLAVPGTIDERAINTKKLLNLWEKNENHTLCLNSAKAIGCTVVNIGTQDLAEGRPHLILGLISQIIKIQLLADVNLKSTPQLVELVEDSKEMEELMSLSPEKILLRWMNFQLKKGGFQRTVTNFSSDIKDSEAYACLLNVLAPECSAKPSPMSVKDLLHRARLVLEHADRMGCKRYLTPKDIVDGLPNLNLAFVAHIFQKRNGLSKQMKQVSFVDGLSDDAQVSREERSFRLWINSLGISTYINNVFEDLRNGWVLLEVIDKIAPGSVNWKMANRPPIKLPFRKVENCNQVLKIGKELKFSLVNIAGNDIVQGNKKLILAFLWQLMRYNILQLLKNLRFHSNGKEITDNDILIWANKKVKDSGKHSRMESFKDRSLSSGIFFLNLLGAVEPRVVNWSLVTKGEKDEEKQMNASYIISVARKLGCSIFLLPEDILEVNQKMMLTLTASIMYWHLKKPTSFSLDTENGSSCETSSISTSDDSASESSFDDSGAR

SEQ ID NO: 7852 - protein, 698 aa, Brachypodium distachyon
MGFDGLVVVSDPYLQRRFTQTDLRALQAQYAALRDAAPSGRLRLRDLPAALTSLGRAASTAGGKGGEVRGDAEKENSSPEPGLTDEEWASVLNAVARPDHKPPQHDVNFEFFLRVYAEMQLRLKGARKVRGDGGIKRSSSSSAAFLTASTTTLLHTISESEKASYVGHINAYLAEDPFLKNALPVDPATDQLFHLTKDGVLLCKLINLAVPGTIDERAINTKRLLNLWEKNENHTLCLNSAKAIGCTVVNIGTQDLAEGRPHLILGLISQIIKIQLLADVNLKSTPQLVELVEDSQEMEELMSLSPEKILLRWMNFQLKKGGFQRTVTNFSSDIKDSEAYACLLNVLAPECSAKPSPMSVKDLLHRARLVLEHADRMGCKRYLSSKDIVDGLQNLNLAFVAHIFQKRNGLSKQMKQVSFVDGLSDDAQVSREERSFRLWINSLGISTYINNVFEDLRNGWVLLEVMDKLAPGSVNWKMANRPPIKLPFRKVENCNQVLKIGKEINFSLVNIAGNDIVQGSKKLILAFLWQLMRYNILQLLKNLRFHSNGKEITDNDILLWANKKVKDSGKHSRMESFKDRSLSGGIFFVNLLSAVEPRVVNWSLVTKGEKAEEKQMNASYIISVARKLGCSIFLLPEDILEVNQKMMLTLTASIMYWHLKRPTSYLLDPENSSSTETSSISTSDDSASESSIDDSGTR

SEQ ID NO: 7853 - protein, 683 aa, Triticum aestivum
TQADLRALQAQYAGLRDTAPTGRLRLRDLPAALTGLGSPTAMAAGKGEALRGDAGKENSSPPERALTDEEWSSVLTAVSRADEKPQLDVNFELFLRVYAEMQLRLKGGKKARERDGGQGIKRSSSSSAAFLTASTTTLLHTISESEKASYVGHINAYLAEDPFLKNALPVDPATNQLFHLTKDGVLLCKLINLAVPGTIDERAINTKRLLNLWEKNENHTLCLNSAKAIGCTVVNIGTQDLAEGRPHLILGLISQIIKIQLLADVNLKSTPQLVELVQDSQEMEELMSLSPEKILLRWMNFQLKKGGFQRTVTNFSSDIKDSEAYACLLNVLAPECSAKPSPMSVKDLLHRARLVLEHADRMGCKRYLAPKDIVDGLQNLNLAFVAHIFQKRNGLSKQMKQVSFVDGVSDDAQVSREERSFRLWINSLGISTYINNVFEDLRNGWVLLEVMDKVAPGSVNWKFANRPPIKLPFRKVENCNQLLKIGKEIKFSLVNIAGHDIVQGNKKLILAFLWQLMRYNILQLLKNLRFHSNGKEITDNDILLWANKKVKDSGRQSQMGSFKDRSLSSGIFFVNLLSAVEPRVVNWSLVTKGEKDEEKQMNASYIISVARKLGCSIFLLPEDITEVNQKMMLTLTASIMYWHLKRPTSYSLDPDNSSLCETSSISTSDDSASESSIDDSGTR

SEQ ID NO: 7854 - protein, 92 aa, Pennisetum glaucum
MEPRKKSSYLVAVVFASLLLSSMAGGHRKLVNKDDAGSMETSESMQQLQGYDEAAAVVHERILRQKQVKMDDYGRYDPTPTMSKPHFKDIPN

SEQ ID NO: 7855 - protein, 92 aa, Panicum virgatum
MEPRKSSYLVVVVFASLLLSAMAGGHRKKLLSKDGAGPMETTEESMQPLQEDDEAAVVVVHERILKQVRMDDYGRYDPTPTMSKPHFKDIPN

SEQ ID NO: 7856 - protein, 91 aa, Panicum virgatum
MEPRKSSYLVAVVLASLLLSAMAGGHRKKLLSKHGAGSMETTEESMQPLQEDDEAAVVVHERILKQVRMDDYGRSDPTPTMSKPHFKDIPN

SEQ ID NO: 7857 - protein, 91 aa, Sorghum bicolor
MEPRKSNYLVALVLASLLLSAMAGGHRKRLLNKDDASESMETSESMQQLQEDDEMAVVVHERILRQVKMNDYGRYDPSPTMAKPHFKDIPI

SEQ ID NO: 7858 - protein, 92 aa, Saccharum officinarum
MESRKSNYLVALVLASLLLSAMAGGHRKRLLNKDDASESMETSSESMQQLQEDDEMAVVVHERILRQVKMNDYGRYDPSPTMAKPHFKDIPN

SEQ ID NO: 7859 - protein, 466 aa, Setaria italica
CRVVVTVPLAAAALVAVARLGPEELAGRVRDARPVHLFLAAFLPAAAATVYLMLRPRAVYLVDYACFRTASNCRVPFSTFLEHAKQVPVLNERSIRFMTKLLERSGLGEETCLPPAHHYIPPYKYCTLDAARGEVDLVVFGALDDLFAKTGVSPGDIDILVVNCSLFCPTPSFVDMIINRYKLRSDIRSTHLSGMGCSAGLVSVGLARNLLQVAPRGAHALVVSTETITPNYYVGSERAMLLPNCLFRIGGAAALLSNSPAKARFRLRHVVRTLTGAQDSAYTCVFQEEDDRGNVGINLNKDLMTIAGNALKANITAIGPLVLPASEQLLFALSFIVRKVLSGKFKPYIPDFRTAFDHFCIHAGGRAVIDELQRSLNLSDQQVEASRMALHRFGNTSSSSLWYELAYIEAKGRMRKGDRVWMIGFGSGFKCNSAAWECIEPAANAEGPWATSIHRYPVDIPDVLKH

SEQ ID NO: 7860 - protein, 119 aa, Zea mays
MNSPPPLARGLMAVYRRVVDNILAVVAVPVAAAALVAAARFGPPEELAGRLGEVRPAHLFLAAFVPAAAATVYLMLRPRAVYLVDYACFRTASNCRVPFSTFLEHAKQCRCSTSAASGS

SEQ ID NO: 7861 - protein, 490 aa, Sorghum bicolor
MSSPPLFGNGKGLKAVCRRVVDNILAVVTVPLTAAALVAMARFGPEEQLAGQFREARPVHVFLAAFVPAAAATVYLMLRPRAVYLVDYACFRTASNCRVPFSTFLEHAKQVPVLDERSIRFMTKLLERSGLGEETCLPPAHHYIPPYNYCTLDAARGEVDLVVFSALDDLFAKTGISAGAIDIVVVNCSLFCPTPSFVDMIVHRYKLRSDVRSVHLSGMGCSAGLISVGLARNLLQVAPKGTHALVVSTETITPNYYVGSERAMLLPNCLFRVGGAAALLSNSPDKARFRLKHVVRTLTGAQDSAYTCVFQQEDDNGNVGINLNKDLMTIAGNALKANITAMGPLVLPASEQLLFALSFIARKVISGKFKPYLPDFRTAFEHFCIHAGGRAVIDELQRSLGLSDEQVEASRMTLHRFGNTSSSSLWYELAYMEAKGCMRRGDRVWMIGFGSGFKCNSAAWECIEPARTAEGPWATSIHRYPVHIPDVMKH

SEQ ID NO: 7862 - protein, 473 aa, Oryza sativa
MGNVLVAVPAAAGALVTVALLAPEAESTTVAIGRLRELIRPAHLFLAVFLPAAAATVYLVMRPRAVYLVDYACFRTAPNCRVPFATFLEHARQVPTLTERSVRFMTRLLERSGLGEETCLPPAHHYIPTYKYCTLEAARAEVDLVVFSAVDELFAKTGVSPDDVDILVVNCSLFCPTPSFVDMIVNRYKLRSDIRSMHLSGMGCSASLISIGLARNLLQVAPHGARALVVSTETITPNYYVGNERAMLLPNCLFRMGGAAALLSTSPAKARFRLKHVVRTLTGAEDSAHHCVFQEEDEHGSIGINLSKDLMTIAGNALKANITAIAPLVLPASEQLKFALAFIARKALSGRVKPYIPDFRAAFEHFCIHAGGRAVIDELQRSLCLSDEQVQASRMALHRFGNTSSSSVWYELAYVEAKGRMRRGDRVWMIGFGSGFKCNSAAWECISPARDDDGPWATSIHRYPVDIPDVLKH

SEQ ID NO: 7863 - protein, 491 aa, Oryza sativa
MSTAASPLLERLKAAYHYHAAVGNVRAIFITLLAAAAVAALTHLAPEEVVIGRLRELRTVHLFLAIFLPVAAATMYLMLRPRPVYLVDYACFRTAPNCRVPAATFLEYAKQVPVITDRSVRFMTRLLERSGLGEETCLPPANHYIPPYKYCTLDAARGEVDLVVFSAVDELFAKTGISPDDVDILVVNCSLFCPTPSFVDMIVNRYKLRSDIRSMDLSGMGCSASPISIGLARNLLQLAPHGARALVVSTETITPNYYVGNERAMLLPICLFRIGGAAALLSTSPAKARFRLQHVVRTLTAAEDSAYHCVFQEEDEHGNTGINLSKELMTIAGNALKANITAIAPLVLPASEQLKFALAFIARKALSGRVKPYIPDFRAAFEHFCIHAGGRAVIDELQRSLCLSDEQVEASRMVLHRFGNTSSSSVWYELAYIEAKGRMRRGDRVWMIGFGSGFKCNSAAWECISPARDADGPWATSIHRYPVDIPDVLKH

SEQ ID NO: 7864 - protein, 265 aa, Panicum virgatum
ATIEKRHVHDEEEQGAGSDSDSSSSSSSCATPRRGPCSPCSPYTQQWPQSYRQSIDILSSVQSPNLSFLGTPTLSRLSNSFLAVTDSFRSKTPEIVSNFVKPLLSPATSDEQQQHEDTRKSSQYLLPSRKPSLQQIPEDQKPLVAGHEVSPYRNCSYTHGVMNGINVLCGVGILSTPYAIKQGGWIGLGILSLFALLAWYTGMLLRHCLDSKEGLETYPDIGHAAFGSTGRIVISIILYVELYACCIEYLILESDICQNCSPLLI

SEQ ID NO: 7865 - protein, 564 aa, Saccharum officinarum
MRSPVPERSLIIESDDDDDTQSAVATNWTGHGHDEEEPEQDSDSSSSSSSCATPRRGPSSPAYTQQWPQSYRQSIDILSSVHSPNLSFLGTPTLSRLSNSFLAITDSFRGKAPETISNFIKPLLGPTSSDEQQQQHEDTRKSSQHIMPSRKSSLQQIPEDQKPLVVGHEASHNRNCSYTQGVMNGINVLCGVGILSTPYAIKQGGWIGLVILCLFALLAWYTGVLLRHCLDSKEGLETYPDIGHAAFGSTGRIVISIILYVELYACCIEYLILESDNLSKLFPTAHLTIGSLTLNSHVFFAILTTIIVMPTTWLRDLSCLSYISAGGVIASILVVICLFLVGVVNNVGFENEGTALNLPGIPIAIGLYGYCYSGHGVFPNIYSSLKNRNQFPSILFTCIGLSTFLYAGAAVMGYKMFGEATESQFTLNLPDNSLISKVAVWTTVANPITKYALTIIPLAMSLEELLPPNQQKYSTIIMLRSSLVMSTLLIALSVPFFGLVMALVGSLFAMLVTYILPCACFLAILKTKVGWHQIAACSFIIAVGVCCACVGTYSSLSKIIQNYT

SEQ ID NO: 7866 - protein, 571 aa, Sorghum bicolor
MRSPVPERSLIIESDDDDDTQSAVATNWIGHGHGHDEEEPEQEPGSDSDSSSSSSSCATPRRGPSSPAYTQQWPQSYRQSIDILSSVHSSNLSFLGTPTLSRLSNSFLAITDSFRGKAPETISNFVKPLLGPTSSDEQQQQQHEDTRKSSQYIMPSRKSSLEQIPEDQKPLVVGHEASRNRNCSYTQGVMNGINVLCGVGILSTPYAIKQGGWIGLVILCLFALLAWYTGVLLRHCLDSKEGLETYPDIGHAAFGSTGRIVISIILYVELYACCIEYLILESDNLTKLFPTAHLTIGSLTLNSHVFFAILTTIIVMPTTWLRDLSCLSYISAGGVIASILVVICLFLVGVVNDVGFENEGTALNLPGIPIAIGLYGYCYSGHGVFPNIYSSLKNRNQFPSILFTCIGLSTFLYAGAAVMGYKMFGEATESQFTLNLPDNSLISKVAVWTTVANPITKYALTIIPLAMSLEELLPPNQQKYSTIIMLRSSLVMSTLLIALSVPFFGLVMALVGSLFAMLVTYILPCACFLAILKTKVGWHQIAACSFIIAVGVCCACVGTYSSLSKIIQNYT

SEQ ID NO: 7867 - protein, 555 aa, Zea mays
MMSPASERSLIIQSDDDDDARSGHDVEEPEQDSDSSSSSSSCATPRRGPSSPPYIQQWPQSYRQSIDILSSVQSPNLSFLGTPTLSRLSNSFLAITDSFRSKAPETISSFIKPLLGPTPSDEQQRQHEGTRKSSEYLVPSRRSSLQQIPEDQKPPVGGHGASHDQNCSYTQGVMNGINVLCGVGILSTPYAIKQGGWIGLAILCTFALLAWYTGVLLRHCLDSKEGLKTYPDIGHAAFGSTGRIVISIILYVELYACCIEYLILEGDNLSKLFPNAHLTIGSMTLNSHVFFAILTTIIVMPTTWLRDLSWLSYISAGGVIASILVVICLFLVGVVNDFGFENEGTALNAPGIPIAIGLYGYCYSGHGVFPNIYSSLKNRNQFPSILFTCIGLSTFLYAGAAVMGYKMFGEATESQFTLNLPDNSVISKIAVWTTVAKSITKYALTIIPLAMSLEELLPPNQQKYSTIIMLRSSLVISTLLIALSVPFFGLVMALVGSLFAMLVTYILPCACFLAILKTKVGWHQIAACSFIIVVGVCCAYVGTYSSLSKIIQNYA

SEQ ID NO: 7868 - protein, 565 aa, Setaria italica
MRSSVSERSLIIESDDDDDHPQSQPPSAAAARRRRHHDQGSGSDSDSGSGSDSSSPCATPRAEPTASSYTQQWPQSYRQSIDILSSVQSPNLSFLGTPTLSRLSNSFTNSFRGKTPEIISNLVKPLLRPTTSDEQQREEARKSSQYLLPSRKPSLQQIPEDQKPLLVADEVSPHQKCSYTQAVVNGINVLCGVGILSTPYAIKQGGWLGLAILCLFAILAWYTGVLLRRCLDSKEGLETYPDIGHAAFGTTGRIAISIILYVELYACCIEYLILESDNLSKLFPNAHLTIGSLTLNSHVFFAILTTIIVMPTTWLRDLSCLSYLSAGGVIASILGVICLFWAGAVDNVGFENEGTVLNLPGIPIAIGLYGYCYSGHGVFPNIYSSLKNRNQFPSILFTCIALSTILYAGAAVMGYKMFGEATKSQFTLNLPENLVVSKVAVWTTVANPITKYALTIIPLSMSLEELLPPNQQKYSNIMMLRSALVVSTLLIALSVPFFGLVMALVGSLLTMLVTYILPCACFLAILKTKVTWHQVAACSFIMAVGVCCACVGTYSSLSRIIQSYT

SEQ ID NO: 7869 - protein, 572 aa, Saccharum officinarum
MRSSVSERSLIIESDDDDDERPQTQPSAAARSTRRHRHEDEERSGSGSGSDSDSGSSSSSCATPRGPATASSYTQQWPQSYRQSINILSSVQSPNLSFLGTPTLSRLSNSFITNSFRGKTPEIISNLVKPLLHPTTSDDLQQQQHEERKSSQYLLPSRKPSLQQIPEDQKPVPVAHEVSPYHKCSYTQAVVNGIKGLCGVGILSTPYAIKQGGWLGLVILCLFAILAWYTGVLLRRCLDSKEGLETYPDIGHAAFGTTGRIAISIILYVELYACCIEYLILEGDNLSKLFPNAHLTIGSLTVNSHVLFAILTTIIVMPTTWLRDLSCLSYLSAGGVIASILGVFCLFWVGVIDNVGFENKRTALNLPGIPIAIGLYGYCYSGHGVFPNIYSSLKNRNQFPSILFTCIGLSTILFAGAAVMGYKMFGEATQSQFTLNLPENLVVSKIAVWTTVANPITKYALTITPLAMSLEELLPPNQQKYSNIVMLRSALVVSTLLIALSVPFFGLVMALVGSLLTMLVTYILPCACFLAILRRKVSWHQVAACSFIIVVGVCCACVGTYSSLSKIIQNYT

SEQ ID NO: 7870 - protein, 576 aa, Sorghum bicolor
MRSSVSERSLIIESDDDDNDDRPQSQPSAAAARSRRRHHQHEEGSGSGSGSGSDSDSGSSSSSCATPRGHAQATASSYTQQWPQSYRQSINILSSVQSPNLSFLGTPTLSRLSNSFITNSFRGKTPEIISNLVKPLLRPTTSDDLQQQHEERKSSQYLLPSRKPSLQQIPEDQKPVPVAHEVSPYHKCSYTQAVVNGINVLCGVGILSTPYAIKQGGWLGLVILCLFAILAWYTGVLLRRCLDSKEGLETYPDIGHAAFGTTGRIAISIILYVELYACCIEYLILEGDNLSKLFPNAHLTIGSLTVNSHVLFAILTTIIVMPTTWLRDLSCLSYLSAGGVIASILGVICLFWVGVVDNVDFENKGTALNLPGIPIAIGLYGYCYSGHGVFPNIYSSLKNRNQFPSILFTCIGLSTILFAGAAVMGYKMFGEATQSQFTLNLPENLVVSKIAVWTTVANPITKYALTITPLAMSLEELLPPNQQKYSNIVMLRSALVVSTLLIALSVPFFGLVMALVGSLLTMLVTYILPCACFLAILRRKVSWHQVAACSFIIMVGVCCACVGTYSSLSKIIQNYT

SEQ ID NO: 7871 - protein, 565 aa, Brachypodium distachyon
MKSLLSEESTFIIESDDDEEDPAGLQDAGLNEDGNGDGDGSSSDSSSCATPRCDSRPGSYTQQWPQSYRQSIDIYSSVQSPNLSFLGTPTLSRLSNSFLTNSFRGKTPEIISNLVKPLLRPTTSDEQQQPQQQQQQHEDIRKSSQYLLPSRKPSLQQIPEDQKPLVVGHEVSPYQQCSYTQGAMNGINVLCGVGILSTPYAIKQGGWLGLVILVLFALLAWYTGVLLRRCLDSKEGLQTYPDIGHAAFGTTGRIAISVILYIELYACCIEYLILESDNLSKLFPNVHLTIGSLTLNSHVFFAILTTIIVMPTTWLRDLTCLSYISVGGVIASILVVICLFWIGVVDHVGFENKGATLNLPGIPIAIGLYGYCYSGHGVFPNIYSSLKNRNQFPSILFTCIAFSTILFAAAAVMGYKMFGESTESQFTLNLPENLLVSKIAVWATVANPITKYALTITPLAMSLEELLPRSQQKYSNIIMLRSALVASTLLIALSVPFFALVMSLIGSLLAMLVTYILPCACFLAILKTKVTWYQITACSFIIIVGVSCACVGTYSSLSGIIQNYT

SEQ ID NO: 7872 - protein, 252 aa, Zea mays
MAIDHAARLGLTSRGATGGGGCGDDVDAENRRWPPWLKPLLCTSFFVQCRIHADAHKSECNMYCLDCMDGALCSLCLARHRDHHSIQIRRSSYHDVIRVSEIHKVLDIAGVQTYIINSARVVFLNERPQPRPGKGVTNTCEVCERSLLDCFRFCSLGCKIVGTARGYRPKKKHGGGGGGGNKRKRAALKDVRSDSEESCTSTSGASSDKSSVVQSFSPSTPPPASASYRRPGNKRRKGVPHRSPFGSLIVEF

SEQ ID NO: 7873 - protein, 249 aa, Hordeum vulgare
MAIDHASPLALKSGGATGGAECDEEAGNQRWPPWLKPLLATSFFVQCRVHADAHKSECNMYCLDCIGGALCSLCLAHHRDHHAIQIRRSSYHDVIRVSEIQRVLDITGVQTYIINSARVVFLNERPQPRPGKGVTNTCDVCERSLLDSFRFCSLGCKIVGTSGGHRPRKKHGGVGGGGKKKKRAALKDARSDSEHSCTSTSGGSSDKSSVVQSFSPSTPPATSSSYRAGNKRRKGIPHRSPFGSLIVEL

SEQ ID NO: 7874 - protein, 236 aa, Sorghum bicolor
MGGGECDYDDAENQRWPPWLKPLLSTSFFVQCRIHADAHKSECNMYCLDCMNGALCSLCLAHHRDHHSIQIRRSSYHDVIRVSEIQKVLDIAGVQTYIINSARVVFLNERPQPRPGKGVTNTCEVCERSLLDCFRFCSLGCKIVGTARGYRPKKKHGIGGGGHKKKRAALKVKDVRSDSEDSCTSTSGASSDKSSVVQSFSPSTPPPTSASHRRPGNKRRKGVPHRSPFGSLIVEF

SEQ ID NO: 7875 - protein, 245 aa, Triticum aestivum
MAIDHASPLALKSGGATGGAGCEDEEAENQRWPPWLKPLLATSFFVQCRAHADAHKSECNMYCLDCVNGALCSLCLAHHRDHHAIQIRRSSYHDVIRASEIQRVLDITGVQTYIINSARVVFLNERPQPRPGKGVTNTCEVCERSLLDSFRFCSLGCKIVGTSGGHRPRKKHGGKKKKRAAVKDARSDSEHSCTSTSGGSSDKSSVVQSFSPSTPPATSSSYRAGNKRRKGIPHRSPFGSLIVEY

SEQ ID NO: 7876 - protein, 189 aa, Triticum aestivum
MYCLDCINGALCSLCLAHHRDHHAIQIRRSSYHDVIRVSEIQRVLDITGVQTYIINSARVVFLNERPQPRPGKGVTNTCEVCERSLLDSFRFCSLGCKIVGTSGGHRPRKKHGGVGGGGKKKRAAVKDARSDSEHSCTSTSGGSSDRSSVVQSFSPSTPPATSSSYRAGNKRRKGIPHRSPFGSLIVEY

SEQ ID NO: 7877 - protein, 203 aa, Pennisetum glaucum
MGGGECDDDAENQRWPPWLKPLLSTSFFVQCRVHADAHKSECNMYCLDCMNGALCSLCLAHHRDHHAIQIRRSSYHDVIRVSEIQKVLDITGVQTYIINSARVVFLNERPQPRPGKGVTNTCDVCERSLLDCFRFCSLGCKIVGTARGYRPTKKKHGGGGGGDSKKKRRAALKDVRCDSEDSCTGSSGGSSDKSSVVQSFSPS

SEQ ID NO: 7878 - protein, 241 aa, Oryza sativa
MGGRGYEEEEVENQRWPPWLKPLLSTSFFVQCRIHADAHKSECNMYCLDCMNGALCSLCLSHHRDHHAIQIRRSSYHDVIRVSEIQKVLDITGVQTYIINSARVVFLNERPQPRPGKGVTNTCEVCERSLLDSFRFCSLGCKIVGTSGGYRPRKKHGGCGGGGGGGDGGKKKKKRAALKDARYESEDSCTSTSGGSSDKSSVVQSFTPLTPPPTSASYRTGNKRRKGVPHRSPFGSLIVEF

SEQ ID NO: 7879 - protein, 235 aa, Zea mays
MGGGGECDDGSDTRRWPPWLRPLLSASFFVQCRVHADAHKSECNMYCLDCMGGALCALCLAARHRDHHSIQIRRSSYHDVIRVSEIQKVLDIAGVQTYIINSARVVFLNERPQPRPGKGVTNTCEVCERSLLDCFRFCSLGCKIVGTARGYRPGKKKHGGGGGNKKRASPAPALKDVRSDSEDSCTSTSGASSDKSSVVQSSPPPPTSASHRPPGNKRRKGVPHRSPLGSLIVEL

SEQ ID NO: 7880 - protein, 234 aa, Brachypodium distachyon
MGGAECEDEAEDNQRWPPWLKPLLATSFFVQCRVHAEAHKSECNMYCLDCINGALCSLCLAHHRDHHAIQIRRSSYHDVIRVSEIQKVLDIAGVQTYIINSARVVFLNERPQPRPGKGVTNTCEVCDRSLLDSFRFCSLGCKIAGTSGGYRPRKKHGGGVESKKKKKKRAAALKDARSYSDGSSSSSSSDRSSVVQSFTPSTPPPTTSSSYRAGNKRRKGIPHRSPFGSLIVEF

SEQ ID NO: 7881 - protein, 251 aa, Avena sativa
MAIDHASPLALKSRGATGGAECEDEAENQRWPPWLKPLLATSFFVQCRVHADAHKSECNMYCLDCVNGALCPLCLAHHRDHHAIQIRRSSYHDVIRVSEIQRVLDIAGVQTYIINSARVVFLNERPQPRPGKGVTNTCDVCERSLLDTFRFCSLGCKIVGTSGGHRPRKKQSGSGSGGDGGGQKKRKKRVAVKDARSESEHSCTSSSDKSSVVQSFTPSTPPPASSSHRTGSKRRKGVPHRSPFGSLIVEF

SEQ ID NO: 7882 - protein, 108 aa, Pennisetum glaucum
MSCACYQECMRRVISELRMLSRSWRSASLFPLIVVLALLFSTSSAGRPCNFLTDHQDALRHQREAAVAEQEAVVPLVHGRMLNVKTNDYGSYNPPPTMDKPHFKLIPN

SEQ ID NO: 7883 - protein, 98 aa, Cenchrus ciliaris
MHRVISEMRMLARSWRSPSLFPLIIFALLFSTSFAGRPCNFLTDQDALHHQGEAAVAEQKEAVVPLVHGRMLNVKTNDYGSYDPSPTMDKPHFKLIPN

SEQ ID NO: 7884 - protein, 353 aa, Setaria italica
MGRSRGGKGAGDSKSFPSPASSSASSSEFEFTVTLSPASKQRSAAQLCPADELFYKGQLLPLQLSPRISMVRTLLLSSASTSSASDSTSTSNSSRDSNGSTSSSFSADCAALLLPDSAASSSRPSSATEDDRHLHPLSAAASFAGLPPAKRTGKQYLSSFATRFSSVFHRGGAPAAKKQPSKSLAKEVIKKYAKKVKPLYEKLSQIPKNQNNVNVNVNGASAGANNQPQQGFKKPFTFSIRKKRADDDHAVVAAAAAVDADVVSGKYAHSNSFSGNLRFPRQKRCAASCPSSMRSSPSHSGLLTFGGAGGAGFPDVPAAAAAAVAGGIGVGPVSLSTASSMEELQSAIEGAIA

SEQ ID NO: 7885 - protein, 194 aa, Sorghum bicolor
MGRTRGSKSAGGVRSFPSPASSSSASSSEFEFTVTLSPASKQRSAEQLCPADELFYKGQLLPLQLSPRISMVRTLLLSSASTSSASASDSTSTSNSSRDSNGSTSSSFSADCAALLLPDSAASSSRPSSATEDDRHLHPHPLSAAAAFAGLPPASKRTGKQYLSSFATRFSSVFHLAALRPRRRSSRPSRSPRR

SEQ ID NO: 7886 - protein, 393 aa, Saccharum officinarum
MGRTRGNKSAAGAGGVGGVRSFPSPASSSSASSSEFEFTVTLSPASKQRSAEQLCPADELFYKGQLLPLQLSPRISMVRTLLLSSASTSSASASDSTSTSNSSRDSNGSTSSSFSADCAALMLPDSAASSSRPSSATEDDRHLHHPLSAAASFAGLPPANKRTGKQYLSSFATRFSSVFHRGAGAPAAKKQPSKSLAKEVIKKYAKKVKPLYEKLSQIPKNQNNVSGSGGGVGGANNQPQQGVKKPFTFSIRKKRGDDDHAVAAAAAVEAEVVGGGKYAHSNSFSGNLRFPRQKRAAASCPSSMRSSPSHSGLLTFGGAGGVGFPDVPAAAAAAVASGIGVGPPVSLSTASSMEELQSAIEGAIAHCKNTMSGAVSVCPRKAAAAGADEICAF

SEQ ID NO: 7887 - protein, 362 aa, Zea mays
MGRTRGNRGVGGAKSFPSPASSSASSSEFEFTVTLSPASKQRSAEQLCPADELFYKGQLLPLQLSPRISMVRTLLLSSASTSSASASDSTNSSSRDSNGSTSSSFSADCGALLGPDSAASSSRPSSATEDDRHLHPPSAAAGLLPPAKRTGKQYLSSFATRFSSVFHRGGAGAPAAKKQPSKSLAKEVIKKYAKKVKPLYERLSQIPNKNQNNVVNGNSQPQQRFKKPFTFSIRKKKGDAVAAVVEAAAEVGGNKYAHSSSFSGNLWFPRQKRATASCPSSMQSSPSHSGLLTFGGAGGVGFPDVPAVASGIGVGPVSLSTASSMEELQSAIEGAIAHCKNTMGGTVSVKAAAAAADEICTF

SEQ ID NO: 7888 - protein, 385 aa, Oryza sativa
MGRSRGKDGGGRSFPSPASSSSASSSEFEFTVTLSPASKQRSAAQLCPADELFYKGQLLPLQLSPRISMVRTLLLSSASTSSASASDSTSNSSSSRDSNGSTSSSFSADCAALLLPDSAASSSRPSSATEDDRHLAPPPPPPGVAASFAAKRTGKQYLSSFATRFSSVFHRGGAPAPAAAAANAKKPPSKSLAKEVIKKYAKKVKPLYEKLSQIPKNQSNSSGQPLQQQQQQGLKKPFSFSMRKKRGDDDHAAAAPAAAAAVAAEVGGGGKYAHSNSFSGNLRFPRQKRCAASCPSSMRSSPSHSGLLTFGGAGGVGFPDVPAAAAAAMSGGISVGPVSLSTASSMEELQSAIEGAIAHCKSTMGGAVTMCSRKAAAAADEICAF

SEQ ID NO: 7889 - protein, 521 aa, Setaria italica
MATAPANGDSQSGPQRNYQVVVAATRDMGIGKDGVLPWKLLGDLKFFKEVTLSTSDPAKKNAVIMGRKTWESIPVKSRPLPGRLNVILTRSGSFDFATVENVVICGSMKSALELLASTPYCVSIEKVFVIGGGQVLREYLNGPACEAIHLTDVQSSIECDTFIPPIDFSVFQPWYSSFPVVESNIRHSFVTFVRVRKSLEETHVSNGKESTEVDTKNDKFETENFSFLPKMIFDRHEEYHYLNLAEDIIKSGAQKNDRTGTGTLSKFGCQMRFNLRKIFPLLTTKRVFWRGVVEELLWFISGSTNAKVLQEKGIHIWDGNASREYLDSVGLAHREEGDLGPVYGFQWRHFGAEYTDMHADYTGKGFDQLMDVIDKIKNNPDDRRIILSAWNPSDLKKMALPPCHMFAQFYVENGELSCQMYQRSADMGLGVPFNIASYSLLTYMIAQVCGLSPGDFVHVIGDAHVYRTHVRALEEQIQKMPKPFPILKINPSKKDIDSFVASDFKLVGYDPHQKIEMKMAI

SEQ ID NO: 7890 - protein, 521 aa, Sorghum bicolor
MAAAPANGDSQSGPQRNYQVVVAATRDMGIGKDGVLPWKLLGDLKFFKELTLTTSDPAKKNAVIMGRKTWESIPVKSRPLPGRLNVILTRSGSFDFATVENVVICGSMNSALELLASTPYCLSIEKVFVVGGGQVLREYLNGPACEAIHLTDIQSSIECDTFIPPVDFSVFQPWYSSFPVVESNIRHSFVTFVRVRKSVAETHESNGKESTEVDTKNDKFEIENFSFLPEMVYDRHEEYQYLNLVEDIIRSGAQKNDRTGTGTMSKFGCQMRFNLRKNFPLLTTKRVFWRGVVEELLWFISGSTNAKVLQEKGIHIWDGNASREYLDSVGLAHREEGDLGPVYGFQWRHFGAEYTDMHADYTGKGFDQLMDVIDKIKNNPDDRRIIMSAWNPSDLKKMALPPCHMFAQFYVENGELSCQMYQRSADMGLGVPFNIASYSLLTYMIAQVCDLSPGDFVHVIGDAHVYRTHVRALEEQIQKMPKPFPILKINPSKKDIDSFMASDFKLVGYDPHQKIEMKMAV

SEQ ID NO: 7891 - protein, 521 aa, Saccharum officinarum
MAAAPASGDSQSGPQRNYQVVVAATRDMGIGKDGVLPWKLLGDLKFFKELTLTTSDPAKKNAVIMGRKTWESIPVKSRPLPGRLNVILTRSGSFDFATVENVVICGSMKSALELLASTPYCLSIEKVFVVGGGQVLREYLNGPACEAIHLTDIQSSIECDTFIPPVDFSVFQPWYSSFPVVESNIRHSFVTFVRVRKSVAETHESNGKESTEVDTKNDKFEIENFTFLPKMVYDCHEEYQYLNLVEDIIRSGAQKNDRTGTGTLSKFGCQMRFNLRKNFPLLTTKRVFWRGVVEELLWFISGSTNAKVLQEKGIHIWDGNASREYLDSVGLAHREEGDLGPVYGFQWRHFGAEYTDMHADYTGKGFDQLMDVIDKIKNNPDDRRIILSAWNPSDLKKMALPPCHMFAQFYVENGELSCQMYQRSADMGLGVPFNIASYSVLTYMIAQVCDLSPGDFVHVIGDAHVYRTHVRALEEQIQKMPKPFPILKINPSKKDIDSFMASDFKLVGYDPHQKIEMKMAV

SEQ ID NO: 7892 - protein, 291 aa, Pennisetum glaucum
MIFDRHEEYHYLNLVEDIIRSGAQKNDRTGTGTLSKFGCQVRFNLRKNFPLLTTKRVFWRGVVEELMWFISGSTNAKVLQEKGIHIWDGNASREYLDSVGLAHREEGDLGPVYGFQWRHFGAEYTDMHANYTGKGFDQLMDVIDKIKNNPDDRRIILSAWNPSDLKKMALPPCHMFAQFYVENGELSCQMYQRSADMGLGVPFNIASYSLLTYMIAQVCDLSPGDFVHVIGDAHVYRTHVRALEEQIQKMPKPFPVLKINPSKKDIDSFVASDFKLVGYDPHQKIEMKMAI

SEQ ID NO: 7893 - protein, 521 aa, Zea mays
MAAVLANGDSQGRPQRNYQVVVAGTRDMGIGKDGVLPWKLPGDLKFFKELTLITSDPVKKNAVIMGRKTWESIPVKSRPLPGRLNVILTRSGSFDFATVENVVICGSMESALELLASTPYCLSIEKVFVIGGGQVLREYLKGPACEAIHLTDIQSSIECDTFIPPVDFSVFQPWYSSFPVIESNIRHSFVSFVRVRKSVAETHESNGKESTEVDTKNDKFETENFSFLPKMVYDRHEEYQYLNLVEDIIRSGAQKNDRTGTGTLSKFGCQMRFNLRKNFPLLTTKRVFWRGVVEELLWFISGSTNAKVLQEKGIHIWDGNASREYLNSVGLAHREEGDLGPIYGFQWRHFGAEYTDMHADYTGKGFDQLMDVIDKIKNDPDDRRIILSAWNPSDLKKMALPPCHMFAQFYVENGELSCQMYQRSADMGLGVPFNIASYSLLTYMIAQVCDLSPGDFVHVIGDAHVYRNHVRALEEQIQKMPKPFPILKINPSKKDIDSFMASDFKLVGYDPHQKIEMKMAV

SEQ ID NO: 7894 - protein, 488 aa, Pennisetum glaucum
GVLPWKLPGDLKFFKELTHATSDPAKKNAVIMGRKTWESIPVKLRPLPGRLNVILTRSGSFDFATVENVVICGSMKSALELLASTPYCLSIEKVFVIGGGQVLREYLNGPACEAIHLTDIQSSIECDTFIPPIDFSVFHPWYSSFPVVESNIRHSFVTFVRVRKSLAETHESNGKESTEIDTKNDKFETENFSFLPKMIFDRHEEYHYLNLVEDIIRSGAQKSDRTGTGTLSKFGCQMRFNLRKNFPLLTTKRVFWRGVVEELLWFISGSTNAKVLQEKGIHIWDGNASREYLDSVGLAHREEGDLGPVYGFQWRHFGAEYTDMHANYTGKGFDQLMDVIDKIKNNPDDRRIILSAWNPSDLKKMALPPCHMFAQFYVENGELSCQMYQRSADMGLGVPFNIASYSLLTYMIAQVCDLSPGDFVHVIGDAHVYRTHVRALEEQIQKMPKPFPILKINPSKKDIDSFVASDFKLVGYDPHQKIEMKMAI

SEQ ID NO: 7895 - protein, 521 aa, Oryza sativa
MATTLSNGVSQNGPQRNYQVVVAATRDMGIGKDGVLPWKLLGDLKFFKELTVTTADPVKKNAVIMGRKTWESLPLKARPLPGRLNIILTRSGSFEFATVENVVICGSMNSALELLSSTPYCLSIEKVFVIGGGQVLRESLNGPSCEAVHLTDIQSSIECDTFIPPIDLSVFQPWYSSLPVVESNIRHSFVTYVRVRKTMAETHDSNGKESANDGIKSDKFETENFSFLPKLIFDRHEEYHYLNLVEDIIRSGAQKNDRTGTGTLSKFGCQMRFNLRNSFPLLTTKKVFWRGVVEELLWFISGSTSAKVLQEKGIHIWDGNASREYLDSVGLAHREEGDLGPVYGFQWRHFGAEYTDMHADYTGKGFDQLMDVIDKIKNNPDDRRIILSAWNPSDLKKMALPPCHMFAQFYVESGELSCQMYQRSADMGLGVPFNIASYSLLTYMIAHVCGLSPGEFVHVIGDAHVYRTHVRALEEQIQKLPKPFPVLKINPLKKDIDSFVASDFKLVGYDPHQKIEMKMAI

SEQ ID NO: 7896 - protein, 494 aa, Zea mays
MGIGKGGVLPWKLLGDLKFFKELTLTTTDPAKKNAVIMGRKTWESIPVKSRPLPGRLNVILTRSGSFDFATVENVVICGSMKSALELLASTPYCLSIEKVFVIGGGQVLREYLNGPACEAIHLTDIQSSIECDTFIPPVDFSVFQPWYSSFPVVESNIRHSFVTFVRVRKSVAETHESNGKESTEIDTKNDKFEIENFSFLPKIVYDRHEEYQYLNLVEDIIRFGAQKNDRTGTGTLSKFGCQMRFNLRKNFPLLTTKRVFWRGVVEELLWFISGSTNAKVLQEKGIHIWDGNASREYLDRIGLAHREEGDLGPVYGFQWRHFGAEYTDMHADYTGKGFDQLMDVIDKIKNNPDDRRIILSAWNPSDLKKMALPPCHMFAQFYVENGELSCQMYQRSADMGLGVPFNIASYSLLTYMIAQVCDLSPGDFVHVIGDAHVYRNHVRALEEQIQKMPKPFPILKINPSKKDIDSFMASDFKLVGYDPHQKLEMKMAV

SEQ ID NO: 7897 - protein, 518 aa, Avena sativa
MATALANGDSQNSLQRNYQVVVAATRDMGIGKDGDLPWKLPSDLKFFKNVTLTTSDPAKKNAVIMGRKSWDSLPLKARPLRGRLNVILTRSGSFDFATAENVVICGSMNSALELLASTPYCLSIEKVFVIGGGQILMEWLNAPACEAIHITDIESNIECDTFIPPVDFSVFQPWCSSLPVTESNIRHSFVTFVRVRKSVPESNGKESTEHDTKSNKFEIENFSFLPKMIFDRHEEYYYLNLVDDIIRCGAQKGDRTGTGTLSKFGCQMRFNLRKSFPLLTTKRVFWRGVLEELLWFISGSTNAKVLQEKGIHIWDGNASREYLDSVDLANREEGDLGPVYGFQWRHFGAEYTDMHADYTGKGFDQLMDVIDKIKNNPDDRRIILSAWNPSDLKKMALPPCHMFAQFYVENGELSCQMYQRSADMGLGVPFNIASYSLLTCMIAQVCGLSPGDFIHVIGDAHVYRTHIRALEEQIQKQPKPFPILKINPLKKDIDSFVASDFKLDSYDPHKKIEMEMAI

SEQ ID NO: 7898 - protein, 471 aa, Panicum virgatum
TLSTSDPAKKNAVIMGRKTWESIPVKLRPLPGRLNVILTRSGSFDFATVENVVICGSMKSALELLASTPYCLSIEKVFVIGGGQVLREYLNGPACEAIHLTNIQLSIECDTFIPPIDFSVFQPWYSSFPVVESNIRHYFVTFVRVRKSLAETNDSDGKESTEVDSKNGKFGIENFSFLPKMIFDRHEEYHYLNLVEDIIRSGAQKNDRTGTGTLSKFGCQMRFNLRKNFPLLTTKRVFWRGVVEELLWFVSGSTNAKVLQEKGIHIWDGNASREYLDSVGLAQREEGDLGPVYGFQWRHFGAEYTDMHADYTGKGFDQLMDVIDKIKNNPDDRRIILSAWNPSDLKKMALPPCHMFAQFYVENGELSCQMYQRSADMGLGVPFNIASYSLLTYMIAQVCDLSPGDFVHVIGDAHVYRTHVRALEEQIQKMPKPFPILKINPSKKDIDTFVASDFKLVGYDPHQKIEMKMAI

SEQ ID NO: 7899 - protein, 517 aa, Brachypodium distachyon
MFANVANGSSYNPDIRRNYQVVVAATHEMGIGKDGALPWKLPSDLNFFKELTMATSDPSKKNAVIMGRKTWESIPAKFRPLPGRLNVILTRSGSFDFATVENVVICGSLDSSLELLASTPYSLTIEKAFLIGGGQVLRDSLNAPACEAIHLTDIESTIECDTYIPPIDLSVFHPWYSSFPVVENNIRHSFVTFVRVRKPVTEVNDSNGNDAKKERFEIKNFSFLPKMIFERHDEYQYLNLVQDIIQSGARKNDRTGTGTLSKFGCQMRFNLRRNFPLLTTKRVFWRGVLEELLWFISGSTNAKVLQEKGIHIWDGNASREYLDSIGLSQREEGDLGPVYGFQWRHFGAEYTDMHADYTGKGYDQLIDVINKIRNNPDDRRIILSAWNPTDLKKMALPPCHMFAQFYVENGELSCQMYQRSADMGLGVPFNIASYSLLTCMIAQVCDLSPGDFVHVIGDAHVYSTHVRALEEQIKKQPKPFPILKINPVKKDIDSFVASDFELVCYDPHQKIEMKMAV

SEQ ID NO: 7900 - protein, 521 aa, Oryza sativa
MSTNVNNGNSESNLKRSYQVVVSATRDMGIGKDGTLPWKLPGDLKFFKDITVTTSDPSKKNAVVMGRKTWESIPLKFRPLPGRLNVILTRSGSFDFATAENVVICGSLDSALQLLATTPYCLTVEKTFIIGGGEILRQSLNAPACEAIHLTDIESSIECDTFIPPIDLSMFHPWYSSFPVVENGIKHSFISFVRVTKSIAEANDSSGKELTGNDSKKVKFEIENFSFLPKMIFERHEEYQYLNLVQDIIRNGAKKNDRTGTGTVSKFGCQMRFNLRRNFPLLTTKRVFWRGVLEELLWFISGSTNAKVLQEKGIHIWDGNASRQYLDSIGLTQREEGDLGPVYGFQWRHFGAEYTDMHADYVGKGFDQLMDVIDKIKNNPDDRRIILSAWNPTDLKKMALPPCHMFAQFYVENGELSCQMYQRSADMGLGVPFNIASYSLLTCMIAQVCDLSPGDFVHVIGDAHVYRTHVEALEEQMRKQPKPFPILKINPVKKDIDSFVTSDFKLVRYDPHHKIEMKMAV

SEQ ID NO: 7901 - protein, 521 aa, Triticum aestivum
MMAGVTNGNSHSDIQRKYQVVVAATREMGIGKDGALPWKLPSDLKFFKDLTMATADPSKKNAVIMGRKTWESIPTKFRPLPGRLNVILTRSGSSDYATVENVVTCGSLDSSLELLASAPYSSTIEKAFLIGGGQVLRESLNASACEAIHLTDIESTIECDTFIPPIDPLVFHPWYSSSPVVENNIRHSFATFVRVRKSAEEANDSNPSELTSNDAKKEKFEIQNFSFLPKMIFEKHDEYQYLNLVQDILRSGARKNDRTGTGTISKFGCQMRFNLRKNFPLLTTKRVFWRGVLEELLWFISGSTNAKVLQEKNIRIWDGNASREYLDSIGLSQREEGDLGPVYGFQWRHFGAEYTDMHADYTGKGFDQLADVINKIKNNPDDRRIIMSAWNPTDLKKMALPPCHMFAQFYVENGELSCQMYQRSADMGLGVPFNIASYSLLTCMIAQVCDLSPGEFVHVMGDAHVYSTHVQALEEQLQKQPKPFPILKINPLKKDIDSFVASDFKLVSYDPHQKIEMKMAV

SEQ ID NO: 7902 - protein, 521 aa, Triticum aestivum
MMAGVTNGNSHSDIQRKYQVVVAATREMGIGKDGALPWKLPSDLKFFKDLTMATADPSKKNAVIMGRKTWESIPTKFRPLPGRLNVILTRSGSSDYATVENVVTCGSLDSSLELLASAPYSSTIEKAFLIGGGQVLRESLNASACEAIHLTDIESTIECDTFIPPIDPLVFHPWYSSSPVVENNIRHSFATFVRVRKSAEEANDSNLSELTSNDAKKEKFEIQNFSFLPKMIFEKHDEYQYLNLVQDILRSGARKNDRTGTGTISKFGCQMRFNLRKNFPLLTTKRVFWRGVLEELLWFISGSTNAKVLQEKNIRIWDGNASREYLDSIGLSQREEGDLGPVYGFQWRHFGAEYTDMHADYTGKGFDQLADVINKIKNNPDDRRIIMSAWNPTDLKKMALPPCHMFAQFYVENGELSCQMYQRSADMGLGVPFNIASYSLLTCMIAQVCDLSPGEFVHVMGDAHVYSTHVQALEEQLQKQPKPFPILKINPLKKDIDSFVASDFKLVSYDPHQKIEMKMAV

SEQ ID NO: 7903 - protein, 368 aa, Triticum aestivum
MMAGVTNGNSHSDIQRKYQVVVAATREMGIGKDGALPWKLPSDLKFFKDLTMATADPSKKNAVIMGRKTWESIPTKFRPLPGRLNVILTRSGSSDYATVENVVTCGSLDSSLELLASAPYSSTIEKAFLIGGGQVLRESLNASACEAIHLTDIESTIECDTFIPPIDPLVFHPWYSSSPVVENNIRHSFATFVRVRKSAEEANDSNLSELTSNDAKKEKFEIQNFSFLPKMIFEKHDEYQYLNLVQDILRSGARKNDRTGTGTISKFGCQMRFNLRKNFPLLTTKRVFWRGVLEELLWFISGSTNAKVLQEKISVYGMGMRQGSILTVLVYHKERRVTWDQFMDFSGDTSVLNILTCMLITRGKVLIS

SEQ ID NO: 7904 - protein, 261 aa, Unknown
  Sequence found in Organisms: Pennisetum glaucum, Sorghum bicolor, Saccharum officinarum
MGRVIRAQRKGAGSVFKSHTHHRKGPARFRSLDFGERNGYLKGVVTDVIHDPGRGAPLAKVTFRHPFRYKHQKELFVAAEGMYTGQFVYCGRRATLSIGNVLPLRGIPEGAVVCNVEHHVGDRGVFARASGDYAIVISHNPDNGTSRIKLPSGAKKIVPSSCRAMIGQVAGGGRTEKPMLKAGNAYHKYRVKRNCWPKVRGVAMNPVEHPHGGGNHQHIGHASTVRRDAPPGQKVGLIAARRTGRLRGQAAATAAKADKAT

SEQ ID NO: 7905 - protein, 147 aa, Sorghum bicolor
MGRVIRAQRKGAGSVFKSHTHHRKGPARFRSLDFGERNGYLKGVVTDVIHDPGRGAPLAKVTFRHPFRYKHQKELFVAAEGMYTGQFVYCGRRATLSIGNVLPLRGIPEGAVVCNVEHHVGDRGVFARASGDYAIVISHNPDNGTSR

SEQ ID NO: 7906 - protein, 238 aa, Sorghum bicolor
MCWWLPPPWGCSTGFMATPRTLGQQFLFTRYLWYALPAFSIGFSVLPPPATCPIMARQLLGTIFLAPEGSLILPRGAVVRVVADHDGVVPRGPGEDTTVTDVVLDVADDGTLGDPAERQDVADGERGAAAAVDELARVHALGGDEELLLVLVPEGVAEGDLGERRAAARVVDDVGDDALEVPVALAEVEGAEPGGALAVVGVGLEDGPRTLTLRADHATHLLRRWRRRRGEAGGGTRK

SEQ ID NO: 7907 - protein, 261 aa, Zea mays
MGRVIRAQRKGAGSVFKSHTHHRKGPARFRSLDFGERNGYLKGVVTDVIHDPGRGAPLAKVTFRHPFRYKHQKELFVAAEGMYTGQFVYCGRRATLSIGNVLPLRGIPEGAVVCNVEHHVGDRGVFARASGDYAIVISHNPDNGTSRIKLPSGAKKIVPSSCRAMIGQVAGGGRTEKPMLKAGNAYHKYRVKRNSWPKVRGVAMNPVEHPHGGGNHQHIGHASTVRRDAPPGQKVGLIAARRTGRLRGQAAATASKADKAT

SEQ ID NO: 7908 - protein, 260 aa, Zea mays
MGRVIRAQRKGAGSVFKSHTHHRKGPARFRSLDFGERNGYLKGVVTDVIHDPGRGAPLAKVTFRHPFRYKHQKELFVAAEGMYTGQFVYCGRRATLSIGNVLPLRGIPEGAVVCNVEHHVGDRGVFARASGDYAIVISHNPDNGTSRIKLPSGAKKIVPSSCRAMIGQVAGGGRTEKPMLKAGNAYHKYRVKRNSWPKVRGVAMNPVEHPHGGGNHQHIGHASTVRRDAPPGQKVGLIAARRTGRLRGQAAATAAKADKA

SEQ ID NO: 7909 - protein, 261 aa, Oryza sativa
MGRVIRAQRKGAGSVFKSHTHHRKGPARFRSLDFGERNGYLKGVVTDIIHDPGRGAPLAKVTFRHPFRYKHQKELFVAAEGMYTGQFVYCGRRATLSIGNVLPIRSVPEGAVVCNVEHHVGDRGVFARASGDYAIVISHNPDNGTSRIKLPSGAKKIVPSSCRAMIGQVAGGGRTEKPMLKAGNAYHKYRVKRNCWPKVRGVAMNPVEHPHGGGNHQHIGHASTVRRDAPPGQKVGLIAARRTGRLRGQAAATAAKADKAT

SEQ ID NO: 7910 - protein, 261 aa, Brachypodium distachyon
MGRVIRAQRKGAGSVFKSHTHHRKGPARFRSLDFGERNGYLKGVVTDVIHDPGRGAPLAKVTFRHPFRYKHQKELFVAAEGMYTGQFVYCGRRATLSVGNVLPLRSVPEGGVICNVEHHVGDRGVFARASGDYAIVISHNPDNGTSRIKLPSGAKKIVPSSCRAMIGQVAGGGRTEKPMLKAGNAYHKYRVKRNCWPKVRGVAMNPVEHPHGGGNHQHIGHASTVRRDAPPGQKVGLIAARRTGRLRGQAAASAAKADKAT

SEQ ID NO: 7911 - protein, 261 aa, Avena sativa
MGRVIRAQRKGAGSVFKSHTHHRKGPARFRSLDFGERNGYLKGVVTDVIHDPGRGAPLAKVTFRHPFRYKHQKELFVAAEGMYTGQFVYCGRRATLSVGNVLPVRAIPEGGVICNVEHHVGDRGVFARASGDYAIVISHNPDNGTSRIKLPSGAKKIVPSSCRAMIGQVAGGGRTEKPMLKAGNAYHKYRVKRNCWPKVRGVAMNPVEHPHGGGNHQHIGHASTVRRDAPPGQKVGLIAARRTGRLRGQAAASAAKADKAT

SEQ ID NO: 7912 - protein, 261 aa, Unknown
  Sequence found in Organisms: Hordeum vulgare, Leymus cinereus x Leymus triticoides, Pseudoroegneria spicata, Secale cereale, Triticum aestivum
MGRVIRAQRKGAGSVFKSHTHHRKGPARFRSLDFGERNGYLKGVVTDVIHDPGRGAPLAKVTFRHPFRYKHQKELFVAAEGMYTGQFVYCGRRATLSVGNVLPLRSVPEGGVICNVEHHVGDRGVFARASGDYAIVISHNPDNGTSRIKLPSGAKKIVPSSCRAMIGQVAGGGRTEKPMLKAGNAYHKYRVKRNSWPKVRGVAMNPVEHPHGGGNHQHIGHASTVRRDAPPGQKVGLIAARRTGRLRGQAAASAAKADKAT

SEQ ID NO: 7913 - protein, 260 aa, Vitis vinifera
MGRVIRAQRKGAGSVFKSHTHHRKGPARFRSLDFGERNGYLKGVVTEIIHDPGRGAPLARVTFRHPFRYKHQKELFVAAEGMYTGQFVYCGKKATLIVGNVLPLRSIPEGAVVCNVEHHVGDRGVFARASGDYAIVVSHNPDNGTSRIKLPSGAKKIVPSGCRAMIGQVAGGGRTEKPMLKAGNAYHKYRVKRNCWPKVRGVAMNPVEHPHGGGNHQHIGHASTVRRDAPPGQKVGLIAARRTGRLRGQAAATAAKADKA

SEQ ID NO: 7914 - protein, 260 aa, Vigna unguiculata
MGRVIRAQRKGAGSVFKSHTHHRKGPARFRSLDFGERNGYLKGVVTDVIHDPGRGAPLAKVTFRHPFRYKKQNELFVAAEGLYTGQFIYCGKKATLVVGNVLPLRSIPEGAVICNVEHHVGDRGVFARASGDYAIVISHNPDNDTSRIKLPSGAKKIVPSNCRAMIGQVAGGGRTEKPLLKAGNAYHKFRVKRNCWPKVRGVAMNPVEHPHGGGNHQHIGHASTVRRDAPPGQKVGLIAARRTGRLRGQAAATAAKADKA

SEQ ID NO: 7915 - protein, 260 aa, Vigna unguiculata
MGRVIRAQRKGAGSVFKSHTHHRKGPARFRSLDFGERNGYLKGVVTDVIHDPGRGAPLAKVTFRHPFRYKKQNELFVAAEGLYTGQFIYCGKKATLVVGNVLPLRSIPEGAVICNVEHHVGDRGVFARASGDYAIVISHNPDNDTSRIKLPSGAKKIVPSDCRAMIGQVAGGGRTEKPLLKAGNAYHKFRVKRNCWPKVRGVAMNPVEHPHGGGNHQHIGHASTVRRDAPPGQKVGLIAARRTGRLRGQAAATAAKADKA

SEQ ID NO: 7916 - protein, 260 aa, Actinidia deliciosa
MGRVIRAQRKGAGSVFKSHTHHRKGPARFRSLDFGERNGYLKGVVTEIVHDPGRGAPLARVTFRHPFRYKHQKELFVAAEGMYTGQFIFCGKKANLMVGNVLPLRSIPEGAVVCNVEHHVGDRGVLARASGDYAIVISHNPDNGTSRIKLPSGAKKIVPSGCRAMIGQVAGGGRTEKPMLKAGNAYHKYRVKRNCWPKVRGVAMNPVEHPHGGGNHQHIGHASTVRRDAPPGQKVGLIAARRTGRLRGQAAATAAKADKA

SEQ ID NO: 7917 - protein, 261 aa, Cajanus cajan
MGRVIRAQRKGAGSVFKSHTHHRKGPARFRSLDFGERNGYLKGVVTDVIHDPGRGAPLAKVTFRHPFRYKKQNELFVAAEGLYTGQFIYCGKKATLVVGNVLPLRSIPEGAVICNVEHHVGDRGVFARASGDYAIVISHNPDNDTSRIKLPSGAKKIVPSDCRAMIGQVAGGGRTEKPLLKAGNAYHKFRVKRNCWPKVRGVAMNPVEHPHGGGNHQHIGHASTVRRDAPPGQKVGLIAARRTGRLRGQAAATAAKADKGA

SEQ ID NO: 7918 - protein, 261 aa, Ricinus communis
MGRVIRAQRKGAGSVFKSHTHHRKGPARFRSLDFGERNGYLKGVVTDIIHDPGRGAPLAKVTFRHPFRYKHQKELFVAAEGMYTGQFVYCGKKANLMVGNVLPLRSIPEGAVVCNVEHHVGDRGSFARCSGDYAIVISHNPDNGTTRIKLPSGAKKIVPSGCRAMVGQVAGGGRTEKPMLKAGNAYHKYRVKRNCWPKVRGVAMNPVEHPHGGGNHQHIGHASTVRRDAPPGQKVGLIAARRTGRLRGQAAATAAKADKGA

SEQ ID NO: 7919 - protein, 247 aa, Gossypium hirsutum
AQRKGAGSVFKSHTHHRKGPARFRSLDFGERNGYLKGVVTDVIHDPGRGAPLAKVTFRHPFRYKHQKELFVAAEGMYTGQFVYCGRRATLSIGNVLPLRGIPEGAVVCNVEHHVGDRGVFARASGDYAIVISHNPDNGTSRIKLPSGAKKIVPSSCRAMIGQVAGGGRTEKPMLKAGNAYHKYRVKRNSWPKVRGVAMNPVEHPHGGGNHQHIGHASTVRRDAPPGQKVGLIAARRTGRLRGQAAAT

SEQ ID NO: 7920 - protein, 261 aa, Vigna unguiculata
MGRVIRAQRKGAGSVFKSHTHHRKGPARFRSLDFGERNGYLKGVVTDIIHDPGRGAPLAKVTFRHPFRYKKQTELFVAAEGLYTGQFLYCGKKATLVVGNVLPLRSIPEGAVICNVEHHVGDRGVFARASGDYAIVISHNPDNDTSRIKLPSGAKKIVPSACRAMIGQVAGGGRTEKPLLKAGNAYHKFRVKRNCWPKVRGVAMNPVEHPHGGGNHQHIGHASTVRRDAPPGQKVGLIAARRTGRLRGQAAATAAKADKTT

SEQ ID NO: 7921 - protein, 260 aa, Vitis vinifera
MGRVIRAQRKGAGSVFKSHTHHRKGPARFRSLDFGERNGYLKGVVTEIIHDPGRGAPLARVTFRHPFRYKHQKELFVAAEGMYTGQFVYCGKKANLVVGNVLPLRSIPEGAVVCNVEHHVGDRGVFARASGDYSIVVSHNPDNGTSRIKLPSGAKKIVPSGCRAMIGQVAGGGRTEKPMLKAGNAYHKFRVKRNCWPKVRGVAMNPVEHPHGGGNHQHIGHASTVRRDAPPGQKVGLIAARRTGRLRGQAAATAAKADKA

SEQ ID NO: 7922 - protein, 260 aa, Vitis vinifera
MGRVIRAQRKGAGSVFKSHTHHRKGPARFRSLDFGERNGYLKGVVTDIIHDPGRGAPLARVTFRHPFRYKHQKELFVAAEGMYTGQFVYCGKKANLVVGNVLPVRSIPEGAVVCNVEHHVGDRGVFARASGDYAIVVSHNPDNGTSRIKLPSGAKKIIPSGCRAMVGQVAGGGRTEKPMLKAGNAYHKYRVKRNCWPKVRGVAMNPVEHPHGGGNHQHIGHASTVRRDAPPGQKVGLIAARRTGRLRGQAAATAAKADKA

SEQ ID NO: 7923 - protein, 260 aa, Glycyrrhiza uralensis
MGRVIRAQRKGAGSVFKSHTHHRKGPARFRSLDFGERNGYLKGVVTDVIHDPGRGAPLAKVTFRHPFRYKKQNELFVAAEGIYTGQFIYCGKKANLVVGNVLPLRSIPEGAVICNVEHHVGDRGVFARASGDYAIVISHNPDNDTSRIKLPSGAKKIVPSDCRAMIGQVAGGGRTEKPLLKAGNAYHKFRVKRNCWPKVRGVAMNPVEHPHGGGNHQHIGHASTVRRDAPPGQKVGLIAAKRTGRLRGQAAATASKADKA

SEQ ID NO: 7924 - protein, 261 aa, Arachis hypogaea
MGRVIRAQRKGAGSVFKSHTHHRKGAARFRSLDFGERNGYLKGVVTDIIHDPGRGAPLAKVTFRHPFRYKKQTELFVAAEGIYTGQFIYCGKKATLVVGNVLPLRSIPEGAVICNVEHHVGDRGVFARASGDYAIVISHNPDNDTSRIKLPSGSKKIVPSGCRAMIGQVAGGGRTEKPLLKAGNAYHKFRVKRNCWPKVRGVAMNPVEHPHGGGNHQHIGHASTVRRDAPPGQKVGLIAARRTGRLRGQAAATAAKADKTT

SEQ ID NO: 7925 - protein, 260 aa, Petunia hybrida
MGRVIRAQRKGAGSVFKSHTHHRKGPARFRSLDFGERNGYLKGVITEVIHDPGRGAPLARVTFRHPFRYKHQKELMVAAEGMYTGQFIYCGKKATLMVGNVLPLRSIPEGAVVCNVEHKVGDRGVFARCSGDYAIVISHNPDNGTTRIKLPSGSKKIVPSGCRAMIGQVAGGGRTEKPMLKAGNAYHKYRVKRNCWPKVRGVAMNPVEHPHGGGNHQHIGHASTVRRDAPPGQKVGLIAARRTGRLRGQAAATAAKADKA

SEQ ID NO: 7926 - protein, 260 aa, Utricularia gibba
MGRVIRAQRKGAGSVFKSHTHHRKGPARFRSLDFGERNGYLKGVVTDIIHDPGRGAPLAKVTFRHPFRYQHQKELFVAAEGMYTGQFVYCGKKANLVVGNVLPLRSIPEGAVVCNVEHHVGDRGVFARASGDYAIVISHNPDNGTSRIKLPSGSKKIVPSSCRAMVGQVAGGGRTEKPLLKAGNAYHKFRVKRNSWPKVRGVAMNPVEHPHGGGNHQHIGHASTVRRDAPPGQKVGLIAARRTGRLRGQAAATAAKSDKV

SEQ ID NO: 7927 - protein, 80 aa, Cajanus cajan
MLVVTTSVRMLNRVHSNTTHLGPAIPLHSKLVVSISSLKKRLLSPSTTCNLPNHSPTVTWNNLLRTGRKLNPRCHYQGCG

SEQ ID NO: 7928 - protein, 259 aa, Aquilegia formosa
MGRVIRAQRKGAGSVFKSHTHHRKGPARFRSLDFGERNGYLKGVVTEIIHDPGRGAPLAKVTFRHPFRYKHQKELFVAAEGMYTGQFVYCGKKANLMVGNVLPLRSIPEGAVVCNVEHHVGDRGTLARASGDYAIVISHNPDNGTSRIKLPSGAKKIVPSGCRAMIGQVAGGGRTEKPMLKAGNAYHKYRVKRNCWPKVRGVAMNPVEHPHGGGNHQHIGHASTVRRDAPPGQKVGLIAARRTGRLRGQAAANLAKEKA

SEQ ID NO: 7929 - protein, 261 aa, Musa acuminata
MGRVIRAQRKGAGSVFRSHTHHRKGPARFRSLDFGERNGYLKGVVTEIIHDPGRGAPLARVTFRHPFRYKLQKELFIAAEGIYTGQFIYCGRKASLMVGNVLPLRSIPEGAVVCNVEHHVGDRGVLARASGDYAIVISHNPDNGTSRIKLPSGAKKIVPSNCRAMIGQVAGGGRTEKPMLKAGNAYHKFRVKRNCWPKVRGVAMNPVEHPHGGGNHQHIGHASTVRRDAPPGQKVGLIAARRTGRLRGQAAATAAKAEKTS

SEQ ID NO: 7930 - protein, 260 aa, Phaseolus coccineus
MGRVIRAQRKGAGSVFKSHTHHRKGPARFRSLDFGERNGYLKGVVTDVIHDPGRGAPLAKVTFRHPFRYKKQNELFVAAEGLYTGQFIYCGKKATLVVGNVLPIRSIPEGAVICNVEHHVGDRGVFARASGDYAIVISHNPDNDTSRIKLPSGAKKIVPSDCRAMIGQVAGGGRTEKPLLKAGNAYHKFRVKRNCWPKVRGVAMNPVEHPHGGGNHQHIGHASTVRRDAPPGQKVGLIAARRTGRLRGQAAATASKADKV

SEQ ID NO: 7931 - protein, 259 aa, Medicago truncatula
MGRVIRAQRKGAGSVFKSHTHHRKGPARFRSLDFGERNGYLKGVVTDVIHDPGRGAPLAKVTFRHPFRYQKQKELFVAAEGLYTGQFIYCGKKATLVVGNVLPLRSIPEGAVICNVEGHVGDRGVFARASGDYAIVISHNPDNDTSRIKLPSGAKKIVPSDCRAMIGQVAGGGRTEKPMLKAGNAYHKFRVKRNCWPKVRGVAMNPVEHPHGGGNHQHIGHASTVRRDAPPGQKVGLIAAKRTGRLRGQAAASAAKADK

SEQ ID NO: 7932 - protein, 260 aa, Aristolochia fimbriata
MGRVIRAQRKGAGSVFRSHTHHRKGPARFRSLDFGERNGYLKGVVTEVIHDPGRGAPLARVTFRHPFRYKHQKELFIAAEGMYTGQFVYCGKKATLMVGNVLPLRSIPEGAVVCNVEHHVGDRGVLARASGDYAIVISHNPDNGTTRIKLPSGAKKIVPSGCRAMIGQVAGGGRTEKPLLKAGNAYHKFRVKRNCWPKVRGVAMNPVEHPHGGGNHQHIGHASTVRRDAPPGQKVGLIAARRTGRLRGQAAATAAKADKA

SEQ ID NO: 7933 - protein, 260 aa, Phaseolus coccineus
MGRVIRAQRKGAGSVFKSHTHHRKGPARFRSLDFGERNGYLKGVVTDVIHDPGRGAPLAKVTFRHPFRYKKQNELFVAAEGLYTGQFIYCGKKATLVVGNVLPIRSIPEGAVICNVEHHVGDRGVFARASGDYAIVISHNPDNDTSRIKLPSGAKKIVPSACRAMIGQVAGGGRTEKPLLKAGNAYHKFRVKRNCWPKVRGVAMNPVEHPHGGGNHQHIGHASTVRRDAPPGQKVGLIAARRTGRLRGQAAATASKGDKV

SEQ ID NO: 7934 - protein, 260 aa, Phaseolus coccineus
MGRVIRAQRKGAGSVFKSHTHHRKGPARFRSLDFGERNGYLKGVVTDVIHDPGRGAPLAKVTFRHPFRYKKQNELFVAAEGLYTGQFIYCGKKATLVVGNVLPIRSIPEGAVICNVEHHVGDRGVFARASGDYAIVISHNPDNDTSRIKLPSGAKKIVPSDCRAMIGQVAGGGRTEKPLLKAGNAYHKFRVKRNCWPKVRGVAMNPVEHPHGGGNHQHIGHASTVRRDAPPGQKVGLIAARRTGRLRGQAAATASKGDKV

SEQ ID NO: 7935 - protein, 261 aa, Fagus grandifolia
MGRVIRAQRKGAGSVFKSHTHHRKGPARFRSLDFGERNGYLKGVVTEIIHDPGRGAPLAKVTFRHPFRYKKQNELFVAAEGLYTGQFLYCGKKATLVVGNVLPLRSIPEGAVVCNVEHHVGDRGVFARASGDYAIVISHNPDNDTSRVKLPSGAKKIVPSGCRAMIGQVAGGGRTEKPMLKAGNAYHKFRVKRNCWPKVRGVAMNPVEHPHGGGNHQHIGHASTVRRDAPPGQKVGLIAARRTGRLRGQAAATASKADKST

SEQ ID NO: 7936 - protein, 261 aa, Manihot esculenta
MGRVIRAQRKGAGSVFKSHTHHRKGPARFRSLDFGERNGYLKGVVTEIIHDPGRGAPLARVTFRHPFRYKHQKELFVAAEGMYTGQFVYCGKKANLMVGNVLPLRSIPEGAVVCNVEHHVGDRGVFARCSGDYAIVISHNPDNGTTRIKLPSGAKKIVPSGCRAMVGQVAGGGRTEKPMLKAGNAYHKYRVKRNCWPKVRGVAMNPVEHPHGGGNHQHIGHASTVRRDAPPGQKVGLIAARRTGRLRGQAAATAAKADKGA

SEQ ID NO: 7937 - protein, 261 aa, Ricinus communis
MGRVIRAQRKGAGSVFKSHTHHRKGPARFRSLDFGERNGYLKGVVTDIIHDPGRGAPLAKVTFRHPFRYKHQKELFVAAEGMYTGQFVYCGKKANLMVGNVLPLRSIPEGAVVCNVEHHVGDRGAFARCSGDYAIVISHNPDNGTTRVKLPSGAKKIVPSGCRAMVGQVAGGGRTEKPMLKAGNAYHKYRVKRNCWPKVRGVAMNPVEHPHGGGNHQHIGHASTVRRDAPPGQKVGLIAARRTGRLRGQAAATAAKADKGA

SEQ ID NO: 7938 - protein, 260 aa, Cyamopsis tetragonoloba
MGRVIRAQRKGAGSVFKSHTHHRKGPARFRSLDFGERNGYLKGVVTDVIHDPGRGAPLAKVTFRHPFRYKKQNELFVAAEGMYTGQFVYCGKKATLVVGNVLPIRSIPEGAVICNVEHHVGDRGVFARASGDYAIVISHNPDNDTSRIKLPSGAKKIVPSECRAMIGQVAGGGRTEKPLLKAGNAYHKFRVKRNCWPKVRGVAMNPVEHPHGGGNHQHIGHASTVRRDAPPGQKVGLIAAKRTGRLRGQAAATAAKADKA

SEQ ID NO: 7939 - protein, 258 aa, Eschscholzia californica
MGRVIRAQRKGAGSVFKSHTHHRKGPARFRSLDFGERNGYLKGVVTDIIHDPGRGAPLAKVTFRHPFRYKHQKELFVAAEGMYTGQFLYCGKKANLMVGNVLPLRSIPEGAVVCNVEHHVGDRGVLARASGDYAIVISHNPDNGTSRIKLPSGSKKIVPSGCRAMVGQVAGGGRTEKPMLKAGNAYHKYRVKRNCWPKVRGVAMNPVEHPHGGGNHQHIGHASTVRRDAPPGQKVGLIAARRTGRLRGQAAASAAKAD

SEQ ID NO: 7940 - protein, 150 aa, Vitis vinifera
MARQPLGIIFFAPDGSLILGSIVRVVANHNGVITRSPSEDPTVTNMVLNVTHNGTLRNGSDRQYISYNEIGLFSTIDELASVHAFSGHEQLLLMLVAKRVTEGNSGEWSASTRVVDDIGDNALEVAIAFTEVEAAEASWTLAVVGVGLED

SEQ ID NO: 7941 - protein, 260 aa, Petunia hybrida
MGRVIRAQRKGAGSVFKSHTHHRKGPARFRTLDFGERNGYLKGVITEVIHDPGRGAPLARVTFRHPFRYKHQKELMVAAEGMYTGQFIYCGKKATLMVGNVLPLRSIPEGAVVCNVEHKVGDRGVFARCSGDYAIVISHNPDNGTTRVKLPSGAKKIVPSGCRAMIGQVAGGGRTEKPMLKAGNAYHKYRVKRNCWPKVRGVAMNPVEHPHGGGNHQHIGHASTVRRDAPPGQKVGLIAARRTGRLRGQAAATAAKADKA

SEQ ID NO: 7942 - protein, 261 aa, Cajanus cajan
MGRVIRAQRKGAGSVFKSHTHHRKGPARFRSLDFGERNGYLKGVVTDIIHDPGRGAPLAKVTFRHPFRYKKQNELFVAAEGLYTGQFIYCGKKATLVVGNVLPIRSIPEGAVICNVEHHVGDRGVFARASGDYAIVISHNPDNDTSRIKLPSGAKKIVPSGCRAMIGQVAGGGRTEKPLLKAGNAYHKFRVKRNCWPKVRGVAMNPVEHPHGGGNHQHIGHASTVRRDAPPGQKVGLIAARRTGRLRGQAAATAAKADKTS

SEQ ID NO: 7943 - protein, 260 aa, Unknown
  Sequence found in Organisms: Solanum lycopersicum, Solanum tuberosum, Solanum phureja
MGRVIRAQRKGAGSVFKSHTHHRKGPARFRSLDFGERNGYLKGVITEVIHDPGRGAPLARITFRHPFRYKHQKELFVAAEGMYTGQFVYCGKKATLMVGNVLPLRSIPEGAVVCNVEHKVGDRGVFARCSGDYAIVISHNPDNGTTRIKLPSGSKKIVPSGCRAMIGQVAGGGRTEKPMLKAGNAYHKYRVKRNCWPKVRGVAMNPVEHPHGGGNHQHIGHASTVRRDAPPGQKVGLIAARRTGRLRGQAAATAAKADKA

SEQ ID NO: 7944 - protein, 260 aa, Glycine max
MGRVIRAQRKGAGSVFKSHTHHRKGPARFRSLDFGERNGYLKGVVTDVIHDPGRGAPLAKVAFRHPFRYKKQNELFIAAEGLYTGQFIYCGKKATLVVGNVLPLRSIPEGAVICNVEHHVGDRGVFARASGDYAIVISHNPDNDTSRIKLPSGSKKIVPSDCRAMIGQVAGGGRTEKPLLKAGNAYHKFRVKRNCWPKVRGVAMNPVEHPHGGGNHQHIGHASTVRRDAPPGQKVGLIAARRTGRLRGQAAATAAKADKA

SEQ ID NO: 7945 - protein, 261 aa, Glycine max
MGRVIRAQRKGAGSVFKSHTHHRKGPARFRSLDFGERNGYLKGVVTDIIHDPGRGAPLAKVAFRHPFRYKKQMELFVAAEGLYTGQFIYCGKKATLVVGNVLPLRSIPEGAVICNVEHHVGDRGVFARASGDYAIVISHNPDNDTSRIKLPSGSKKIVPSGCRAMIGQVAGGGRTEKPLLKAGNAYHKFRVKRNCWPKVRGVAMNPVEHPHGGGNHQHIGHASTVRRDAPPGQKVGLIAARRTGRLRGQAAATAAKADKTT

SEQ ID NO: 7946 - protein, 179 aa, Nicotiana tabacum
MYTGQFVYCGKKATLMVGNVLPLRSIPEGAVVCNVEHKVGDRGVFARCSGDYAIVISHNPDNGTTRIKLPSGSKKIVPSGCRAMIGQVAGGGRTEKPMLKAGNAYHKYRVKRNCWPKVRGVAMNPVEHPHGGGNHQHIGHASTVRRDAPPGQKVGLIAARRTGRLRGQAAATAAKADKA

SEQ ID NO: 7947 - protein, 260 aa, Unknown
  Sequence found in Organisms: Solanum lycopersicum, Nicotiana tabacum
MGRVIRAQRKGAGSVFKSHTHHRKGPARFRTLDFGERNGYLKGVITEVIHDPGRGAPLARVTFRHPFRYKHQKELFVAAEGMYTGQFVYCGKKATLMVGNVLPLRSIPEGAVVCNVEHKVGDRGVFARCSGDYAIVISHNPDNGTTRVKLPSGAKKIVPSGCRAMIGQVAGGGRTEKPMLKAGNAYHKYRVKRNCWPKVRGVAMNPVEHPHGGGNHQHIGHASTVRRDAPPGQKVGLIAARRTGRLRGQAAATAAKADKA

SEQ ID NO: 7948 - protein, 259 aa, Trigonella foenum-graecum
MGRVIRAQRKGAGSVFKSHTHHRKGPARFRSLDFGERNGYLKGVVTDVIHDPGRGAPLAKVTFRHPFRYKKQNELFVAAEGLYTGQFIYCGKKATLVVGNVLPLRSIPEGAVICNVEGHVGDRGVFARASGDYAIVISHNPDNDTSRIKLPSGAKKIVPSDCRAMIGQVAGGGRTEKPMLKAGNAYHKFRVKRNCWPKVRGVAMNPVEHPHGGGNHQHIGHASTVRRDAPPGQKVGLIAAKRTGRLRGQAAASAAKADK

SEQ ID NO: 7949 - protein, 145 aa, Phaseolus coccineus
MGRVIRAQRKGAGSVFKSHTHHRKGPARFRSLDFGERNGYLKGVVTDVIHDPGRGAPLAKVTFRHPFRYKKQNELFVAAEGLYTGQFIYCGKKATLVVGNVLPIRSIPEGAVICNVEHHVGDRGVFARASGDYAIVISHNPDNDT

SEQ ID NO: 7950 - protein, 177 aa, Medicago truncatula
MALQSLGTIFFAPDGSLILSIIIRIMTDNNSIITRSSSKNTTVTNMTLNITNHSTFRDRSKRQNITNNKSRLFTAVNKLTGIQTLSSNEKLLLFLITEGMTESDLSKRSTATWIVDDVGDDSFEVTVALAEVEGTETGGAFAVVRMGFENGTCSLTLGTDDTTHFSGGEKWRKGSEV

SEQ ID NO: 7951 - protein, 175 aa, Phalaenopsis aphrodite
MGRVIRAQRKGAGSVFRSHTHHRKGPARFRSLDFSERNGYLKGVVTDIIHDPGRGAPLARVTFRHPFRYKHQKELFVAAEGMYTGQFVYCGRKASLMVGNVLPLRSIPEGAVVCNVEHHVGDRGMLARASGDYAIVISHNPDNGTSRIKLPSGAKKSVPKWLPCHDWASCWWRSN

SEQ ID NO: 7952 - protein, 164 aa, Phalaenopsis aphrodite
MGRVIRAQRKGAGSVFRSHTHHRKGPARFRSLDFSERNGYLKGVVTDIIHDPGRGAPLARVTFRHPFRYKHQKELFVAAEGMYTGQFVYCGRKASLMVGNVLPLRSIPEGAVVCNVEHHVGDRGMLARASGDYAIVISHNPDNGTSRIKLPSGAKKSSQVAAVP

SEQ ID NO: 7953 - protein, 260 aa, Unknown
  Sequence found in Organisms: Gossypium hirsutum, Gossypium raimondii
MGRVIRAQRKGAGSVFKAHTHHRKGPARFRSLDFGERNGYLKGVVTDVIHDPGRGAPLARVVFRHPFRYKKQKELFVAAEGMYTGQFVYCGKKATLVVGNVLPLRSIPEGAVVCNVEHHVGDRGVFARASGDYAIVISHNPDNDTTRIKLPSGSKKIVPSGCRAMIGQVAGGGRTEKPLLKAGNAYHKFRVKRNCWPKVRGVAMNPVEHPHGGGNHQHIGHASTVRRDAPPGQKVGLIAARRTGRLRGQAAATAAKADKA

SEQ ID NO: 7954 - protein, 260 aa, Unknown
  Sequence found in Organisms: Gossypium hirsutum, Gossypium raimondii
MGRVIRAQRKGAGSVFKAHTHHRKGPARFRSLDFGERNGYLKGVVTDVIHDPGRGAPLARVVFRHPFRYKKQKELFVAAEGMYTGQFVYCGKKATLVVGNVLPLRSIPEGAVVCNVEHHVGDRGVFARASGDYAIVISHNPDNDTTRIKLPSGSKKIVPSGCRAMIGQVAGGGRTEKPLLKAGNAFHKYRVKRNCWPKVRGVAMNPVEHPHGGGNHQHIGHASTVRRDAPPGQKVGLIAARRTGRLRGQAAATAAKADKA

SEQ ID NO: 7955 - protein, 261 aa, Manihot esculenta
MGRVIRAQRKGAGSVFKSHTHHRKGPARFRSLDFGERNGYLKGVVTEIIHDPGRGAPLARVTFRHPFRYKHQKELFVAAEGMYTGQFVYCGKKANLMVGNVLPLRSIPEGAVVCNVEHHVGDRGVFARCSGDYAIVISHNPDNGTTRIKLPSGAKKIVPSGCRAMVGQVAGGGRTEKPLLKAGNAYHKYRVKRNCWPKVRGVAMNPVEHPHGGGNHQHIGHASTVRRDAPPGQKVGLIAARRTGRLRGQAAATAAKADKGA

SEQ ID NO: 7956 - protein, 260 aa, Chelidonium majus
MGRVIRAQRKGAGSVFKSHTHHRKGPARFRSLDFGERNGYLKGVVTDIIHDPGRGAPLAKITFRHPFRYKHQKELFVAAEGMYTGMFVYCGKKANLMVGNVLPLRSIPEGGVVCNVEHHVGDRGVLARASGDYAIVISHNPDNGTSRIKLPSGAKKIVPSSCRAMVGQVAGGGRTEKPMLKAGNAYHKFRVKRNCWPKVRGVAMNPVEHPHGGGNHQHIGHASTVRRDAPPGQKVGLIAARRTGRLRGQAAAMSAKADKA

SEQ ID NO: 7957 - protein, 260 aa, Cicer arietinum
MGRVIRAQRKGAGSVFKSHTHHRKGPARFRSLDFGERNGYLKGVVTDVIHDPGRGAPLAKVTFRHPFRYKKQNELFVAAEGLYTGQFIYCGKKATLVVGNVLPLRSIPEGAVICNVEHHVGDRGAFARASGDYAIVISHNPDNDTSRIKLPSGAKKVVPSECRAMIGQVAGGGRTEKPLLKAGNAYHKFRVKRNCWPKVRGVAMNPVEHPHGGGNHQHIGHASTVRRDAPPGQKVGLIAAKRTGRLRGQAAATAAKADKV

SEQ ID NO: 7958 - protein, 259 aa, Trifolium pratense
MGRVIRAQRKGAGSVFKSHTHHRKGPARFRSLDFGERNGYLKGVVTDVIHDPGRGAPLAKVTFRHPFRYKKQNELFVAAEGLYTGQFIYCGKKATLVVGNVLPLRSIPEGAVICNVEGHVGDRGVFARASGDYAIVISHNPDNDTSRIKLPSGAKKIVPSDCRAMIGQVAGGGRTEKPLLKAGNAYHKFRVKRNCWPKVRGVAMNPVEHPHGGGNHQHIGHASTVRRDAPPGQKVGLIAAKRTGRLRGQAAASAAKADK

SEQ ID NO: 7959 - protein, 258 aa, Eschscholzia californica
MGRVIRAQRKGAGSVFKSHTHHRKGPARFRSLDFGERNGYLKGVVTDIIHDPGRGAPLAKVTFRHPFRYKHQKELFVAAEGMYTGQFLYCGKKANLMVGNVLPLRSIPEGAVVCNVEHHVGDRGVLARASGDYAIVISHNPDNGTSRIKLPSGSKKIVPSGCRAMVGQVAGGGRTEKPMLKAGNAYHKYRVKRNCWPKVRGVAMNPVEHPHGGGNHQHIGHASTVRRDAPPGQKVGLIAARRTGRLRGQAAASASKAD

SEQ ID NO: 7960 - protein, 260 aa, Unknown
  Sequence found in Organisms: Solanum lycopersicum, Capsicum annuum, Solanum tuberosum
MGRVIRAQRKGAGSVFKSHTHHRKGPARFRSLDFGERNGYLKGVVTEIIHDPGRGAPLARMTFRHPFRYKHQKELFVAAEGMYTGQFIYCGKKANLMVGNVLALRSIPEGAVVCNVEHKVGDRGVFARCSGDYAIVISHNPDNGTTRIKLPSGSKKIVPSGCRAMIGQVAGGGRTEKPMLKAGNAYHKYRVKRNCWPKVRGVAMNPVEHPHGGGNHQHIGHASTVRRDAPPGQKVGLIAARRTGRLRGQAAATAAKADKA

SEQ ID NO: 7961 - protein, 260 aa, Lippia dulcis
MGRVIRAQRKGAGSVFKSHTHHRKGPARFRSLDFGERNGYIKGVVTEIIHDPGRGAPLARVTFRHPFRYQHQKELFVAAEGIYTGQFIYCGKKANLVVGNVLPLRSIPEGAVVCNVEHHVGDRGVFARASGDYAIVISHNPDNGTTRIKLPSGSKKIVPSGCRAMVGQVAGGGRTEKPLLKAGNAYHKFRVKRNCWPKVRGVAMNPVEHPHGGGNHQHIGHASTVRRDAPPGQKVGLIAARRTGRLRGQAAATAAKADKA

SEQ ID NO: 7962 - protein, 260 aa, Unknown
  Sequence found in Organisms: Solanum tuberosum, Solanum phureja
MGRVIRAQRKGAGSVFKSHTHHRKGPARFRTLDFGERNGYLKGVITEVIHDPGRGAPLARVTFRHPFRYKHQKELFVAAEGMYTGQFVYCGKKATLMVGNVLPLRSIPEGAVVCNVEHKVGDRGVFARCSGDYAIVISHNPDNGTTRVKLPSGAKKIVPSGCRAMIGQVAGGGRTEKPMLKAGNAYHKYRVKRNCWPKVRGVAMNPVEHPHGGGNHQHIGHASTVRRDAPPGQKVGLIAARRTGRLRGQAAASAAKADKA

SEQ ID NO: 7963 - protein, 261 aa, Camellia sinensis
MGRVIRAQRKGAGSVFKSHTHHRKGPARFRSLDFGERNGYLKGVITEIIHDPGRGAPLARVTFRHPFRFKHQKELFVAAEGMYTGQFVFCGKKANLMVGNVLPLRSIPEGAVVCNVEHHVGDRGVLARASGDYAIVISHNPDNGTSRIKLPSGAKKIVPSGCRAMIGQVAGGGRTEKPMLKAGNAYHKYRVKRNSWPKVRGVAMNPVEHPHGGGNHQHIGHASTVRRDAPPGQKVGLIAARRTGRLRGQAAATAAKADKTT

SEQ ID NO: 7964 - protein, 259 aa, Nicotiana tabacum
MGRVIRAQRKGAGSVFKSHTHHRKGPARFRTLDFGERNGYLKGVITEVIHDPGRGAPLARVTFRHPFRYKHQKELFVAAEGMYTGQFVYCGKKATLMVGNVLPLRSIPEGAVVCNVEHKVGDRGVFARCSGDYAIVISHNPDNGTTRVKLPSGAKKIVPSGCRAMIGQVAGGGRTEKPMLKAGNAYHKYRVKRNCWPKVRGVAMNPVEHPHGGGNHQHIGHASTVRRDAPPGQKVGLIAARRTGRLRGQAAATAAKADK

SEQ ID NO: 7965 - protein, 260 aa, Nicotiana tabacum
MGRVIRAQRKGAGSVFKSHTHHRKGPARFRSLDFGERNGYLKGVITEVIHDPGRGAPLARITFRHPFRYKHQKELFVAAEGMYSGQFVYCGKKATLMVGNVLPLRSIPEGAVVCNVEHKVGDRGVFARCSGDYAIVISHNPDNGTTRIKLPSGSKKIVPSGCRAMIGQVAGGGRTEKPMLKAGNAYHKYRVKRNCWPKVRGVAMNPVEHPHGGGNHQHIGHASTVRRDAPPGQKVGLIAARRTGRLRGQAAATAAKADKA

SEQ ID NO: 7966 - protein, 261 aa, Phaseolus coccineus
MGRVIRAQRKGAGSVFKSHTHHRKGPARFRSLDFGERNGYLKGVVTDIIHDPGRGAPLAKVTFRHPFRYKKQTELFVSAEGLYTGQFLYCGKKATLVVGNVLPLRSIPEGAVICNVEHHVGDRGVFARASGDYAIVISHNPDNDTSRIKLPSGSKKIVPSACRAMIGQVAGGGRTEKPLLKAGNAYHKFRVKRNCWPKVRGVAMNPVEHPHGGGNHQHIGHASTVRRDAPPGQKVGLIAARRTGRLRGQAAATASKADKTT

SEQ ID NO: 7967 - protein, 258 aa, Phaseolus coccineus
RVIRAQRKGAGSVFKSHTHHRKGPARFRSLDFGERNGYLKGVVTDVIHDPGRGAPLAKVTFRHPFRYKKQNELFVAAEGLYTGQFIYCGKKATLVVGNVLPIRSIPEGAVICNVEHHVGDRGVFARASGDYAIVISHNPDNDTSRIKLPSGAKKIVPSDCRAMIGQVAGGGRTEKPLLKAGNAYHKFRVKRNCWPKVRGVAMNPVEHPHGGGNHQHIGHASTVRRDAPPGQKVGLIAARRTGRLRGQAAATASKADKV

SEQ ID NO: 7968 - protein, 260 aa, Unknown
  Sequence found in Organisms: Gossypium hirsutum, Gossypium raimondii
MGRVIRAQRKGAGSVFKSHTHHRKGAARFRSLDFGERNGYLKGVVTEVIHDPGRGAPLVRVVFRHPFRYKKQKELFVAAEGMYTGQFVYCGKKATLMVGNVLPLRSIPEGAVVCNVEHHVGDRGVFARASGDYAIVISHNPDNDTTRIKLPSGAKKIVPSGCRAMIGQVAGGGRTEKPLLKAGSAYHKYRVKRNCWPKVRGVAMNPVEHPHGGGNHQHIGHASTVRRDAPPGQKVGLIAARRTGRLRGQAAATAAKADKA

SEQ ID NO: 7969 - protein, 259 aa, Ambrosia trifida
MGRVIRAQRKGAGSVFKSHTHHRKGPARFRSLDFGERNGYLKGVITEIIHDPGRGAPLARVTFRHPFRYKHQKELFVAAEGMYTGQFVFCGKRANLMVGNVLPLRSIPEGAVVCNVEHHVGDRGSFARASGDYAIVISHNPDNGTTRVKLPSGAKKIVPSGCRAMIGQVAGGGRTEKPMLKAGNAYHKFRVKRNCWPKVRGVAMNPVEHPHGGGNHQHIGHASTVRRDAPPGQKVGLIAARRTGRLRGQAAATAAKADK

SEQ ID NO: 7970 - protein, 259 aa, Ambrosia trifida
MGRVIRAQRKGAGSVFKSHTHHRKGPARFRSLDFGERNGYLKGVITEIIHDPGRGAPLAKVTFRHPFRYKHQKELFVAAEGMYTGQFVFCGKKANLMVGNVLPLRSIPEGAVVCNVEHHVGDRGSFARASGDYAIVISHNPDNGTTRVKLPSGAKKIVPSGCRAMIGQVAGGGRTEKPMLKAGNAYHKFRVKRNCWPKVRGVAMNPVEHPHGGGNHQHIGHASTVRRDAPPGQKVGLIAARRTGRLRGQAAATAAKADK

SEQ ID NO: 7971 - protein, 261 aa, Cicer arietinum
MGRVIRAQRKGAGSVFKSHTHHRKGPARFRSLDFGERNGYLKGVITDIIHDPGRGAPLAKVSFRHPFRYKKQSELFVAAEGIYTGQFIYCGKKATLVVGNVLPLRSIPEGAVICNVEHHVGDRGAFARCSGDYAIVISHNPDNDTSRIKLPSGAKKIVPSGCRAMIGQVAGGGRTEKPLLKAGNAYHKFRVKRNCWPKVRGVAMNPVEHPHGGGNHQHIGHASTVRRDAPPGQKVGLIAAKRTGRLRGQAAATAAKADKTT

SEQ ID NO: 7972 - protein, 260 aa, Unknown
  Sequence found in Organisms: Citrus sinensis, Citrus clementina, Citrus sinensis
MGRVIRAQRKGAGSVFKSHTHHRKGPARFRSLDFGERNGYLKGVITEIIHDPGRGAPLARVTFRHPFRYQHQKELFVAAEGMYTGQFVYCGRKATLVVGNVLPLRSIPEGAVVCNVEHHVGDRGVFARCSGDYAVVISHNPDNDTTRIKLPSGAKKIVPSGCRAMIGQVAGGGRTEKPLLKAGNAYHKFRVKRNCWPKVRGVAMNPVEHPHGGGNHQHIGHASTVRRDAPPGQKVGLIAARRTGRLRGQAAATAAKADKA

SEQ ID NO: 7973 - protein, 260 aa, Gossypium hirsutum
MGRVIRAQRKGAGSVFKAHTHHRKGPARFRSLDFGERNGYLKGVVTDVIHDPGRGAPLARVVFRHPFRYKKQKELFVAAEGMYTGQFVYCGKKATLMVGNVLPLRSIPEGAVVCNVEHHVGDRGVFARASGDYAIVISHNPDNDTTRIKLPSGSKKIVPSGCRAMIGQVAGGGRTEKPLLKAGNAFHKFRVKRNCWPKVRGVAMNPVEHPHGGGNHQHIGHASTVRRDAPPGQKVGLIAARRTGRLRGQAAATAAKADKA

SEQ ID NO: 7974 - protein, 260 aa, Gossypium hirsutum
MGRVIRAQRKGAGSVFKAHTNHRKGPARFRSLDFGERNGYLKGVVTDVIHDPGRGAPLARVVFRHPFRYKKQKELFVAAEGMYTGQFVYCGKKATLMVGNVLPLRSIPEGAVVCNVEHHVGDRGVFARASGDYAIVISHNPDNDTTRIKLPSGSKKIVPSGCRAMIGQVAGGGRTEKPLLKAGNAYHKFRVKRNCWPKVRGVAMNPVEHPHGGGNHQHIGHASTVRRDAPPGQKVGLIAARRTGRLRGQAAATAAKADKA

SEQ ID NO: 7975 - protein, 260 aa, Solanum melongena
MGRVIRSQRKGAGSVFKSHTHHRKGPARFRTLDFGERNGYLKGVITEVIHDPGRGAPLARVTFRHPFRYKHQKELFVAAEGMYTGQFVYCGKKASLMVGNVLPLRSIPEGAVVCNVEHKVGDRGVFARCSGDYAIVISHNPDNGTTRVKLPSGAKKIVPSGCRAMIGQVAGGGRTEKPMLKAGNAYHKYRVKRNCWPKVRGVAMNPVEHPHGGGNHQHIGHASTVRRDAPPGQKVGLIAARRTGRLRGQAAATAAKADKA

SEQ ID NO: 7976 - protein, 260 aa, Euphorbia peplus
MGRVIRAQRKGAGSVFKSHTHHRKGPARFRSLDFGERNGYLKGVITEIIHDPGRGAPLARVTFRHPFRYKHQKELFIAAEGMYTGQFVYCGKKANLMVGNVLPLRSIPEGAVVCNVEHHVGDRGSFARCSGDYAIVVSHNPDNGTSRIKLPSGAKKIVPSGCRAMVGQVAGGGRTEKPMLKAGNAYHKYRVKRNCWPKVRGVAMNPVEHPHGGGNHQHIGHASTVRRDAPPGQKVGLIAARRTGRLRGQAAATAAKADKA

SEQ ID NO: 7977 - protein, 260 aa, Actinidia deliciosa
MGRVIRAQRKGAGSVFKSHTHHRKGPARFRSLDFGERNGYLKGVVTEILHDPGRGAPLARVTFRHPFRFKHQKELFVAAEGMYTGQFIFCGKKANLTVGNVLPLRSIPEGGVVCNVEHHVGDRGVLARASGDYAIVISHNPDNDTSRIKLPSGAKKIVPSGCRAMIGQVAGGGRTEKPMLKAGNAYHKYRVKRNCWPKVRGVAMNPVEHPHGGGNHQHIGHASTVRRDAPPGQKVGLIAARRTGRLRGQAAATASKADKA

SEQ ID NO: 7978 - protein, 261 aa, Elaeis guineensis
MGRVIRAQRKGAGSVFRSHTHHRKGPARFRSLDYGERNGYLKGVVTDIIHDPGRGAPLARVTFRHPFRYKHQKELFIAAEGMYTGQFVYCGRKASLIVGNVLPLRSIPEGAVVCNVEHHVGDRGVLARASGDYAIVISHNPDNGTTRIKLPSGAKKIVPSGCRAMIGQVAGGGRTEKPLLKAGNAYHKFRVKRNCWPKVRGVAMNPVEHPHGGGNHQHIGHASTVRRDAPPGQKVGLIAARRTGRLRGQAAATAAKADKTS

SEQ ID NO: 7979 - protein, 261 aa, Arachis hypogaea
MGRVIRAQRKGAGSVFKSHTHHRKGAARFRSLDFGERNGYLKGVVTDVIHDPGRGAPLAKVTFRHPFRYKKQNELFVAAEGMYTGQFVYCGKKATLVVGNVLPLKAIPEGAVICNVEHHVGDRGVFARASGDYAIVISHNPDNDTSRIKLPSGSKKIVPSDCRAMIGQVAGGGRTEKPLLKAGNAYHKFRVKRNCWPKVRGVAMNPVEHPHGGGNHQHIGHASTVRRDAPPGQKVGLIAARRTGRLRGQAAATAAKADKGA

SEQ ID NO: 7980 - protein, 261 aa, Phalaenopsis aphrodite
MGRVIRAQRKGAGSVFRSHTHHRKGAARFRSLDFSERNGYLKGVVTDIIHDPGRGAPLARVTFRHPFRYKHQKELFVAAEGMYTGQFVYCGRKASLMVGNVLPLRSIPEGAVVCNVEHHVGDRGVLARASGDYAIVISHNPDNGTSRIKLPSGAKKLVPSGCRAMIGQVAGGGRTEKPLLKAGNAYHKYRVKRNCWPKVRGVAMNPVEHPHGGGNHQHIGHASTVRRDAPPGQKVGLIAARRTGRLRGQAAATAAKAEKGS

SEQ ID NO: 7981 - protein, 261 aa, Platanus occidentalis
MGRVIRAQRKGAGSVFKSHTHHRKGPARFRSLDFGERNGYLKGVVTEIIHDPGRGAPLARVTFRHPFRYKHQKELFVAAEGMYTGQFVYCGKKANLMVGNVLPLRSIPEGAVVCNVEHHVGDRGVLARASGDYAIVISHNPDNGTTRIKLPSGAKKIVPSGCRAMIGQVAGGGRTEKPLLKAGNAYHKYRVKRNCWPKVRGVAMNPVEHPHGGGNHQHIGHASTVRRDAPPGQKVGLIAARRTGRLRGQAAATASKAEKGA

SEQ ID NO: 7982 - protein, 257 aa, Platanus occidentalis
MGRVIRAQRKGAGSVFKSHTHHRKGPARFRSLDFGERNGYLKGVVTEIIHDPGRGAPLARVTFRHPFRYKHQKELFVAAEGMYTGQFVYCGKKANLMVGNVLPLRSIPEGAVVCNVEHHVGDRGVLARASGDYAIVISHNPDNGTSRIKLPSGAKKIVPSGCRAMIGQVAGGGRTEKPLLKAGNAYHKYRVKRNCWPKVRGVAMNPVEHPHGGGNHQHIGHASTVRRDAPPGQKVGLIAARRTGRLRGQAAATASKA

SEQ ID NO: 7983 - protein, 260 aa, Prunus persica
MGRVIRAQRKGAGSVFKSHTHHRKGPARFRSLDFGERNGYLKGVVTEIIHDPGRGAPLARVSFRHPFRYKKQNELFVAAEGIYTGQFIYCGKKANLVVGNVLPLRSIPEGAVVCNVEHHVGDRGVLARASGDYAVVISHNPDNDTSRIKLPSGAKKIVPSGCRAMIGQVAGGGRTEKPMLKAGNAYHKFRVKRNCWPKVRGVAMNPVEHPHGGGNHQHIGHASTVRRDAPPGQKVGLIAARRTGRLRGQAAATASKADKA

SEQ ID NO: 7984 - protein, 260 aa, Solanum phureja
MGRVIRAQRKGAGSVFKSHTHHRKGPARFRSLDFGERNGYLKGVVTEIIHDPGRGAPLARMTFRHPFRYKHQKELFVAAEGMYTGQFIYCGKKANLMVGNVLALRSIPEGAVVCNVEHKVGDRGVFARCSGDYAIVISHNPDNGTTRIKLPSGSKKIVPSGCRAMIGQVAGGGRTEKPMLKAGNAYHKYRVKRNCWPKVRGVAMNPVEHPHGGGNHQHIGHASTVRRDAPPGQKVGLIAARRTGRLRGQAAASAAKADKA

SEQ ID NO: 7985 - protein, 261 aa, Glycine max
MGRVIRAQRKGAGSVFKSHTHHRKGPARFRSLDFGERNGYLKGVVTDIIHDPGRGAPLAKVAFRHPFRYKKQTELFVAAEGLYTGQFVYCGKKATLVVGNVLPIRSIPEGAVICNVEHHVGDRGVFARASGDYAIVISHNPDNDTSRIKLPSGAKKIVPSGCRAMIGQVAGGGRTEKPLLKAGNAYHKFRVKRNSWPKVRGVAMNPVEHPHGGGNHQHIGHASTVRRDAPPGQKVGLIAARRTGRLRGQAAATAAKADKTT

SEQ ID NO: 7986 - protein, 260 aa, Nicotiana tabacum
MGRVIRAQRKGAGSVFKSHTHHRKGPAKFRSLDYGERNGYLKGVVSEIIHDPGRGAPLARVTFRHPFRYKHQKELFVAAEGMYTGQFIYCGKKANLMVGNVLALRSIPEGAVVCNVEHKVGDRGVFARCSGDYAIVISHNPDNGTTRIKLPSGAKKIVPSGCRAMIGQVAGGGRTEKPMLKAGNAYHKYRVKRNCWPKVRGVAMNPVEHPHGGGNHQHIGHASTVRRDAPPGQKVGLIAARRTGRLRGQAAATAAKADKA

SEQ ID NO: 7987 - protein, 259 aa, Tragopogon dubius
MGRVIRAQRKGAGSVFKSHTHHRKGPARFRSLDFGERNGYLKGVITEIIHDPGRGAPLARVTFRHPFRYKHQKELFVAAEGMYTGQFVFCGKKANLMVGNVLPLRSIPEGAVVCNVEHHVGDRGSFARASGDYAIVISHNPDNGTSRVKLPSGAKKIVPSGCRAMIGQVAGGGRTEKPMLKAGNAYHKYRVKRNSWPKVRGVAMNPVEHPHGGGNHQHIGHASTVRRDAPPGQKVGLIAARRTGRLRGQAAATAAKADK

SEQ ID NO: 7988 - protein, 260 aa, Utricularia gibba
MGRVIRAQRKGAGSVFKSHTHHRKGPARFRSLDFGERNGYLKGVITDIIHDPGRGAPLAKVTFRHPFRYQHQKELFIAAEGMYTGQFVYCGKKANLVVGNVLPLRSIPEGAVVCNVEHHVGDRGVFARASGDYAIVISHNPDNGTSRIKLPSGSKKIVPSSCRAMVGQVAGGGRTEKPLLKAGNAYHKFRVKRNSWPKVRGVAMNPVEHPHGGGNHQHIGHASTVRRDAPPGQKVGLIAARRTGRLRGQAAATAAKADKV

SEQ ID NO: 7989 - protein, 260 aa, Vaccinium corymbosum
GRVIRAQRKGAGSVFKSHTHHRKGPARFRSLDFGERNGYLKGVVTEIIHDPGRGAPLARVTFRHPFRFKHQKELMVAAEGMYTGQFIFCGKKANLMVGNVLPLRSIPEGGVVCNVEHHVGDRGVLARASGDYAIVISHNPDNDTSRIKLPSGAKKIVPSGCRAMIGQVAGGGRTEKPLLKAGNAYHKYRVKRNCWPKVRGVAMNPVEHPHGGGNHQHIGHASTVRRDAPPGQKVGLIAARRTGRLRGQAAATAAKADKTT

SEQ ID NO: 7990 - protein, 259 aa, Unknown
  Sequence found in Organisms: Ambrosia trifida, Cichorium intybus, Taraxacum officinale, Flaveria ramosissima, Lactuca sativa, Parthenium argentatum, Helianthus annuus
MGRVIRAQRKGAGSVFKSHTHHRKGPARFRSLDFGERNGYLKGVITEIIHDPGRGAPLARVTFRHPFRYKHQKELFVAAEGMYTGQFVFCGKKANLMVGNVLPLRSIPEGAVVCNVEHHVGDRGSFARASGDYAIVISHNPDNGTTRVKLPSGAKKIVPSGCRAMIGQVAGGGRTEKPMLKAGNAYHKFRVKRNCWPKVRGVAMNPVEHPHGGGNHQHIGHASTVRRDAPPGQKVGLIAARRTGRLRGQAAATAAKADK

SEQ ID NO: 7991 - protein, 260 aa, Solanum melongena
MGRVIRSQRKGAGSVFKSHTHHRKGPARFRTLDFGERNGYLKGVITDVIHDPGRGAPLARITFRHPFRYKHQKELFVAAEGMYTGQFVYCGKKAALMVGNVLPLRSIPEGAVVCNVEHKVGDRGVFARCSGDYAIVVSHNPDNGTTRIKLPSGSKKIVPSGCRAMIGQVAGGGRTEKPMLKAGNAYHKYRVKRNCWPKVRGVAMNPVEHPHGGGNHQHIGHASTVRRDAPPGQKVGLIAARRTGRLRGQAAATAAKADKA

SEQ ID NO: 7992 - protein, 260 aa, Eucalyptus grandis
MGRVIRAQRKGAGSVFKSHTHHRKGPARFRSLDFGERNGYLKGVVTEIVHDPGRGAPLARVAFRHPFRYKKQKELFVAAEGMYTGQFVYCGKKATLVVGNVLPLRSIPEGAVVCNVEHHVGDRGVFARASGDYAIVISHNPDNDTSRIKLPSGSKKIVPSGCRAMIGQVAGGGRTEKPLLKAGNAYHKFRVKRNCWPKVRGVAMNPVEHPHGGGNHQHIGHASTVRRDAPPGQKVGLIAARRTGRLRGQAAATASKADKA

SEQ ID NO: 7993 - protein, 260 aa, Unknown
  Sequence found in Organisms: Euphorbia peplus, Euphorbia esula
MGRVIRAQRKGAGSVFKSHTHHRKGPAQFRSLDFGERNGYLKGVITEIIHDPGRGAPLARVTFRHPFRYKHQKELFIAAEGMYTGQFVYCGKKANLMVGNVLPLRSIPEGAVVCNVEHHVGDRGSFARCSGDYAIVVSHNPDNGTSRIKLPSGAKKIVPSGCRAMVGQVAGGGRTEKPMLKAGNAYHKYRVKRNCWPKVRGVAMNPVEHPHGGGNHQHIGHASTVRRDAPPGQKVGLIAARRTGRLRGQAAATAAKADKA

SEQ ID NO: 7994 - protein, 259 aa, Flaveria ramosissima
MGRVIRAQRKGAGSVFKSHTHHRKGPARFRSLDFGERNGYLKGVITDIIHDPGRGAPLARVTFRHPFRYKHQKELFIAAEGMYTGQFVFCGKKANLMVGNVLPLRSIPEGAVVCNVEHHVGDRGSFARASGDYAIVISHNPDNGTTRVKLPSGAKKIVPSGCRAMIGQVAGGGRTEKPMLKAGNAYHKFRVKRNCWPKVRGVAMNPVEHPHGGGNHQHIGHASTVRRDAPPGQKVGLIAARRTGRLRGQAAATAAKADK

SEQ ID NO: 7995 - protein, 259 aa, Linum usitatissimum
MGRVIRAQRKGAGSVFTSHTHHRKGPARFRSLDFGERNGYLKGVVTEVIHDPGRGAPLIKVTFRHPFRYQKQKELFVAAEGMYTGQFVYCGKKANLMVGNVLPLRSIPEGAVVCNVEHHVGDRGVFARCSGDYAIVISHNPDNDTTRVKLPSGAKKIVPSGCRAMIGQVAGGGRTEKPMLKAGNAYHKYRVKRNCWPKVRGVAMNPVEHPHGGGNHQHIGHASTVRRDAPPGKKVGLIAARRTGRLRGQAAATAAKSDK

SEQ ID NO: 7996 - protein, 260 aa, Ipomoea nil
MGRVIRAQRKGAGSVFKSHTHHRKGPARFRSLDFGERNGYLKGVVSEVIHDPGRGAPLARVTFRHPFRYQHQKELFIAAEGMYTGQFVYCGKKAALIVGNVLPLRSIPEGAVVCNVEHKVGDRGVFARCSGDYAIVISHNPDNGTTRIKLPSGSKKIVPSGCRAMIGQVAGGGRTEKPLLKAGNAYHKFRVKRNCWPKVRGVAMNPVEHPHGGGNHQHIGHASTVRRDAPPGQKVGLIAARRTGRLRGQAAATAAKSDKA

SEQ ID NO: 7997 - protein, 260 aa, Lotus japonicus
MGRVIRAQRKGAGSVFKSHTHHRKGPARFRSLDFGERNGYLKGVVTDVIHDPGRGAPLAKVAFRHPFRYKKQNELFVAAEGMYTGQFIFCGKKATLVVGNVLPIRSIPEGAVICNVEHHVGDRGVFARCSGDYAIVISHNPDNDTSRIKLPSGAKKIVPSDCRAMIGQVAGGGRTEKPLLKAGNAYHKFRVKRNCWPKVRGVAMNPVEHPHGGGNHQHIGHASTVRRDAPPGQKVGLIAAKRTGRLRGQAAATAAKADKV

SEQ ID NO: 7998 - protein, 258 aa, Lotus japonicus
MGRVIRAQRKGAGSVFKSHTHHRKGPARFRSLDFGERNGYLKGVVTDVIHDPGRGAPLAKVAFRHPFRYKKQNELFVAAEGIYTGQFIFCGKKATLVVGNVLPIRSIPEGAVICNVEHHVGDRGVFARCSGDYAIVISHNPDNDTSRIKLPSGAKKIVPSDCRAMIGQVAGGGRTEKPLLKAGNAYHKFRVKRNCWPKVRGVAMNPVEHPHGGGNHQHIGHASTVRRDAPPGQKVGLIAAKRTGRLRGQAAATAAKAD

SEQ ID NO: 7999 - protein, 260 aa, Cucumis melo
MGRVIRAQRKGAGSVFRSHTHHRKGPARFRSLDFGERNGYLKGVVSEIIHDPGRGAPLARVTFRHPFRYKHQKELFVAAEGMYTGQFVYCGKKANLVVGNVLPIRAIPEGAVVCNVEHHVGDRGVFARCSGDYAIVISHNPDNDTSRIKLPSGAKKIVPSGCRAMIGQVAGGGRTEKPLLKAGNAYHKFRVKRNCWPKVRGVAMNPVEHPHGGGNHQHIGHASTVRRDAPPGQKVGLIAARRTGRLRGQAAATAAKADKA

SEQ ID NO: 8000 - protein, 260 aa, Orobanche aegyptiaca
MGRVIRAQRKGAGSVFKSHTHHRKGPARFRSLDFGERNGYLKGVVTDVIHDPGRGAPLARVTFRHPFRFQHQKELFVAAEGMYTGQFVYCGKKANLVVGNVLPLRSIPEGAVVCNVEHHVGDRGVFARASGDYAIVISHNPDNDTTRIKLPSGAKKIVPSGCRAMVGQVAGGGRTEKPMLKAGNAYHKFRVKRNSWPKVRGVAMNPVEHPHGGGNHQHIGHASTVRRDAPPGQKVGLIAARRTGRLRGQAAALSAKADKA

SEQ ID NO: 8001 - protein, 259 aa, Capsicum annuum
MGRVIRAQRKGAGSVFKSHTHHRKGPARFRTLDFGERNGYLKGVITDVIHDPGRGAPLARVTFRHPFRYKHQKELFIAAEGMYTGQFVYCGKKANLVVGNVLPLRSIPEGAVVCNVEHKVGDRGVFARCSGDYAIVISHNPDNGTTRVKLPSGSKKIVPSGCRAMIGQVAGGGRTEKPMLKAGNAYHKYRVKRNCWPKVRGVAMNPVEHPHGGGNHQHIGHASTVRRDAPPGQKVGLIAARRTGRLRGQAAATAAKADK

SEQ ID NO: 8002 - protein, 260 aa, Capsicum annuum
MGRVIRAQRKGAGSVFKSHTHHRKGPAKFRTLDFGERNGYLKGVITEVIHDPGRGAPLARITFRHPFRYKHQKELFVAAEGMYTGQFVYCGKKANLMVGNVLPLRSIPEGAVVCNVEHKVGDRGVFARCSGDYAIVISHNPDNGTTRIKLPSGSKKIVPSGCRAMIGQVAGGGRTEKPMLKAGNAYHKYRVKRNCWPKVRGVAMNPVEHPHGGGNHQHIGHASTVRRDAPPGQKVGLIAARRTGRLRGQAAATAAKADKA

SEQ ID NO: 8003 - protein, 261 aa, Lippia dulcis
THCRVIRAQRKGAGSVFKSHTHHRKGPARFRSLDFGERNGYIKGVVTDIIHDPGRGAPLARVTFRHPFRYQHQKELFVAAEGIYTGQFIYCGKKANLVVGNVLPLRSIPEGAVVCNVEHHVGDRGVFARASGDYAIVISHNPDNGTTRIKLPSGSKKIVPSGCRAMVGQVAGGGRTEKPLLKAGNAYHKFRVKRNCWPKVRGVAMNPVEHPHGGGNHQHIGHASTVRRDAPPGQKVGLIAARRTGRLRGQAAATAAKADKA

SEQ ID NO: 8004 - protein, 260 aa, Papaver somniferum
MGRVIRSQRKGAGSIFKSHTHHRKGPARFRSLDFGERNGYLKGVVTEIIHDPGRGAPLARVTFRHPFRYKHQKELFVAAEGMYTGQFLYCGKKANLMVGNVLPLRSIPEGAVVCNVEHHVGDRGTLARASGDYAIVISHNPDNGTSRIKLPSGAKKIVPSGCRAMIGQVAGGGRTEKPMLKAGNAYHKYRVKRNSWPKVRGVAMNPVEHPHGGGNHQHIGHASTVRRDAPPGQKVGLIAARRTGRLRGQAASAAAKTDKA

SEQ ID NO: 8005 - protein, 260 aa, Prunus persica
MGRVIRAQRKGAGSVFKSHTHHRKGPARFRSLDFGERNGYLKGVVTEIIHDPGRGAPLARVSFRHPFRYKKQNELFVAAEGIYTGQFIYCGKKANLVVGNVLPLRSIPEGAVVCNVEHHVGDRGTLARASGDYAVVISHNPDNDTSRIKLPSGAKKIVPSGCRAMIGQVAGGGRTEKPMLKAGNAYHKFRVKRNCWPKVRGVAMNPVEHPHGGGNHQHIGHASTVRRDAPPGQKVGLIAARRTGRLRGQAAATASKADKA

SEQ ID NO: 8006 - protein, 258 aa, Carthamus tinctorius
MGRVIRAQRKGAGSVFKSHTHHRKGPARFRSLDFGERNGYLKGVITEIIHDPGRGAPLARVTFRHPFRYKHQKELFVAAEGMYTGQFVFCGKKANLMVGNVLPLRSIPEGAVVCNVEHHVGDRGSFARASGDYAIVISHNPDNGTTRVKLPSGAKKIVPSGCRAMIGQVAGGGRTEKPMLKAGNAYHKFRVKRNCWPKVRGVAMNPVEHPHGGGNHQHIGHASTVRRDAPPGQKVGLIAARRTGRLRGQAAATAAKDK

SEQ ID NO: 8007 - protein, 260 aa, Salvia sclarea
MGRVIRAQRKGAGSVFKSHTHHRKGPARFRSLDFGERNGYLKGVVTEIIHDPGRGAPLARVTFRHPFRFQHQKELFVAAEGMYTGQFVYCGKKANLVVGNVLPLRSIPEGAVVCNVEHHVGDRGVFARASGDYAIVISHNPDNGTTRVKLPSGAKKIVPSGCRAMVGQVAGGGRTEKPMLKAGNAYHKFRVKRNSWPKVRGVAMNPVEHPHGGGNHQHIGHASTVRRDAPPGQKVGLIAARRTGRLRGQAAATAAKADKA

SEQ ID NO: 8008 - protein, 259 aa, Triphysaria pusilla
MGRVIRAQRKGAGSVFKSHTHHRKGPARFRSLDFGERNGYLKGVITEVIHDPGRGAPLARVVFRHPFRFQHQKELFVAAEGMYTGQFVYCGKKANLVVGNVLPLGSIPEGAVVCNVEHHVGDRGVFARASGDYAIVISHNPDNGTSRIKLPSGAKKIVPSGCRAMVGQVAGGGRTEKPMLKAGNAYHKYRVKRNSWPKVRGVAMNPVEHPHGGGNHQHIGHASTVRRDAPPGQKVGLIAARRTGRLRGQAAATAAKADK

SEQ ID NO: 8009 - protein, 96 aa, Fraxinus spp
MIGQVAGGGRTEKPLLKAGNAYHKFRVKRNCWPKVRGVAMNPVEHPHGGGNHQHIGHASTVRRDAPPGQKVGLIAARRTGRLRGQAAATASKADKA

SEQ ID NO: 8010 - protein, 261 aa, Musa acuminata
MGRVIRAQRKGAGSVFRSHTHHRKGPARFRSLDFGERNGYLKGVVTEILHDPGRGAPLARVTFRHPFRYKLQKELFIAAEGMYTGQFVYCGRKASLMVGNVLPLRSIPEGAVVCNVEHHVGDRGVLARASGDYAIVISHNPDNGTSRIKLPSGAKKIVPSNCRAMIGQVAGGGRTEKPLLKAGNAYHKFRVKRNCWPKVRGVAMNPVEHPHGGGNHQHIGHASTVRRDAPPGQKVGLIAARRTGRLRGQAAATAAKAEKTS

SEQ ID NO: 8011 - protein, 258 aa, Capsicum annuum
GRVIRAQRKGAGSVFKSHTHHRKGPARFRTLDFGERNGYLKGVITDVIHDPGRGAPLARVTFRHPFRYKHQKELFIAAEGMYTGQFVYCGKKANLVVGNVLPLRSIPEGAVVCNVEHKVGDRGVFARCSGDYAIVISHNPDNGTTRVKLPSGSKKIVPSGCRAMIGQVAGGGRTEKPMLKAGNAYHKYRVKRNCWPKVRGVAMNPVEHPHGGGNHQHIGHASTVRRDAPPGQKVGLIAARRTGRLRGQAAATAAKADK

SEQ ID NO: 8012 - protein, 261 aa, Amorphophallus konjac
MGRVIRAQRKGAGSVFRSHTHHRKGPARFRSLDFGERNGYLKGVVTEILHDPGRGAPLARVTFRHPFRYKHQKELFVAAEGMYTGQFVFCGKKANLMVGNVLPLRSIPEGAVVCNVEHHVGDRGSFARASGDYAIVISHNPDNGTSRIKLPSGAKKVVPSGCRAMIGQVAGGGRTEKPMLKAGNAFHKYRVKRNCWPKVRGVAMNPVEHPHGGGNHQHIGHASTVRRDAPPGQKVGLIAARRTGRLRGQAAATAAKAEKSA

SEQ ID NO: 8013 - protein, 259 aa, Arnica chamissonis
MGRVIRAQRKGAGSIFKSHTHHRKGPARFRSLDFGERNGYLKGVITEIIHDPGRGAPLARVTFRHPFRYKHQKELFVAAEGMYTGQFVFCGKKANLMVGNVLPLRSIPEGAVVCNVEHHVGDRGSFARASGDYAIVISHNPDNGTSRVKLPSGAKKIVPSGCRAMIGQVAGGGRTEKPMLKAGNAYHKFRVKRNCWPKVRGVAMNPVEHPHGGGNHQHIGHASTVRRDAPPGQKVGLIAARRTGRLRGQAAASAAKADK

SEQ ID NO: 8014 - protein, 258 aa, Phaseolus coccineus
MGRVIRAQRKGAGSVFKSHTHHRKGPARFRSLDFGERNGYLKGVVTDIIHDPGRGAPLAKVTFRHPFRYKKQTELFVSAEGLYTGQFLYCGKKATLVVGNVLPLRSIPEGAVICNVEHHVGDRGVFARASGDYAIVISHNPDNDTSRIKLPSGSKKIVPSACRAMIGQVAGGGRTEKPLLKAGNAYHKFRVKRNCWPKVRGVAMNPVEHPHGGGNHQHIGHASTVRRDAPPGQKVGLIAARRTGRLRGQAAATASKAD

SEQ ID NO: 8015 - protein, 260 aa, Theobroma cacao
MGRVIRAQRKGAGSVFKAHTHHRKGPARFRSLDFGERNGYLKGVVTEVIHDPGRGAPLARVVFRHPFRYKKQKELFVAAEGMYTGQFVYCGKKATLMVGNVLPLRSIPEGAVVCNVEHHVGDRGVFARCSGDYAIVISHNPDNDTTRIKLPSGSKKIVPSGCRAMIGQVAGGGRTEKPLLKAGNAYHKFKVKRNCWPKVRGVAMNPVEHPHGGGNHQHIGHASTVRRDAPPGQKVGLIAARRTGRLRGQAAATAAKADKA

SEQ ID NO: 8016 - protein, 260 aa, Unknown
  Sequence found in Organisms: Castanea mollissima, Quercus alba
MGRVIRAQRKGAGSVFKSHTHHRKGPARFRSLDFGERNGYLKGVVTEIIHDPGRGAPLARITFRHPFRYKKQNELFVAAEGMYTGQFVYCGKKATLVVGNVLPLRSIPEGAVVCNVEHHVGDRGVFARCSGDYAIVISHNPDNDTSRVKLPSGAKKIVPSGCRAMIGQVAGGGRTEKPLLKAGNAYHKFRVKRNCWPKVRGVAMNPVEHPHGGGNHQHIGHASTVRRDAPPGQKVGLIAARRTGRLRGQAAATASKADKA

SEQ ID NO: 8017 - protein, 259 aa, Cirsium arvense
MGRVIRAQRKGAGSVFKSHTHHRKGPARFRSLDFGERNGYLKGVITEIIHDPGRGAPLARVTFRHPFRYKHQKELFVAAEGMYTGQFVFCGKKANLMVGNVLPLRSIPEGAVVCNVEHHVGDRGSFARASGDYAIVISHNPDNGTTRVKLPSGAKKIVPSGCRAMIGQVAGGGRTEKPMLKAGNAYHKFRVKRNSWPKVRGVAMNPVEHPHGGGNHQHIGHASTVRRDAPPGQKVGLIAARRTGRLRGQAAATAAKADK

SEQ ID NO: 8018 - protein, 260 aa, Cucumis sativus
MGRVIRAQRKGAGSVFRSHTHHRKGPARFRSLDFGERNGYLKGVVSEIIHDPGRGAPLARVTFRHPFRYKHQKELFIAAEGMYTGQFVYCGKKANLVVGNVLPVRAIPEGAVVCNVEHHVGDRGVFARCSGDYAIVISHNPDNDTSRIKLPSGAKKIVPSGCRAMIGQVAGGGRTEKPLLKAGNAYHKFRVKRNCWPKVRGVAMNPVEHPHGGGNHQHIGHASTVRRDAPPGQKVGLIAARRTGRLRGQAAATAAKADKA

SEQ ID NO: 8019 - protein, 260 aa, Cucurbita pepo
MGRVIRAQRKGAGSVFRSHTHHRKGPARFRSLDFGERNGYLKGVVSEIIHDPGRGAPLARVTFRHPFRYKHQKELFVAAEGMYTGQFVYCGKKANLVVGNVLPIRAIPEGAVVCNVEHHVGDRGVFARCSGDYAIVISHNPDNDTSRIKLPSGAKKIVPSGCRAMIGQVAGGGRTEKPLLKAGNAYHKFRVKRNCWPKVRGVAMNPVEHPHGGGNHQHIGHASTVRRDAPPGQKVGLIAARRTGRLRGQAAATASKADKA

SEQ ID NO: 8020 - protein, 259 aa, Cynara scolymus
MGRVIRAQRKGAGSVFKSHTHHRKGPARFRSLDFGERNGYLKGVITEIIHDPGRGAPLARVTFRHPFRYKHQKELFVAAEGMYTGQFVFCGKKANLMVGNVLPLRSIPEGAVVCNVEHHVGDRGSFARASGDYAIVISHNPDNGTTRVKLPSGAKKIVPSGCRAMIGQVAGGGRTEKPMLKAGNAYHKFRVKRNCWPKVRGVAMNPVEHPHGGGNHQHIGHASTVRRDAPPGQKVGLIAARRTGRLRGQAAATASKADK

SEQ ID NO: 8021 - protein, 259 aa, Flaveria ramosissima
MGRVIRAQRKGAGSVFRSHTHHRKGPARFRSLDFGERNGYLKGVITEIIHDPGRGAPLARVTFRHPFRYKHQKELFVAAEGMYTGQFVFCGKKANLMVGNVLPLRSIPEGAVVCNVEHHVGDRGSFARASGDYAIVISHNPDNGTTRVKLPSGAKKIVPSGCRAMIGQVAGGGRTEKPMLKAGNAYHKFRVKRNCWPKVRGVAMNPVEHPHGGGNHQHIGHASTVRRDAPPGQKVGLIAARRTGRLRGQAAATAAKADK

SEQ ID NO: 8022 - protein, 259 aa, Flaveria ramosissima
MGRVIRAQRKGAGSVFRSHTHHRKGPARFRSLDFGERNGYLKGVITDIIHDPGRGAPLARVTFRHPFRYKHQKELFIAAEGMYTGQFVFCGKKANLMVGNVLPLRSIPEGAVVCNVEHHVGDRGSFARASGDYAIVISHNPDNGTTRVKLPSGAKKIVPSGCRAMIGQVAGGGRTEKPMLKAGNAYHKFRVKRNCWPKVRGVAMNPVEHPHGGGNHQHIGHASTVRRDAPPGQKVGLIAARRTGRLRGQAAATAAKADK

SEQ ID NO: 8023 - protein, 259 aa, Flaveria ramosissima
MGRVIRAQRKGAGSVFKSHTHHRKGPARFRSLDFGERNGYLKGVITEIIHDPGRGAPLARVTFRHPFRYKHQKELFIAAEGMYTGQFVFCGKKANLMVGNVLPLRSIPEGAVVCNVEHHVGDRGSFARASGDYAIVISHNPDNGTTRVKLPSGAKKIVPSGCRAMIGQVAGGGRTEKPMLKAGNAYHKFRVKRNCWPKVRGVAMNPVEHPHGGGNHQHIGHASTVRRDAPPGQKVGLIAARRTGRLRGQAAATAAKADK

SEQ ID NO: 8024 - protein, 260 aa, Zingiber officinale
  misc_feature (79)..(79): Xaa can be any naturally occurring amino acid
MGRVIRAQRKGAGSVFKSHTHHRKGPARFRSLDYGERNGYLKGVVTDIIHDPGRGAPLARVTFRHPFRFKLQKELFIAXEGMYTGQFVYCGRKANLMVGNVLPLRSIPEGAVVCNVEHHVGDRGVLARASGDYAIVISHNPDNGTSRIKLPSGAKKIVPSNCRAMIGQVAGGGRTEKPLLKAGNAYHKFRVKRNCWPKVRGVAMNPVEHPHGGGNHQHIGHASTVRRDAPPGQKVGLIAARRTGRLRGQAAATASKADKV

SEQ ID NO: 8025 - protein, 260 aa, Mimulus guttatus
MGRVIRAQRKGAGSVFKSHTHHRKGPARFRSLDFGERNGYLKGVITEIIHDPGRGAPLARITFRHPFRFQHQKELFVASEGMYTGQFIYCGKKANLVVGNVLPLRSIPEGAVVCNVEHHVGDRGVLARASGDYAIVISHNPDNGTSRIKLPSGAKKIVPSGCRAMIGQVAGGGRTEKPMLKAGNAYHKYRVKRNSWPVVRGVAMNPVEHPHGGGNHQHIGHASTVRRDAPPGQKVGLIAARRTGRLRGQAAATASKADKA

SEQ ID NO: 8026 - protein, 261 aa, Elaeis guineensis
MGRVIRAQRKGAGSVFRSHTHHRKGPARFRSLDYGERNGYLKGVVTDIIHDPGRGAPLARVTFRHPFRYKHQKELFIAAEGMYTGQFVYCGRKASLIVGNVLPLRSIPEGAVVCNVEHHVGDRGVLARASGDYAIVISHNPDNGTSRIKLPSGAKKVVPSGCRAMIGQVAGGGRTEKPLLKAGNAYHKFRVKRNCWPKVRGVAMNPVEHPHGGGNHQHIGHASTVRRDAPPGQKVGLIAARRTGRLRGQAAATASKAEKTA

SEQ ID NO: 8027 - protein, 260 aa, Papaver somniferum
MGRVIRSQRKGAGSIFKSHTHHRKGPARFRSLDFGERNGYLKGVVTEIIHDPGRGAPLARVTFRHPFRYKHQKELFVAAEGMYTGQFLYCGKKANLMVGNVLPLRSIPEGAVICNVEHHVGDRGTLARASGDYAIVISHNPDNGTSRIKLPSGAKKIVPSGCRAMIGQVAGGGRTEKPMLKAGNAYHKYRVKRNSWPKVRGVAMNPVEHPHGGGNHQHIGHASTVRRDAPPGQKVGLIAARRTGRLRGQAASAAAKTDKA

SEQ ID NO: 8028 - protein, 258 aa, Eutrema halophilum
MGRVIRAQRKGAGSVFKSHTHHRKGPAKFRSLDFGERNGYLKGVVTEIIHDPGRGAPLARVAFRHPFRYKKQKELFVAAEGMYTGQFLYCGKKATLVVGNVLPLRSIPEGAVVCNVEHHVGDRGVFARASGDYAIVIAHNPDNDTSRIKLPSGSKKIVPSGCRAMIGQVAGGGRTEKPMLKAGNAYHKYRVKRNCWPKVRGVAMNPVEHPHGGGNHQHIGHASTVRRDAPPGQKVGLIAARRTGRLRGQAAALAAKQD

SEQ ID NO: 8029 - protein, 260 aa, Tripterygium wilfordii
MGRVIRAQRKGAGSVFKSHTHHRKGPACFRSLDFGERNGYLRGVVSEIIHDPGRGAPLARVVFRHPFRYKHQKELFVAAEGMYTGQFIYCGKKANLMVGNVLPLRGIPEGAVVCNVEHHVGDRGVLARASGDYAIVISHNPDNGTTRVKLPSGAKKIVPSGCRAMIGQVAGGGRTEKPMLKAGNAYHKYRVKRNCWPKVRGVAMNPVEHPHGGGNHQHIGHASTVCRHAPPGQKVGLIAARRTGRLRGQAAAAASKSDKA

SEQ ID NO: 8030 - protein, 258 aa, Utricularia gibba
GRVIRAQRKGAGSVFRSHTHHRKGPARFRSLDFGERNGYLKGVVTEIIHDPGRGAPLARVTFRHPFRYQHQKELFVAAEGMYTGQFIYCGKKANLVVGNVLPLRSIPEGAVVCNVEHHVGDRGVFARASGDYAIVISHNPDNGTSRIKLPSGSKKIVPSNCRAMVGQVAGGGRTEKPLLKAGNAYHKFRVKRNSWPKVRGVAMNPVEHPHGGGNHQHIGHASTVRRDAPPGQKVGLIAARRTGRLRGQAAATAAKADK

SEQ ID NO: 8031 - protein, 95 aa, Ambrosia trifida
MGRVIRAQRKGAGSVFKSHTHHRKGPARFRSLDFGERNGYLKGVITEIIHDPGRGAPLARVTFRHPFRYKHQKELFVAAEGMYTGQLCFVGRRLT

SEQ ID NO: 8032 - protein, 164 aa, Eucalyptus grandis
QNFDYKMHPQIPRIIIVEYPKPSPTEYQMKKNRNISSSLISLGSSCGGLSSEPTSPPSGDETNLLARWRVTPDCARVTNVLVITSSVRMLNWVHGHTTHLGPAVPLHSELVVSIASLKKGLLSSSSTSNLPDHCSAATWHNFLRPGWKLDSEVSLSGLWLITIA

SEQ ID NO: 8033 - protein, 261 aa, Musa acuminata
MGRVIRAQRKGAGSVFRSHTHHRKGPARFRSLDFGERNGYLKGVITEILHDPGRGAPLARVTFRHPFRYKLQKELFIAAEGMYTGQFVYCGRKASLMVGNVLPLRSIPEGAVVCNVEHHVGDRGVLARASGDYAIVISHNPDNGTSRIKLPSGAKKIVPSNCRAMIGQVAGGGRTEKPLLKAGNAYHKFRVKRNCWPKVRGVAMNPVEHPHGGGNHQHIGHASTVRRDAPPGQKVGLIAARRTGRLRGQAAATAAKAEKTS

SEQ ID NO: 8034 - protein, 258 aa, Medicago truncatula
MGRVIRAQRKGAGSVFKSHTHHRKGPARFRSLDFGERNGYLKGVVNEIIHDPGRGAPLAKVTFRHPFRYKKQKELFVAAEGLYTGQFIYCGKKATLVVGNVLPLRMIPEGAVICNVEHHVGDRGAFARCSGDYAIVISHNPDNDTSRIKLPSGAKKIVPSECRAMIGQVAGGGRTEKPMLKAGNAYHKFRVKRNCWPKVRGVAMNPVEHPHGGGNHQHIGHASTVRRDAPPGQKVGLIAAKRTGRLRGQAASAAAKAD

SEQ ID NO: 8035 - protein, 259 aa, Helianthus annuus
MGRVIRAPRMGAGSVFKSHTHHRKGPARFRSLDFGERNGYLKGVITEIIHDPGRGAPLARVTFRHPFRYKHQKELFVAAEGMYTGQFVFCGKKANLMVGNVLPLRSIPEGAVVCNVEHHVGDRGSFARASGDYAIVISHNPDNGTTRVKLPSGAKKIVPSGCRAMIGQVAGGGRTEKPMLKAGNAYHKFRVKRNCWPKVRGVAMNPVEHPHGGGNHQHIGHASTVRRDAPPGQKVGLIAARRTGRLRGQAAATAAKADK

SEQ ID NO: 8036 - protein, 261 aa, Amsonia hubrichtii
MGRVIRAQRKGAGSVFKSHTHHRKGPAKFRSLDFGERNGYLKGVITEIIHDPGRGAPLARVTFRHPFRFQHQKELFVAAEGMYTGQFVYCGKKATLMVGNVLPLRSIPEGAVVCNVEHKMGDRGVFARASGDYAIVISHNPDNGTTRIKLPSGSKKIVPSGCRAMIGQVAGGGRTEKPLLKAGNAYHKYRVKRNCWPKVRGVAMNPVEHPHGGGNHQHIGHASTVRRDAPPGQKVGLIAARRTGRLRGQAAATAAKADKGA

SEQ ID NO: 8037 - protein, 259 aa, Arnica chamissonis
MGRVIRAQRKGAGSIFKSHTHHRKGPARFRSLDFGERNGYLKGVITEIIHDPGRGAPLARVTFRHPFRYKHQKELFVAAEGMYTGQFVFCGKKANLMVGNVLPLRSIPEGAVVCNVEHHVGDRGSFARASGDYAIVISHNPENGTSRVKLPSGAKKIVPSGCRAMIGQVAGGGRTEKPMLKAGNAYHKFRVKRNCWPKVRGVAMNPVEHPHGGGNHQHIGHASTVRRDAPPGQKVGLIAARRTGRLRGQAAASAAKADK

SEQ ID NO: 8038 - protein, 260 aa, Catharanthus roseus
MGRVIRAQRKGAGSVFKSHTHHRKGAAKFRSLDFGERNGYLKGVITEIIHDPGRGAPLARVTFRHPFRYQHQKELFVAAEGMYTGQFVYCGKKANLMVGNVLPLRSIPEGAVVCNVEHKMGDRGVFARASGDYAIVISHNPDNGTTRVKLPSGAKKIVPSGCRAMIGQVAGGGRTEKPLLKAGNAYHKYRVKRNCWPKVRGVAMNPVEHPHGGGNHQHIGHASTVRRDAPPGQKVGLIAARRTGRLRGQAAATAAKADKA

SEQ ID NO: 8039 - protein, 260 aa, Cleome spinosa
MGRVIRAQRKGAGSVFKSHTHHRKGPAKFRSLDFGERNGYLKGVVTEIIHDPGRGAPLARVVFRHPFRYKKQKELFVAAEGMYTGQFVYCGKRASLIVGNVLPLRSIPEGAVVCNVEHHVGDRGVFARASGDYAIVIAHNPDNDTTRIKLPSGSKKIVPSGCRAMIGQVAGGGRTEKPLLKAGNAYHKFRVKRNCWPKVRGVAMNPVEHPHGGGNHQHIGHASTVRRDAPPGQKVGLIAARRTGRLRGQAAATASKADKA

SEQ ID NO: 8040 - protein, 260 aa, Gossypium hirsutum
MGRVIRAQRKGAGTVFKSHTHHRKGAARFRSLDFGERNGYLKGVVTEVIHDPGRGAPLVRVVFRHPFRYKKQKELFVAAEGMYTGQFVYCGKKATLMVGNVLPLRSIPEGAVVCNVEHHVGDRGVFARASGDYAIVISHNPDNDTTRIKLPSGSKKIVPSGCRAMIGQIAGGGRTEKPLLKAGSAYHKYRVKRNCWPKVRGVAMNPVEHPHGGGNHQHIGHASTVRRDAPPGQKVGLIAARRTGRLRGQAAATAAKADKA

SEQ ID NO: 8041 - protein, 260 aa, Cucumis sativus
MGRVIRAQRKGAGSVFKSHTHHRKGPARFRSLDFGERNGYLKGVVTEIIHDPGRGAPLARVSFRHPFRYKKQNELFVAAEGMYTGQFVYCGKKANLVVGNVLPVRSIPEGAVVCNVEHHVGDRGVFARCSGDYAIVISHNPDNDTSRIKLPSGAKKIVPSGCRAMVGQVAGGGRTEKPLLKAGNAYHKFRVKRNCWPKVRGVAMNPVEHPHGGGNHQHIGHASTVRRDAPPGQKVGLIAARRTGRLRGQAAATAAKADKA

SEQ ID NO: 8042 - protein, 259 aa, Cynara scolymus
  misc_feature (7)..(7): Xaa can be any naturally occurring amino acid
MGRVIRXQRKGAGSVFKSHTHHRKGPARFRSLDFGERNGYLKGVITEIIHDPGRGAPLARVTFRHPFRYKHQKELFVAAEGMYTGQFVFCGKKANLMVGNVLPLRSIPEGAVVCNVEHHVGDRGSFARASGDYAIVISHNPDNGTTRVKLPSGAKKIVPSGCRAMIGQVAGGGRTEKPMLKAGNAYHKFRVKRNCWPKVRGVAMNPVEHPHGGGNHQHIGHASTVRRDAPPGQKVGLIAARRTGRLRGQAAATASKADK

SEQ ID NO: 8043 - protein, 257 aa, Taraxacum officinale
MGRVIRAQRKGAGSVFKSHTHHRKGPARFRSLDFGERNGYLKGVITEIIHDPGRGAPLARVTFRHPFRYKHQKELFVAAEGMYTGQFVFCGKKANLMVGNVLPLRSIPEGAVVCNVEHHVGDRGSFARASGDYAIVISHNPDNGTTRVKLPSGAKKIVPSGCRAMIGQVAGGGRTEKPMLKAGNAYHKFRVKRNCWPKVRGVAMNPVEHPHGGGNHQHIGHASTVRRDAPPGQKVGLIAARRTGRLRGQAAATAAKA

SEQ ID NO: 8044 - protein, 261 aa, Eucalyptus grandis
MGRVIRAQRKGAGSVFKSHTHHRKGPARFRSLDFGERNGYLKGVVTEILHDPGRGAPLARVAFRHPFRYKKQKELFVAAEGMYTGQFVYCGKKATLVVGNVLPLRSIPEGAVVCNVEHHVGDRGVFARASGDYAIVISHNPDNDTTRVKLPSGSKKIVPSGCRAMIGQVAGGGRTEKPLLKAGNAYHKFRVKRNCWPKVRGVAMNPVEHPHGGGNHQHIGHASTVRRDAPPGQKVGLIAARRTGRLRGQAAATASKADKTT

SEQ ID NO: 8045 - protein, 261 aa, Ipomoea nil
MGRVIRAQRKGAGSVFKSHTHHRKGPAKFRSLDFGERNGYLKGVVSEIIHDPGRGAPLARVTFRHPFRYQHQKELFVAAEGMYTGQFVYCGKKANLIVGNVLPLRSIPEGAVVCNVEHKVGDRGVFARCSGDYAIVISHNPDNGTTRIKLPSGSKKIVPSGCRAMIGQVAGGGRTEKPLLKAGNAYHKFRVKRNCWPKVRGVAMNPVEHPHGGGNHQHIGHASTVRRDAPPGQKVGLIAARRTGRLRGQAAATAAKSDKGS

SEQ ID NO: 8046 - protein, 260 aa, Lotus japonicus
MGRVIRAQRKGAGSVFKSHTHHRKGPARFRSLDFGERNGYLRGVVTDVIHDPGRGAPLAKVSFRHPFRYKKQNELFVAAEGMYTGQFVFCGKKANLVVGNVLPVRSIPEGAVICNVEHHVGDRGVFARCSGDYAIVISHNPDNDTSRIKLPSGAKKIVPSDCRAMIGQVAGGGRTEKPLLKAGNAYHKFRVKRNCWPKVRGVAMNPVEHPHGGGNHQHIGHASTVRRDAPPGQKVGLIAAKRTGRLRGQAAATAAKADKA

SEQ ID NO: 8047 - protein, 261 aa, Momordica charantia
MGRVIRAQRKGAGSVFRSHTHHRKGPARFRSLDFGERNGYLKGVVSEIIHDPGRGAPLARVTFRHPFRYKHQKELFIAAEGMYTGQFVYCGKKANLVVGNVLPIRAIPEGAVVCNVEHHVGDRGVFARCSGDYAIVISHNPDNDTSRIKLPSGAKKIVPSGCRAMIGQVAGGGRTEKPLLKAGNAYHKFRVKRNCWPKVRGVAMNPVEHPHGGGNHQHIGHASTVRRDAPPGQKVGLIAARRTGRLRGQAAATAAKADKGA

SEQ ID NO: 8048 - protein, 261 aa, Mimulus guttatus
MGRVIRAQRKGAGSIFKSHTHHRKGPARFRSLDFGERNGYLKGVITEIIHDPGRGAPLARVTFRHPFRFQHQKELFVAAEGMYTGQFIYCGKKANLVVGNVLPLRSIPEGAVVCNVEHHVGDRGSFARCSGDYAIVISHNPDNGTTRVKLPSGAKKIVPSGCRAMVGQVAGGGRTEKPMLKAGNAYHKYRVKRNCWPVVRGVAMNPVEHPHGGGNHQHIGHASTVRRDAPPGQKVGLIAARRTGRLRGQAAATAAKSDKGS

SEQ ID NO: 8049 - protein, 259 aa, Tropaeolum majus
MGRVIRAQRKGAGSVFKSHTHHRKGPARFRSLDFGERNGYLKGVVTEIIHDPGRGAPLARVSFRHPFRYKKQKELFVASEGMYTGQFLYCGKRANLVVGNVLPLRSIPEGAVVCNVEHHVGDRGVFARASGDYAVVVSHNPDNDTSRIKLPSGSKKIVPSGCRAMIGQIAGGGRTEKPMLKAGNAYHKFRVKRNCWPKVRGVAMNPVEHPHGGGNHQHIGHASTVRRDAPPGQKVGLIAARRTGRLRGQAAATAAKEKA

SEQ ID NO: 8050 - protein, 261 aa, Quercus alba
MGRVIRAQRKGAGSVFKSHTHHRKGPARFRSLDFGERNGYLKGVVTEIIHDPGRGAPLARITFRHPFRYKKQNELFVAAEGMYTGQFVYCGKKATLVVGNVLPLRSIPEGAVVCNVEHHVGDRGVFARCSGDYAIVISHNPDNDTSRVKLPSGAKKIVPSGCRAMIGQVAGGGRTEKPLLKAGNAYHKFRVKRNCWPKVRGVAMNPVEHPHGGGNHQHIGHASTVRRDAPPGQKVGLIAARRTGRLRGQAAATASKADKGS

SEQ ID NO: 8051 - protein, 261 aa, Elaeis guineensis
MGRVIRAQRKGAGSVFRSHTHHRKGPARFRSLDYGERNGYLKGVVTDIIHDPGRGAPLARVTFRHPFRYKKQKELFVAAEGMYTGQFVYCGRKASLMVGNVLPLRSIPEGAVVCNIEHHVGDRGVLARASGDYAIVISHNPDNGTTRIKLPSGAKKVVPSGCRAMIGQVAGGGRTEKPLLKAGNAYHKFRVKRNCWPKVRGVAMNPVEHPHGGGNHQHIGHASTVRRDAPPGQKVGLIAARRTGRLRGQAAATASKADKSS

SEQ ID NO: 8052 - protein, 260 aa, Populus trichocarpa
MGRVIRAQRKGAGSVFKSHTHHRKGPARFRSLDFGERNGYLKGVVTEIIHDPGRGAPLARVSFRHPFRYKKQKELFVAAEGMYTGQFVYCGKKANLMVGNVLPLRSVPEGAVVCNVEHHVGDRGVFARASGDYAIVISHNPDNDTTRIKLPSGSKKIVPSGCRGMIGQVAGGGRTEKPMLKAGNAYHKFRVKRNCWPKVRGVAMNPVEHPHGGGNHQHIGHASTVRRDAPPGQKVGLIAARRTGRLRGQAAATASKADKA

SEQ ID NO: 8053 - protein, 260 aa, Populus trichocarpa
MGRVIRAQRKGAGSVFKSHTHHRKGPARFRSLDFGERNGYLKGVVTEIIHDPGRGAPLARVTFRHPFRYKKQKELFVAAEGMYTGQFVYCGKKANLMVGNVLPLRSVPEGAVVCNVEHHVGDRGVFARASGDYAIVISHNPDNDTTRIKLPSGSKKIVPSGCRGMIGQVAGGGRTEKPMLKAGNAYHKFRVKRNCWPKVRGVAMNPVEHPHGGGNHQHIGHASTVRRDAPPGQKVGLIAARRTGRLRGQAAASAAKADKV

SEQ ID NO: 8054 - protein, 259 aa, Senecio madagascariensis
MGRVIRAQRKGAGSVFKSHTHHRKGPARFRSLDFVERNGYLKGVITEIIHDPGRGAPLARVTFRHPFRYKHQKELFVAAEGMYTGQFVFCGKKANLMVGNVLPLRSIPEGAVVCNVEHHVGDRGSFARASGDYAIVISHNLDNGTSRVKLPSGAKKIVPSGCRAMIGQVAGGGRTEKPMLKAGNAYHKFRVKRNCWPKVRGVAMNPVEHPHGGGNHQHIGHASTVRRDAPPGQKVGLIAARRTGRLRGQAAASAAKADK

SEQ ID NO: 8055 - protein, 260 aa, Sequoia sempervirens
MGRVIRAQRKGAGSVFKSHTHHRKGPARFRSLDYGERNGYLKGIVTEVVHDPGRGAPLCRVSFRHPFRYRQQKELFVAAEGMYTGQFIYCGKKANLTVGNVLPLRSIPEGAVVCNVEQHVGDRGSFARASGDYAIVISHNPDNGTSRVKLPSGAKKIVPSSCRAMIGQVAGGGRTEKPMLKAGNAYHKYRVKRNCWPKVRGVAMNPVEHPHGGGNHQHIGHASTVRRDAPPGQKVGLIAARRTGRLRGQAATAAAKTDKA

SEQ ID NO: 8056 - protein, 261 aa, Tabernaemontana elegans
MGRVIRAQRKGAGSVFKSHTHHRKGPAKFRTLDFGERNGYLKGVITDIIHDPGRGAPLARVTFRHPFRYQQQKELFIAAEGMYTGQFVYCGKKATLVVGNVLPLRSIPEGAVVCNVEHKMGDRGVFARASGDYAIVISHNPDNGTTRIKLPSGAKKIVPSGCRAMIGQVAGGGRTEKPLLKAGNAYHKYRVKRNCWPKVRGVAMNPVEHPHGGGNHQHIGHASTVRRDAPPGQKVGLIAARRTGRLRGQAAATAAKADKGA

SEQ ID NO: 8057 - protein, 259 aa, Triphysaria pusilla
MGRVIRAQRKGAGSVFKSHTHHRKGPARFRSLDFGERNGYLKGVVTEVIHDPGRGAPLARVLFRHPFRHQHQKELFVAAEGMYTGQFVYCGKKANLVVGNVLPIRSIPEGAVVCNVEHHVGDRGVFARASGDYAIVISHNPDNGTSRIKLPSGAKKIVPSGCRAMVGQVAGGGRTEKPMLKAGNAYHKFRVKRNSWPKVRGVAMNPVEHPHGGGNHQHIGHASTVRRDAPPGQKVGLIAARRTGRLRGQAAATAAKAKE

SEQ ID NO: 8058 - protein, 260 aa, Citrullus lanatus
MGRVIRAQRKGAGSVFRSHTHHRKGAARFRSLDFGERNGYLKGVVSEIIHDPGRGAPLARVTFRHPFRYKHQKELFIAAEGMYTGQFVYCGKKANLVVGNVLPIRAIPEGAVVCNVEHHVGDRGVFARCSGDYAIVISHNPDNDTSRIKLPSGAKKIVPSGCRAMIGQVAGGGRTEKPLLKAGNAYHKFRVKRNCWPKVRGVAMNPVEHPHGGGNHQHIGHASTVRRDAPPGQKVGLIAARRTGRLRGQAAATAAKADKA

SEQ ID NO: 8059 - protein, 160 aa, Flaveria ramosissima
MCCRLDLFLKELWCVMLSIIVGDRGSFARASGDYAIVISHNPDNGTTRVKLPSGAKKIVPSGCRAMIGQVAGGGRTEKPMLKAGNAYHKFRVKRNCWPKVRGVAMNPVEHPHGGGNHQHIGHASTVRRDAPPGQKVGLIAARRTGRLRGQAAATAAKADK

SEQ ID NO: 8060 - protein, 261 aa, Vaccinium corymbosum
MGRVIRAQRKGPGSVFKSHTHHRKGPARFRSLDFGERNGYLKGVITEIIHDPGRGAPLARVTFRHPFRFKHQKELFIAAEGMYTGQFVFCGKKANLTVGNVLPLRSIPEGGVVCNVEHHVGDRGVLARASGDYAIVISHNPDNDTSRIKLPSGAKKIVPSGCRAMIGQVAGGGRTEKPLLKAGNAYHKYRVKRNCWPKVRGVAMNPVEHPHGGGNHQHIGHASTVRRDAPPGQKVGLIAARRTGRLRGQAAATAAKADKTS

SEQ ID NO: 8061 - protein, 145 aa, Medicago truncatula
MGRVIRAQRKGAGSVFKSHTHHRKGPARFRSLDFGERNGYLKGVVNEIIHDPGRGAPLAKVTFRHPFRYKKQKELFVAAEGLYTGQFIYCGKKATLVVGNVLPLRMIPEGAVICNVEHHVGDRGAFARCSGDYAIVISHNPDNDT

SEQ ID NO: 8062 - protein, 261 aa, Amborella trichopoda
MGRVIRAQRKGAGSVFKSHTHHRKGPARFRSLDYGERNGYLKGVVTDVIHDPGRGAPLCKVSFRHPFRYKIQKELFVAAEGMYTGQFVYCGKKANLIVGNVLPLRSIPEGAVVCNVEHHAGDRGSFARASGDYCIVISHNPDNGTTRIKLPSGAKKVVPSGCRAMIGQVAGGGRTEKPLLKAGNAYHKFRVKRNCWPKVRGVAMNPVEHPHGGGNHQHIGHASTVRRDAPPGQKVGLIAARRTGRLRGQAAATASKADKGA

SEQ ID NO: 8063 - protein, 259 aa, Malus domestica
MGRVIRAQRKGAGSVFKSHTHHRKGPARFRSLDFGERNGYLKGVVTEIIHDPGRGAPLARVSFRHPFRYKKQNELFVAAEGIYTGQFIYCGKKANLVVGNVLPLRSIPEGAVVCNVEHHVGDRGTLARASGDYAVVISHNPDNDTSRIKLPSGAKKIVPSGCRAMIGQVAGGGRTEKPMLKAGNAYHKFRVKRNCWPKVRGVAMNPVEHPHGGGNHQHIGHASTVRRDAPPGQKVGLIAARRTGRLRGQAAANISKADK

SEQ ID NO: 8064 - protein, 258 aa, Arabidopsis lyrata
MGRVIRAQRKGAGSVFKSHTHHRKGPAKFRSLDFGERNGYLKGVVTEIIHDPGRGAPLARVAFRHPFRFKKQKELFVAAEGMYTGQFLYCGKKATLVVGNVLPLRSIPEGAVVCNVEHHVGDRGVFARASGDYAIVIAHNPDNDTSRIKLPSGSKKIVPSGCRAMIGQVAGGGRTEKPMLKAGNAYHKYRVKRNCWPKVRGVAMNPVEHPHGGGNHQHIGHASTVRRDAPPGQKVGLIAARRTGRLRGQAAALASKAD

SEQ ID NO: 8065 - protein, 258 aa, Brassica juncea
MGRVIRAQRKGAGSVFKSHTHHRKGPAKFRSLDFGERNGYLKGVVTEIIHDPGRGAPLARVSFRHPFRYKKQKELFVAAEGMYTGQFLYCGKKATLVVGNVLPLRSIPEGAVVCNVEHHVGDRGVFARASGDYAIVIAHNPDNDTTRVKLPSGSKKIVPSGCRAMIGQVAGGGRTEKPMLKAGNAYHKYRVKRNCWPKVRGVAMNPVEHPHGGGNHQHIGHASTVRRDAPPGQKVGLIAARRTGRLRGQAAASAAKAD

SEQ ID NO: 8066 - protein, 258 aa, Centaurea maculosa
  misc_feature (117)..(117): Xaa can be any naturally occurring amino acid
  misc_feature (146)..(146): Xaa can be any naturally occurring amino acid
  misc_feature (163)..(163): Xaa can be any naturally occurring amino acid
  misc_feature (202)..(202): Xaa can be any naturally occurring amino acid
MGRVIRAQRKGAGSVFKSHTHHRKGPARFRSLDFGERNGYLKGVITEIIHDPGRGAPLARVTFRHPFRYKHQKELFVAAEGMYTGQFVFCGKKANLMVGNVLPLRSIPEGAVVCNVXHHVGDRGSFARASGDYAIVISHNPDNGTXRVKLPSGAKKIVPSGCXAMIGQVAGGGRTEKPMLKAGNAYHKFRVKRNCWPKVRGXAMNPVEHPHGGGNHQHIGHASTVRRDAPPGQKVGLIAARRTGRLRGQAAATAAKDK

SEQ ID NO: 8067 - protein, 258 aa, Cirsium arvense
MGRVIRAQRKGAGSVFKSHTHHRKGPARFRSLDFGERNGYLKGVITEIIHDPGRGAPLARVTFRHPFRYKHQKELFVAAEGMYTGQFVFCGKKANLMVGNVLPLRSIPEGAVVCNVEHHVGDRGSFARASGDYAIVISHNPDNGTTRVKLPSGAKKIVPSGCRAMIGQVAGGGRTEKPMLKAGNAYHKFRVKRNCWPKVRGVAMNPVEHPHGGGNHQHIGHASTVRRDAPPGQKVGLIAARRTGRLRGQAAATASKEK

SEQ ID NO: 8068 - protein, 258 aa, Cleome spinosa
MGRVIRAQRKGAGSVFKSHTHHRKGPAKFRSLDFGERNGYLKGVVTEIIHDPGRGAPLARVVFRHPFRYKKQKELFVAAEGMYTGQFVYCGKRASLVVGNVLPLRSIPEGAVVCNVEHHVGDRGVFARASGDYAIVIAHNPDNDTTRIKLPSGSKKIVPSGCRAMIGQVAGGGRTEKPLLKAGNAYHKFRVKRNCWPKVRGVAMNPVEHPHGGGNHQHIGHASTVRRDAPPGQKVGLIAARRTGRLRGQAAATAAKAD

SEQ ID NO: 8069 - protein, 260 aa, Coffea canephora
MGRVIRAQRKGARSVFKSHTHHRKGPARFRSLDFGERNGYLKGVVNEIIHDPGRGAPLARVSFRHPFRHQQQKELFVAAEGMFTGQFVYCGKKATLMVGNVLPLRSIPEGAVVCNVEHKMGDRGVFARASGDYAIVISHNPDNGTTRIKLPSGAKKIVPSGCRAMIGQVAGGGRTEKPLLKAGNAYHKYRVKRNCWPKVRGVAMNPVEHPHGGGNHQHIGHASTVRRDAPPGQKVGLIAARRTGRLRGQAAATAAKADKA

SEQ ID NO: 8070 - protein, 258 aa, Eschscholzia californica
MGRVIRAQRKGAGSVFKSHTHHRKGPARFRSLDFGERNGYLKGVITEIIHDPGRGAPLARITFRHPFRYKHQKELFVAAEGMYTGQFVYCGKKANLMVGNVLPLRSIPEGAVVCNVEHHVGDRGVLARASGDYAIVISHNPDNGTSRIKLPSGSKKIVPSGCRAMIGQVAGGGRTEKPMLKAGNAYHKFRVKRNSWPKVRGVAMNPVEHPHGGGNHQHIGHASTVRRDAPPGQKVGLIAARRTGRLRGQAAASASKAD

SEQ ID NO: 8071 - protein, 258 aa, Euonymus alatus
MGRVIRAQRKGAGSIFKSHTHHRKGPARFRSLDYGERNGYLRGVVSEIIHDPGRGAPLARVVFRHPFRYKHQKELFVAAEGMYTGQFIYCGKKANLMVGNVLPLRAIPEGAVVCNVEHHVGDRGVLARASGDYAIVISHNPDNGTSRIKLPSGAKKIVPSGCRAMIGQVAGGGRTEKPMLKAGNAYHKYRVKRNCWPKVRGVAMNPVEHPHGGGNHQHIGHASTVSRYAPPGQKVGLIAARRTGRLRGQAAAAASKSD

SEQ ID NO: 8072 - protein, 258 aa, Euonymus alatus
MGRVIRAQRKGAGSIFKSHTHHRKGPARFRSLDFGERNGYLRGVVSEIIHDPGRGAPLARVVFRHPFRYKHQKELFVAAEGMYTGQFIYCGKKANLMVGNVLPLRAIPEGAVVCNVEHHVGDRGVLARASGDYAIVISHNPDNGTSRIKLPSGAKKIVPSGCRAMIGQVAGGGRTEKPMLKAGNAYHKYRVKRNCWPKVRGVAMNPVEHPHGGGNHQHIGHASTVSRFAPPGQKVGLIAARRTGRLRGQAAAAASKAD

SEQ ID NO: 8073 - protein, 257 aa, Flaveria ramosissima
RVIRAQRKGAGSVFRSHTHHRKGPARFRSLDFGERNGYLKGVITEIIHDPGRGAPLARVTFRHPFRYKHQKELFVAAEGMYTGQFVFCGKKANLMVGNVLPLRSIPEGAVVCNVEHHVGDRGSFARASGDYAIVISHNPDNGTTRVKLPSGAKKIVPSGCRAMIGQVAGGGRTEKPMLKAGNAYHKFRVKRNCWPKVRGVAMNPVEHPHGGGNHQHIGHASTVRRDAPPGQKVGLIAARRTGRLRGQAAATAAKADK

SEQ ID NO: 8074 - protein, 260 aa, Cucumis melo
MGRVIRAQRKGAGSVFRSHTHHRKGPARFRSLDFGERNGYLKGVVTEIIHDPGRGAPLARVSFRHPFRYKKQNELFVAAEGMYTGQFVYCGKKANLVVGNVLPIRSIPEGAVVCNVEHHVGDRGVFARCSGDYAIVISHNPDNDTSRIKLPSGAKKIVPSGCRAMVGQVAGGGRTEKPLLKAGNAYHKFRVKRNCWPKVRGVAMNPVEHPHGGGNHQHIGHASTVRRDAPPGQKVGLIAARRTGRLRGQAAATAAKADKA

SEQ ID NO: 8075 - protein, 259 aa, Tropaeolum majus
MGRVIRAQRKGAGSVFKSHTHHRKGPARFRSLDFGERNGYLKGVVTEIIHDPGRGAPLARVSFRHPFRYKKQKELFVASEGMYTGQFLYCGKRANLVVGNVLPLRSIPEGAVVCNVEHHVGDRGVFARASGDYAVVVSHNPDNDTSRIKLPSGSKKIVPSGCRAMIGQIAGGGRTEKPMLKAGNAYHKFRVKRNCWPKVRGVAMNPVEHPHGGGNHQHIGHASTVRRDAPPGQKVGLIAARRTGRLRGQAAATASKEKA

SEQ ID NO: 8076 - protein, 223 aa, Nicotiana benthamiana
  misc_feature (5)..(5): Xaa can be any naturally occurring amino acid
  misc_feature (9)..(9): Xaa can be any naturally occurring amino acid
  misc_feature (127)..(127): Xaa can be any naturally occurring amino acid
  misc_feature (134)..(134): Xaa can be any naturally occurring amino acid
MVTSXGVIXEVIHDPGRGAPLARITFRHPFRYKHQKELFVAAEGMYTGQFVYCGKKATLMVGNVLPLRSVPEGAVVCNVEHKVGDRGVFARCSGDYAIVISHNPDNGTTRIKLPSGSKKIVPSGCRXMIGQVAXGGRTEKPMLKAGNAYHKYRVKRNCWPKVRGVAMNPVEHPHGGGNHQHIGHASTVRRDAPPGQKVGLIAARRTGRLRGQAAATTAKADKA

SEQ ID NO: 8077 - protein, 260 aa, Carica papaya
MGRVIRAQRKGAGSVFKSHTHHRKGPARFRSLDFGERNGYLKGVVTEILHDPGRGAPLARITFRHPFRYKKQKELFIAAEGMYTGQFVYCGKKANLMVGNVLPLRSIPEGAVVCNVEHHVGDRGVLARASGDYAIVISHNPDNDTTRIKLPSGSKKIVPSGCRAMIGQVAGGGRTEKPLLKAGNAYHKFKVKRNCWPKVRGVAMNPVEHPHGGGNHQHIGHASTVRRDAPPGQKVGLIAARRTGRLRGQAAATAAKSDKA

SEQ ID NO: 8078 - protein, 179 aa, Papaver somniferum
MYTGQFLYCGKKANLMVGNVLPLRSIPEGAVVCNVEHHVGDRGTLARASGDYAIVISHNPDNGTSRIKLPSGAKKIVPSGCRAMIGQVAGGGRTEKPMLKAGNAYHKYRVKRNSWPKVRGVAMNPVEHPHGGGNHQHIGHASTVRRDAPPGQKVGLIAARRTGRLRGQAAATAAKADKA

SEQ ID NO: 8079 - protein, 260 aa, Sequoia sempervirens
MGRVIRAQRKGAGSVFKSHTHHRKGPARFRSLDYGERNGYLKGIVTEVVHDPGRGAPLCRVNFRHPFRYRQQKELFIAAEGMYTGQFIYCGKKANLTVGNVLPLRSIPEGAVVCNVEQHVGDRGSFARASGDYAIVISHNPDNGTSRVKLPSGAKKIVPSSCRAMIGQVAGGGRTEKPMLKAGNAYHKYRVKRNCWPKVRGVAMNPVEHPHGGGNHQHIGHASTVRRDAPPGQKVGLIAARRTGRLRGQAATAAAKTDKA

SEQ ID NO: 8080 - protein, 258 aa, Fragaria vesca
MGRVIRAQRKGAGSVFKSHTHHRKGPARFRSLDFGERNGYLKGVVTDIIHDPGRGAPLARVSFRHPFRYKKQNELFVAAEGIYTGQFIYCGKKANLVVGNVLPIRSIPEGAVVCNVEHHVGDRGTLARASGDYAVVISHNPDNDTSRIKLPSGAKKIVPSGCRAMIGQVAGGGRTEKPMLKAGNAYHKFRVKRNCWPKVRGVAMNPVEHPHGGGNHQHIGHASTVRRDAPPGQKVGLIAARRTGRLRGQAAATASKEK

SEQ ID NO: 8081 - protein, 259 aa, Triphysaria pusilla
MGRVIRAQRKGAGSVFKSHTHHRKGPARFRSLDFGERNGYLKGVVTEVLHDPGRGAPLARVLFRHPFRHQHQKELFVAAEGMYTGQFIYCGKKANLVVGNVLPVRSIPEGAVVCNVEHHVGDRGVFARASGDYAIVISHNPDNGTSRIKLPSGAKKIIPSGCRAMVGQVAGGGRTEKPMLKAGNAYHKFRVKRNSWPKVRGVAMNPVEHPHGGGNHQHIGHASTVRRDAPPGQKVGLIAARRTGRLRGQAAATAAKAKE

SEQ ID NO: 8082 - protein, 257 aa, Utricularia gibba
RVIRAQRKGAGSVFKSHTHHRKGPARFRSLDFGERNGYLKGVITEIIHDPGRGAPLARVTFRHPFRYQHQKELFVAAEGMYTGQFIYCGKKANLVVGNVLPLRSIPEGAVVCNVEHHVGDRGVFARASGDYAIVISHNPDNGTSRIKLPSGSKKIVPSNCRAMVGQVAGGGRTEKPLLKAGHAYHKFRVKRNSWPKVRGVAMNPVEHPHGGGNHQHIGHASTVRRDAPPGQKVGLIAARRTGRLRGQAAATAAKADK

SEQ ID NO: 8083 - protein, 259 aa, Valeriana officinalis
MGRVIRAQRKGAGSVFKSHTHHRKGPARFRSLDFGERNGYLKGVISEIIHDPGRGAPLARITFRHPFRFKHQKELFVAAEGMYTGQFVFCGKKANLMVGNVLPLRSIPEGAVVCNVEHHVGDRGTLARASGDYAIVISHNPDNGTSRIKLPSGAKKIVPSGCRAMIGQVAGGGRTEKPMLKAGNAYHKYRVKRNCWPKVRGVAMNPVEHPHGGGNHQHIGHASTVRRDAPPGQKVGLIAARRTGRLRGQAAASASKADK

SEQ ID NO: 8084 - protein, 260 aa, Vinca minor
MGRVIRAQRKGAGSVFKSHTHHRKGPAKFRSLDFGERNGYLKGVITEIIHDPGRGAPLARVTFRHPFRFQHQKELFVAAEGMYTGQFVYCGKKANLMVGNVLPLRSIPEGAVVCNVEHKMGDRGVFARASGDYAIVISHNPDNGTTRIKLPSGSKKIVPSGCRAMIGQVAGGGRTEKPMLKAGNAYHKYRVKRNSWPKVRGVAMNPVEHPHGGGNHQHIGHASTVRRDAPPGQKVGLIAARRTGRLRGQAAASAAKADKA

SEQ ID NO: 8085 - protein, 260 aa, Citrullus lanatus
MGRVIRAQRKGAGSVFKSHTHHRKGPARFRSLDFGERNGYLKGVVTEIIHDPGRGAPLARVSFRHPFRYKKQNELFVAAEGMYTGQFVYCGKKANLVVGNVLPIRSIPEGAVVCNVEHHVGDRGVFARCSGDYAIVISHNPDNDTSRIKLPSGSKKIVPSGCRAMVGQVAGGGRTEKPLLKAGNAYHKFRVKRNCWPKVRGVAMNPVEHPHGGGNHQHIGHASTVRRDAPPGQKVGLIAARRTGRLRGQAAATAAKADKA

SEQ ID NO: 8086 - protein, 265 aa, Scabiosa columbaria
MGRVIRAQRKGAGSVFKSHTHHRKGPARFRSLDFGERNGYLKGVITEIIHDPGRGAPLARITFRHPFRFKHQKELFVAAEGMYTGQFVFCGKKANLMVGNVLPLRSIPEGAVVCNVEHHVGDRGVLARASGDYAIVISHNPDNGTSRIKLPSGAKKIVPSGCRAMIGQVAGGGRTEKPMLKAGNAYHKYRVKRNCWPKVRGVAMNPVEHPHGGGNHQHIGHASTVRRDAPPGQKVGLIAARRTGRLRGQAAATASKERLRDKFEI

SEQ ID NO: 8087 - protein, 64 aa, Eutrema halophilum
MLMVTSSVRMLHWVHSHTTHLRPAVSLHTVLVVCVSCLEHWLLCSSTSCNLTNHGPASTWDNLL

SEQ ID NO: 8088 - protein, 147 aa, Malus domestica
MGRVIRAQRKGAGSVFKSHTHHRKGPARFRSLDFGERNGYLKGVVTEIIHDPGRGAPLARVSFRHPFRYKKQNELFVAAEGIYTGQFIYCGKKANLVVGNVLPLRSIPEGAVVCNVEHHVGDRGTLARASGDYAVVISHNPDNDTSR

SEQ ID NO: 8089 - protein, 106 aa, Brassica rapa
MALQPLGTIFLEPDGSLILSVVVRVVRNNNSVITRSSSEPTTITDMMLDVTDNSSFGDSSKRENISDNESGSLTAVQELSGVHTLGGDEELLLLLVTERMTERDAS

SEQ ID NO: 8090 - protein, 97 aa, Cucurbita pepo
MIGQVAGGGRTEKPLLKAGNAYHKFRVKRNSWPKVRGVAMNPVEHPHGGGNHQHIGHASTVRRDAPPGQKVGLIAARRTGRLRGQAAATAAKSDKGS

SEQ ID NO: 8091 - protein, 67 aa, Citrullus lanatus
MSNMLMVTSSVRMLNGIHCNTTDLRPAVPLHSKFMVSITSLQKGLLSPTSTCNLSNHGTAPTWNYFL

SEQ ID NO: 8092 - protein, 258 aa, Brassica juncea
MGRVIRAQRKGAGSVFKSHTHHRKGPAKFRSLDFGERNGYLKGVVTEIIHDPGRGAPLARVAFRHPFRYKKQKELFVAAEGMYTGQFLYCGKKATLVVGNVLPLRSIPEGAVVCNVEHHVGDRGVFARASGDYAIVISHNPDNDTTRVKLPSGSKKIVPSGCRAMIGQVAGGGRTEKPMLKAGNAYHKYRVKRNCWPKVRGVAMNPVEHPHGGGNHQHIGHASTVRRDAPPGQKVGLIAARRTGRLRGQAAALASKQE

SEQ ID NO: 8093 - protein, 260 aa, Beta vulgaris
MGRVIRAQRKGAGSVFKSHTHHRKGAAKFRTLDFGERNGYLKGVITEIIHDPGRGAPLARVTFRHPFRYKHQKELFVAAEGMYSGQFVYCGKKANLMVGNVLPLRSIPEGAVVCNVEHHVGDRGVLARASGDYAIVISHNPDNDTSRIKLPSGSKKIVPSGCRAMIGQVAGGGRTEKPLLKAGNAYHKYRVKRNCWPKVRGVAMNPVEHPHGGGNHQHIGHASTVRRDAPPGQKVGLIAARRTGRLRGQAAANVSKSDKA

SEQ ID NO: 8094 - protein, 259 aa, Rosa hybrid cultivar
MGRVIRAQRKGAGSVFKSHTHHRKGPARFRSLDYGERNGYLKGVVTDIIHDPGRGAPLARVSFRHPFRYKKQNELFVAAEGLYTGQFIYCGKKANLVVGNVLPVRSIPEGAVVCNVEHHVGDRGTLARASGDYAVIISHNPDNDTSRIKLPSGAKKIVPSGCRAMIGQVAGGGRTEKPMLKAGNAYHKFRVKRNCWPKVRGVAMNPVEHPHGGGNHQHIGHASTVRRDAPPGQKVGLIAARRTGRLRGQAAATASKEKA

SEQ ID NO: 8095 - protein, 258 aa, Rosa hybrid cultivar
GRVIRAQRKGAGSVFKSHTHHRKGPARFRSLDFGERNGYLKGVVTDIIHDPGRGAPLARVSFRHPFRYKKQNELFVAAEGLYTGQFIYCGKKANLVVGNVLPVRSIPEGAVICNVEHHVGDRGTLARASGDYAVVISHNPDNDTSRIKLPSGAKKIVPSGCRAMIGQVAGGGRTEKPMLKAGNAYHKFRVKRNCWPKVRGVAMNPVEHPHGGGNHQHIGHASTVRRDAPPGQKVGLIAARRTGRLRGQAAAFASKDKA

SEQ ID NO: 8096 - protein, 259 aa, Malus domestica
MGRVIRAQRKGAGSVFKSHTHHRKGPARFRSLDFGERNGYLKGVVTEIIHDPGRGAPLARVSFRHPFRYKKQNELFVAAEGIYTGQFIYCGKKANLVVGNVLPLRSIPEGAVVCNVEHHVGDRGTLARASGDYAVVISHNPDNDTSRVKLPSGAKKIVPSGCRAMIGQVAGGGRTEKPMLKAGNAYHKFRVKRNCWPKVRGVAMNPVEHPHGGGNHQHIGHASTVRRDAPPGQKVGLIAARRTGRLRGQAAANISKADK

SEQ ID NO: 8097 - protein, 258 aa, Arabidopsis lyrata
MGRVIRAQRKGAGSVFKSHTHHRKGPAKFRSLDFGERNGYLKGVVTEIIHDPGRGAPLARVTFRHPFRFKKQKELFVAAEGMYTGQFLYCGKKATLVVGNVLPLRSIPEGAVVCNVEHHVGDRGVLARASGDYAIVIAHNPDNDTTRIKLPSGSKKIVPSGCRAMIGQVAGGGRTEKPMLKAGNAYHKYRVKRNSWPKVRGVAMNPVEHPHGGGNHQHIGHASTVRRDAPPGQKVGLIAARRTGRLRGQAAASAAKAD

SEQ ID NO: 8098 - protein, 259 aa, Artemisia annua
MGRVIRAQRKGAGSVFKSHTHHRKGPARFRSLDFGERNGYLKGVITEIIHDPGRGAPLAKVTFRHPFRYKHQKELFVAAEGMYTGQFVFCGKKANLMVGNVLPIGMIPEGGVVCNVEHHVGDRGSFARASGDYAIVISHNPDNGTSRVKLPSGAKKIVPSGCRAMIGQVAGGGRTEKPMLKAGNAYHKFRVKRNSWPKVRGVAMNPVEHPHGGGNHQHIGHASTVRRDAPPGQKVGLIAARRTGRLRGQAAAAAMKADK

SEQ ID NO: 8099 - protein, 258 aa, Brassica rapa
MGRVIRAQRKGAGSVFKSHTHHRKGPAKFRSLDYGERNGYLKGVVTEIIHDPGRGAPLARVAFRHPFRYKKQKELFVAAEGMYTGQFLYCGKRATLVVGNVLPLRAIPEGAVVCNVEHHVGDRGGLARASGDYAIVISHNPDNDTTRIKLPSGSKKIVPSGCRAMIGQVAGGGRTEKPMLKAGNAYHKYRVKRNSWPKVRGVAMNPVEHPHGGGNHQHIGHASTVRRDAPPGQKVGLIAARRTGRLRGQAAASAAKAD

SEQ ID NO: 8100 - protein, 258 aa, Brassica napus
MGRVIRAQRKGAGSVFKSHTHHRKGPAKFRSLDYGERNGYLKGVVTEIIHDPGRGAPLARVAFRHPFRYKKQKELFVAAEGMYTGQFLYCGKKATLVVGNVLPLRAIPEGAVVCNVEHHVGDRGVLARASGDYAIVISHNPDNDTTRIKLPSGSKKIVPSGCRAMIGQVAGGGRTEKPMLKAGNAYHKYRVKRNSWPKVRGVAMNPVEHPHGGGNHQHIGHASTVRRDAPPGQKVGLIAARRTGRLRGQAAASAAKAD

SEQ ID NO: 8101 - protein, 258 aa, Cleome gynandra
MGRVIRAQRKGAGSVFKSHTHHRKGPAKFRSLDFGERNGYLKGVVTEIIHDPGRGAPLARVVFRHPFRYKKQKELFVAAEGMYTGQFIYCGKRASLVVGNVLPLRSIPEGAVVCNVEHHVGDRGVLARASGDYAIVIAHNPDNDTTRIKLPSGSKKIVPSGCRAMVGQVAGGGRTEKPLLKAGNAYHKFRVKRNCWPKVRGVAMNPVEHPHGGGNHQHIGHASTVRRDAPPGQKVGLIAARRTGRLRGQAAATAAKAD

SEQ ID NO: 8102 - protein, 260 aa, Cucurbita pepo
MGRVIRAQRKGAGSVFKSHTHHRKGPARFRSLDFGERNGYLKGVVSEIIHDPGRGAPLARVTFRHPFRYKKQNELFVAAEGMYTGQFVYCGKKANLMVGNVLPLRSIPEGAVVCNVEHHVGDRGVFARCSGDYAIVISHNPDNDTSRIKLPSGSKKVVPSGCRAMVGQVAGGGRTEKPLLKAGNAYHKFRVKRNCWPKVRGVAMNPVEHPHGGGNHQHIGHASTVRRDAPPGQKVGLIAARRTGRLRGQAAATASKADKA

SEQ ID NO: 8103 - protein, 258 aa, Euonymus alatus
MGRVIRAQRKGAGSIFKSHTHHRKGPARFRSLDYGERNGYLRGVVSEIIHDPGRGAPLARVVFRHPFRYKHQKELFVAAEGMYTGQFIYCGKKANLMVGNVLPLRAIPEGAVVCNVEHHVGDRGVLARASGDYAIVISHNPDNGTSRIKLPSGAKKIVPSGCRAMIGQVAGGGRTEKPMLKAGNAYHKYRVKRNCWPKVRGVAMNPVEHPHGGGNHQHIGHASTVSRFAPPGQKVGLIAARRTGRLRGQAAAAASKAD

SEQ ID NO: 8104 - protein, 258 aa, Euonymus alatus
MGRVIRAQRKGAGSIFKSHTHHRKGPARFRSLDFGERNGYLRGVVSEIIHDPGRGAPLARVTFRHPFRYKHQKELFVAAEGMYTGQFIYCGKKANLMVGNVLPLRAIPEGAVVCNVEHHVGDRGVLARASGDYAIVISHNPDNGTTRVKLPSGAKKIVPSGCRAMIGQVAGGGRTEKPLLKAGNAYHKYRVKRNCWPKVRGVAMNPVEHPHGGGNHQHIGHASTVSRFAPPGQKVGLIAARRTGRLRGQAAAAASKSD

SEQ ID NO: 8105 - protein, 260 aa, Ipomoea batatas
MGRVIRAQRKGAGSVFKSHTHHRKGPARFRSLDFGERNGYLKGVVSEIIHDPGRGAPLARVTFRHPFRFQHQKELFVAAEGMYTGQFVYCGKKANLIVGNVLPLRSIPEGAVVCNVEHKVGDRGVFARCSGDYVIVISHNPDNGTTRIKLPSGSKKIVPSGCRAMIGQVAGGGRTEKPLLKAGNAYHKFRVKRNCWPKVRGVAMNPVEHPHGGGNHQHIGHASTVRRDAPPGQKVGLIAARRTGRLRGQAAATASKADKA

SEQ ID NO: 8106 - protein, 260 aa, Momordica charantia
MGRVIRAQRKGAGSVFKSHTHHRKGPARFRSLDFGERNGYLKGVITEIVHDPGRGAPLARVTFRHPFRYKKQNELFVAAEGMYTGQFVYCGKKANLMVGNVLPLRSIPEGAVVCNVEHHVGDRGVFARCSGDYAIVISHNPDNDTSRIKLPSGSKKVVPSGCRAMVGQVAGGGRTEKPLLKAGNAYHKFRVKRNCWPKVRGVAMNPVEHPHGGGNHQHIGHASTVRRDAPPGQKVGLIAARRTGRLRGQAAATAAKADKA

SEQ ID NO: 8107 - protein, 260 aa, Carica papaya
MGRVIRAQRKGAGSVFKSHTHHRKGPARFRSLDFGERNGYLKGVVTEIVHDPGRGAPLARITFRHPFRYKKQKELFIAAEGMYTGQFVYCGKKANLMVGNVLPLRSIPEGAVVCNVEHHVGDRGVLARASGDYAIVISHNPDNDTTRIKLPSGSKKIVPSGCRAMIGQVAGGGRTEKPLLKAGNAYHKFKVKRNCWPKVRGVAMNPVEHPHGGGNHQHIGHASTVRRDAPPGQKVGLIAARRTGRLRGQAAATAAKADKA

SEQ ID NO: 8108 - protein, 259 aa, Plantago ovata
MGRVIRAQRKGAGSVFRSHTHHRKGPARFRTLDFGERNGYQKGVVTEIIHDPGRGAPLARVTFRHPFRYQHQKELFVAAEGMYTGQFIFCGKKANLVVGNVLPLRSIPEGAVVCNVEHHVGDRGSFARASGDYAVVISHNPDNGTSRIKLPSGAKKIVPSGCRAMIGQVAGGGRTEKPMLKAGNAYHKFRVKRNCWPVVRGVAMNPVEHPHGGGNHQHIGHASTVRRDAPPGQKVGLIAARRTGRLRGQAASAAAKEKA

SEQ ID NO: 8109 - protein, 261 aa, Pseudotsuga menziesii
MGRVIRAQRKGAGSVFRSHTHHRKGPARFRSLDYGERNGYIKGIVSDVIHDPGRGAPLCRVTFRHPFRYRHQKELFIAAEGMYTGQFIYCGKKANLIVGNVLPLRSIPEGAVVCNVEQHVGDRGSFARASGDYAIVVSHNVDNGTSRIKLPSGAKKIVPSSCRAMIGQVAGGGRTEKPMLKAGNAYHKYRVKRNCWPKVRGVAMNPVEHPHGGGNHQHIGHASTVRRDAPPGQKVGLIAARRTGRLRGQAASAASKVDKTT

SEQ ID NO: 8110 - protein, 260 aa, Sequoia sempervirens
MGRVIRAQRKGAGSVFKSHTHHRKGPARFRSLDYGERNGYLKGIVTEVVHDPGRGAPLCRVNFRHPFRYRQQKELFIAAEGMYTGQFIYCGKKANLTVGNVLPLRSIPEGAVVCNVEQHVGDRGSFARASGDYAIVISHNPDNGTSRVKLPSGAKKIVPSSCRAMIGQVAGGGRTEKPMLKAGNAYHKYRVKRNSWPKVRGVAMNPVEHPHGGGNHQHIGHASTVRRDAPPGQKVGLIAARRTGRLRGQAATAAAKTDKA

SEQ ID NO: 8111 - protein, 260 aa, Taxus baccata
MGRVIRAQRKGAGSVFKSHTHHRKGPARFRSLDYGERNGYLKGIVAEVVHDPGRGAPLCRVNFRHPFRYRQQKELFIAAEGMYTGQFIYCGKKANLTVGNVLPLRSIPEGAVVCNVEQHVGDRGSFARASGDYAIVISHNPDNGTSRIKLPSGAKKIVPSSCRAMIGQVAGGGRTEKPMLKAGNAYHKYRVKRNCWPKVRGVAMNPVEHPHGGGNHQHIGHASTVRRDAPPGKKVGLIAARRTGRLRGQAATAAAKTDKA

SEQ ID NO: 8112 - protein, 261 aa, Tripterygium wilfordii
MGRVIRSQRKGAGSVFKSHTHHRKGPARFRSLDFGERNGYLRGVVSEIIHDPGRGAPLARVVFRHPFRYKHQKELFVAAEGMYTGQFIYCGKKANLMVGNVLPLRAIPEGAVVCNVEHHVGDRGVLARASGDYAIVISHNPDNGTTRVKLPSGAKKIVPSGCRAMIGQVAGGGRTEKPLLKAGNAYHKYRVKRNCWPKVRGVAMNPVEHPHGGGNHQHIGHASTVSRFAPPGQKVGLIAARRTGRLRGQAAAAASKSDKGS

SEQ ID NO: 8113 - protein, 175 aa, Brassica juncea
MYTGQFLYCGKKATLVVGNVLPLRSIPEGAVVCNVEHHVGDRGVFARASGDYAIVIAHNPDNDTTRVKLPSGSKKIVPSGCRAMIGQVAGGGRTEKPMLKAGNAYHKYRVKRNCWPKVRGVAMNPVEHPHGGGNHQHIGHASTVRRDAPPGQKVGLIAARRTGRLRGQAAASAAK

SEQ ID NO: 8114 - protein, 84 aa, Malus domestica
MLVVTSSVRMLDWVHSHTTNLGPAVPLHSELVVSITSLEHWLFCSSSSCNLPNHSTAPTWNNLLGSRRKFDPVSLSGLWLITTA

SEQ ID NO: 8115 - protein, 258 aa, Unknown
  Sequence found in Organisms: Brassica napus, Brassica juncea
MGRVIRAQRKGAGSVFKSHTHHRKGPAKFRSLDFGERNGYLKGVVTEIIHDPGRGAPLARVSFRHPFRYKKQKELFVAAEGMYTGQFLYCGKKATLVVGNVLPLRSIPEGAVVCNVEHHVGDRGVLARASGDYAIVISHNPDNDTTRVKLPSGSKKIVPSGCRAMIGQVAGGGRTEKPMLKAGNAYHKYRVKRNCWPKVRGVAMNPVEHPHGGGNHQHIGHASTVRRDAPPGQKVGLIAARRTGRLRGQAAALASKQE

SEQ ID NO: 8116 - protein, 258 aa, Unknown
  Sequence found in Organisms: Brassica napus, Brassica juncea, Brassica oleracea, Brassica rapa, Raphanus sativus
MGRVIRAQRKGAGSVFKSHTHHRKGPAKFRSLDFGERNGYLKGVVTEIIHDPGRGAPLARVAFRHPFRYKKQKELFVAAEGMYTGQFLYCGKKATLVVGNVLPLRSIPEGAVVCNVEHHVGDRGVLARASGDYAIVISHNPDNDTTRVKLPSGSKKIVPSGCRAMIGQVAGGGRTEKPMLKAGNAYHKYRVKRNCWPKVRGVAMNPVEHPHGGGNHQHIGHASTVRRDAPPGQKVGLIAARRTGRLRGQAAALASKQE

SEQ ID NO: 8117 - protein, 259 aa, Unknown
  Sequence found in Organisms: Abies balsamea, Cedrus atlantica
MGRVIRAQRKGAGSVFRSHTHHRKGPARFRSLDYGERNGYIRGIVTDVIHDPGRGAPLCKVTFRHAFRYKHQKELFVAAEGMYTGQFVYCGKKANLTVGNVLPLRSIPEGAVVCNVEQHVGDRGSFARASGDYAIVVSHNPDNGTTRVKLPSGAKKIVPSSCRAMIGQVAGGGRTEKPMLKAGNAYHKYRVKRNCWPKVRGVAMNPVEHPHGGGNHQHIGHASTVRRDAPPGQKVGLIAARRTGRLRGQAASAAAKTDN

SEQ ID NO: 8118 - protein, 261 aa, Abies balsamea
MGRVIRAQRKGAGSVFRSHTHHRKGPARFRSLDYGERNGYIKGIVSDVIHDPGRGAPLCRVTFRHPFRYRHQKELFIAAEGMYTGQFVYCGKKANLIVGNVLPLRSIPEGAVVCNVEQHVGDRGSFARASGDYAIVVSHNLDNGTSRIKLPSGAKKIVPSSCRAMIGQVAGGGRTEKPMLKAGNAYHKYRVKRNCWPKVRGVAMNPVEHPHGGGNHQHIGHASTVRRDAPPGQKVGLIAARRTGRLRGQAASAAAKTDKTS

SEQ ID NO: 8119 - protein, 261 aa, Antirrhinum majus
MGRVIRAQRKGAGSVFRSHTHHRKGPARFRTLDFGERNGYQKGVVTEIIHDPGRGAPLARVTFRHPFRYQHQKELFVAAEGMYTGQFVYCGKKANLVVGNVLPLRSIPEGAVVCNVEHHVGDRGSFARASGDYAVVISHNPDNGTTRVKLPSGAKKIVPSGCRAMVGQVAGGGRTEKPLLKAGNAYHKFRVKRNSWPKVRGVAMNPVEHPHGGGNHQHIGHASTVRRDAPPGQKVGLIAARRTGRLRGQAAATAAKSDKGS

SEQ ID NO: 8120 - protein, 258 aa, Arabidopsis thaliana [sequence omitted]

SEQ ID NO: 8121 - protein, 258 aa, Arabidopsis thaliana
MGRVIRAQRKGAGSVFKSHTHHRKGPAKFRSLDFGERNGYLKGVVTEIIHDPGRGAPLARVAFRHPFRFKKQKELFVAAEGMYTGQFLYCGKKATLVVGNVLPLRSIPEGAVICNVEHHVGDRGVFARASGDYAIVIAHNPDNDTSRIKLPSGSKKIVPSGCRAMIGQVAGGGRTEKPMLKAGNAYHKYRVKRNCWPKVRGVAMNPVEHPHGGGNHQHIGHASTVRRDAPPGKKVGLIAARRTGRLRGQAAALASKAD

SEQ ID NO: 8122 - protein, 258 aa, Unknown
  Sequence found in Organisms: Brassica napus, Brassica juncea, Brassica oleracea, Brassica rapa, Raphanus sativus
MGRVIRAQRKGAGSVFKSHTHHRKGPAKFRSLDFGERNGYLKGVVTEIIHDPGRGAPLARVAFRHPFRYKKQKELFVAAEGMYTGQFLYCGKKATLVVGNVLPLRSIPEGAVVCNVEHHVGDRGVFARASGDYAIVIAHNPDNDTTRVKLPSGSKKIVPSGCRAMIGQVAGGGRTEKPMLKAGNAYHKYRVKRNCWPKVRGVAMNPVEHPHGGGNHQHIGHASTVRRDAPPGQKVGLIAARRTGRLRGQAAALASKQE

SEQ ID NO: 8123 - protein, 258 aa, Brassica oleracea
  misc_feature (88)..(88): Xaa can be any naturally occurring amino acid
MGRVIRAQRKGAGSVFKSHTHHRKGPAKFRSLDFGERNGYLKGVVTEIIHDPGRGAPLARVAFRHPFRYKKQKELFVAAEGMYTGQFXYCGKKATLVVGNVLPLRSIPEGAVVCNVEHHVGDRGVLARASGDYAIVISHNPDNDTTRVKLPSGSKKIVPSGCRAMIGQVAGGGRTEKPMLKAGNAYHKYRVKRNCWPKVRGVAMNPVEHPHGGGNHQHIGHASTVRRDAPPGQKVGLIAARRTGRLRGQAAALASKQE

SEQ ID NO: 8124 - protein, 256 aa, Cleome gynandra
MGRVIRAQRKGAGSVFKSHTHHRKGPAKFRSLDFGERNGYLKGVVTEIIHDPGRGAPLARVVFRHPFRYKKQKELFVAAEGMYTGQFVYCGKRASLVVGNVLPLRSIPEGAVVCNVEHHVGDRGVFARASGDYAIVIAHNPDNDTTRIKLPSGSKKIVPSGCRAMVGQVAGGGRTEKPLLKAGNAYHKFRVKRNCWPKVRGVAMNPVEHPHGGGNHQHIGHASTVRRDAPPGQKVGLIAARRTGRLRGQAAATAAK

SEQ ID NO: 8125 - protein, 258 aa, Cleome gynandra
MGRVIRAQRKGAGSVFKSHTHHRKGPAKFRSLDFGERNGYLKGVVTEIIHDPGRGAPLARVVFRHPFRYKKQKELFVAAEGMYTGQFVYCGKRASLVVGNVLPLRSIPEGAVVCNVEHHVGDRGVLARASGDYAIVIAHNPDNDTTRIKLPSGSKKIVPSGCRAMIGQVAGGGRTEKPLLKAGNAYHKFRVKRNSWPKVRGVAMNPVEHPHGGGNHQHIGHASTVRRDAPPGQKVGLIAARRTGRLRGQAAATAAKAD

SEQ ID NO: 8126 - protein, 260 aa, Cryptomeria japonica
MGRVIRAQRKGAGSVFKSHTHHRKGPARFRSLDYGERNGYLKGIVTEVVHDPGRGAPLCRVNFRHPFRYRQQKELFIAAEGMYTGQFIYCGKKANLTVGNVLPLRSIPEGAVVCNVEQHVGDRGSFARASGDYAIVISHNPDNGTSRVKLPSGAKKIVPSSCRAMIGQVAGGGRTEKPMLKAGNAYHKFRVKRNCWPKVRGVAMNPVEHPHGGGNHQHIGHASTVRRDAPPGQKVGLIAARRTGRLRGQAATAASKTDKA

SEQ ID NO: 8127 - protein, 258 aa, Euonymus alatus
MGRVIRAQRKGAGSIFKSHTHHRKGPARFRSLDFGERNGYLRGVVSEIIHDPGRGAPLARVVFRHPFRYKHQKELFVAAEGMYTGQFIYCGKKANLMVGNVLPLRAIPEGAVVCNVEHHVGDRGVLARASGDYAIVISHNPDNGTTRVKLPSGSKKIVPSGCRAMIGQVAGGGRTEKPMLKAGNAYHKYRVKRNCWPKVRGVAMNPVEHPHGGGNHQHIGHASTVSRYAPPGQKVGLIAARRTGRLRGQAAAAASKSD

SEQ ID NO: 8128 - protein, 260 aa, Linum usitatissimum
MGRVIRAQRKGAGSVFKSHTHHRKGPARFRSLDFGERNGYLKGVITEVIHDPGRGAPLVRVSFRHPFRYQKQKELFVAAEGMYTGQFVYCGKKANLMVGNVLPLRSIPEGGVVCNVEHHVGDRGAFARCSGDYAIVISHNPDNDTTRVKLPSGAKKIVPSGCRAMIGQVAGGGRTEKPMLKAGNAYHKFRVKRNCWPKVRGVAMNPVEHPHGGGNHQHIGHASTVRRDAPPGQKVGLIAARRTGRLRGQAAASAAKTDKA

SEQ ID NO: 8129 - protein, 259 aa, Allium cepa
MGRVIRAQRKGAGGIFKSHTHHRKGPARFRSLDFSERNGYLKGVITDIIHDPGRGAPLARVRFRHPFRYKHEKELFVAAEGMYTGQFVYCGKKANLMVGNVLPLSSIPEGAVICNVEHHVGDRGVLARASGDYAIVISHNPDNGTSRIKLPSGAKKIVPSGCRAMIGQVAGGGRTEKPLLKAGNAYHKYRVKRNCWPKVRGVAMNPVEHPHGGGNHQHIGHASTVRRDAPPGQKVGLIAARRTGRLRGQAAASASKADK

SEQ ID NO: 8130 - protein, 258 aa, Raphanus sativus
MGRVIRAQRKGAGSVFKSHTHHRKGPAKFRSLDYGERNGYLKGVVTEIIHDPGRGAPLARVAFRHPFRYKKQKELFVAAEGMYTGQFLYCGKKATLVVGNVLPLRAIPEGAVVCNVEHHVGDRGVLARASGDYAIVISHNPDNDTTRVKLPSGSKKIVPSGCRAMIGQVAGGGRTEKPMLKAGNAYHKYRVKRNSWPKVRGVAMNPVEHPHGGGNHQHIGHASTVRRDAPPGQKVGLIAARRTGRLRGQAAASAAKAD

SEQ ID NO: 8131 - protein, 260 aa, Silene vulgaris
MGRVIRAQRKGAGSIFKSHTHHRKGAAKLRTLDFGERNGYLKGVITDIIHDPGRGAPLAKVTFRHPFRYKHQKELFVAAEGMYTGQFLYCGKKANLMVGNVLPLRSIPEGAVVCNVEHHVGDRGVFARASGDYAIVISHNPDNDTSRVKLPSGAKKVVPSGCRAMIGQIAGGGRTEKPLLKAGNAYHKFRVKRNCWPKVRGVAMNPVEHPHGGGNHQHIGHASTVRRDAPPGQKVGLIAARRTGRLRGQAASAASKSDKA

SEQ ID NO: 8132 - protein, 261 aa, Picea glauca
MGRVIRAQRKGAGSVFRSHTHHRKGPARFRSLDYGERNGYIKGIVSDVIHDPGRGAPLCKVTFRHPFRYRHQKELFVAAEGMYTGQFVYCGKKANLIVGNVLPLRSIPEGAIVCNVEQHVGDRGSFARASGDYAIVVSHNFDNGTSRIKLPSGAKKIVPSSCRAMIGQVAGGGRTEKPMLKAGNAYHKYRVKRNCWPKVRGVAMNPVEHPHGGGNHQHIGHASTVRRDAPPGQKVGLIAARRTGRLRGQAATAASKTDKTS

SEQ ID NO: 8133 - protein, 258 aa, Unknown
  Sequence found in Organisms: Thellungiella halophila, Eutrema halophilum
MGRVIRAQRKGAGSVFKSHTHHRKGPAKFRSLDFGERNGYLKGVVTEIIHDPGRGAPLARVSFRHPFRYKKQKELFVAAEGMYTGQFLYCGKKATLVVGNVLPLRAIPEGAVVCNVEHHVGDRGVLARASGDYAIVIAHNPDSDTTRIKLPSGSKKIVPSGCRAMIGQVAGGGRTEKPMLKAGNAYHKYRVKRNSWPKVRGVAMNPVEHPHGGGNHQHIGHASTVRRDAPPGQKVGLIAARRTGRLRGQAAASAAKAD

SEQ ID NO: 8134 - protein, 260 aa, Vinca minor
MGRVIRAQRKGAGSVFKSHTHHRKGPAKFRSLDFGERNGYLKGVITEIIHDPGRGAPLARVTFRHPFRFQHQKELFVAAEGMYTGQFVYCGKKANLMVGNVLPLRSIPEGAVVCNVEHKMGDRGVFARASGDYAIVISHNPDNGTTRVKLPSGSKKIVPSGCRAMIGQVAGGGRTEKPMLKAGNAYHKYRVKRNSWPKVRGVAMNPVEHPHGGGNHQHIGHASTVRRDAPPGQKVGLIAARRTGRLRGQAAASASKADKA

SEQ ID NO: 8135 - protein, 258 aa, Brassica juncea
MGRVIRAQRKGAGSIFKSHTHHRKGPAKFRSLDYGERNGYLKGVVTEIIHDPGRGAPLARVAFRHPFRYKKQKELFVAAEGMYTGQFLYCGKKATLVVGNVLPLRAIPEGAVVCNVEHHVGDRGVLARASGDYAIVISHNPDNDTTRIKLPSGSKKIVPSGCRAMIGQVAGGGRTEKPMLKAGNAYHKYRVKRNSWPKVRGVAMNPVEHPHGGGNHQHIGHASTVRRDAPPGQKVGLIAARRTGRLRGQAAASAAKAD

SEQ ID NO: 8136 - protein, 257 aa, Brassica juncea
GRVIRAQRKGAGSVFKSHTHHRKGPAKFRSLDFGERNGYLKGVVTEIIHDPGRGAPLARVAFRHPFRYKKQKELFVAAEGMYTGQFLYCGKKATLVVGNVLPLRSIPEGAVVCNVEHHVGDRGVLARASGDYAIVISHNPDNDTTRVKLPSGSKKIVPSGCRAMIGQVAGGGRTEKPMLKAGNAYHKYRVKRNCWPKVRGVAMNPVEHPHGGGNHQHIGHASTVRRDAPPGQKVGLIAARRTGRLRGQAAALASKQE

SEQ ID NO: 8137 - protein, 258 aa, Brassica juncea
MGRVIRAQRKGAGSVFKSHTHHRKGPAKFRSLDFGERNGYLKGVVTEIIHDPGRGAPLARVAFRHPFRYKKQKELFVAAEGMYTGQFLYCGKKATLVVGNVLPLRSIPEGAVVCNVEHHVGDRGVLARASGDYAIVIAHNPDNDTTRVKLPSGSKKIVPSGCRAMIGQVAGGGRTEKPMLKAGNAYHKYRVKRNCWPKVRGVAMNPVEHPHGGGNHQHIGHASTVRRDAPPGQKVGLIAARRTGRLRGQAAALASKQE

SEQ ID NO: 8138 - protein, 258 aa, Brassica oleracea
  misc_feature (239)..(239): Xaa can be any naturally occurring amino acid
  misc_feature (245)..(245): Xaa can be any naturally occurring amino acid
  misc_feature (257)..(257): Xaa can be any naturally occurring amino acid
MGRVIRAQRKGAGSVFKSHTHHRKGPAKFRSLDYGERNGYLKGVVTEIIHDPGRGAPLARVAFRHPFRYKKQKELFVAAEGMYTGQFLYCGKKATLVVGNVLPLRAIPEGAVVCNVEHHVGDRGVLARASGDYAIVISHNPDNDTTRIKLPSGSKKIVPSGCRAMIGQVAGGGRTEKPMLKAGNAYHKYRVKRNSWPKVRGVAMNPVEHPHGGGNHQHIGHASTVRRDAPPGQKVGLIXARRTGXLRGQAAASAAKXD

SEQ ID NO: 8139 - protein, 258 aa, Brassica rapa
MGRVIRAQPKGAGSVFKSHTHHRKGPAKFRSLDYGERNGYLKDVVTEIIHDPGRGAPLARVAFRHPFRYKKQKELFVAAEGMYTGQFLYCGKKATLVVGNVLPLRAIPEGAVVCNVEHHVGDRGVLARASGDYAIVISHNPDNDTTRIKLPSGSKKIVPSGCRAMIGQVAGGGRTEKPMLKAGNAYHKYRVKRNSWPKVRGVAMNPVEHPHGGGNHQHIGHASTVRRDAPPGQKVGLIAARRTGRLRGQAAASAAKAD

SEQ ID NO: 8140 - protein, 261 aa, Humulus lupulus
MGRVIRAQRKGAGSVFKSHTHHRKGPARFRSLDFGERNGYLKGVVTDIIHDPGRGAPLARVTFRHPFRYKHQKELFIAAEGLYSGQFIYCGKKANLVVGNVLPLRSLPEGTVICNVEHHVGDRGVLARASGDYAVVISHNPDNGTSRVKLPSGAKKILPSGCRAMIGQVAGGGRTEKPMLKAGNAYHKFRVKRNSWPKVRGVAMNPVEHPHGGGNHQHIGHASTVPRDAAPGQKVGLIAARRTGRLRGQAAAAASKSDKGS

SEQ ID NO: 8141 - protein, 260 aa, Silene vulgaris
MGRVIRAQRKGAGSIFKSHTHHRKGAAKLRTLDFGERNGYLKGVITDIIHDPGRGAPLAKVTFRHPFRYKHQKELFVAAEGMYTGQFLYCGKKANLMVGNVLPLRSIPEGAVVCNVEHHVGDRGVFARASGDYAIVISHNPDNDTSRVKLPSGAKKVVPSGCRAMIGQIAGGGRTEKPLLKAGNAYHKFRVKRNCWPKVRGVAMNPVEHPHGGGNHQHIGHASTVCRDAPPGQKVGLIAARRTGRLRGQAASAASKSDKA

SEQ ID NO: 8142 - protein, 259 aa, Picea glauca
MGRVIRAQRKGAGSVFTSHTHHRKGPARFRSLDYGERNGYIRGIVTDVIHDPGRGAPLCKVTFRHAFRYRHQKELFVAAEGMYTGQFVYCGKKANLTVGNVLPLRSIPEGAVVCNVEQHVGDRGSFARASGDYAIVVSHNPDNGTTRVKLPSGAKKIVPSSCRAMIGQVAGGGRTEKPMLKAGNAYHKYRVKRNCWPKVRGVAMNPVEHPHGGGNHQHIGHASTVRRDAPPGQKVGLIAARRTGRLRGQAASAAAKTDN

SEQ ID NO: 8143 - protein, 258 aa, Brassica juncea
MGRVIRAQRKGAGSVFKSHTHHRKGPAKFRSLDFDERNGYLKGVVTEIIHDPGRGAPLARVSFRHPFRYKKQKELFVAAEGMYTGQFLYCGKKATLVVGNVLPLRSIPEGAVVCNVEHHVGDRGVLARASGDYAIVISHNPDNDTTRVKLPSGSKKIVPSGCRAMIGQVAGGGRTEKPMLKAGNAYHKYRVKRNCWPKVRGVAMNPVEHPHGGGNHQHIGHASTVRRDAPPGQKVGLIAARRTGRLRGQAAALASKQE

SEQ ID NO: 8144 - protein, 227 aa, Malus domestica
MSNMLVITSSMRMLDWVHSHTTNLGPAVPLHSELVVSITSLEHWLFCSSSTCNLPNHSTAPAWNNLLGSRRKLDPVRTSIVVRVVADNNSVITRRPSEGSAVPNMVLDVTDDSSLRDRSERQHIPDHQIGLLPAVDELTGVDSLGGNEELVLLLVPKRMAEADAGQRGTATRIVDDLGDDTLEVAVALAEVEAPEAGRTLAVVGVRLENGARTLTLSSDNPPHSSGE

SEQ ID NO: 8145 - protein, 258 aa, Brassica juncea
MGRVIRAQRKGAGSIFKSHTHHRKGPAKFRSLDFGERNGYLKGVVTEIIHDPGRGAPLARVAFRHPFRYKKQKELFVAAEGMYTGQFLYCGKKATLVVGNVLPLRSIPEGAVVCNVEHHVGDRGVFARASGDYAIVIAHNPDNDTTRVKLPSGSKKIVPSGCRAMIGQVAGGGRTEKPMLKAGNAYHKYRVKRNCWPKVRCVAMNPVEHPHGGGNHQHIGHASTVRRDAPPGQKVGLIAARRTGRLRGQAAALASKQE

SEQ ID NO: 8146 - protein, 254 aa, Ocimum basilicum
RAQRKGAGSVFKPHTHHRKGPARFRSLDFGERNGYLKGVVSEIIHDPGRGAPLARVTFRHPFRYQHQKELFVAAEGMYTGMFVYCGKKANLVVGNVLPLRSIPEGAVVCNVEHHVGDRGVFARASGDYAIVISHNPDNGTTRIKLPSGAKKIVPSGCRAMVGQVAGGGRTEKPMLKAGNAYHKFRVKRNSWPKVRGVAMNPVEHPHGGGNHQHIGHASTVRRDAPPGQKVGLIAARRTGRLRGQAAATAAKEKA

SEQ ID NO: 8147 - protein, 256 aa, Brassica napus
RVIRAQRKGAGSVFKSHTHHRKGPAKFRSLDFGERNGYLKGVVTEIIHDPGRGAPLARVAFRHPFRYKKQKELFVAAEGMYTGQFLYCGKKATLVVGNVLPLRSIPEGAVVCNVEHHVGDRGVLARASGDYAIVISHNPDNDTTRVKLPSGSKKIVPSGCRAMIGQVAGGGRTEKPMLKAGNAYHKYRVKRNCWPKVRGVAMNPVEHPHGGGNHQHIGHASTVRRDAPPGQKVGLIAARRTGRLRGQAAALASKQE

SEQ ID NO: 8148 - protein, 260 aa, Unknown
  Sequence found in Organisms: Citrus sinensis, Citrus clementina
MGRVIRAQRKGAGSVFKSHTHHRKGPAQFRSLDFGERNGYLKGVVAEIIHDPGRGAPLARVTFRHPFRYMKQKELFIAAEGMYTGQFVYCGKKATLMVGNVLPVRSIPEGAVVCNVEHHVGDRGVLARASGDYAVIISHNPDNDTTRVKLPSGAKKIIPSGCRAMIGQVAGGGRTEKPLLKAGNAYHKFRVKRNCWPKVRGVAMNPVEHPHGGGNHQHIGHASTVRRDAPPGQKVGLIAARRTGRLRGQAAATAAKADKA

SEQ ID NO: 8149 - protein, 260 aa, Fagopyrum esculentum
MGRVIRAQRKGAGSVFKSHTHHRKGAAKLRTLDFGERNGYLKGVITEIIHDPGRGAPLAKVTFRHPFRFKHQKELFVAAEGMYTGQFIYCGKKANLMVGNVLPLRSIPEGAVVCNVEHHVGDRGTLARASGDYAIVISHNPDNDTSRIKLPSGAKKIVPSGCRAMIGQVAGGGRTEKPLLKAGNAYHKFRVKRNSWPKVRGVAMNPVEHPHGGGNHQHIGHASTVRRDSAPGQKVGLIAARRTGRLRGQAASAASKSDKA

SEQ ID NO: 8150 - protein, 261 aa, Humulus lupulus
MGRVIRAQRKGAGSVFKSHTHHRKGPARFRSLDFGERNGYLKGVVTDIIHDPGRGAPLARVTFRHPFRYKHQKELFIAAEGLYSGQFIYCGKKANLVVGNVLPLRSLPEGTVICNVEHHVGDRGVLARASGDYAVVISHNPDNGTSRVKLPSGAKKILPSGCRAMIGQVAGGGRTEKPMLKAGNAYHKFRVKRNSWPKVRGVAMNPVEHPHGGGNHQHIGHASTIARDAAPGQKVGLIAARRTGRLRGQAAAAASKSDKGS

SEQ ID NO: 8151 - protein, 259 aa, Pseudotsuga menziesii
MGRVIRAQRKGAGSVFTSHTHHRKGPARFRSLDYGERNGYIRGIVTDVIHDPGRGAPLCKVTFRHAFRYKHQKELFVAAEGMYTGQFVYCGKKANLTVGNVLPLRSIPEGAVVCNVEQHVGDRGSFARASGDYAIVVSHNPDNGMTRVKLPSGAKKIVPSSCRAMIGQVAGGGRTEKPMLKAGNAFHKYRVKRNCWPKVRGVAMNPVEHPHGGGNHQHIGHASTVRRDAPPGQKVGLIAARRTGRLRGQAASAAAKTDN

SEQ ID NO: 8152 - protein, 258 aa, Zostera marina
MGRVIRAQRKGAGSIFRSHTHHRKGPAQFRSLDFGERNGYIKGVITDIIHDPGRGAPLARVTFRHPFRYRHQKELFVAAEGMYTGQFVYCGKKANLMVGNVLPIRSIPEGAVVCNVEHHVGDRGSFARCSGDYAIVISHNPDNGTSRIKLPSGAKKIVASGCRAMVGQVAGGGRTEKPMLKAGNAYHKYRVKRNCWPKVRGVAMNPVEHPHGGGNHQHIGHASTVRRDAPPGQKVGLIAARRTGRLRGQAAATASKAE

SEQ ID NO: 8153 - protein, 261 aa, Carpinus betulus
MGRVIRAQRKGAGSVFRSHTHHRKGPAQFRSLDYGERNGYIRGVVTEIIHDPVGALRWPGCSSATPSGTSSRRSSSWPPRACTPASSCTAERRPTSWSATCCPSGPSLKVRWCATSSTMWATVGSWLGPLGDYAIVISHNPDNGTSRIKLPSGAKKIVPSNCRAMVGQVAGGGRTEKPMLKAGNAYHKFRVKRNCWPKVRGVAMNPVEHPHGGGNHQHIGHASTVRRDAPPGQKVGLIAARRTGRLRGQAAATASKADKSA

SEQ ID NO: 8154 - protein, 188 aa, Artemisia annua
MGRVIRAQRKGAGSIFKSHTHHRKGPARFRSLDFGERNGYLKGVITEIIHDPGRGAPLAKVTFRHPFRYKHQKELFVAAEGMYTGQFVFCGKKANLMVGNVLPIGMIPEGGVVCNVEHHVGDRGSFARASGDYAIVISHNPDNGTSRVKLPSGAKKIVPSGCRAMIGQVAGGGRTENSRQVTHITNSV

SEQ ID NO: 8155 - protein, 257 aa, Epimedium sagittatum
SDQSSTKGAGSVFKSHTHHRKGPARFRSLDFGERNGYLKGVVTEIIHDPGRGAPLARVTFRHPFRYKHQKELFVAAEGMYTGQFVYCGKKANLMVGNVLPLNSIPEGAVVCNVEHHVGDRGTLARASGDYAIVISHNPDNGTSRIKLPSGAKKIVPSGCRAMIGQVAGGGRTEKPMLKAGNAYHKYRVKRNCWPKVRGVAMNPVEHPHGGGNHQHIGHASTVRRDAPPGKKVGLIAARRTGRLRGQAAATASKADKS

SEQ ID NO: 8156 - protein, 259 aa, Beta vulgaris
MGRVIRAQRKGAGSVFKSHTHHRKGAAKFRTLDFGERNGYLKGVITEIIHDPGRGAPLARVTFRHPFRYKHQKELFVAAEGMYSGQFVYCGKKANLMVGNVLPLRSIPEGAVVCNVEHHVGDRGVLARASGDYAIVISHNPDNDTSRIKLPSGSKKIVPSGCRAMIGQVAGGGRTEKPLLKAGNAYHKYRVKRNCWPKVRGVAMNPVEHPHGGGNHQHIGHASTVRRDAPPGQKVGLIAARRTGRLRGQAAAMVHKAQA

SEQ ID NO: 8157 - protein, 254 aa, Centaurea maculosa
RGVSLRAQRKGAGSVFKSHTHHRKGPARFRSLDFGERNGYLKGVITEIIHDPGRGAPLARVTFRHPFRYKHQKELFVAAEGMYTGQFVFCGKKANLMVGNVLPLRSIPEGAVVCNVEHHVGDRGSFARASGDYAIVISHNPDNGTTRVKLPSGAKKIVPSGCRAMIGQVAGGGRTEKPMLKAGNAYHKFRVKRNCWPKVRGVAMNPVEHPHGGGNHQHIGHASTVRRDAPPGQKVGLIAARRTGRLRGQAAATA

SEQ ID NO: 8158 - protein, 258 aa, Cephalotaxus harringtonia
RVIRAQRKGAGSVFKSHTHHRKGPARFRSLDYGERNGYLKGIVAEVIHDPGRGAPLCRVNFRHPFRYRQQKELFIAAEGMYTGQFIYCGKKANLTVGNVLPLRSIPEGAVVCNVEQHVGDRGSFARASGDYAIVISHNPDNGTSRVKLPSGAKKIVPSSCRAMIGQVAGGGRTEKPMLKAGNAYHKYRVKRNCWPKVRGVAMNPVEHPHGGGNHQHIGHASTVRRDAPPGKKVGLIAARRTGRLRGQAATAASKTDKV

SEQ ID NO: 8159 - protein, 260 aa, Cryptomeria japonica
MGRVIRAQRKGAGSVFKSHTHHRKGPARFRSLDYGERNGYLKGIVTEVVHDPGRGAPLCRINFRHPFRYRQQKELFIAAEGMYTGQFIYCGKKANLTVGNVLPLRSIPEGAVVCNVEQHVGDRGSFARASGDYAIVISHNPDNGTSRVKLPSGAKKIVPSSCRAMIGQVAGGGRTEKPMLKAGNAYHKFRVKRNCWPKVRGVAMNPVEHPHGGGNHQHIGHASTVRRDAPPGQKVGLIAARRTGRLRGQAATAASKTEKT

SEQ ID NO: 8160 - protein, 261 aa, Distylium racemosum
MGRVIRAQRKGAGSVFRAHTHHRKGPAQFRSLDYSERNGYIKGIVTDVLHDPGRGAPLCRVTFRHPFRYKHQKELFVAAEGMYTGQFVYCGKKANLTVGNVLPLRSIPEGAIVCNVEQHAGDRGSFARASGDYAIVISHNPDNGTSRIKLPSGAKKIVPSSCRAMIGQVAGGGRTEKPMLKAGRAYHKYRVKRNCWPKVRGVAMNPVEHPHGGGNHQHIGHASTVRRDAPPGQKVGLIAARRTGRLRGQAATAASKTDKGS

SEQ ID NO: 8161 - protein, 261 aa, Pinus pinaster
MGRVIRAQRKGAGSVFRSHTHHRKGPARFRSLDYGERNGYIKGIVSDVIHDPGRGAPLLRVTFRHPFRYRHQKELYIAAEGMYTGQFIYCGKKANLTVGNVLPLKSIPEGAIVCNVEQHVGDRGSFARASGDYAIVVSHNFDNGTSRIKLPSGAKKIVPSSCRAMIGQVAGGGRTEKPMLKAGNAYHKYRVKRNSWPKVRGVAMNPVEHPHGGGNHQHIGHASTVRRDAPPGQKVGLIAARRTGRLRGQAASAAAKTDKTS

SEQ ID NO: 8162 - protein, 103 aa, Fagopyrum esculentum
MGRVIRAQRKGAGSVFKSHTHHRKGAAKLRTLDFGERNGYLKGVITEIIHDPGRGAPLAKVTFRHPSGSSTRRSSSSPPRVCTPVSSSTAVRRLTSWSEMCCL

SEQ ID NO: 8163 - protein, 177 aa, Flaveria ramosissima
MYTGQFVFCGKKANLMVGNVLPLRSIPEGAVVCNVEHHVGDRGSFARASGDYAIVISHNPDNGTTRVKLPSGAKKIVPSGCRAMIGQVAGGGRTEKPMLKAGNAYHKFRVKRNCWPKVRGVAMNPVEHPHGGGNHQHIGHASTVRRDAPPGQKVGLIAARRTGRLRGQAAATAAKAD

SEQ ID NO: 8164 - protein, 200 aa, Picea glauca
MYTGQFVTAVRRPILSWATCCLSDLFPREPSSAMWSNMSGTVVHLPELRETTPSSSATILINGTTRVKLPSGAKKIVPSSCRAMIGQVAGGGRTEKPMLKAGNAYHKYRVKGNCWPKVRGVAMNPVEHPHGGGNHQHIGHASTVRRDAPPGQKVGLIAARRTGRLRGQAASAAAKQTTNLSSFLFARISWFYFSVLFFVM

SEQ ID NO: 8165 - protein, 149 aa, Eutrema parvulum
MGRVIRAQRKGAGSVFKSHTHHRKGPAKFRSLDFGERNGYLKGVVTEIIHDPGRGAPLARVAFRHPFRYKKQKELFVAAEGMYTGQFLYCGKKATLVVGNVLPLRSIPEGAVVCNVEHHVGDRGVFARASGDYAIVIAHNPDNDTSRFK

SEQ ID NO: 8166 - protein, 222 aa, Scabiosa columbaria
MVTSRGVITEIIHDPGRGAPLARITFRHPFRFKHQKELFVAAEGMYTGQFVFCGKKANLMVGNVLPLRSIPEGAVVCNVEHHVGDRGVLARASGDYAIVISHNPDNGTSRIKLPSGAKKIVPSGCRAMIGQVAGGGRTEKPMLKAGNAYHKYRVKRNCWPKVRGVAMNPVEHPHGGGNHQHIGHASTVRRDAPPGQKVGLIAARRTGRLRGQAAATASKEKA

SEQ ID NO: 8167 - protein, 258 aa, Cannabis sativa
MGRVIRAQRKGAGSVFKSHTHHRKGPARFRSLDFGERNGYLKGVVTDIIHDPGRGAPLARVTFRHPFRYKHQKELFIAAEGLYSGQFIYCGKKANLVVGNVLPLRSLPEGTVICNVEHHVGDRGVLARASGDYAVVISHNPDNGTSRVKLPSGAKKILPSGCRAMIGQVAGGGRTEKPMLKAGNAYHKFRVKRNSWPKVRGVAMNPVEHPHGGGNHQHIGHASTIARDAAPGQKVGLIAARRTGRLRGQAAAAASKAD

SEQ ID NO: 8168 - protein, 252 aa, Brassica oleracea
  misc_feature (241)..(241): Xaa can be any naturally occurring amino acid
MGRVIRAQRKGAGSVFKSHTHHRKGPAKFRSLDYGERNGYLKGVVTEIIHDPGRGAPLARVAFRHPFRYKKQKELFVAAEGMYTGQFLYCGKKATLVVGNVLPLRAIPEGAVVCNVEHHVGDRGVLARASGDYAIVISHNPDNDTTRIKLPSGSKKIVPSGCRAMIGQVAGGGRTEKPMLKAGNAYHKYRVKRNSWPKVRGVAMNPVEHPHGGGNHQHIGHASTVRRDAPPGQKVGLIAAXRTGRLRGQAAA

SEQ ID NO: 8169 - protein, 247 aa, Fagus grandifolia
VFKSHTHHRKGPARFRSLDFGERNGYLKGVVTEIIHDPGRGAPLAKVTFRHPFRYKKQNELFVAAEGIYTGQFVYCGKKATLVVGNVLPLRSIPEGAVVCNVEHHVGDRGVFARASGDYAIVISHNPDNDTSRVKLPSGAKKIVPSGCRAMIGQVAGGGRTEKPMLKAGNAYHKFRVKRNCWPKVRGVAMNPVEHPHGGGNHQHIGHASTVRRDAPPGQKVGLIAARRTGRLRGQAAATAAKADKST

SEQ ID NO: 8170 - protein, 261 aa, Cycas rumphii
MGRVIRAQRKGAGSVFRAHTHHRKGPARFRSLDYGERNGYIKGVVTDVIHDPGRGAPLCRVTFRHPFRYRHQKELFVAAEGMYTGQFVYCGKKANLTVGNVLPLKSVPEGAIVCNVEHHVGDRGAFARASGDYAIVVSHNPDNGTTRVKLPSGAKKIVPSGCRAMIGQVAGGGRTEKPMLKAGNAYHKYKAKRNCWPKVRGVAMNPVEHPHGGGNHQHIGHASTVRRDAPPGQKVGLIAARRTGRLRGQAATAAAKTDKGA

SEQ ID NO: 8171 - protein, 251 aa, Flaveria ramosissima
MGRVIRAQRKGAGSVFKSHTHHRKGPARFRSLDFGERNGYLKGVITEIIHDPGRGAPLARVTFRHPFRYKHQKELFIAAEGMYTGQFVFCGKKANLMVGDVLPLRSIPEGAVVCNVEHHVGDRGSFARASGDYAIVISHNPDNGTTRVKLPSGAKKIVPSGCRAMIGQVAGGGRTEKPMLKAGNAYHKFRVKRNCWPKVRGVAMNPVEHPHGGGNHQHIGHASTVRRDAPPGQKVGLIAARRTGRLRGQAA

SEQ ID NO: 8172 - protein, 261 aa, Podocarpus macrophillus
MGRVIRAQRKGAGSVFRSHTHHRKGPAQFRSLDYSERNGYIKGIVSEVVHDPGRGAPLCRVTFRHPFRYRHQKELFVAAEGMYTGQFVYCGKKANLTVGNVLPLRSIPEGAIVCNVEQHVGDRGSFARASGDYAIVVSHNPDNGTSRIKLPSGAKKIVPSSCRAMIGQVAGGGRTEKPMLKAGRAYHKYRVKRNCWPKVRGVAMNPVEHPHGGGNHQHIGHASTVRRDAPPGQKVGLIAARRTGRLRGQAATAAAKTDKGS

SEQ ID NO: 8173 - protein, 256 aa, Camellia sinensis
MGRVIRAQRKGAGSVFKSHTHHRKGPARFRSLDFGERNGYLKGVITEIIHDPGRGAPLARVTFRHPFRFKHQKELFIAAEGMYTGQFVFCGKKANLMVGNVLPLRSIPEGAVVCNVEHHVGDRGVLARASGDYAIVISHNPDNGTSRIKLPSGAKKIVPSGCRAMIGQVAGGGRTEKPMLKAGNAYHKYRVKRNSWPKVRGVAMNPVEHPHGGGNHQHIGHASTVRRDAPPGQKVGLIAARRTGRLRGQPLLLLQG

SEQ ID NO: 8174 - protein, 251 aa, Juglans hindsii x Juglans regia
GGAGSVFKSHTHHRKGPARFRSLDFGERNGYLKGVVTEIIHDPGRGAPLARVTFRHPFRYKKQNELFVAAEGIYTGQFIYCGKKANLMVGNVLPLRSIPEGAVVCNVEHHVGDRGVFARASGDYAIVISHNPDNDTTRVKLPSGAKKIVPSGCRAMVGQVAGGGRTEKPLLKAGNAYHKFRVKRNCWPKVRGVAMNPVEHPHGGGNHQHIGHASTVRRDAPPGQKVGLIAARRTGRLRGQAAATASKSDKA

SEQ ID NO: 8175 - protein, 95 aa, Primula obconica
MGRVIRAQRKGAGSVFRSHTHHRKGQRASAASTSRNATDTPKESSLRSFMTPAAALPWLASPSVTSLGSSTRKSSWLQLKACILGSLSIAERKQI

SEQ ID NO: 8176 - protein, 249 aa, Brassica napus
MGRVIRAQRKGAGSVFKSHTHHRKGPAKFRSLDFGERNGYLKGVVTEIIHDPGRGAPLARVSFRHPFRYKKQKELFVAAEGMYTGQFLYCGKKATLVVGNVLPLRSIPEGAVVCNVEHHVGDRGVLARASGDYAIVISHNPDNDTTRVKLPSGSKKIVPSGCRAMIGQVAGGGRTEKPMLKAGNAYHKYRVKRNCWPKVRGVAMNPVEHPHGGGNHQHIGHASTVRRDAPPGQKVGLIAARRTGRLRGQ

SEQ ID NO: 8177 - protein, 260 aa, Marchantia polymorpha
MGRVIRAQRKGAGSIFRSHTHRRKGPARFRSLDYAERNGYIKGVVSDVIHDSGRGAPLAKVTFRHAFRFKHQKELFVAAEGMYTGQFLYCGKKAALTVGNVLPLRSVPEGAVVCNVEHRMGDRGAFARASGDYVIVISHNPDNGTSRIKLPSGAKKIVPSGCRAMIGQVAGGGRTEKPMLKAGNAYHKYKVKRNSWPKVRGVAMNPVEHPHGGGNHQHIGHASTVRRDAPPGQKVGLIAARRTGRLRGQAATAAAKTDKS

SEQ ID NO: 8178 - protein, 259 aa, Pinus pinaster
MGRVIRAQRKGAGSVFKSHTHHRKGPARFRSLDYGERNGYIRGIITDVIHDPGRGAPLCKVTFRHPFRYKHQKELFVAAEGMYSGQFVYCGKKANLTVGNVLPLRSIPEGAIVCNVEQNVGDRGSFARASGDYAIVVSHNIDNGTTRVKLPSGAKKIVPSGCRAMIGQVAGGGRTEKPMLKAGNAYHKYRVKRNSWPKVRGVAMNPVEHPHGGGNHQHIGHASTVRRDAPPGQKVGLIAARRTGRLRGQAASAAAKMDN

SEQ ID NO: 8179 - protein, 261 aa, Pinus taeda
MGRVIRAQRKGAGSVFRSHTHHRKGPARFRSLDYGERNGYIKGIVSDVIHDPGRGAPLLRVTFRHPFRYRHQKELYIAAEGMYTGQFIYCGKKANLTVGNVLPLKSIPEGAIVCNVEQHVGDRGSFARASGDYAIVVSHNFDNDTTRIKLPSGAKKIVPSSCRAMIGQVAGGGRTEKPMLKAGNAYHKYRVKRNSWPKVRGVAMNPVEHPHGGGNHQHIGHASTVRRDAPPGQKVGLIAARRTGRLRGQAASAAAKTDKTS

SEQ ID NO: 8180 - protein, 252 aa, Brassica juncea
AQRKGAGSVFKSHTHHRKGPAKFRSLDFGERNGYLKGVVTEIIHDPGRGAPLARVSFRHPFRYKKQKELFVAAEGMYTGQFLYCGKKATLVVGNVLPLRSIPEGAVVCNVEHHVGDRGVLARASGDYAIVISHNPDNDTTRVKLPSGSKKIVPSGCRAMIGQVAGGGRTEKPMLKAGNAYHKYRVKRNCWPKVRGVAMNPVEHPHGGGNHQHIGHASTVRRDAPPGQKVGLIAARRTGRLRGQAAALASKQE

SEQ ID NO: 8181 - protein, 259 aa, Allium cepa
MGRVIRAQRKGAGGIFKSHTHHRKGPARFRSIDYSERNGYLKGVITDIIHDPGRGAPLARVTFRNPLRYKHQKELFIAAEGMYTGQFVYCGRKANLMVGNVLPLSAIPEGAVICNVEHHVGDRGSLARASGDYAIVISHNPDNNTTRVKLPSGAKKILPSGCRAMIGQVAGGGRTEKPLLKAGNAYHKYRVKRNCWPKVRGVAMNPVEHPHGGGNHQHIGHASTVRRDAPPGQKVGLIAARRTGRLRGQAAASAAKEKA

SEQ ID NO: 8182 - protein, 258 aa, Brassica rapa
MGRVIRAQRKGAGSVFKSHTHHRKGPAKFRSLDFGERNGYLKGVVTEIIHDPGRGAPLARVSFRHPFRYKKQKELFVAAEGMYTGQFLYCGKKATLVVGNVLPLRSIPEGAVVCNVEHHVGDRGVLARASGDYAIVISHNPDNDTTRVKLPSGSKKIVPSGCRAMIGQVAGGGRTEKPMLKAGNAYHKHRVKRNCWPNVRGVAMNPVEHPHGAGNHQHIGHASTVRRDAQPGQKAGLIAARSTGRLRGQAAALASKQE

SEQ ID NO: 8183 - protein, 247 aa, Brassica juncea
MGRVIRAQRKGAGSVFKSHTHHRKGPAKFRSLDFGERNGYLKGVVTEIIHDPGRGAPLARVSFRHPFRYKKQKELFVAAEGMYTGQFLYCGKKATLVVGNVLPLRAIPEGAVVCNVEHHVGDRGVLARASGDYAIVISHNPDNDTTRIKLPSGSKKIVPSGCRAMIGQVAGGGRTEKPMLKAGNAYHKYRVKRNSWPKVRGVAMNPVEHPHGGGNHQHIGHASTVRRDAPPGQKVGLIAARRTGRLR

SEQ ID NO: 8184 - protein, 260 aa, Marchantia polymorpha
MGRVIRAQRKGAGSIFRSHTHRRKGPARFRSLDYAERNGYIKGVVSDVIHDSGRGAPLCRVTFRHAFRYKHQKELFVAAEGMYSGQFVYCGKKAALTVGNVLPLRSVPEGAVICNVEHRMGDRGAFARASGDYAIVISHNPDNGTSRIKLPSGAKKIVPSGCRAMIGQVAGGGRTEKPMLKAGNAYHKYKVKRNSWPKVRGVAMNPVEHPHGGGNHQHIGHASTVRRDAPPGQKVGLIAARRTGRLRGQAATAAAKTDKT

SEQ ID NO: 8185 - protein, 249 aa, Platanus occidentalis
GSVFKSHTHHRKGPARFRSLDFGERNGYLKGVVTEIVHDPGRGAPLARVTFRHPFRYKHQKELFVAAEGMYTGQFVYCGKKANLMVGNVLPLRSIPEGAVVCNVEHHVGDRGVLARASGDYAIVISHNPDNGTTRIKLPSGAKKIVPSGCRAMIGQVAGGGRTEKPLLKAGNAYHKYRVKRNCWPKVRGVAMNPVEHPHGGGNHQHIGHASTVRRDAPPGQKVGLIAARRTGRLRGQAAATASKAEKSS

SEQ ID NO: 8186 - protein, 120 aa, Cannabis sativa
LVGFGSSGGSLSSETTSPPGSNETDLLPRCSVSCNCTGMTNVLVVTTTMRMLHRVHSNTTNLRPAIPLHSELVVRISGLQHWLLGPASTGNLTNHSSASTWQNLLSSGWKLNSFHYPGCD

SEQ ID NO: 8187 - protein, 260 aa, Selaginella moellendorffii
MGRAIRAQRKGRGSVFKSHTHHRKGPARLRKLDFAERNGYIKGVVTDVIHDSGRGAPLCKVTFRHPFRFKHQKELMIAAEGIYSGQFMYCGKKAQLAIGNILPLRSVPEGAVVCNVEHRVGDRGAFARASGDYAIVVSHNPDMGTSRIKLPSGAKKVVPSGCRAMIGQVAGGGRTEKPLLKAGNAYHKFRVKRNSWPKVRGVAMNPVEHPHGGGNHQHIGHASTVRRDAPPGQKVGLIAARRTGRLRGQAASAAAKTEKA

SEQ ID NO: 8188 - protein, 246 aa, Papaver somniferum
YLKSHTHHRKGPARFRSLDFGERNGYLKGVVTEIIHDPGRGAPLARVTFRHPFRYKHQKELFVAAEGMYTGQFLYCGKKANLMVGNVLPLRSIPEGAVVCNVEHHVGDRGTLARASGDYAIVISHNPDNGTSRIKLPSGAKKIVPSGCRAMIGQVAGGGRTEKPMLKAGNAYHKYRVKRNSWPKVRGVAMNPVEHPHGGGNHQHIGHASTVRRDAPPGQKVGLIAARRTGRLRGQAASAAAKTDKA

SEQ ID NO: 8189 - protein, 71 aa, Zostera marina
MGRVIRAQRKGAGSIFRSHTHHRKGPARFRSLDFGERNGYIKGVITDVIHDPGRGTPLARVTFRHPFRYMH

SEQ ID NO: 8190 - protein, 188 aa, Brassica juncea
MGRVIRAQRKGAGSVFKSHTHHRKGPAKFRSLDYGERNGYLKGVVTEIIHDPGRGSPLARVAFRHPFRYKKQKELFVAAEGMYTGQFLYCGKKATLVVGNVLPLRSIPEGAVVCNVEHHVGDRGVLARASGDYAIVISHNPDNDTTRVKLPSGSKKIVPSGCRAMIGQVAGGGRSQCSRLVTRTTSTV

SEQ ID NO: 8191 - protein, 259 aa, Brassica rapa
MGRVIRAQRKGAAGSVFKSHTHHRKGPAKFRSLDYGERNGYLKGVVTEIIHDPGRGAPLARVDFRHPFRYKKQKELFVAAEGMYTGQFLYCGKKATLVVGNVLPLRSIPEGAVVCNVELHVGDRGALARASGDYAIVISHNPDNDTTRIKLPSGAKKIVQSGCRAMIGQVAGGGRTEKPLLKAGRAYHKYRVKRNCWPIVRGVAMNPVEHPHGGGNHQHIGHASTVRRDAPPGKKVGQIAARRTGRRRGAAAVESAKAD

SEQ ID NO: 8192 - protein, 242 aa, Platanus occidentalis
VFKSHTHHRKGPARFRSLDFGERNGYLKGVVTEIVHDPGRGAPLARVTFRHPFRYKHQKELFVAAEGMYTGQFVYCGKKANLMVGNVLPLRSIPEGAVVCNVEHHVGDRGVLARASGDYAIVISHNPDNGTSRIKLPSGAKKIVPSGCRAMIGQVAGGGRTEKPLLKAGNAYHKYRVKRNCWPKVRGVAMNPVEHPHGGGNHQHIGHASTVRRDAPPGRRLVLLLPGGLVVFEGKLLPQLQK

SEQ ID NO: 8193 - protein, 247 aa, Cleome spinosa
MGRVIRAQRKGAGSVFKSHAHHRKGPAKFRSLDFGERNGYLKGVVTEIIHDPGRGAPLARVVFRHPFRYKKQKELFVAAEGMYTGQFVYCGKRASLVVGNVLPLRSIPEGAVVCNVEHHVGDRGVFARASGDYAIVIAHNPDNDTTRIKLPSGSKKIVPSGCRAMVGQVAGGGRTEKPLLKAGNAYHKFRVKRNCWPKVRGVAMNPVEHPHGGGNHQHIGHASTVRRDAPPGQKVGLIAARRTGRLR

SEQ ID NO: 8194 - protein, 258 aa, Fagopyrum esculentum
MGRVIRSQRKGAGSIFKSHTHHRKGAAKLRTLDFGERNGYLKGVVTDIIHDPGRGAPLARVTFRHPFRFKHQKELFVAAEGMYTGQFIYCGKKANLVVGNVLPVRAIPEGAVVCNVEHHVGDRGVFARASGDYAIVISHNPDNDTTRVKLPSGSKKTIPSSCRAMVGQVAGGGRTEKPLLKAGNAYHKFRVKRNCWPKVRGVAMNPVEHPHGGGNHQHIGHASTVSRSSVPGQKVGLIAARRTGRLRGQAATAAAKSK

SEQ ID NO: 8195 - protein, 249 aa, Raphanus sativus
NPWVVSSELNVREQAPSSSPTLTTARAPPSSGASTSAREMVTSRVSSRRSSTIRVAVLRYKKQKELFVAAEGMYTGQFLYCGKKATLVVGNVLPLRSIPEGAVVCNVEHHVGDRGVLARASGDYAIVISHNPDNDTTRVKLPSGSKKIVPSGCRAMIGQVAGGGRTEKPMLKAGNAYHKYRVKRNCWPKVRGVAMNPVEHPHGGGNHQHIGHASTVRRDAPPGQKVGLIAARRTGRLRGQAAALASKQE

SEQ ID NO: 8196 - protein, 259 aa, Eutrema parvulum
MGCVIRAQRKGAAGSVFKSHTHHRKGPAKFRSLDYGERNGYLKGVVTEIIHDPGRGAPLARVSFRHPFRYKKQKELFVAAEGMYTGQSLYCGKKANLVVGNVLPLRSIPEGAVVCNVELHVGDRGALARASGDYAIVIAHNPDNDTTRIKLPSGSKKIVQSGCRAMIGQVAGGGRTEKPLLKAGNAYHKYRVKRNCWPKVRGVAMNPVEHPHGGGNHQHIGHASTVRRDKPAGAKVGLIAARRTGRLRGQAAASASKAD

SEQ ID NO: 8197 - protein, 250 aa, Sciadopitys verticillata
GAGSVFKSHTHHRKGPARFRSLDYGERNGYLKGIVKEVIHDPGRGAPLCRVAFRHPFRYRIQKELFIAAEGMYTGQFVYCGKKANLTVGNVLPLRSIPEGAVVCNVEQHVGDRGSFARASGDYAIVISHNPDNDTTRVKLPSGAKKIVPSSCRAMIGQVAGGGRTEKPMLKAGNAYHKYRVKRNCWPKVRGVAMNPVEHPHGGGNHQHIGHASTVRRDAPPGQKVGLIAARRTGRLRGQAATAAAKTDKA

SEQ ID NO: 8198 - protein, 240 aa, Phaseolus coccineus
MGRVIRAQRKGGGSVFKSHTHHRKGPARFRSLDFGERNGYLKGVVTDIIHDPGRGAPLAKVTFRHPFRYKKQTELFVSAEGLYTGQFLYCGKKATLVVGNVLPLRSIPEGAVICNVEHHVGDRGVFARASGDYAIVISHNPDNDTSRIKLPSGSKKIVPSACRAMIGQVAGGGRTEKPLLKAGNAYHKFRVKRNCWPKVRGVAMNPVEHPHGGGNHQHIGHASTVRRDAPPGQKVGLIAA

SEQ ID NO: 8199 - protein, 243 aa, Euphorbia peplus
  misc_feature (236)..(236): Xaa can be any naturally occurring amino acid
AGSVFRSHTHHRKGPAQFRSLDFGERNGYLKGVITEIIHDPGRGAPLARVTFRHPFRYKHQKELFIAAEGMYTGQFVYCGKKANLMVGNVLPLRSIPEGAVVCNVEHHVGDRGSFARCSGDYAIVVSHNPDNGTSRIKLPSGAKKIVPSGCRAMVGQVAGGGRTEKPMLKAGNAYHKYRVKRNCWPKVRGVAMNPVEHPHGGGNHQHIGHASTVRRDAPPGQKVGLIAARRTGRLXGQAAATA

SEQ ID NO: 8200 - protein, 243 aa, Gerbera hybrid cultivar
MGRVIRAQRKGAGSVFKSHTHHRKGPARFRSLDFGERNGYLKGVITEIIHDPGRGAPLARVTFRHPFRYKHQKELFVAAEGMYTGQFVFCGKKANLMVGNVLPLRSIPEGAVVCNVEHHVGDRGSFARASGDYAIVISHNPDNGTTRVKLPSGAKKIVPSGCRAMIGQVAGGGRTEKPLLKAGNAYYKFRVKRNCWPKVRGVAMNPAEHPHGGGNHQHIGHASTVRRDAPPGQKVGLIAARRT

SEQ ID NO: 8201 - protein, 260 aa, Unknown
  Sequence found in Organisms: Ceratodon purpureus, Physcomitrella patens
MGRVIRAQRKGAGSIFRSHTHRRKGPAQFRSLDYAERNGYIKGVVSEVVHDSGRGAPLCKVTFRHPFRFKRQKERFIAAEGMYSGQFVYCGKKATLSIGNVLPLRSVPEGAVVCNVEHRMGDRGAFARASGDYAIVVSHNVDSGTTRIKLPSGAKKVVPSGCRAMVGQVAGGGRTEKPMLKAGNAYHKYKVKRNSWPKVRGVAMNPVEHPHGGGNHQHIGHASTVRRDAPPGQKVGLIAARRTGRLRGQAATAASKVDKA

SEQ ID NO: 8202 - protein, 261 aa, Adiantum capillus-veneris
MGRVIRGQRKGAGSIFRAHTHRRKGPARFRSLDYSESNGYIKGVVSDIVHDSGRGAPLCKVTFRHPFRFKHQNERFIAAEGMYSGQFVYCGKKATLSIGNVLPLKSVPEGAVVCNVEQRVGDRGSFARASGDYVIVVSHNPDNNTTRIKLPSGAKKIVPSGCRAMIGQVAGGGRTEKPMLKAGNAYHKYKVKRNCWPKVRGVAMNPVEHPHGGGNHQHIGHASTVRRDAPPGQKVGLIAARRTGRLRGQAATAAAKTDKSA

SEQ ID NO: 8203 - protein, 259 aa, Eutrema halophilum
MGRVIRAQRKGAAGSVFKSHTHHRKGPAKFRSLDYGERNGYLKGVVTEIVHDPGRGAPLARVDFRHPFRYMKQKELFVAAEGMYTGQFLYCGKKANLVVGNVLPLRSVPEGAVVCNVELKVGDRGALARASGDYAIVVSHNPDNDTTRIKLPSGSKKIVQSGCRAMIGQVAGGGRTEKPLLKAGNAYHKYRVKRNCWPKVRGVAMNPVEHPHGGGNHQHIGHASTVRRDSSAGQKVGQIAARRTGRLRGQAAAAAAKAG

SEQ ID NO: 8204 - protein, 108 aa, Brassica juncea
MGRVIRAQRKGAGSVFKSHTHHRKGPAKFRSLDFGERNGYLKGVVTEIIHDPGRGAPLARVAFRHPFRYKKQKELFVAAEGMYTGQFLYCGKKATLVVGKCFASQIYP

SEQ ID NO: 8205 - protein, 261 aa, Pteridium aquilinum
MGRVIRGQRKGAGSIFTAHTHRRKGPARFRSLDYSERNGYIKGVVSDIVHDSGRGAPLCKVTFRHPFRFKHQKERFIAAEGMYSGQFVYCGKKASLSIGNVLPLKSVPEGAVVCNVEQRMGDRGSFARASGDYVIVVSHNPDNNTTRIKLPSGAKKVVPSGCRAMIGQVAGGGRTEKPMLKAGNAYHKYKVKRNCWPKVRGVAMNPVEHPHGGGNHQHIGHASTVRRDAPPGQKVGLIAARRTGRLRGQAATAAAKTDKSA

SEQ ID NO: 8206 - protein, 196 aa, Raphanus sativus
  misc_feature (196)..(196): Xaa can be any naturally occurring amino acid
QRKGAGSVFKSHTHHRKGPAKFLSLDYGERNGYLKGVVTEIIHDPGRGAPLARVAFRHPFRYKKQKELFVAAEGMYTGQFLYCGKKATLVVGNVIPLRAIPEGAVVCNVEHHVGDRGVLARASGDYAIVIAHNPDNDTTRIKLPSGSKKIVPSGCRAMIGQVAGGGRTEKPMLKAGNAYHKYRVKRNSWPKFVVWX

SEQ ID NO: 8207 - protein, 259 aa, Cannabis sativa
MGRVIRAQRKGAAGSVFKSHTHHRKGPAKFRSLDFGERNGYLKGVVNDIIHDPGRGAPLARVTFRHPFRYKHQKELFIAAEGLYSGQFIYCGKKANLVVGNVLPLMSLPEGTVVCNVERHVGDRGALARASGDYAVVISHNPDNGTTRVKLPSGAKKVLPSGCRAMIGQVAGGGRTEKPLLKAGNAYHKYKAKRNSWPIVRGVAMNPVEHPHGGGNHQHIGHASTVARDAVPGQKVGLTAARRTGRLRGTDAATSKGDN

SEQ ID NO: 8208 - protein, 142 aa, Pinus taeda
MGRVIRAQRKGAGSVFKSHTHHRKGPARFRSLDYGERNGYIRGIITDVIHDPGRGAPLCKVTFRHPFRYKHQKELFVAAEGMYSGQFVYCGKKANLTVGNVLRREPLSATWNRMSAIGVRLLGLLETTPSSSATISITALPG

SEQ ID NO: 8209 - protein, 178 aa, Thalictrum flavum
MYTGQFVYCGKKANLMVGNVLPLRSIPEGAVVCNVEHHVGDRGVLARASGDYAIVISHNPDNGTSRIKLPSGAKKIVPSGCRAMIGQVAGGGRTEKPMLKAGNAYHKFRVKRNCWPKVRGVAMNPVEHPHGGGNHQHIGHASTVRRDAPPGQKVGLIAARRTGRLRGQAAANLAKEKA

SEQ ID NO: 8210 - protein, 242 aa, Brassica juncea
KSHTHHRKGPAKFRSLDFGERNGYLKGVVTEIIHDPGRGAPLARVSFRHPFRYKKQKELFVAAEGMYTGQFLYCGKKATLVVGNVLPLRSIPEGAVVCNVEHHVGDRGVLARASGDYAIVISHNPDNDTTRVKLPSGSKKIVPSGCRAMIGQVAGGGRTEKPMLKAGNAYHKYRVKRNCWPKVRGVAMNPVEHPHGGGNHQHIGHASTVRRDAPPGQKVGLIAARRTGRLRGQAAALASKQE

SEQ ID NO: 8211 - protein, 261 aa, Gnetum gnemon
MGRVIRAQRKGAGSVFRSHTHHRKGAAKFRVLDYSERNGYIKGVIGKIIHDPGRGAPLAQVTFRHPFKFRLQKENFVAAEGMYTGQFVFCGRKATLMVGNVLPLREIPEGAVICNVEQNPGDRGSFARASGDYAIVVSHNPDNNTTRIKLPSGAKKQVSSACRAMVGQVAGGGRTEKPMLKAGNAYHKYRVKRNCWPKVRGVAMNPVEHPHGGGNHQHIGHASTVRRDAPPGQKVGLIAARRTGRLRGQAASAAAKTEKSA

SEQ ID NO: 8212 - protein, 260 aa, Utricularia gibba
MGRVIRAQRKGAGSIFVSHTHKRKGAARFRSLDFSERNGYIKGVVTEIIHDPGRGAPLAKVTFRHPFHYKHQNELFIAAEGVYTGQFLYCGKKANLTIGNVLPLRSMPEGTVICNVEQNLGDRGSFARASGDYAIIVSHNLDNGTTRIKLPSGSKKIVPSGCRAMVGQVAGGGRTEKPMLKAGNAYHKYRVKRNSWPKVRGVAMNPVEHPHGGGNHQHIGHASTVRRDAPAGQKVGLIAARRTGRLRGQAAGSLKLEKGA

SEQ ID NO: 8213 - protein, 284 aa, Helianthus annuus
MGRVIRAQRKGAGSVFKSHTHHRKGPARFRSLDFGERNGYLKGVITEIIHDPGRGAPLARVTFRHPFRYKHQKELFVAAEGMYTGQFVFCGKKANLMVGNVLPLRSIPEGAVVCNVEHHVGDRGSFARASGDYAIVISHNPDNGTTRVKLPSGAKKIVPSGCRAMIGQVAGGGRTEKPMLKAGNAYHKFRVKRNCWPKVRGVAMNPVEHPHGGGNHQHIGHASTVRRDAPPGQKVGLIAARRTGRLRGQAAATAARLISRALEWILVSGLKFLLICLFCLNLDF

SEQ ID NO: 8214 - protein, 97 aa, Jatropha curcas
MVGQVAGGGRTEKPMLKAGNAYHKYRVKRNCWPKVRGVAMNPVEHPHGGGNHQHIGHASTVRRDAPPGQKVGLIAARRTGRLRGQAAATAAKADKGA

SEQ ID NO: 8215 - protein, 259 aa, Secale cereale
GPRDQGAAQGRGLGVQVAHAPPPGPGAVPGAGLRRAERVPQGRGDGHRARPRPRRAAGPRRLPRPVRYKHRKELFVAAEGMYTGQPVYCGRRAVVAIGNVLPLASLPEGAVVCNVEQHVGDRGALARASGDYAIVISHNSDNGTTRIKLPSGAKKVVQSGCRAMVGQVAGGGRTEKPLLKAGRAYHKFRVKRNSWPKVRGVAMNPVDHPHGGGNHQHIGHASTVRRDAPPGQKVGQIGARRTGRLRGQAAVNASKDSRA

SEQ ID NO: 8216 - protein, 242 aa, Brassica juncea
KSHTHHRKGPAKFRSLDFGERNGYLKGVVTEIIHDPGRGAPLARVSFRHPFRYKKQKELFVAAEGMYTGQFLYCGKKATLVVGNVLPLRSIPEGAVVCNVEHHVGDRGVLARASGDYAIVISHNPDNDTTRVKLPSGSKKIVPSGCRAMIGQVAGGGRTEKPMLKAGNAYHKYRVKRNCWPKVRGVAMNPVEHPHGGGNHQHIGRASTVRRDAPPGQKVGLIAARRTGRLRGQAAALASKQE

SEQ ID NO: 8217 - protein, 236 aa, Cirsium arvense
KSHTHHRKGPARFRSLDFGERNGYLKGVITEIIHDPGRGAPLARVTFRHPFRYKHQKELFVAAEGMYTGQFVFCGKKANLMVGNVLPLRSIPEGAVVCNVEHHVGDRGSFARASGDYAIVISHNPDNGTTRVKLPSGAKKIVPSGCRAMIGQVAGGGRTEKPMLKAGNAYHKFRVKRNCWPKVRGVAMNPVEHPHGGGNHQHIGHASTVRRDAPPGQKVGLIAARRTGRLRGQAAA

SEQ ID NO: 8218 - protein, 257 aa, Cannabis sativa
MGRVIRAQRKGAAGSVFKSHTHHRKGPAKFRSLDFGERNGYLKGVVNDIIHDPGRGAPLARVTFRHPFRYKHQKELFIAAEGLYSGQFIYCGKKANLVVGNVLPLMSLPEGTVVCNVERHVGDRGALARASGDYAVVISHNPDIYRVKLPSGAKKVLPSGCRAMIGQVAGGGRTEKPLLKAGNAYHKYKAKRNSWPIVRGVAMNPVEHPHGGGNHQHIGHASTVARDAVPGQKVGLTAARRTGRLRGTDAATSKGDN

SEQ ID NO: 8219 - protein, 244 aa, Elaeis guineensis
PTPDRPEGPARFRSLDYGERNGYLKGVVTDIIHDPGRGAPLARVTFRHPFRYKKQKELFVAAEGMYTGQFVYCGRKASLMVGNVLPLRSIPEGAVVCNIEHHVGDRGVLARASGDYAIVISHNPDNGTTRIKLPSGAKKVVPSGCRAMIGQVAGGGRTEKPLLKAGNAYHKFRVKRNCWPKVRGVAMNPVEHPHGGGNHQHIGHASTVRRDAPPGQKVGLIAARRTGRLRGQAAATASKADKSS

SEQ ID NO: 8220 - protein, 260 aa, Setaria italica
MGRVIRAQRKGAAGSVFKSHTHHRKGPARFRSLDVGERRGYLKGLVTDIVHDPGRGAPLARVTFRHPFRYGQQKELFLAAEGMYTGQLIYCGRRASLSIGNVLPVGTLPEGTVTCNVESHVGDRGALARCSGDYAIVISHNTDNGTTRVKLPSGAKKLVQSNCRAMVGQVAGGGRTEKPLLKAGNAYHKFRVKRNCWPRVRGVAMNPVDHPHGGGNHQHIGHASTVRRDAPPGAKTGQIGARRTGRRTGQAAVTAGKSML

SEQ ID NO: 8221 - protein, 260 aa, Sorghum bicolor
MGRVIRAQRKGAAGSVFKSHTHHRKGPARFRALDVGERSGYLKGVVTDIVHDPGRGAPLARVTFRHPFRYRQQKELFLAAEGMYTGQLIYCGRRANLSIGNVLPVGTLPEGTVICNVESRVGDRGALARCSGDYAIVISHNTDNGTTRVKLPSGAKKLLQSNCRAMVGQVAGGGRTEKPLLKAGNAYHKFRVKRNCWPRVRGVAMNPVDHPHGGGNHQHIGHASTVRRDAPPGAKSGHIAARRTGRRRGQAAVAAGKSML

SEQ ID NO: 8222 - protein, 260 aa, Hordeum vulgare
MGRVIRAQRKGAGSVFKSHTHHRKGPARFRALDYGERNGYLKGVVTDIVHDPGRGAPLARVDFRDPIRYKHRKELFVAAEGMYTGQSVYCGRRAVVAIGNVLPLASLPEGAVVCNVEQHVGDRGALARASGDYAIVISHNADSGTTRQLPSGAKKVVQSGCRAMVGQVAGGGRTEKPLLKAGRAFHKFRVKRNSWPRVRGVAMNPVDHPHGGGNHQHIGHASTVRRDAPPGQKVGQIGARRTGRLRGQAAVNASKDSRTA

SEQ ID NO: 8223 - protein, 233 aa, Parthenium argentatum
MGRVIRAQRKGAGSVFKSHTHHRKGPARFRSLDFGERNGYLKGVITEIIHDPGRGAPLARVTFRHPFRYKHQKELFVAAEGMYTGQFVFCGKKANLMVGNVLPLRSIPEGAVVCNVEHHVGDRGSFARASGDYAIVISHNPDNGTTRVKLPSGAKKIVPSGCRAMIGQVAGGGRTEKPMLKAGNAYHKFRVKRNSWPKVRGVAMNPVEHPHGGGNHQHIGHASTVRRDAPPGQ

SEQ ID NO: 8224 - protein, 232 aa, Petunia hybrida
MGRVIRAQRKGAGSVFKSHTHHRKGPAKFRSLDFGERNGYLKGVITEIIHDPGRGAPLARVTFRHPFRYKHQKELFVAAEGMYTGQFIYCGKKANLMVGNVLALRSIPEGAVVCNVEHKVGDRGVFARCSGDYAIVISHNPDNGTTRIKLPSGAKKIVPSGCRAMIGQVAGGGRTEKPMLKAGNAYHKYRVKRNCWPKVRGVAMNPVEHPHGGGNHHILVMPVLSVVMHHLG

SEQ ID NO: 8225 - protein, 288 aa, Sciadopitys verticillata
MGRVIRAQRKGAGSVFRSHTHHRKGPARFRSLDYSERNGYIKGIVSEVVHDPGRGAPLCRVTFRHPFRYRHQKELFVAAEGIYTGQFIYCGKKANLTVGNVLPLRSIPEGAVVCNVEQHVGDRGSFARASGDYAIVISHNVDNGTSRIKLPSGAKKIVPSSCRAMIGQVAGGGRTEKPMLKAGNAYHKYRVKRNCWPKVRGVAMNPVEHPHGGGNHQHIGHASTVRRDAPPGQKVGLIAARRTGRLRGQAATAAAKTEKALRHFTRSLREKSLHVGSFVGQFWFYCRQ

SEQ ID NO: 8226 - protein, 145 aa, Cajanus cajan
MGRVIRAQRKGAGSVFKSHTHHRKGPARFRSLDFGERNGYLKGVVTDVIHDPGRGAPLAKVTFRHPFRYKKQNELFVAAEGLYTGQFIYCGKKATLVVGNVLPLRSIPEGAVICNVEHHVGDRGVFARASGDYAIVISHNPDNDT

SEQ ID NO: 8227 - protein, 141 aa, Picea glauca
MSAYRGSFARASGDYAIVVSHNPDNGTTRVKLPSGAKKIVPSSCRAMIGQVAGGGRTEKPMLKAGNAYHKYRVKRNCWPKVRGVAMNPVEHPHGGGNHQHIGHASTVRRDAPPGQKVGLIAARRTGRLRGQAASAAAKTDN

SEQ ID NO: 8228 - protein, 258 aa, Arabidopsis lyrata
MGRVIRAQRKGAGSVFKSHTHHRKGPAKFRSLDYGERNGYLKGLVTEIIHDPGRGAPLARVAFRHPFRYMKQKELFVAAEGMYTGQYLYCGKKANLMVGNVLPLGSIPEGAVVCNVELHVGDRGALARASGDYAIVIAHNPDSNTTRVKLPSGSKKILPSACRAMIGQVAGGGRTEKPLLKAGNAYHKFKVKRNCWPVVRGVAMNPVEHPHGGGNHQHIGHASTVRRDKSAGAKVGQVAARRTGRRRGTAALAAKADY

SEQ ID NO: 8229 - protein, 235 aa, Brassica juncea
KGPAKFRSLDYGERNGYLKGVVTEIIHDPGRGAPLARVAFRHPFRYKKQKELFVAAEGMYTGQFLYCGKKATLVVGNVLPLRAIPEGAVVCNVEHHVGDRGVLARASGDYAIVISHNPDNDTTRIKLPSGSKKIVPSGCRAMIGQVAGGGRTEKPMLKAGNAYHKYRVKRNSWPKVRGVAMNPVEHPHGGGNHQHIGHASTVRRDAPPGQKVGLIAARRTGRLRGQAAASAAKAD

SEQ ID NO: 8230 - protein, 230 aa, Ocimum basilicum
RSLDFGERNGYLKGVVTDVIHDPGRGAPLARVTFRHPFRYQHQKELFVAAEGMYTGQFVYCGKKANLVVGNVLPLRSVPEGAVVCNVEHHVGDRGVFARASGDYAIVISHNLDNGTTRIKLPSGAKKIVPSGCRAMIGQVAGGGRTEKPMLKAGNAYHKFRVKRNSWPKVRGVAMNPVEHPHGGGNHQHIGHASTVRRDAPPGQKVGLIAARRTGRLRGQAAATAAKADK

SEQ ID NO: 8231 - protein, 231 aa, Chelidonium majus
RSLDFGERNGYLKGVVTEIIHDPGRGAPLARVTFRHPFRYKHQKELFVAAEGMYTGMFVYCGKKANLMVGNVLPLRAIPEGAVVCNVEHHVGDRGVLARASGDYAIVISHNPDNGTSRIKLPSGAKKIVPSGCRAMIGQVAGGGRTEKPMLKAGNAYHKFRVKRNSWPKVRGVAMNPVEHPHGGGNHQHIGHASTVRRDAPPGQKVGLIAARRTGRLRGQAAATASKADKA

SEQ ID NO: 8232 - protein, 261 aa, Brachypodium distachyon
MGRVIRAQRKGAAGSVFKSHTHHRKGPARFRALDYGERHGYLKGVVTEIVHDPGRGAPLARVDFREPVRYKHRKELFVAAEGMYTGQSLYCGRRAALSVGNVLPLAALPEGSVVCNVEERVGDRGALARASGDYAIVVSHNSDAGTTRIKLPSGAKKVVQSGCRAMVGQVAGGGRTEKPLLKAGNAYHKYRVKRNCWPRVRGVAMNPVDHPHGGGNHQHIGHASTVRRDAPPGAKTGQVAARRTGRRRGQDAVNAAKASLN

SEQ ID NO: 8233 - protein, 230 aa, Liriodendron tulipifera
  misc_feature (116)..(116): Xaa can be any naturally occurring amino acid
  misc_feature (118)..(118): Xaa can be any naturally occurring amino acid
  misc_feature (124)..(124): Xaa can be any naturally occurring amino acid
SLDFGERNGYLKGVVTEIIHDPGRGAPLARVTFRHPFRYKHQKELFVAAEGMYTGQFVYCGKKANLIVGNVLPLRSIPEGAVVCNVEHHVGDRGVFARASGDYAIVISHNPDNGTXRXKLPSGXKKIVPSGCRAMIGQVAGGGRTEKPLLKAGNAYHKFRVKRNCWPKVRGVAMNPVEHPHGGGNHQHIGHASTVRRDAPPGQKVGLIAARRTGRLRGQAAATAAKSEKA

SEQ ID NO: 8234 - protein, 260 aa, Arabidopsis thaliana
MGRVIRAQRKGAAGSVFKSHTHHRKGPAKFRSLDYGERNGYLKGLVTEIIHDPGRGAPLARVAFRHPFRYMKQKELFVAAEGMYTGQYLYCGKKANLMVGNVLPLGSIPEGAVICNVELHVGDRGALARASGDYAIVIAHNPESNTTRVKLPSGSKKILPSACRAMIGQVAGGGRTEKPLLKAGNAYHKYKAKRNCWPVVRGVAMNPVEHPHGGGNHQHIGHASTVRRDKSAGAKVGQIAARRTGRRRGAAATLAAKADY

SEQ ID NO: 8235 - protein, 232 aa, Senecio madagascariensis
  misc_feature (13)..(13): Xaa can be any naturally occurring amino acid
MGRVIRAQRKGSXGSVFKSHTHHRKGPARFRSLDFGERNGYLKGVITEIIHDPGRGAPLARVTFRHPFRYKHQKELFVAAEGMYTGQFVFCGKKANLMVGNVLPLRSIPEGAVVCNVEHHVGDRGSFARASGDYAIVISHNLDNGTSRVKLPSGAKKIVPSGCRAMIGQVAGGGRTEKPMLKAGNAYHKFRVKRNCWPKVRGVAMNPVEHPHGGGNHQHIGHASTVRRDAPP

SEQ ID NO: 8236 - protein, 263 aa, Aquilegia formosa
MGRVIRAQRKGHGGIFKAHTHHRKGPAKFRSLDFGEKHGYLKGVVTEIVHDPGRGAPLARVTFRHPFRYKHQKELFVAAEGMYTGQFIYCGKKAQLTVGNVLPIGTIPEGAVVCNVERKVGDRGALARASGDYAIVISHNPENGTSRVKLPSGSKKIISSGCRAMVGQVAGGGRTEKPMLKAGNAYHKYRVKRNSWPKVRGVAMNPVEHPHGGGNHQHIGHGSCVGRDAVPGQRVGQLYARQTGRGRKGQATGTTSKTKADKA

SEQ ID NO: 8237 - protein, 230 aa, Cleome spinosa
MGRVIRAQRKGAGSVFKSHTHHRKGPAKFRSLDFGERNGYLKGVVTEIIHDPGRGAPLARVVFRHPFRYKKQKELFVAAEGMYTGQFVYCGKRASLVVGNVLPLRSIPEGAVVCNVEHHVGDRGVFARASGDYAIVIAHNPDNDTTRIKLPSGSKKIVPSACRAMVGQVAGGGRTEKPMLKAGNAYHKFRVKRNCWPKVRGVAMNPVEHPHGGGNHQHIGHASTVRRDAP

SEQ ID NO: 8238 - protein, 261 aa, Brachypodium distachyon
MGRVIRAQRKGAAGSVFKSHTHHRKGPARFRALDYGERHGYLKGVVTEIVHDPGRGAPLARVDFREPVRYKHRKELFVAAEGMYTGQSLYCGRRAALSVGNVLPLAALPEGSVVCNVEERVGDRGALARASGDYAIVRDMMIDGCLQDQAAVGGEEGGAERVQGDGGAGGGRREDGEAAAESRQRVPQVQGEEELLAQGARRRHEPRRPPARRRQPPAHWPRLHRPPRRASGGQDRPGRRTEDRQAQGARRRQRCQGVAQL

SEQ ID NO: 8239 - protein, 229 aa, Brassica juncea
MGRVIRAQRKGAGSVFKSHTHHRKGPAKFRSLDFGERNGYLKGVVTEIIHDPGRGAPLARVAFRHPFRYKKQKELFVAAEGMYTGQFLYCGKKATLVVGNVLPLRAIPEGAVVCNVEHHVGDRGVLARASGDYAIVISHNPDNDTTRVKLPSGSKKIVPSGCRAMIGQVAGGGRTEKPMLKAGNAYHKYRVKRNCWSKVRGVAMNPVEHPHGGGNHQHIGHASTVRRDA

SEQ ID NO: 8240 - protein, 221 aa, Cenchrus ciliaris
  misc_feature (10)..(10): Xaa can be any naturally occurring amino acid
MSRRGDWVYXNNGGTCVAIAGADYCVVAADTRLSVGYSILTRDHSKICDLADKCVLASSGFQGDIKALHKNLAARELLYQHQHNKRMSCPAMAQLLSNTLYYKRFFPYYAFNVLGGLDSEGKGCVFTYDAVGSYERTGYSAQGTGSSLIMPVLDNQLKSPSPLLLPARDAVTPLSESEAIDLVKDVFASATERDIYTGDKLEIVVINKAGTKREYIELRKD

SEQ ID NO: 8241 - protein, 221 aa, Pennisetum glaucum
MSRRGDWVYENNGGTCVAIAGADYCVVAADTRLSVGYSILTRNHSKICDLADKCVLASSGFQGDIKALHKNLAARELLYQHQHNKRMSCPAMAQLLSNTLYYKRFFPYYAFNVLGGLDSEGKGCVFTYDAVGSYERTGYSAQGTGSSLIMPVLDNQLKSPSPLLLPARDAVTPLSESEAIDLVKDVFASATERDIYTGDKLEIVVINKAGTKREYIELRKD

SEQ ID NO: 8242 - protein, 221 aa, Saccharum officinarum
MSRRGDWVYENNGGTCVAIAGADYCVVAADTRLSVGYSILTRDHSKICDLADKCVLASSGFQGDIKALHKNLAARELLYQHQHNKRMSCPAMAQLLSNTLYYKRFFPYYAFNVLGGLDSEGKGCVFTYDAVGSYERTGYSAQGTGSTLIMPVLDNQLKSPSPLLLPARDAVTPLSESEAIDLVKDVFASATERDIYTGDKLEIVVINKAGTKREYIELRKD

SEQ ID NO: 8243 - protein, 221 aa, Unknown
  Sequence found in Organisms: Sorghum bicolor, Triticum aestivum
MSRRGDWVYENNGGTCVAIAGADYCVVAADTRLSVGYSILTRDHSKICDLADKCVLASSGFQGDIKALHKNLAARELLYQHQHNKRMSCPAMAQLLSNTLYYKRFFPYYAFNVLGGLDSEGKGCVFTYDAVGSYERTGYSAQGTGSTLMMPVLDNQLKSPSPLLLPARDAVTPLSESEAIDLVKDVFASATERDIYTGDKLEIVVINKAGTKREYIELRKD

SEQ ID NO: 8244 - protein, 221 aa, Zea mays
MSRRGDWVYENNGGTCVAIAGADYCVVAADTRLSVGYSILTRDHSKICDLADKCVLASSGFQGDIKALHKNLAARELLYQHQHNKRMSCPAMAQLLSNTLYYKRFFPYYAFNVLGGLDSEGKGCVFTYDAVGSYERTGYSAQGTGSTLIMPVLDNQLKSPSPLLLPARDAVTPLSESEAIDLVKDVFASATERDIYTGDKLEIVVINKVGTKREYIDLRKD

SEQ ID NO: 8245 - protein, 221 aa, Panicum virgatum
MSRRGDWVYENNGGTCVAIAGADYCVVAADTRLSVGYSILTRNHSKICDLADKCVLASSGFQGDIKALHKNLAARELLYQHQHNKRMSCPGMAQLLSNTLYYKRFFPYYAFNVLGGLDSEGKGCVFTYDAVGSYERTGYSAQGTGSSLIMPVLDNQLKSPSPLLLPARDAVTPLSESEAVDLVKDVFASATERDIYTGDKLEIVVINKAGTKREYIELRKD

SEQ ID NO: 8246 - protein, 221 aa, Panicum virgatum
MSRRGDWVYENNGGTCVAIAGADYCVVAADTRLSVGYSILTRDHSKICDLADKCVLASSGFQGDIKALHKHLAARELLYQHQHNKRMSCPAMAQLLSNTLYYKRFFPYYAFNVLGGLDNEGKGCVFTYDAVGSYERTGYGAQGTGSSLIMPVLDNQLKSPSPLLLPARDAVTPLSESEAVDLVKDVFASATERDIYTGDKLEIVVINKAGTKREYIELRKD

SEQ ID NO: 8247 - protein, 221 aa, Zea mays
MSRRGDWVYENNGGTCVAIAGADYCVVAADTRLSVGYSILTRDHSKICDLADKCVLASSGFQGDIKALQKNLAARELLYQHQHNKRMSCPAMAQLLSNTLYYKRFFPYYAFNVLGGLDSEGKGCVFTYDAVGSYERTGYSAQGTGSTLIMPVLDNQLKSPSPLLLPVRDAVTPLSESEAIDLVKDVFASATERDIYTGDKLEIVVINKAGTMREYIDLRKD

SEQ ID NO: 8248 - protein, 221 aa, Cynodon dactylon
MSRRGDWVYENNGGTCVAIAGADYCVIAADTRLSVGYSILTRDHSKICELADKCVLASSGFQGDIKALHKNLAARELLYQHQHNKRMSCPAMAQLLSNTLYYKRFFPYYAFNVLGGLDSEGKGCVFTYDAVGSYERTGYSAQGTGSTLIMPVLDNQLKSPSPLLLPARDAVTPLSETEAIDLVKDVFASATERDIYTGDKLEIVVVNKDGTKREYIDLRKD

SEQ ID NO: 8249 - protein, 221 aa, Oryza sativa
MSRRGDWVYENNGGTCVAIAGADYCVVAADTRLSVGYNILTRDHSKICELADKCALASSGFQGDIKALHKNLAARELLYQHQHNKRMSCPAMAQLLSNTLYYKRFFPYYAFNVLGGLDSEGKGCVFTYDAVGSYERTGYSAQGTGSALIMPVLDNQLKSPSPLLLPARDAVTPLSETEAVDLVKDVFASATERDIYTGDKLEIVVINKAGTKREYIDLRKD

SEQ ID NO: 8250 - protein, 221 aa, Brachypodium distachyon
MSRRGDWVYENNGGTCVAIAGADYCVVAADTRLSVGYSILTRDHSKICELAEKCVIASSGFQGDIKALQKNLAARELLYQHQHNKRMSCPAMAQLLSNTLYYKRFFPYYAFNVLGGLDSEGKGCVYSYDAVGSYERTGYSAQGTGSTLIMPVLDNQLKSPSPLLLPARDAVTPLSESEAVDLVKDVFASATERDIYTGDKVEIVVINKAGTRREYIELRKD

SEQ ID NO: 8251 - protein, 255 aa, Brachypodium distachyon
GGHRTAPLRLPFQVTNSGDSTTTSRATYPLRPPPCLGAATGSTRITAGPAWPSPAQTTAWSPLTPVSPSATASSRATTPRSASWQRKCVIASSGFQGDIKALQKNLAARELLYQHQHNKRMSCPAMAQLLSNTLYYKRFFPYYAFNVLGGLDSEGKGCVYSYDAVGSYERTGYSAQGTGSTLIMPVLDNQLKSPSPLLLPARDAVTPLSESEAVDLVKDVFASATERDIYTGDKVEIVVINKAGTRREYIELRKD

SEQ ID NO: 8252 - protein, 221 aa, Unknown
  Sequence found in Organisms: Hordeum vulgare, Leymus cinereus x Leymus triticoides, Pseudoroegneria spicata, Secale cereale, Triticum aestivum
MSRRGDWVYENNGGTCVAIAGADYCVVAADTRLSVGYNILTREHSKICELADKCVIASSGFQGDIKALQKNLAARELLYQHQHNKRMSCPAMAQLLSNTLYYKRFFPYYAFNVLGGLDSEGKGCVYSYDAVGSYERTGYSAQGSGSTLIMPVLDNQLKSPSPLLVPARDAVTPLSESEAVDLVKDVFASATERDIYTGDKVEIVVINKAGTRREYIELRKD

SEQ ID NO: 8253 - protein, 221 aa, Avena sativa
MSRRGDWVYENNGGTCVAIAGADYCVVAADTRLSVGYNILTRDHSKICELAEKCVIASSGFQGDIKALQKNLSAKELLYQHQHNKRMSCPAMAQLLSNTLYYKRFFPYYAFNVLGGLDSEGKGCVYSYDAVGSYERTGYSAQGTGSTLIMPVLDNQLKSPSPLLVPARDAVTPLSESEAVDLVKDVFASATERDIYTGDKVEIVVINKAGTRREYIELRKD

SEQ ID NO: 8254 - protein, 222 aa, Festuca arundinacea
MARRGGDWVYENNGGTCVAIAGADYCVVAADTRLSVGYNILTRDHSKICELAEKCVIASSGFQGDIKALQKNLSAKELLYQHQHNKRMSCPAMAQLLSNTLYYKRFFPYYAFNVLGGLDSEGKGCVYSYDAVGSYERTGYSAQGTGSTLIMPVLDNQLKSPSPLLVPARDAVTPLSESEAVDLVKDVFASATERDIYTGDKVEIVVINKAGTRREYIELRKD

SEQ ID NO: 8255 - protein, 221 aa, Ananas comosus
MALRRDWVYENNGGTCVAIAGADYCVVAADMRLSVGYSILTRDHSKICELADKCVLASSGFQGDIKALHKNLAARHLIYQHQHNKQMSCPAMAQLLSNTLYYKRFFPYYAFNVLGGLDNEGKGCVFTYDAVGSYERVGYSAQGTGATLIMPVLDNQLKSPSPLLLPARDAVTPLSESEAVDLVKDVFASATERDIYTGDKLEIVVINAAATRREYIELRKD

SEQ ID NO: 8256 - protein, 210 aa, Triticum aestivum
HEGTCLAIAGADYCVVAADTRLSVGYSILTRDHSKICDLADKCVLASSGFQGDIKALHKNLAARELLYQHQHNKRMSCPAMAQLLSNTLYYKRFFPYYAFNVLGGLDSEGKGCVFTYDAVGSYERTGYSAQGTGSTLMMPVLDNQLKSPSPLLLPARDAVTPLSESEAIDLVKDVFASATERDIYTGDKLEIVVINKAGTKREYIELRKD

SEQ ID NO: 8257 - protein, 219 aa, Setaria italica
MARFDPYENNGGTCVAVAGADYCVVAADTRLSVGYSILSRDHSKIAQLADKCVLASSGFQGDIKALQKNLAAKELVYEHNHNKKMSCPAMAQLLSNTLYYKRFFPYYAFNVLGGLDSQGKGCVFTYDAVGSYERTGYSAQGTGAALMMPVLDNQLKSPSPLLLPARDAVTPLSESDAVDLVKDVFASATERDIYTGDKLEIVVINSSGTHRECIELRKD

SEQ ID NO: 8258 - protein, 221 aa, Elaeis guineensis
MALSRNWMYENNGGTCVAIAGADYCVVAADTRLSIGYSIYTRDYSKICKLADKCVLASSGFQGDIKALQKNLAARHLIYQHQHNKQMSCPAMAQLLSNTLYYKRFFPYYAFNVLGGLDNEGKGCVFTYDAVGSYERVGYSTQGSGSTLIMPVLDNQLKSPSPLLLPARDAVTPLSESDAVDLVKDVFASATERDIYTGDKLEIVVINASGIRREFIELRKD

SEQ ID NO: 8259 - protein, 219 aa, Pennisetum glaucum
MARFNPYENNGGTCVAVAGADYCVVAADTRLSVGYSILSRDHSKIAQLADKCVLASSGFQGDIKALQKNLAAKELVYEHNHNKKMSCPAMAQLLSNTLYYKRFFPYYTFNVLGGLDSQGKGCVFTYDAVGSYERTGYSAQGTGAALMMPVLDNQLKSPSPLLLPARDAVTPLSESDAVDLVKDVFASATERDIYTGDKLEIVVINSSGTHRECIELRKD

SEQ ID NO: 8260 - protein, 219 aa, Brachypodium distachyon
MARFDPYENNGGTCVAVAGADYCVVAADTRLSVGYSILSRAHSKIAHLADKCVLASSGFQGDIKALQKNLTAKELVYEHNHNKKMSCPAMAQLLSNTLYYKRFFPYYAFNVLGGLDSEGKGCVFTYDAVGSYERTGYSAQGTGATLMMPVLDNQLKSPSPLLLPARDAVTPLSESEAVDLVKDVFASATERDIYTGDSVEIVVINSSGTHRECIELRKD

SEQ ID NO: 8261 - protein, 219 aa, Oryza sativa
MARFEVYENNGGTCVAVAGADYCVVAADTRLSVGYSILSRDSSKIAHLADKCVLASSGFQGDVKALQRNLTAKELLYEHNHNKKMSCPAMAQLLSNTLYYKRFFPYYAFNVLGGLDSEGKGCVFTYDAVGSYERTGYSAQGTGAALMMPVLDNQLKSPSPLLLPARDAVTPLSQSDAVDLVKDVFASATERDIYTGDKLEIVVINSAGSHREFIELRKD

SEQ ID NO: 8262 - protein, 219 aa, Panicum virgatum
MARFDPYENNGGTCVAVAGADYCVVAADTRLSVGYSILSRDHSKVAQLAEKCVLASSGFQGDIKALQKNLAAKELVYEHNHNKKMSCPAMAQLLSNTLYYKRFFPYYAFNVLGGLDSQGKGCVFTYDAVGSYERTGYSAQGTGAALMMPVLDNQLKSPSPLLLPARDAVTPLSQSEAVDLVKDVFASATERDIYTGDRLEIVVINSSGTYREYIELRKD

SEQ ID NO: 8263 - protein, 247 aa, Eragrostis curvula
RGLGSRSTPATPHHPHPSSQPTPTTALSRRGDWVYENNGGTCVAIAGADYCVIAADTRLSVGYSILTRDHSKICELADKCVLASSGFQGDIKALHKNLAARELLYQHQHNKRMSCPAMAQLLSNTLYYKRFFPYYAFNVLGGLDSEGKGCVFTYDAVGSYERTGYSAQGTGSTLIMPVLDNQLKSPSPLLLPARDAVTPLSESEAVDLVKDVFASATERDIYTGDKLEIVVINKAGTKREYIDLRKD

SEQ ID NO: 8264 - protein, 219 aa, Zea mays
MARFNPYENNGGTCLAVAGADYCVVAADTRLSIGYSILSRDHSKISQLSDKCVLASSGFQGDIKALQKALAAKELIYEHNNNKKMSCPAMAQLLSNTLYYKRFFPYYAFNVLAGLDTQGKGCVFTYDAVGSYERTGYSAQGTGSALMMPVLDNQLKSPSPLLLPARDAVTPLSESDAVDLVKDVFASATERDIYTGDRLEIVVINKSGTHREYIELRKD

SEQ ID NO: 8265 - protein, 219 aa, Unknown
  Sequence found in Organisms: Sorghum bicolor, Saccharum officinarum
MARFDPYENNGGTCVAVAGADYCVVAADTRLSVGYSILSRDHSKIAQLADKCVLASSGFQGDIKALQKALTAKELIYEHNNNKKMSCPAMAQLLSNTLYYKRFFPYYAFNVLAGLDTQGKGCVFTYDAVGSYERTGYSAQGTGSALMMPVLDNQLKSPSPLLLPARDAVTPLSESDAVDLVKDVFASATERDIYTGDRLEIVVINSSGTHRECIELRKD

SEQ ID NO: 8266 - protein, 221 aa, Musa acuminata
MALRRDWVYENNGGTCVAIAGSDYCVIAADTRLSVGYSIYTRDYSKICKLADKCVMASSGFQGDLKALQKNLAARHLIYQHQHNKQMSCPAMAQLLSNTLYYKRFFPYYTFNILGGLDSDGKGCVFTYDAVGSYERVGYSAQGTGAGLIIPVLDNQLKSPSPLLLPAKDAVTPLLESEAVDLVKDVFASATERDIYTGDKVEIVVINASGIRQELMELRKD

SEQ ID NO: 8267 - protein, 221 aa, Phalaenopsis aphrodite
MALRGDWVYENNGGTCVAIAGTDYCVVAADTRLSVGYSIYTRDYSKICKLADKCVLASSGFQGDMKALQKNLAAKHLIYQHQHNKQMSCPAMARLLSNTLYYKRFFPYYTFNILGGLDNEGKGCVYSYDAVGSYERVGYSCQGTGGTLIMPVLDNQLKSPSPLLLPARDAVTPLSESEAVDLIKDVFASATERDIYTGDKLEIIIVNATGIRQEFIELRKD

SEQ ID NO: 8268 - protein, 218 aa, Allium cepa
MGDWVYENNGGTCVAIAGLDYCVVAADTRLSVGYSIYTRDYSKICQLAEKSVLASSGCQCDIKALQKHLGSKHLLYQHQHNKQMSCPAMAQLLSNTLYYKRFFPYYAFNVLGGLDNEGKGCVYTYDAVGSYERVGYSAQGSGSTLIMPVLDNQLKSPSPLLLPAKDAVTPLSETEAVDMVKDVFASATERDIYTGDKVEIVIINAAGIRREYIELRKD

SEQ ID NO: 8269 - protein, 235 aa, Secale cereale
ATPPRAARPLRPPPCRGAATGSYENNGGTCVAIAGADYCVVAADTRLSVGYNILTREHSKICELADKCVIASSGFQGDIKALQKNLAARELLYQHQHNKRMSCPAMAQLLSNTLYYKRFFPYYAFNVLGGLDSEGKGCVYSYDAVGSYERTGYSAQGSGSTLIMPVLDNQLKSPSPLLVPARDAVTPLSESEAVDLVKDVFASATERDIYTGDKVEIVVINKAGTRREYIELRKD

SEQ ID NO: 8270 - protein, 407 aa, Amorphophallus konjac
PEAELSPLDTARLHRSPAESRRPKFASLLSSESKARPRSRIWGLVAAASPSAVAELGGEEGGSGDEESMSIDLLHRFVDLNIGKWSGSFYQFDAYGNLLQKVVTRVAASSYGEDELISLIQTLYIKQPPSRTFISAHDDESEWVEYKIKETNMFTADKYQQITFFPNEKAFSLRYQTAGMLETVLRAGVLGEDDTGEECPRNLKLPSLRPSIVCENCLYSLEKDIRARAFHIMDPKGFLEMFLIFLEERGDDTSLISLDDYLKDDTNTLTSLLGRWEGRSVTKRSGVYGSTITEADITALLEMDGKGQLVQDITSTTRGSNTATNVNWTGTISNNLITFDGGYQMTLLPGGMYMGCPCDIANSVAHLQSFHLEFCWMESPNRRQRLVRTYDAEGLAVSSTYSLETKV

SEQ ID NO: 8271 - protein, 221 aa, Elaeis guineensis
MALSRDWMYENNGGTCVAIAGADYCVVAADTRLSIGYSIYTRDYSKICKLTEKCVLASSGFQGDIKALQKNLAAKHLIYQHQHNKQMSCPAMAQLLSNTLYFKRFFPYYAFNVLGGLDNEGKGCVFTYDAVGSYERVGYSAQGSGSTLVMPILDNQLKSPSPLLLPARDAVTPLSEADAVDMVKDVFASATERDIYTGDKLEIVILNASGVRREFMDLRKD

SEQ ID NO: 8272 - protein, 220 aa, Zostera marina
MGSRWSPYDNNGGTCVAIAGANYCVVAADTRMSTGYSILTREYSKTCKLADKCVLASSGFQADVRALQKNLSAKHLFYQHQHNKQMSCPAMGQLLSNTLYYKRFFPYYAFNVLGGLDNEGKGCVFTYDAVGSYERVGYSTQGSGSSLIMPVLDNQLKSPSPLLLPAKDAITPLSESEAVDLVKDVFASATERDIYTGDKVEIVIINDVGIRREYIDLRKD

SEQ ID NO: 8273 - protein, 219 aa, Aquilegia formosa
MARFSPYDNNGGTCVAIAGADYCVIAADTRMSTGYSILTRDYSKICKLADKCLLASSGFQADVRALQKVLSSRHLVYQHQHNKQMSCPAMGQLLSNTLYYKRFFPYYAFNVLGGLDSEGKGCVFTYDAVGSYERVGYSAQGSGSTLIMPVLDNQLKSPSPLLLPAKDAVTPLSENEAVDLVKDVFASATERDIYTGDRVEIVIVNAEGIRREYIELRKD

SEQ ID NO: 8274 - protein, 219 aa, Aquilegia formosa
MARFSPYDNNGGTCVAIAGADYCVIAADTRMSTGYSILTRDYSKICKLADKCLLASSGFQADVRALQKVLSSRHLVYQHQHNKQMSCPAMGQLLSNTLYYKRFFPYYAFNVLGGLDSEGKGCVFTYDAVGSYERVGYSAQGSGSALIMPVLDNQLKSPSPLLLPAKDAVTPLSENEAVDLVKDVFASATERDIYTGDRVEIVIVNAEGIRREYIELRKD

SEQ ID NO: 8275 - protein, 224 aa, Cephalotaxus harringtonia
MSQHQSTWSPYDNNGGTCVAIAGANYCVVAADTRMSTGYSILTRDYSKICELADKCVLASSGFQADVKALQKNLSARHLIYQHQHNKQMSCPAMAQLLSNTLYYKRFFPYYAFNVLGGLDSEGKGCVFTYDAVGSYERVGYGSQGTGSTLMMPVLDNQLKSPSPLLLPVKDATTPLSESEAVDLVKDIFASATERDIYTGDGLEIVVVNAGGIRREEIMKLRYD

SEQ ID NO: 8276 - protein, 280 aa, Cryptomeria japonica
GDRYFFWEREILDLDCQGKIGDRRIAEEFFLAGERIGGFVFSFLGSVFGEMGATEVITQRQSTWSPYDNNGGTCVAIAGANYCVIAADRRMSTGYSILTRDYSKICKLADKCVLASSGFQADIKALQKNLSARHLIYQHQHNKQMSCPAMAQLLSNTLYYKRFFPYYSFNVLGGLDSEGKGCVYTYDAVGSYERVGYGSQGTGSTLMMPVLDNQLKSPSPLLLPAKDATTPLSESEAVDLVKDIFASATERDIYTGDGLEIVVVNAEGIRREEIMELRKD

SEQ ID NO: 8277 - protein, 223 aa, Manihot esculenta
MTKQQANWSPYDNNGGSCVAIAGADYCVIAADTRMSTGYSILTREYSKICKLADKSVMASSGFQADVKALQKHLAARHLIYQHQHNKQMSCPAMAQLLSNTLYYKRFFPYYAFNVLGGLDSEGKGCVYTYDAVGSYERVGYSAQGSGSTLIMPFLDNQLKSPSPLLLPAQDAVTPLSELEAVDLVKTVFASATERDIYTGDKLEIVVLNADGIRREYMELRKD

SEQ ID NO: 8278 - protein, 223 aa, Unknown
  Sequence found in Organisms: Citrus sinensis, Citrus clementina, Citrus sinensis
MTKQHPAWSPYDNNGGTCVAIAGADYCVIAADTRMSTGYSILTRDYSKICKLADKCVMASSGFQADVKALQKLLAARHLIYQHQHNKQMSCPGMAQLLSNTLYYKRFFPYYSFNVLGGLDNEGKGCVYTYDAVGSYERVGYSSQGSGSTLIMPFLDNQLKSPSPLLLPAQDAVTPLSEAEAVDLVKTCFASATERDIYTGDKLEIVVLNKGGIHREYMELRKD

SEQ ID NO: 8279 - protein, 223 aa, Prunus persica
MTKQHANWSPYDNNGGSCVAIAGANYCVIAADTRMSTGYSILTRDYSKICKLADKAVLASSGFQADVKALQKHLAAKHLIYQHQHNKQMSCPAMAQLLSNTLYYKRFFPYYAFNVLGGLDSEGKGCVFTYDAVGSYERVGYSSQGSGSTLIIPFLDNQLKSPSPLLLPAVDAVTPLSEAEAIDLVKTVFASATERDIYTGDRLEIVVLNADGTRYEYMELRKD

SEQ ID NO: 8280 - protein, 228 aa, Nuphar advena
MAPVEVAKQQANWSPYDNNGGTCVAIAGLDYCVVAADTRMSTGYSILTRDYSKISQLAEKSVMASSGFQADVKALQKNLAARHSIYQHQHNKQMSCPAMAQLLSNTLYYKRFFPYYAFNVLGGLDTEGKGCVFTYDAVGSYERVGYSAQGSGSTLVIPVLDNQLKSPSPLLLPPRDAVTPLSESEAVDLVKDVFASAAERDIYTGDRVEIAVINASGIRREYIELRKD

SEQ ID NO: 8281 - protein, 209 aa, Musa acuminata
MALRRDWVYENNGGTCVAIAGTDYCVIAADTRLSVGYSIYTRDYSKICKLADKCVMASSGFQGDLKALQKNLAARHLIYQHQHNKQMSCPAMAQLLSNTLYYKRFFPYYTFNILGGLDSDGKGCVYTYDAVGSYERVGYSAQGTGAGLIIPVLDNQLKSPSPLLLPAKDAVTPLSETEAVDLVKDVFASATERDIYTGDKVEIMVINAS

SEQ ID NO: 8282 - protein, 230 aa, Allium cepa
  misc_feature (227)..(227): Xaa can be any naturally occurring amino acid
  misc_feature (229)..(229): Xaa can be any naturally occurring amino acid
LSTSFHLLQFSSMGDWVYENNGGTCVAIAGLDYCVVAADTRLSVGYSIYTRDYSKICQLAEKSVLASSGCQCDIKALQKHLGSKHLLYQHQHNKQMSCPAMAQLLSNTLYYKRFFPYYAFNVLGGLDNEGKGCVYTYDAVGSYERVGYSAQGSGSTLIMPVLDNQLKSPSPLLLPAKDAVTPLSETEAVDMVKDVFASATERDIYTGDKVEIVIINAAGIRREYIEXRXD

SEQ ID NO: 8283 - protein, 224 aa, Aristolochia fimbriata
MAHKEHAKWSPYDNNGGTCVAVAGADYCVIAADTRMSTGYNILTRDYSKICKLADKCLLASSGFQADIRALQKNLAAKHLIYQHQHNKQMSCPAMAQLLSNTLYYKRFFPYYAFNVLGGLDNEGKGCVFTYDAVGSYERVGYSSQGSGSTLMMPVLDNQLKSPSPLLLPAKDAVTPLSESEAVDLVKDVFASAAERDIYTGDGLEIVVVNAGGIRREYVELRKD

SEQ ID NO: 8284 - protein, 224 aa, Cephalotaxus harringtonia
MRQHQSTWSPYDNNGGTCVAIAGANYCVVAADTRMSTGYSILTRDYSKICELADKCVLASSGFQADVKALQKNLSARHLIYQHQHNKQMSCPAMAQLLSNTLYYKRFFPYYAFNVLGGLDSEGKGCVFTYDAVGSYERVGYGSQGTGSTLMMPVLDNQLKSPSPLLLPVKDATTPLSESEAVDLVKDIFASATERDIYTGDGLEIVVVNAGGIRREEIMKLRYD

SEQ ID NO: 8285 - protein, 223 aa, Momordica charantia
MTKQHANWSPYDNNGGSCVAIAGADYCVIAADTRMSTGYNILTRDYSKICKLADKAVMASSGFQADVKALQKVLAARHLTYQHQHNKQMSCPAMAQLLSNTLYYKRFFPYYAFNVLGGLDNEGKGCVFTYDAVGSYERVGYSAQGSGSTLITPFLDNQLKSPSPLLLPAQDAATPLSEAEAIDLVKTVFASATERDIYTGDKLEIVVLNADGLRREYMDLRKD

SEQ ID NO: 8286 - protein, 223 aa, Quercus alba
MTKQQANWSPYDNNGGSCVAIAGADYCVIAADTRMSSGYNILTREYSKICKLADKAVMASSGFQADVNALQKHLAARHLTYQHQHNKQMSCPAMAQLLSNTLYYKRFFPYYAFNVLGGLDSEGKGCVFTYDAVGSYERVGYSSQGSGSTLIMPFLDNQLKSPSPLLLPAQDAVTPLSESEAVDLVKTVFASATERDIYTGDKLEIVVLNAGGIHREYMELRKD

SEQ ID NO: 8287 - protein, 223 aa, Tripterygium wilfordii
MTKQQANWSPYDNNGGSVVAIAGADYCVVAADTRMSTGYSILTREYSKICQLADKSFLASSGFQADVRALQKQLAARHLIYQHQHNKQMSCPAMAQLLSNTLYYKRFFPYYAFNVLGGLDNEGKGCVFTYDAVGSYERVGYSSQGSGSTLIIPFLDNQLKSPSPLLLPAQDAVTPLSEAEAIDLVKTVFASATERDIYTGDKLEIVILNAAGTRREYMELRKD

SEQ ID NO: 8288 - protein, 230 aa, Taxus baccata
MGATEGISQHQSTWSPYDNNGGTCVAIAGANYCVIAADTRMSTGYSILTRDYSKICQLADKCVLASSGFQADVKALQKNLSARHLIYQHQHNKQMSCPAMAQLLSNTLYYKRFFPYYAFNVLGGLDSEGKGCVFTYDAVGSYERVGYGSQGTGSTLMMPVLDNQLKSPSPLLLPAKDAATLLSESEAVDLVKDIFASATERDIYTGDGLEIVVVNAEGIRREEIMKLRYD

SEQ ID NO: 8289 - protein, 224 aa, Epimedium sagittatum
MAHKQQANWSPYDNNGGTCVAIAGADYCVIAADTRMSTGYSILTRDYSKICKLADKCVLASSGFQADVKALQKVLSARHLVYQHQHNKQMSCPAMGQLLSNTLYYKRFFPYYAFNVLGGLDNEGKGCVFTYDAVGSYERVGYSSQGSGSTLIMPVLDNQLKSPSPLLLPAKDAVTPLLESEAVDLVKDVFASAAERDIYTGDSVEIVVVNASGIRKEYIELRED

SEQ ID NO: 8290 - protein, 223 aa, Manihot esculenta
MTKQLANWSPYDNNGGSCVAIAGADYCVIAADTRMSTGYSILTREYSKICKLAEKSVMASSGFQADVKALQKHLAARHLIYQHQHNKQMSCPAMAQLLSNTLYYKRFFPYYAFNVLGGLDSEGKGCVYTYDAVGSYERVGYSAQGSGSTLIMPFLDNQLKSPSPLLLPAQDAVTPLSEVEAVDLVKTVFASATERDIYTGDKLEIVILNADGIRREHMELRKD

SEQ ID NO: 8291 - protein, 223 aa, Castanea mollissima
MTKQQANWSPYDNNGGSCVAIAGADYCVIAADTRMSSGYNILTREYSKICKLADKAVMASSGFQADVNALQKQLAAKHLTYQHQHNKQMSCPAMAQLLSNTLYYKRFFPYYAFNVLGGLDSEGKGCVFTYDAVGSYERVGYSSQGSGSTLIMPFLDNQLKSPSPLLLPAQDAVTPLSESEAVDLVKTVFASATERDIYTGDKLEIVVLNAGGIHREYMELRKD

SEQ ID NO: 8292 - protein, 223 aa, Unknown
  Sequence found in Organisms: Citrus sinensis, Citrus clementina, Citrus sinensis
MTKQHPAWSPYDNNGGTCVAIAGADYCVTAADTRMSTGYSILSRDYSKIIKLADKCVMASSGFQADVKALQKLLAARHLIYQHQHNKQMSCPAMGQLLSNTLYYKRFFPYYSFNVLGGLDNEGKGCVYTYDAVGSYERVGYSSQGSGSTLIMPFLDNQLKSPSPLLLPAQDAVTPLSEAEAVDLVKTCFASATERDIYTGDKLEIVVLNKDGIHREYMELRKD

SEQ ID NO: 8293 - protein, 223 aa, Cucumis sativus
MTKQQANWSPYDNNGGSCVAIAGADYCVIAADTRLSTGYNILTRDYSKICKLADKAVLASSGFQADVKALQKALSARHLIYQHQHNKQMSCPAMAQLLSNTLYYKRFFPYYAFNVLGGLDSEGKGCVFTYDAVGSYERVGYSAQGSGSTLITPFLDNQLKSPSPLLLPAQDSSTPLSEAEAIDLVKTVFASATERDIYTGDKLEIVVLNADGLRREYMNLRED

SEQ ID NO: 8294 - protein, 223 aa, Eucalyptus grandis
MTKQQANWSPYDNNGGSCVAIAGRDYCVIAADTRMSTGYSILTRDYSKISKLADKAVLASSGFQADIKALQKHLAARHLIYQHQHNKQMSCPAMAQLLSNTLYYKRFFPYYAFNVLGGLDSEGKGCVFTYDAVGSYERVGYSAQGSGSTLIMPFLDNQLKSPSPLLLPAQDAVTPLSELEAIDLVKTVFVSATERDIYTGDKVEIVILNAEGLRREFMDLRKD

SEQ ID NO: 8295 - protein, 223 aa, Euonymus alatus
MTKQQANWSPYDNNGGSVVAIAGADYCVVAADTRMSTGYSILTREYSKICQLAEKSFLASSGFQADVGALQKQLAARHLIYQHQHNKQMSCPAMAQLLSNTLYYKRFFPYYAFNVLGGLDNKGKGCVFTYDAVGSYERVGYSAQGSGSTLIMPFLDNQLKSPSPLLLPAQDAVTPLSEAEAVDLVKTVFASATERDIYTGDKLEIVILNSAGTHREYMELRKD

SEQ ID NO: 8296 - protein, 224 aa, Aristolochia fimbriata
MAPKEHANWSPYDNNGGTCVAIAGADYCVIAADTRMSTGYSILTRDYSKIIKLADKCVMASSGFQADVNTLQRNLAAKHLVYQHQHNKQMSCPAMAQHLSNTLYYKRFFPYYAFNVLGGLDNDGKGCVFTYDAVGSYERVGYSSQGSGSTLIMPVLDNQLKSPSPLLLPAKDAVTPLSESEAVDLIKDVFASAAERDIYTGDKVEIVVITAAGIKREYKDLRKD

SEQ ID NO: 8297 - protein, 224 aa, Eschscholzia californica
MAHKQQASFNPYDNNGGTCVAIAGSDYCVIAADTRMSTGYNILTRDYSKICQLADKCVLSSSGFQADVKALQKALSARHLIYQHQHGKQMSCPAMGQLLSNTLYYKRFFPYYAFNVLGGLDNEGKGCVYTYDAVGSYERVGYSSQGSGSSLIMPVLDNQLKSPSPLLLPAKDAVTPLSESEAVDLVKDVFASAAERDIYTGDRVEIVIVNAAGIRREYVELRKD

SEQ ID NO: 8298 - protein, 223 aa, Euphorbia peplus
MTKQHANWSPYDNNGGSCVAIAGANYCVIAADTRMSTGYSILTREYSKISKLADKSVMASSGFQADVKALQKHLTARHLIYQHQHNKQMSCPAMAQLLSNTLYYKRFFPYYAFNVLGGLDSEGMGCVYTYDAVGSYERVGYSAQGSGSTLIMPFLDNQLKSPSPLLLPAVDAVTPLSESEAIDLVKTVFASATERDIYTGDKLEIVVLNADGIRPEFMELRKD

SEQ ID NO: 8299 - protein, 223 aa, Cucumis melo
MTKQQANWSPYDNNGGSCVAIAGADYCVIAADTRLSTGYNILTRDYSKICKLADKAVMASSGFQADVKALQKVLSARHLTYQHQHNKQMSCPAMAQLLSNTLYFKRFFPYYAFNVLGGLDSEGKGCVFTYDAVGSYERVGYSAQGSGSTLITPFLDNQLKSPSPLLLPAQDSSTPLSEAEAIDLVKTVFASATERDIYTGDKLEIVVLNADGLRREYMDLRKD

SEQ ID NO: 8300 - protein, 223 aa, Vinca minor
MTIDHANWSPYDNNGGTCVAIAGADYCVVAADTRMSSGYNILTRDYSKIVQLAEKSVMASSGFQADVRALQKVLSARHLFYQHQLNKQMSCPAMAQLLSNTLYYKRFFPYYAFNVLAGLDSEGKGCVFTYDAVGSYERVGYSSQGSGSTLIMPFLDNQLKSPSPLLLPAKDAVTPLSESEAIDLVKTCFASATERDIYTGDKLEIVILNASGISREYMELRKD

SEQ ID NO: 8301 - protein, 223 aa, Unknown
  Sequence found in Organisms: Gossypium hirsutum, Gossypium raimondii
MTKQQANWSPYDNNGGSCVAIAGADYCVIAADTRMSTGYNILTRDYSKICKLADKCVMASSGFQADVRALQKQLAARHLIYQHQHNKQMSCPAMAQLLSNTLYYKRFFPYYSFNVLGGLDNEGKGCVFTYDAVGSYEKVGYSSQGSGSTLIMPFLDNQLKSPSPLLLPAQDAVTPLVEAEAIDLVKTVFASASERDIYTGDKLELVIINAAGIRREYMELRKD

SEQ ID NO: 8302 - protein, 223 aa, Unknown
  Sequence found in Organisms: Gossypium hirsutum, Gossypium raimondii
MPKEQANWSPYDNNGGSCVAVAGADYCVIAADTRMSTGYNILTRDYSKICKLADKCVMASSGFQADVKALQKHLAARHLIYQHQHNKQMSCPAMAQLLSNTLYYKRFFPYYSFNVLGGLDNEGKGCVFTYDAVGSYEKVGYSSQGSGSTLIMPFLDNQLKSPSPLLLPAQDAVTPLAEAEAIDLVKTVFASASERDIYTGDKLEIVVINADGIRREYMDLRKD

SEQ ID NO: 8303 - protein, 224 aa, Fagus grandifolia
MTTKQHANWSPYDNNGGSCVAIAGTDYCVIAADTRMSSGYNILTREYSKICKLADKSVMASSGFQADVKALQKHLAARHLIYQHQHNKQMSCPAMGQLLSNTLYYKRFFPYYSFNVLGGLDNEGKGCVFTYDAVGSYERVGYSAQGSGSTLIMPFLDNQLKSPSPLLLPAQDAVTPLSEAEAVDLVKTVFASATERDIYTGDKLEIVVLNADGIHREYMELRKD

SEQ ID NO: 8304 - protein, 223 aa, Cirsium arvense
MPKEQANWSPYDNNGGTCVAIAGADYCVIAADTRMSTGYSILTRDYSKICKLADKSVLASSGFQADVKALQKVLASRHLIYQHQHNKQMSCPAMAQLLSNTLYYKRFFPYYAFNVLGGLDSEGKGCVFTYDAVGSYERVGYSAQGSGATLITPFLDNQLKSPSPLLLPAKDAVTPLSETEAIDLVKTCFSSATERDIYTGDKVEILVLNADGIHCEYEELRRD

SEQ ID NO: 8305 - protein, 223 aa, Coffea canephora
MPIQQANWSPYDNNGGTCVAIAGADYCVIAADTRMSTGYNILTRDYSKIIQLADKSVMASSGFQADVRALQKVLEARHLVYQHQHNKQMSCPAMAQLLSNTLYYKRFFPYYSFNVLGGLDSEGKGCVFTYDAVGSYERVGYSSQGSGSTLIMPFLDNQLKSPSPLLLPAKDAVTPLSESEAADLVKTCFASATERDIYTGDKLEILVLNAEGIRREYMELRKD

SEQ ID NO: 8306 - protein, 223 aa, Cucurbita pepo
MTKQQANWSPYDNNGGSCVAIAGADYCVIAADTRLSTGYNILTRDYSKICKLADKAVMASSGFQADVKALQKVLAARHLTYQHQHNKQMSCPAMAQLLSNTLYFKRFFPYYAFNVLGGLDNEGKGCVFTYDAVGSYERVGYSAQGSGSTLITPFLDNQLKSPSPLLLPAQDSATPLSEAEAIDLVKTVFASATERDIYTGDKLEIVILNADGIRREYLDLRKD

SEQ ID NO: 8307 - protein, 223 aa, Fraxinus spp
MTKQKANWSPYDNNGGTCVAIAGTDYCVIAADTRMSSGYSILTRDYSKIIQLADKSVLASSGFQADVRALQKVLAAKHLQYQHQHNKQMSCPAMAQLLSNTLYYKRFFPYYAFNVLGGLDHEGKGCVFTYDAVGSYERVGYSSQGSGSTLITPFLDNQLKSPSPLLLPARDAVTPLSESEAIDLVKTCFASATERDIYTGDKLEILILNASGIRVEYMELRKD

SEQ ID NO: 8308 - protein, 223 aa, Heritiera littoralis
MTKQQANWSPYDNNGGSCVAIAGADYCVIAADTRMSTGYNILTRDYSKICKLADKCVMASSGFQADVKALQKQLAARHLIYQHQHNKQMSCPAMAQLLSNTLYYKRFFPYYSFNVLGGLDNEGKGCVFTYDAVGSYEKVGYSSQGSGSTLIMPFLDNQLKSPSPLLLPAQDAVTPLMEAEAVDLVKTVFASASERDIYTGDKLEIVIINAAGICREYMDLRKD

SEQ ID NO: 8309 - protein, 223 aa, Lippia dulcis
MTKQQANWSPYDNNGGTCVAIAGADYCVIAADTRMSTGYNILTRDYSKIIQLADKSVMASSGFQADVRALQKVLSARHLIYQHQHNKQMSCPAMAQLLSNTLYYKRFFPYYSFNVLGGLDNEGKGCVFTYDAVGSYERVGYSSQGSGSTLITPFLDNQLKSPSPLLLPAVDAVTPLSESEAIDLVKTCFASATERDIYTGDKLEIVVLNASGLRREYMELRKD

SEQ ID NO: 8310 - protein, 223 aa, Podocarpus macrophillus
MRQHQSTWSPYDNNGGTCVAIAGSNYCVIAADTRMSTGYSILTREYSKICKLADKCVLASSGFQADVKALQKNLSATHLIYQHQHNKQMSCPAMAQLLSNTLYYKRFFPYYAFNVLGGLDSEGKGCVFTYDAVGSYERVGYGAQGTGATLMMPVLDNQLKSPSPLLLPAMDSATPLSESEAVDLVKDIFASAAERDIYTGDGLEIVVVNAEGIRRESIELRLD

SEQ ID NO: 8311 - protein, 229 aa, Picea glauca
MAATEGIKQHHSTWSPYDNNGGTCIAIAGSNYCVIAADTRMSTGYSILTRDYSKICNLADKCVMASSGFQADVKALQKNLSARHLIYQHQHNKQMSCPAMAQLLSNTLYYKRFFPYYSFNVLGGLDNEGKGCVFTYDAVGSYERVGYGAQGTGGTLMMPVLDNQLKSPSPLLLPAQDATTPLSESEAVDLVKDVFASAAERDIYTGDGLEIVVVNAEGVKREFLELRRD

SEQ ID NO: 8312 - protein, 223 aa, Triphysaria pusilla
MTKQQANWSPYDNNGGTCVAIAGADYCVVAADTRMSTGYSILTRDYSKIIQLADKSVMASSGFQADVRALQKVLSARHLLYQHQHNKQMSCPAMAQLLSNTLYYKRFFPYYSFNVLGGLDSEGKGCVFTYDAVGSYERVGYSAQGSGATLITPFLDNQLKSPSPLLLPAKDAVTPLNETEAIDLVKTCFASATERDIYTGDKLEVLVLNASGIRREYMELRKD

SEQ ID NO: 8313 - protein, 223 aa, Tripterygium wilfordii
MTKQQANWSPYDNNGGSVVAIAGADYCVIAADTRMSTGYSILTREYSKICQLADKSFLASSGFQADVRALQKQLAARHLIYQHQHNKQMSCPAMGQLLSNTLYYKRFFPYYAFNVLGGLDNEGKGCVFTYDAVGSYERVGYSSQGSGSTLIMPFLDNQLKSPSPLLLPAQDAVTPLSEAEAVDLVKTVFASATERDIYTGDKLEIVILNASGTRREYMELRKD

SEQ ID NO: 8314 - protein, 223 aa, Papaver somniferum
MAHKQQRFDPYDMNGGTCVAIAGADYCVIAADTRMSTGYSILTRDYSKLCKLADKCIMASGGFQADVKALQKALSAKHLIYQHQHGKQVSCPAMGQLLSNTLYYKRFFPYYAFNVLGGLDNEGKGCVYTYDAVGSYERVGYSAQGSGSTLIMPVLDNQLKSPSPLLLPAVDAVTPLSEAEAIDLVKDVFASATERDIYTGDRLEIMIVNAAGTRTEYVELRKD

SEQ ID NO: 8315 - protein, 223 aa, Primula obconica
MTKQQANFSPYDNNGGTCVAIAGSDYCVIAADTRMSTGYSILTRDYSKIRKLADKSVMASSGFQADVRALQKVLEARHLSYQHQHNKQMSCPAMAQLLSNTLYYKRFFPYYAFNVLGGLDKEGKGCVYTYDAVGSYERVGFSAQGSGSTLIMPFLDNQLKSPSPLLLPAKDAVTPLSESEAIDLVKTCFASATERDIYTGDKLELVVLNANGLRREYMELRKD

SEQ ID NO: 8316 - protein, 230 aa, Sequoia sempervirens
MGAIEVITQRQSTWSPYDNNGGTCVAIAGANYCVIAADRRMSTGYSILTRDYSKICKLADKCVLASSGFQADVKALQKNLSARHLIYQHQHNKQMSCPAMAQLLSNTLYYKRFFPYYAFNVLGGLDSEGKGCVFTYDAVGSYERVGYGSQGTGSTLMMPVLDNQLKSPSPLLLPAKDATTPLSESEAVDLVKDIFASATERDIYTGDGLEIVVVNAEGIRREEIMELRKD

SEQ ID NO: 8317 - protein, 171 aa, Panicum virgatum
MCDLVARTGRHLQRYEDGRRLVAGCIPFRYRHIKDEQKKLVEVLMINSQSGPGLLFPKGGWENDETVEEAAAREAIEEAGVRGDLVKLLGFYDFKTKQPEGMCRAAVFALHVKEELASWPEQSTRQRSWLTVPEAAERSRHPWMQEALVTGFSAWLENWINGGGCVDGSER

SEQ ID NO: 8318 - protein, 176 aa, Sorghum bicolor
MCDLVARTGRHLQRYENGRRLVAGCIPFRYRDINDEASDDEQKKLVEVLMISSQSGPGLLFPKGGWENDETVEEAAAREAIEEAGVRGDLVQLLGFYDFKSKQPEAMCRAAIFALHVKEELASWPEQNTRQRSWLTVPEAAEQSRYPWMQEALVTGFSAWLENWRNGGGRVDRSER

SEQ ID NO: 8319 - protein, 180 aa, Zea mays
MCDLVARTGRHLQRYENGRRLVAGCIPFRYRDINDGASDDEQKKLVEVLMISSQSGPGLLFPKGGWENDETVEEAAAREAIEEAGVRGDLVQLLGFYDFKSKQPEATCRAAIFALHVKEELASWPEQSTRQRSWLTVPEAAERSRYPWMQEALVTGFSAWLENWRNGGGGGGGCVDRTER

SEQ ID NO: 8320 - protein, 151 aa, Pennisetum glaucum
LVAGCIPFRYRDIKDEQKKLVEVLMINSQSGPGLLFPKGGWENDETVEEAAAREAIEEAGVRGDLVKLLGFYDFKSKQPEGMCRAAVFALHVTEELASWPEQSTRERSWLTVPEAAERSRHPWMQEALVTGFSAWLENASNGGGCVDRSER

SEQ ID NO: 8321 - protein, 178 aa, Zea mays
MCDLVARTGRHLQRYENGRRLVAGCIPFRYMDIDDGASDDEQKKLVEVLMISSQSGPGLLFPKGGWENDEAVEETAAREAIEEARVRGDLVQLLGFYDFKSKQPEATCRAAIFALHVKEERASWPEQSTRQRSWLTVPEAAERSCYLWMQEALVTGFSSWLENWRNGGGGGCVDRTER

SEQ ID NO: 8322 - protein, 182 aa, Brachypodium distachyon
MCDLVARTGRLQQRYEDGRRLVAGCIPFRYRDNNDETSGGEQKRLVEVLMINSQSGPGLLFPKGGWENDETVEEAAAREAIEEAGVRGDLVQFLGFYNFKSKSHQDEFCPEGMCRAAIFALHVKEELASWPEQSIRQRSWLTVPEAAERSRYPWVQEALVTGFSAWHDKWSEAGSAPDPSSR

SEQ ID NO: 8323 - protein, 144 aa, Panicum virgatum
CIPFRYRDIKDEQKKLVEVLMINSQSGPGLLFPKGGWENDETVEEAAAREAIEEAGVRGDLVKLLGFYDFKTKQPEGMCRAAVFALHVKEELASWPEQSTRQRSWLTVPEAAERSRHPWMQEALVTGFSAWLENWSDGGCCVNL

SEQ ID NO: 8324 - protein, 177 aa, Panicum virgatum
MCDLVARTGRHQQRYEDGRRLVAGCIPFRYRVNNDEHKKLVEVLMINSQSGPGLLFPKGGWENDETVEEAAAREAIEEAGVRGDIVHLLGFYDFKSKTHQDACCPEGMCRAAVFALHVKEELTSWPEQSTRQRTWLTVPEAASQCRYQWMQEALLTGFSDWHDKWSRGGGGTNCDPA

SEQ ID NO: 8325 - protein, 182 aa, Brachypodium distachyon
MCDLVARTGRHQQRYEDGRRLVAGCIPFRYRANSDETSGDEQKKLVEVLMINSQSGPGLLFPKGGWENDETVEQAAAREAIEEAGVRGDIVQFLGFYDFKSKTHQDACCPEGMCRAAVFALHVKEELASWPEQSTRRRTWLTVPEAVSQCRYQWMQEALVTGFSNWHDNWSKGGGGKDCDSV

SEQ ID NO: 8326 - protein, 178 aa, Secale cereale
MCDLVARTGRHQQRYEDGRRLVAGCIPFRYRADETSGDEQKKVVEVLMINSQSGPGLLFPKGGWENDETVEQAAAREAIEEAGVRGDIVQFLGFYDFKSKTHQDACCPEGMCRAAVFALHVKEELASWPEQSTRRRTWLTVPEATTQCRYQWMQEALLTGFSEWHDNWSKGGGAGDTI

SEQ ID NO: 8327 - protein, 106 aa, Triticum aestivum
SPPSSSCAVVLTRGAPGPPAPPTSTAWNPGHPAPPTSVPCLLPRLNCFAAMGLFRGSFTLLVGMGCGVYIAQNYNVPNVKKLFNTYVFLAKHIEETYRKPKKKDDD

SEQ ID NO: 8328 - protein, 56 aa, Zea mays
MGLFRGSFTLLVGMGCGVYIAQNYNVPNVKKLFNTYVFLAKHIEETYRKPKKKDDD

SEQ ID NO: 8329 - protein, 55 aa, Pennisetum glaucum
MGLFRGGFTLLVGMGCGVYIAQNYNVPNVKKLFNTYVFLAKHIEETYRKPKKDED

SEQ ID NO: 8330 - protein, 55 aa, Panicum virgatum
MGLFRGSFTLLVGMGCGIYIAQNYNVPNVKKLFNTYVFMAKHIEETYRKPKKDDD

SEQ ID NO: 8331 - protein, 55 aa, Sorghum bicolor
MGLFKGSFTLLVGMGCGIYVAQNYNVPNVKKLFNTYVFLAKHIEETYRKPKKDDD

SEQ ID NO: 8332 - protein, 55 aa, Panicum virgatum
  misc_feature (11)..(11): Xaa can be any naturally occurring amino acid
  misc_feature (50)..(50): Xaa can be any naturally occurring amino acid
MGLFRGSFTLXVGMGCGIYIAQNYNVPNVKKLFNTYVFLAKHIEETYRKXKKDDD

SEQ ID NO: 8333 - protein, 67 aa, Oryza sativa
MMFMNGEVGKVGSDRRQLNYGGLNALPVNHCLLLYYTAFRGVVRETEVAVQMTMTPFYLLSVLRKCT

SEQ ID NO: 8334 - protein, 87 aa, Secale cereale
PSPASNHPRRRRSPPPRQSPPPRQSPTPCRPVPAPRPSAAAAHLVALPPPSPLGCLRTPVAPGRRADLSLLTPAPAADCPISSTRSC

SEQ ID NO: 8335 - protein, 61 aa, Triticum aestivum
GFLAMGLFGGGLKFLVGVGCGVYVAQNYNVPNVKKLFNTYVFLAKHIEETYRKPKKDDKDE

SEQ ID NO: 8336 - protein, 57 aa, Secale cereale
MGFFGGGFKFLVGMGCGVYVAQNYNVPNVKKLFNTYVFLAKHIEETYRKPKKDDKDE

SEQ ID NO: 8337 - protein, 65 aa, Hordeum vulgare
HRYPGFLAMGLFGSGFKFLAGVGCGVYVAQNYNVPNVKKLFNTYVFLAKHIEETYRKPKKDDKDD

SEQ ID NO: 8338 - protein, 127 aa, Brachypodium distachyon
MRFGLVWSLLVHPVCLTPDSSPPRFPLLSRFAPPPFRSTAGNSPPPPSGYRGTAPTTLLHTQAEAHLAASPTKIRQLGAHLGVHLVPVQDPPPSCSSTPAACSPSLPPFHVDPSRCAELLPLRTKPP

SEQ ID NO: 8339 - protein, 175 aa, Hordeum vulgare
GNPRRPVAAAIPHQAALLDAGAPRRANPRLPADPRALPGHPLRRPHRRTPAVTPRLPPDPRCAWSLCRPAAADSRARGRLLDLLDPHLLIDTDPCSSIRNPVFSQWGSSVAASNFWREWDVVSMWLRTTTFQMSRSCSTRMFSWPSTLRKHTASQRKTTKTTDYRAPGEKKYTLT

SEQ ID NO: 8340 - protein, 54 aa, Brachypodium distachyon
MGLFSGSFKFLMGMGCGIYVAQNYNVPNVKKLFNTYVFLAKHLEETYRKPKKED

SEQ ID NO: 8341 - protein, 62 aa, Secale cereale
TSSHSRRRHPSPSAPRCAAADSDAGGRLPDLLHLRLLIDIGPCSFICNPVFLQWFSVAASNF

SEQ ID NO: 8342 - protein, 70 aa, Secale cereale
RPVRAPGPSAAPPTSSHSRRRHPSPSAPRCAAADSDAGLLHLQLLIDIDPCSFICNPVFLQWFSVAASNF

SEQ ID NO: 8343 - protein, 154 aa, Triticum aestivum
PGSPPLCPRPSALGFLIPPPAPLLLPPTSEGLLRPPQQPTSAAPTRPPRLPLPSSAPGHLRSSRRAKDGAVTLAATSRRLFLRVADRCSPSTAAWGFLAMVFGGGFKFLVGVGCGVYVAQNYNVPNVKKLFNTYVFLAKHVEETYRKPPKKDDD

SEQ ID NO: 8344 - protein, 185 aa, Zea mays
MSLLASPTPFGVTAIRRRVAPLPLLPAGGRAALHVALARRGGVSSRTQRRLEERGGKKRRGGVVAPDVDEDAAEAGVAEWEGEPLGFEVSTEPMPRLPDPETPDFWEGPQWEALGFFVQYMWAFGVVFGLIACGVAVATYNDGATDFKDTPAYKESQSQEFPEESESSSADVFEGNPTEVAPALE

SEQ ID NO: 8345 - protein, 185 aa, Sorghum bicolor
MSLLASPTPFGAAAVRRRVAPLPLLPAGGRAALHVALARRGGVSSRTQRRLEERGGKKRRGGVAAPDVDEDAAEAGAAAWEGEPLGFEVSTEPMPQLPDPETPDFWEGPQWEALGFFVQYMWAFGVVFGLIACGVAVATYNDGATDFRDTPAYKESQSQEFPEEAESSSADVFEGNPTEVAPALE

SEQ ID NO: 8346 - protein, 186 aa, Zea mays
MALLASPTPFGAAAIRRRVAPLPLIPAGGRAALHVALARRGGVSSRTQRRLEERGGKKRRGGVAAPDVDEDAAEAGTAAEWEGEPLGFEVSTEPMPELPNPEKPDFWEGPQWEALGFFVQYMWAFGVVFGLIACGVAVATYNDGATDFRDTPAYKESQSQEFPEESESSSADVFEGNPTEVAPALE

SEQ ID NO: 8347 - protein, 170 aa, Panicum virgatum
RRRAAPLPLLPASGRAALHVALARRGGVSSRTQRRLEERGGKKRRGGVAAPDVDEEAAEAGAAEWEGEPLGFEVSTEPMPELPDPETPDFWEGPQWEALGFFVQYMWAFGVVFGLIACGVAVATYNDGATDFRDTPAYKESQTQEFPEESESSSADVFEGNPTEVAPALE

SEQ ID NO: 8348 - protein, 92 aa, Saccharum officinarum
MPQLPDPETPDFWEGPQWEALGFFVQYMWAFGVVFGLIACGVAVATYNDGATDFRDTPAYKESQSQEFPEESESSSADVFQGNPTEVAPALE

SEQ ID NO: 8349 - protein, 154 aa, Pennisetum glaucum
AVHVALARRGGVSSRTQRRLEERGGKKRRGGVAAPDVDEDAAEAGAAEWEGEPLGFEVSTEPMPVLPDPETPDFWEGPQWEALGFFVQYMWAFGVVFGLIACGVAVATYNDGATDFKDTPAYKESLTQEFPEESESSGADVFEGNPTEVAPALE

SEQ ID NO: 8350 - protein, 187 aa, Pseudoroegneria spicata
MSLLSSPTPFGAATAARRRLPLAAPLLGRRAALHVALARRTGVSSRTQRRLEERGGKKRRGGVETPDADEDSGPAWEGVEWEGEPLGFEVSTEPMPYLPDPEKPDFWEGPNWEALGFFVQYMWAFGVFFSLVACGVAVATYNDGASDFRDTPAFKESTQAQEFPEESESSGADVFEGNPTEVAPALE

SEQ ID NO: 8351 - protein, 191 aa, Brachypodium distachyon
MSLLASPTPFGTASAAARRRLPPATTPLLGRRAALHVALARRGGVSSRTQRRLEERGGKKRRGGVDAPAPPDADEDYAEAWEGVEWEGEPLGFEVSTTPMPYLPDPEQQDFWEGPQWDGLGFFVQYMWAFGVFFSLIACGVAVATYNDGATDFRDTPAFKESQTQEFPEESESSGSDVFEGNPTEVAPALE

SEQ ID NO: 8352 - protein, 88 aa, Sorghum bicolor
MASMKPLLTLTCIFLLSGLVVLGEIGGTTLAAPEPCPVVCIQGGYITCDNYPYQELDGCDCECAPKDGINCVLHHLATGDTFNCPPQA

SEQ ID NO: 8353 - protein, 476 aa, Panicum virgatum
MKLRLRSMEARGGGRAAVETHRVDLPPTATLPYVKALLAAKLSAAQPVPAESVRLSLNRTEELVSPDPAATLPALGLASGDLVYFALSPLTALAPPAQALPRNPSPGSASVPTAMAVDGGKGSEQPGTGGSSLQVRTVAVDPIVPAAPGPADVVMEEVVDATKGWSSFVLRDLKREMGNVAGAEETAAGRLVSALHAALLEVGFLTTDPMGSYLSLQQDWPSVASKPLAIKYTIPELSPMSPAAEEGKVAVLNFSLMGNFVIVYGYVPGAQSEVCRLCLELPRLEPLLYLDSDQLSGVQERAILDMWKVLKDDMCLPLMISLCQLNGLRLPPCLMALPAELKTKVLDLLPGDDLARVECTCKEMRNLAADDSLWEKFIAKYKNYGEGSRGAMSAKAMFGEAWLANKRRQKRPHPTFWNYGWGNNPYSRPLRQPLIGGDSDRLPFIGNHGSVGRNFGNQRRNIVPNCILDGHRHNFL

SEQ ID NO: 8354 - protein, 644 aa, Sorghum bicolor
MGMGSDAAAVLFPFSTTTTTTSPRLCGTAVSSHRRIFSDVAEDVTVSVDGQSFLLHKFPLVSRCGRVRKMVVDSKDPDLLKLELVNVPGGAFAFELAAKFCYGSNFEITTGNVAHLRCVAEYLEMTEDYQEENLIFRTETYLNEIVLKNLDKSLEVLCKCDGLDPVVEEVGLVDRCVDAIAVNASKEQLVSGLAHLECDVGSAKLRMHCQDWWVEDLSALRIDHYRRVIAAMRRNGVRPESIGTSITHYAQTSLKGVERRHVWDSGPFVGDSQRMIVETLIDLLATENITTVTLSFLFGMLRMAIEVDASLDCRIEVEKRIGLQLEMASLDDLLIPSTQTSDSMFDVDTVHRILVNFLQRIDEDSSGELSPCGYDSDGLKSPSHSSVLKVGRLMDGYLAEVAPDPYLKLQKFMALIELLPDYARIVDDGLYRAIDIYLKAHPSLTESECKKLCKLIDCQKLSQDASSHAAQNDRLPIQMVVRVLYFEQLRLKSSFSGGGSGCVSGLGLGADGSLSQRFVCSSSGVPSSCVSPQRDNYASLRRENRELKLEISRMRVRLTELEREQGLMKQQGRMRGGDGGGRHGGEQGRAFLASLSRGFGRITMFGVGGGPAAADRRRKKSGGRSSQCSDGKARRRHKASFAYD

SEQ ID NO: 8355 - protein, 139 aa, Panicum virgatum
MRSSSYCESNCAPPLCYLPCLLKSKDDAGGDLESESPSPAAVAEDKPPVVQKIEEAAAATGGGDDDDDDEKGCKEVAVASKSCLKRADCVDSSKNVVKGNVKWKDLLGKDLTQVKEFEPSESGDSDDDEDAGACTCVIQ

SEQ ID NO: 8356 - protein, 136 aa, Setaria italica
MRSSSYCESNCAPPLCYLPCLPKSKDDAGGDLASGSPSPAAVTEDKPPVVQKIEEAAAAPGGDDDDEKGCKEVAVASKSCLKRADCADSSKNVVKGNVKWKDLLGKDLTQVKEFEPSESGDSDDDEDTGACTCVIQ

SEQ ID NO: 8357 - protein, 130 aa, Sorghum bicolor
MATSVSAVAALAVFSAPRSLLQRPAQLPSRQNVVSFFVGPARAHRRLVAVAASSPATPPDLANKVSESIKQAKETCADDPVSAECVAAWDEVEELSAAASHARDRQKGVDPLEEYCKDNPETDECRTYED

SEQ ID NO: 8358 - protein, 555 aa, Saccharum officinarum
MAKKKEKAVNVSGKPRHSNDVNRPNDKKGAGGGAGGGSRSAATVRRLKMYKTRPKRDRSGKVLRNDFQSKELPNTRIEPDRRWFGNTRVVGQPQLEMFREELQSRLSDNFSVILKERKLPLSLLQDHQKQARAHLLDVEPFEHAFGPKGKRKRPKLTALDYESLLKRADDSQDAFEQKYASSKLPREEEEDGLRDLVRHTMFEKGQSKRIWGELYKVIDSSDVVVQVLDARDPMGTRCYHLEKHLKENCKHKHLVFLLNKCDLIPAWATKGWLRTLSKDYPTLAFHASINKSFGKGSLLSVLRQFARLKNDKQAISVGFVGYPNVGKSSVINTLRSKSVCKVAPIPGETKVWQYITLTKKIFLIDCPGVVYQNNDSETDIVLKGVVRVTNLEDAAEHIGEVLRRVRKEHLQRAYKIQEWSDDNDFLVQLCRTTGKLLKGGEPDLTTAAKMVLHDWQRGKIPFFVPPPQQSEDGASESAEPVGKTEEDGVSSDRTAAAMKAIAGIISSQQNMNVPCHKEHNADNEDTESADNEDIEGADKEDIDSADNDELAEQSE

SEQ ID NO: 8359 - protein, 547 aa, Sorghum bicolor
MAKKKEKAVNVSGKPRHSNDVNRPNDKKGAGGGAGGGSRSAATVRRLKMYKTRPKRDRAGKVLRNDFQSKELPNTRIVPDRRWFGNTRVVGQQQLAFFREELTSQLSDNFSVILKERKLPLSLLQDHQKQARAHLLDVEPFEHAFGPKGKRKRPKLTALDYESLLKKADDSQDAFEQKYASSKLPREEEEDGLRDLVRHTMFEKGQSKRIWGELYKVIDSSDVVVQVLDARDPMGTRCYHLEKHLRENCKHKHLVFLLNKCDLIPAWATKGWLRTLSKDYPTLAFHASINKSFGKGSLLSVLRQFARLKNDKQAISVGFVGYPNVGKSSVINTLRSKSVCKVAPIPGETKVWQYITLTKKIFLIDCPGVVYQNNDSETDIVLKGVVRVTNLEDAAEHIGEVLRRVKKEHLQRAYKIQEWSDDNDFLVQLCRTTGKLLKGGEPDLTTAAKMVLHDWQRGKIPFFVPPPQQSEDGASESAEPVGKTEEDGVSSDRTAAAMKAIAGIISSQQNMNVPCHKEHNADNEDTASEDNEDIESADNDEHAEQSE

SEQ ID NO: 8360 - protein, 541 aa, Panicum virgatum
MAKKKEKAVNVSGKPRHSNDVNRPNDKKGAGGGAGGGARSAATVRRLKMYKTRPKRDRSGKVLRNDFQSKELPNTRIEPDPRWFGNTRVVGQPQLELFREELQNRLSDNFSVILKERKLPLSLLQDHQKQARAHLLDVEPFEHAFGPKGKRKRPKLTALDYESLLKKADDSQDAFEQKYASSKLPKEEEEDGLRDLVRHTMFEKGQSKRIWGELYKVIDSSDVVVQVLDARDPMGTRCYHLEKHLKENCKHKHLVFLLNKCDLIPAWATKGWLRTLSKDYPTLAFHASINKSFGKGSLLSVLRQFARLKNDKQAISVGFVGYPNVGKSSVINTLRSKSVCKVAPIPGETKVWQYITLTKKIFLIDCPGVVYQNNDSETDIVLKGVVRVTNLEDAAEHIGEVLRRVKKEHLQRAYKIQDWTDDNDFLLQLCRTTGKLLKGGEPDLTTAAKMVLHDWQRGKIPFFVPPPQQSDDGASEIAEPVEKTEEDGVSSDRTAAAMKAIARIISSQQNLNVPCHKEHDADNEDIESEDNEEIELPEQSE

SEQ ID NO: 8361 - protein, 541 aa, Setaria italica
MAKKKEKAVNVSGKPRHSNDVNRPNDKKGAGGGAGGGARSAATVRRLQMYKTRPKRDRSGKVLRNEFQSKELPNTRIEPDRRWFGNTRVVGQPQLALFREELQNHLSDNFSVILKERKLPLSLLQDHQKQARAHLLDVEPFEHAFGPKGKRKRPKLTALDYESLLKKADDSQDAFEQKYASSKLPREEEEDGLRDLVRHTMFEKGQSKRIWGELYKVIDSSDVVVQVLDARDPMGTRCYHLEKHLKENCKHKHLVFLLNKCDLIPAWATKGWLRTLSKNYPTLAFHASINKSFGKGSLLSVLRQFARLKNDKQAISVGFVGYPNVGKSSVINTLRSKSVCKVAPIPGETKVWQYITLTKKIFLIDCPGVVYQNNDSETDIVLKGVVRVTNLADAAEHIGEVLRRVKKEHLQRAYKIQDWADDNDFLVQLCRTTGKLLKGGEPDLTTVAKMVLHDWQRGKIPFFVPPPQQSDDGASEGAEPVEKTEEDGVSSDRTAAAMKAIAGIISSQQNMNVPCHKEHDGDNEDSESEDNEDSEVPEQSE

SEQ ID NO: 8362 - protein, 535 aa, Oryza sativa
MAKKKERAVNVSGKPRHSLDVNRANDKKGAGGGAGGGGGGRSAATVRRLKMYKMRPLRDRGGKILKHDLQSKELPNTRIEPDRRWFGNTRVVNQKELEFFREELQSRLSNNYNVILKERKLPLSLLQDHQKQARAHLLDTEPFEHAFGPKGKRKRPKLMALDYESLLKKADDSQGAFEDKHATAKLLKEEEEDGLRDLVRHTMFEKGQSKRIWGELYKVIDSSDVVVQVLDARDPMGTRCYHLEKHLKENAKHKHLVFLLNKCDLVPAWATKGWLRTLSKDYPTLAFHASINSSFGKGSLLSVLRQFARLKSDKQAISVGFVGYPNVGKSSVINTLRSKSVCKVAPIPGETKVWQYITLTKRIFLIDCPGVVYQNNDSETDIVLKGVVRVTNLADASEHIGEVLRRVKKEHLKRAYKIEDWVDDNDFLVQLSKTTGKLLRGGEPDLTTTAKMVLHDWQRGKIPFFVPPPQQGEDSPSETAEPVEKSDEEGVSSDRTAAAMKAIAGIISSQQQMNVPCQKEFGVTNEDSEVAEQSE

SEQ ID NO: 8363 - protein, 502 aa, Pennisetum glaucum
QMYKTRPKRDRSGKVLRNEFQSKELPNTRIEPDRRWFSNTRVVGQPQLALFREELKNHLSDNFSVILKERKLPLSLLQDHQKQARAHLLDVEPFEHAFGPKGKRKRPKLTALDYESLLKKADDSQDAFEQKYASSKLPREEEEDGLRDLVRHTMFEKGQSKRIWGELYKVIDSSDVVVQVLDARDPMGTRCYHLEKHLKENCKHKHLVFLLNKCDLIPAWATKGWLRTLSKDYPTLAFHASINKSFGKGSLLSVLRQFARLKNDKQAISVGFVGYPNVGKSSVINTLRSKSVCKVAPIPGETKVWQYITLTKKIFLIDCPGVVYQNNDSETDIVLKGVVRVTNLEDAAEHIGEVLRRVKKEHLQRAYKIQDWTDDNDFLVQLCRTTGKLLKGGEPDLTTAAKMVLHDWQRGKIPFFVPPPQQSDDGASEGAEPVEKTEEDGVSSDRTAAAMKAIARIISSQQDMSVPCHKEHDGDNADSGSEDNEDNEVPEQTEEILGTDLD

SEQ ID NO: 8364 - protein, 539 aa, Secale cereale
MGKKKERSVNVSGKPRHSLDVNRPNDKKGAGGGGGAGGSRSAATVRRLKMYKLRPMRDRGGKIVKHDLQSKELPNTRIEPDRRWFGNTRVINQKELEYFRQELQARLTNNYSVLLKSKQLPLSLLQDHQKQARAHLLDTEPFEHAFGPKGKRKRPKLSSLDYESLIKKADDSQDAFEEKHASSKLPKDEEEDGLRDLVRHNMFEKGQSKRIWGELYKVLDSSDVVVQVLDARDPMGTRCYHLEKHLKENAKHKHLVFLLNKCDLIPAWATKGWLRTLSRDYPTLAFHASINKSFGKGSLLSVLRQFARLRSDKQAISVGFVGYPNVGKSSVINTLRSKTVCKVAPIPGETKVWQYITMTKKIFLIDCPGVVYQNNDTETDVVLKGVVRVTNLDDASEHIGEVLRRVKKEHLQRAYKIQDWADDNDFLVQLSKMSGKLLKGGEPDLTTAAKMVLHDWQRGKIPFFVPPPQQNEDGPSKITEPVEGSGEEVVSSDRAAAAMKAIAGIISSQQTMNVPCQKELGRNGEDSELLEQSDLLVKD

SEQ ID NO: 8365 - protein, 529 aa, Brachypodium distachyon
MAKKKERAVNVSGKPRHSLDVNRPNDKKGAGAGGRRSAATVRRLQMYKVRPKRDRGGKILSNDCQSKELPNTRIEPDRRWFGNTRTVGQKELELFRGELETRLANNYSVILKARKLPMALLQDHQKQARAHLLETEPFEHAFGPKGKRKRPKLSSLDYESLIKKADDSQDAFEEKHASSKLPKDEEEDGLRDLVRHNMFEKGQSKRIWGELYKVIDSSDVVVQVLDARDPMGTRCYHLEKHLKENAKHKHIVFLLNKCDLIPAWATKGWLRTLSRDYPTLAFHASINKSFGKGSLLSVLRQFARLRSDKQAISVGFVGYPNVGKSSVINTLRSKTVCKVAPIPGETKVWQYITMTKRIFLIDCPGVVYQNNDSETDVVLKGVVRVTNLDDASEHIGEVLRRVKKEHLQRAYKIQDWADDNDFLVQLSKMSGKLLKGGEPDLTTAAKMVLHDWQRGKIPFFVPPPQQNEGPSEIADPVEGSGEEVVSSDRTTAAMKAISGIITSQQTMNIPCQKEFGTNKEDSELAEQSE

SEQ ID NO: 8366 - protein, 539 aa, Triticum aestivum
MGKKKERSVNVSGKPRHSLDVNRPNDKKGAGGGGGAGGSRSAATVRRLKMYKLRPMRDRGGKIVKHDLQSKELPNTRIEPDRRWFGNTRVINQKELEYFRQELQARLTNNYSVLLKSKQLPLSLLQDHQKQARAHLLDTEPFEHAFGPKGKRKRPKLSSLDYESLIKKADDSQDAFEEKHASSKLPKDEEEDGLRDLVRHNMFEKGQSKRIWGELYKVLDSSDVVVQVLDARDPMGTRCYHLEKHLKENAKHKHLVFLLNKCDLIPAWATKGWLRTLSRDYPTLAFHASINKSFGKGSLLSVLRQFARLRSDKQAISVGFVGYPNVGKSSVINTLRSKTVCKVAPIPGETKVWQYITMTKRIFLIDCPGVVYQNNDTETDVVLKGVVRVTNLDDASEHIGEVLRRVKKEHLQRAYKIQDWADDNDFLVQLSKMSGKLLKGGEPDLTTAAKMVLHDWQRGKIPFFVPPPQQNEDGPSKITEPVEGSGEEVVSSDRAAAAMKAIAGIISSQQTMNVPCQKELGRNGEDSELPEQSDLLVKD

SEQ ID NO: 8367 - protein, 538 aa, Hordeum vulgare
MGKKKERSSNVSGKPRHSLDVNRPNDKKGAGGAGGAGGSRSAATVRRLQMYKLRPKRDRGGKIVKHDLQSKELPDTRIEPDRRWFGNTRVINQKELEYLRQELQARLTNNYSVLLKSKQLPLSLLQDHQKQARAHLLDTEPFEHAFGPKGKRKRPKLSSLDYESLIKKADDSQDAFEEKHASSKLPKNEEEDGLRDLVRHNMFEKGQSKRIWGELYKVLDSSDVVVQVLDARDPMGTRCYHLEKHLKENAKHKHLVFLLNKCDLIPAWATKGWLRTLSRDYPTLAFHASINKSFGKGSLLSVLRQFARLRSDKQAISVGFVGYPNVGKSSVINTLRSKTVCKVAPIPGETKVWQYITMTKRIFLIDCPGVVYQNNDTETDVVLKGVVRVTNLDDASEHIGEVLRRVKKEHLQRAYKIQDWADDNDFLVKLSKMSGKLLKGGEPDLTTAAKMVLHDWQRGKIPFFVPPPQQNEEGPKITESVERSGEEVVSSDRTAAAIKAIAGIISSQQTMNIPCQKEFGRNGEDSELPEQSDLLVED

SEQ ID NO: 8368 - protein, 504 aa, Panicum virgatum
MALRRALLRSAEISPDRKAAIEYFHSLSRAQPARSLNGAGLCPASRSFSTQAATTSSTPQPPPPPPPPEKTHFGGLKDEDRIFTNLYGLHDPFLKGAMKRGDWHRTKDLVIKGADWIVNEMKKSGLRGRGGAGFPSGLKWSFMPKVSDGRPSYLVVNADESEPGTCKDREIMRHDPHKLLEGCLIAGVGMRASAAYIYIRGEYVNERLNLEKARQEAYAAGLLGKNACGSGYDFDVHIHFGAGAYICGEETALLESLEGKQGKPRLKPPFPANAGLYGCPTTVTNVETVAVSPTILRRGPEWFASFGRKNNSGTKLFCISGHVNKPCTVEEEMSIPLKELLERHCGGVRGGWDNLLAVIPGGSSVPLLPKHICDDVLMDYDALKAVQSGLGTAAVIVMDKSTDVVDAIARLSYFYKHESCGQCTPCREGTPWLWMIMERLKVGNAKLEEIDMLQEVTKQIEGHTICALGDAAAWPVQGLIRHFRPELERRIRERAERELLAASA

SEQ ID NO: 8369 - protein, 504 aa, Pennisetum glaucum
MALRRALLRSVEISPDRKAAIEYFHSLSRAQPARSLNGSGLCPASRSFSTQAATTSSTPQPPPPPPPPEKTHFGGLKDEDRIFTNLYGLHDPFLKGAMKRGDWHRTKDLVLKGADWIVNEMKKSGLRGRGGAGFPSGLKWSFMPKVSDGRPSYLVVNADESEPGTCKDREIMRHDPHKLLEGCLIAGVGMRASAAYIYIRGEYVNERLNLEKARQEAYAAGLLGKNACGSGYDFDVHIHFGAGAYICGEETALLESLEGKQGKPRLKPPFPANAGLYGCPTTVTNVETVAVSPTILRRGPEWFASFGRKNNSGTKLFCISGHVNKPCTVEEEMSIPLKELLERHCGGVRGGWDNLLAVIPGGSSVPLLPKHICDDVLMDYDALKAVQSGLGTAAVIVMDKSTDVVDAIARLSYFYKHESCGQCTPCREGTPWLWMIMERLKVGNAKLEEIDMLQEVTKQIEGHTICALGDAAAWPVQGLIRHFRPELERRIRERAERELLAASA

SEQ ID NO: 8370 - protein, 504 aa, Setaria italica
MALRRALLRSAEISPDRKAAIEYFHSLSRAQPARSLNGAGLCPASRSFSTQAATTSSTPQPPPPPPPPEKTHFGGLKDEDRIFTNLYGLHDPFLKGAMKRGDWHRTKDLVLKGADWIVNEMKKSGLRGRGGAGFPSGLKWSFMPKVSDGRPSYLVVNADESEPGTCKDREIMRHDPHKLLEGCLIAGVGMRASAAYIYIRGEYVNERLNLEKARQEAYAAGLLGKNACGSGYDFDVHIHFGAGAYICGEETALLESLEGKQGKPRLKPPFPANAGLYGCPTTVTNVETVAVSPTILRRGPEWFASFGRKNNSGTKLFCISGHVNKPCTVEEEMSIPLKELLERHCGGVRGGWDNLLAVIPGGSSVPLLPKHICDDVMMDYDALKAVQSGLGTAAVIVMDKSTDVVDAIARLSYFYKHESCGQCTPCREGTPWLWMIMERLKVGNAKLEEIDMLQEVTKQIEGHTICALGDAAAWPVQGLIRHFRPELERRIRERAERELLAASA

SEQ ID NO: 8371 - protein, 504 aa, Zea mays
MALRRALLRSAEISFERKAAIEYIHSLSRAQPARSLNGAGLCPASRSLSTQAATTSSTPQPPPPPPPPEKTHFGGLKDEDRIFTNLYGLHDPFLKGAMKRGDWYRTKDLVIKGADWIVNEMKKSGLRGRGGAGFPSGLKWSFMPKVSDGRPSYLVVNADESEPGTCKDREIMRHDPHKLLEGCLIAGVGMRASAAYIYIRGEYVNERLNLEKARQEAYAAGLLGKNACGSGYDFDVHIHFGAGAYICGEETALLESLEGKQGKPRLKPPFPANAGLYGCPTTVTNVETVAVSPTILRRGPEWFASFGRKNNSGTKLYCISGHVNKPCTVEEEMSIPLKELLERHCGGVRGGWDNLLAVIPGGSSVPLLPKHICDDVLMDYDALKAVQSGLGTAAVIVMDKSTDVVDAIARLSYFYKHESCGQCTPCREGTPWLWMIMERLKVGDAKLEEIDMLHEVTKQIEGHTICALGDAAAWPVQGLIRHFRPELERRIRERAERELLAASA

SEQ ID NO: 8372 - protein, 499 aa, Unknown
  Sequence found in Organisms: Sorghum bicolor, Saccharum officinarum
MALRRALLRSAEISPDRKAAIEYFHSLSRAQPARSLNGAGRSFSTQAATTSSTPQPPPPPPPPEKTHFGGLKDEDRIFTNLYGLHDPFLKGAMKRGDWYRTKDLVIKGADWIVNEMKKSGLRGRGGAGFPSGLKWSFMPKVSDGRPSYLVVNADESEPGTCKDREIMRHDPHKLLEGCLIAGVGMRASAAYIYIRGEYVNERLNLEKARQEAYAAGLLGKNACGSGYDFDVHIHFGAGAYICGEETALLESLEGKQGKPRLKPPFPANAGLYGCPTTVTNVETVAVSPTILRRGPEWFASFGRKNNSGTKLFCISGHVNKPCTVEEEMSIPLKELLERHCGGVRGGWDNLLAVIPGGSSVPLLPKHICDDVLMDYDALKAVTSGLGTAAVIVMDKSTDVVDAIARLSYFYKHESCGQCTPCREGTPWLWMIMERLKVGNAKLEEIDMLQEVTKQIEGHTICALGDAAAWPVQGLIRHFRPELERRIRERAERELLAASA

SEQ ID NO: 8373 - protein, 485 aa, Setaria italica
AIEYFHSLSRAQPARSLNGAGLCPASRSFSTQAATTSSTPQPPPPPPPPEKTHFGGLKDEDRIFTNLYGLHDPFLKGAMKRGDWHRTKDLVLKGADWIVNEMKKSGLRGRGGAGFPSGLKWSFMPKVSDGRPSYLVVNADESEPGTCKDREIMRHDPHKLLEGCLIAGVGMRASAAYIYIRGEYVNERLNLEKARQEAYAAGLLGKNACGSGYDFDVHIHFGAGAYICGEETALLESLEGKQGKPRLKPPFPANAGLYGCPTTVTNVETVAVSPTILRRGPEWFASFGRKNNSGTKLFCISGHVNKPCTVEEEMSIPLKELLERHCGGVRGGWDNLLAVIPGGSSVPLLPKHICDDVMMDYDALKAVQSGLGTAAVIVMDKSTDVVDAIARLSYFYKHESCGQCTPCREGTPWLWMIMERLKVGNAKLEEIDMLQEVTKQIEGHTICALGDAAAWPVQGLIRHFRPELERRIRERAERELLAASA

SEQ ID NO: 8374 - protein, 505 aa, Triticum aestivum
MALRWALLRSAEISPGRKAALEYLHSLSKAQPTRSISCAGLHPAGRSFSTQAATTSSTPQPPPPPPPPEKTHFGDLKDEDRIFTNLYGLHDPFLKGAMKRGDWYRTKDLVIKGADWIVNEMKKSGLRGRGGAGFPSGLKWSFMPKVSDGRPSYLVVNADESEPGTCKDREIMRHDPHKLLEGCLIAGVGMRASAAYIYIRGEYVNERLNLEKARQEAYASGLLGKNACGSGYDFDVHIHFGAGAYICGEETALLESLEGKQGKPRLKPPFPANAGLYGCPTTVTNVETVAVSPTILRRGPEWFASFGRKNNSGTKLYCISGHVNKPCTVEEEMSIPLKELIEKHCGGVRGGWDNLLAVIPGGSSVPLLPKHICDDVLMDYDALKAVQSGLGTAAVMVMDKSTDVVDAIARLSYFYKHESCGQCTPCREGTGWLWMIMERLKVGNAKLEEIDMLQEVTKQIEGHTICALGDAAAWPVQGLIRHFRPELERRIRDRADSELLMAASA

SEQ ID NO: 8375 - protein, 504 aa, Oryza sativa
MALRRALLRSAEISPDRKAALEYLHYLSRAQPTRSLTGAGLYSAGKSFSTQAATTSSTPQPPPPPPPPEKTHFGDLKDEDRIFTNLYGQHDPFLKGAMKRGDWHRTKDLVLKGADWIVNEMKKSGLRGRGGAGFPSGLKWSFMPKVSDGRPSYLVVNADESEPGTCKDREIMRHDPHKLLEGCLIAGVGMRASAAYIYIRGEYVNERLNLLKAREEAYAAGLLGKNACGSGYDFDVHIHFGAGAYICGEETALLESLEGKQGKPRLKPPFPANAGLYGCPTTVTNVETVAVSPTILRRGPEWFASFGRKNNSGTKLFCVSGHVNKPCTVEEEMSIPLKELIEKHCGGVRGGWDNLLAIIPGGSSVPLLPKHICDDVLMDYDALKAVQSGLGTAAVIVMDKSTDVVDAIARLSYFYKHESCGQCTPCREGTGWLWMIMERLKVGNAKLEEIDMLQEVTKQIEGHTICALGDAAAWPVQGLIRHFRPELERRIRERAERELLAASA

SEQ ID NO: 8376 - protein, 505 aa, Triticum aestivum
MALRWALLRSAEISPGRKAALEYLHSLSKAQPTSSISCAGLHPAGRSFSTQAATTSSTPQPPPPPPPPEKTHFGDLKDEDRIFTNLYGLHDPFLKGAMKRGDWYRTKDLVIKGADWIVNEMKKSGLRGRGGAGFPSGLKWSFMPKVSDGRPSYLVVNADESEPGTCKDREIMRHDPHKLLEGCLIAGVGMRASAAYIYIRGEYVNERLNLEKARQEAYASGLLGKNACGSGYDFDVHIHFGAGAYICGEETALLESLEGKQGKPRLKPPFPANAGLYGCPTTVTNVETVAVSPTILRRGPEWFASFGRKNNSGTKLYCISGHVNKPCTVEEEMSIPLKELIEKHCGGVRGGWDNLLAVIPGGSSVPLLPKHICDDVLMDYDALKAVQSGLGTAAVMVMDKSTDVVDAIARLSYFYKHESCGQCTPCREGTGWLWMIMERLKVGNAKLEEIDMLQEVTKQIEGHTICALGDAAAWPVQGLIRHFRPELERRIRDRADSELLMAASA

SEQ ID NO: 8377 - protein, 505 aa, Triticum aestivum
MALRWALLRSAEISPGRKAALEYLHSLSKAQPTRSISCTGLHPAGRSFSTQAATTSSTPQPPPPPPPPEKTHFGDLKDEDRIFTNLYGLHDPFLKGAMKRGDWYRTKDLVIKGADWIVNEMKKSGLRGRGGAGFPSGLKWSFMPKVSDGRPSYLVVNADESEPGTCKDREIMRHDPHKLLEGCLIAGVGMRASAAYIYIRGEYVNERLNLEKARQEAYASGLLGKNACGSGYDFDVHIHFGAGAYICGEETALLESLEGKQGKPRLKPPFPANAGLYGCPTTVTNVETVAVSPTILRRGPEWFASFGRKNNSGTKLYCISGHVNKPCTVEEEMSIPLKELIEKHCGGVRGGWDNLLAVIPGGSSVPLLPKHICDDVLMDYDALKAVQSGLGTAAVMVMDKSTDVVDAIARLSYFYKHESCGQCTPCREGTGWLWMIMERLKVGNAKLEEIDMLQEVTKQIEGHTICALGDAAAWPVQGLIRHFRPELERRIRDRADSELLMAASA

SEQ ID NO: 8378 - protein, 505 aa, Hordeum vulgare
MALRWALFRSAEISPGRKAAFEYLHSLSRAQPTRSPSCADLYPAGRSFSTQAATTSSTPQPPPPPPPPEKTHFGDLKDEDRIFTNLYGLHDPFLKGAMKRGDWNRTKDLVIKGADWIVNEMKKSGLRGRGGAGFPSGLKWSFMPKVSDGRPSYLVVNADESEPGTCKDREIMRHDPHKLLEGCLIAGVGMRASAAYIYIRGEYVNERLNLEKARQEAYASGLLGKNACGSGYDFDVHIHFGAGAYICGEETALLESLEGKQGKPRLKPPFPANAGLYGCPTTVTNVETVAVSPTILRRGPEWFASFGRKNNSGTKLYCISGHVNKPCTVEEEMSIPLKELIEKHCGGVRGGWDNLLAVIPGGSSVPLLPKHICDDVLMDYDALKAVQSGLGTAAVMVMDKSTDVVDAIARLSYFYKHESCGQCTPCREGTGWLWMIMERLKVGNAKLEEIDMLQEVTKQIEGHTICALGDAAAWPVQGLIRHFRPELERRIRDRADRELLMAASA

SEQ ID NO: 8379 - protein, 480 aa, Sorghum bicolor
AIEYFHSLSRAQPARSLNGAGRSFSTQAATTSSTPQPPPPPPPPEKTHFGGLKDEDRIFTNLYGLHDPFLKGAMKRGDWYRTKDLVIKGADWIVNEMKKSGLRGRGGAGFPSGLKWSFMPKVSDGRPSYLVVNADESEPGTCKDREIMRHDPHKLLEGCLIAGVGMRASAAYIYIRGEYVNERLNLEKARQEAYAAGLLGKNACGSGYDFDVHIHFGAGAYICGEETALLESLEGKQGKPRLKPPFPANAGLYGCPTTVTNVETVAVSPTILRRGPEWFASFGRKNNSGTKLFCISGHVNKPCTVEEEMSIPLKELLERHCGGVRGGWDNLLAVIPGGSSVPLLPKHICDDVLMDYDALKAVTSGLGTAAVIVMDKSTDVVDAIARLSYFYKHESCGQCTPCREGTPWLWMIMERLKVGNAKLEEIDMLQEVTKQIEGHTICALGDAAAWPVQGLIRHFRPELERRIRERAERELLAASA

SEQ ID NO: 8380 - protein, 504 aa, Pseudoroegneria spicata
MALRWALLRSAEISPGRKAALEYLHSLSRAQPTRSISCADLHPAGRSFSTQAATTSSTPQPPPPPPPEKTHFGDLKDEDRIFTNLYGLHDPFLKGAMKRGDWYRTKDLVIKGADWIVNEMKKSGLRGRGGAGFPSGLKWSFMPKVSDGRPSYLVVNADESEPGTCKDREIMRHDPHKLLEGCLIAGVGMRASAAYIYIRGENVNERLNLEKARQEAYASGLLGKNACGSGYDFDVHIHFGAGAYICGEETALLESLEGKQGKPRLKPPFPANAGLYGCPTTVTNVETVAVSPTILRRGPEWFASFGRKNNSGTKLYCISGHVNKPCTVEEEMSIPLKELIEKHCGGVRGGWDNLLAVIPGGSSVPLLPKHICDDVLMDYDALKAVQSGLGTAAVMVMDKSTDVVDAIARLSYFYKHESCGQCTPCREGTGWLWMIMERLKVGNAKLEEIDMLQEVTKQIEGHTICALGDAAAWPVQGLIRHFRPELERRIRDRADSELLMAASA

SEQ ID NO: 8381 - protein, 505 aa, Avena sativa
MALRRALLRSAEISLGRKAVLEYLHPLSRAQPARSLTCAGLYPSGKSFSTQAATTSSTPQPPPPPPPPEKTHFGDLKDEDRIFTNLYGLHDPFLKGAMKRGDWYRTKDLVIKGADWIVNEMKKSGLRGRGGAGFPSGLKWSFMPKVSDGRPSYLVVNADESEPGTCKDREIMRHDPHKLLEGCLIAGVGMRASAAYIYIRGEYVNERLNLEKARQEAYASGLLGKNACGSGYDFDVHIHFGAGAYICGEETALLESLEGKQGKPRLKPPFPANAGLYGCPTTVTNVETVAVSPTILRRGPEWFASFGRKNNSGTKLYCISGHVNKPCTVEEEMSIPLRELIEKHCGGVRGGWDNLLAIIPGGSSVPLLPKHICDDVLMDYDALKAVQSGLGTAAVMVMDKSTDVVDAIARLSYFYKHESCGQCTPCREGTGWLWMIMERMKVGNAKLEEIDMLQEVTKQIEGHTICALGDAAAWPVQGLIRHFRPELERRIRDRADRELLTAASA

SEQ ID NO: 8382 - protein, 505 aa, Secale cereale
MALRWALLRSAEISPGRKAALEYLHSLSKAQPTRPISCAGLHPAGRPFSTQAATTSSTPQPPLPPPHPEKTHFGDLKDEDRIFTNLYGLHDPFLKGAMKRGDWYRTKDLVIKGADWIVNEMKKSGLRGRGGAGFPSGLKWSFMPKVSDGRPSYLVVNADESEPGTCKDREIMRHDPHKLLEGCLIAGVGMRASAAYIYIRGEYVNERLNLEKARQEAYASGLLGKNACGSGYDFDIHIHFGAGAYICGEETALLESLEGKQGKPRLKPPFPANAGLYGCPTTVTNVETVAVSPTILRRGPEWFASFGRKNNSGTKLYCISGHVNKPCTVEEEMSIPLKELIEKHCGGVRGGWDNLLAVIPGGSSVPLLPKHICDDVLMDYDALKAVQSGLGTAAVMVMDKSTDVVDAIARLSYFYKHESCGQCTPCREGTGWLWMIMERLKVGNAKLEEIDMLQEVTKQIEGHTICALGDAAAWPVQGLIRHFRPELERRIRDRADSELLMAASA

SEQ ID NO: 8383 - protein, 408 aa, Amorphophallus konjac
MKRGDWYRTKDLVLKGSDWIVNEMKKSGLRGRGGAGFPSGLKWSFMPKVSDGRPSYLVVNADESEPGTCKDREIMRHDPHKLLEGCLIAGVGMRATAAYIYIRGEYVNERLNLDKARKEAYQAGLLGKNACGSGYDFDVYIHYGAGAYICGEETALLESLEGKQGKPRLKPPFPANAGLYGCPTTVTNVETVAVSPTILRRGPEWFASFGRKNNSGTKLFCISGHVNKPCTVEEEMSIPLKELLERHCGGVRGGWDNLLAVIPGGSSVPLLPKHICDDVLMDYDALKAVQSGLGTAAVIVMDKSTDVVDAIARLSYFYKHESCGQCTPCREGTGWLWMIMERLKVGNAKLEEIDMLQEVTKQIEGHTICALGDAAAWPVQGLIRHFRPELERRIRERAEKELLEAAAA

SEQ ID NO: 8384 - protein, 509 aa, Musa acuminata
MVLFKASRRVVSTSLPAIKSGSVPLKNLSSIYRAGLIRHSSGWRSFSACRSFSTQTATTGSTPQPPPPPPPPEKTHFGGLKDEDRIFTNLYGLHDPLLKGAMKRGDWYRTKDLVVKGSDWIVNEMKKSGLRGRGGAGFPSGLKWSFMPKVSDGRPSYLVVNADESEPGTCKDREIMRHDPHKLLEGCLIAGVGMRATAAYIYVRGEYVNERLTLEKARKEAYQAGLLGKNACGSGYDFDVHIHFGAGAYICGEETALLESLEGKQGKPRLKPPFPANAGLYGCPTTVTNVETVAVSPTILRRGPEWFASFGRKNNSGTKLFCVSGHVNKPCTVEEEMSIPLKELIERHCGGVRGGWDNLLAVIPGGSSVPLLPKHICDDVMMDYDALKAVQSGLGTAAVIVMDKSTDVVDAIARLSYFYKHESCGQCTPCREGTGWLWMIMERLKVGNAKLEEIDMLQEVTKQIEGHTICALGDAAAWPVQGLIRHFRPELERRIRERAERELLEAAAA

SEQ ID NO: 8385 - protein, 485 aa, Malus domestica
MAPIKGILSLQRAALARHHGAKWGLAFRSFSTQGAAPSTTAQPPPPPPPEKTHFGGLKDEDRIFTNLYGLHDPFLKGAMKRGDWYRTKDLVIKGADWIVNEMKKSGLRGRGGAGFPSGLKWSFMPKVSDGRPSYLVVNADESEPGTCKDREIMRHDPHKLLEGCLIAGVGMRASAAYIYIRGEYVNERLNLVKARNEAYAAGLLGKNACGSGYDFDVHIHFGAGAYICGEETALLESLEGKQGKPRLKPPFPANAGLYGCPTTVTNVETVAVSPTILRRGPEWFASFGRKNNSGTKLFCISGHVNKPCTVEEEMSIPLKELLERHCGGVRGGWDNLLAVIPGGSSVPLLTKDICNDVLMDFDALKAVQSGLGTAAVIVMDKSTDIVDAIARLSYFYKHESCGQCTPCREGTGWLWMIMERMKVGNAKLEEIDMLQEVTKQIEGHTICALGDAAAWPVQGLIRHFRPELERRIRERAERELLEAAA

SEQ ID NO: 8386 - protein, 495 aa, Musa acuminata
MSAIGRSSAPLKNFSSRYKAELLHHFKTWRLNSACRSLSTQAATTGSTPQPPPPPPPPEKTHFGGLKDEDRIFTNLYGLHDPLLKGAMKRGDWYRTKDLVLKGSDWIVNEIKKSGLRGRGGAGFPSGLKWSFMPKVSDGRPSYLVVNADESEPGTCKDREIMRHDPHKLLEGCLIAGVGMRATAAYIYIRGEYVNERLTLEKARKEAYQAGLLGKNACGSGYDFDVHIHFGAGAYICGEETALLESLEGKQGKPRLKPPFPANAGLYGCPTTVTNVETVAVSPTILRRGPEWLASFGRKNNSGTKLFCISGHVNKPCTVEEEMSIPLKELLERHCGGVRGGWDNLLAVIPGGSSVPLLPKHICDDVLMDYDALKAVQSGLGTAAVIVMDKSTDVVDAIARLSYFYKHESCGQCTPCREGTGWLWMIMERLKVGNAMLEEIDMLQEVTKQIEGHTICALGDAAAWPVQGLIRHFRPELERRIRERAQKQLLEAAAA

SEQ ID NO: 8387 - protein, 407 aa, Gossypium hirsutum
MKRGDWYRTKDLVLKGADWIVNEMKKSGLRGRGGAGFPSGLKWSFMPKVSDGRPSYLVVNADESEPGTCKDREIMRHDPHKLLEGCLIAGVGMRATAAYIYIRGEYVNERKNLEIARNEAYEAGLLGKNACGSGYDFDVHIHFGAGAYICGEETALLESLEGKQGKPRLKPPFPANAGLYGCPTTVTNVETVAVSPTILRRGPEWFASFGRKNNSGTKLFCVSGHVNKPCTVEEEMSIPLKELIERHCGGIRGGWDNLLAVIPGGSSVPLLPKHICDDVLMDYDALKAVQSGLGTAAVIVMDKSTDVVDAIARLSYFYKHESCGQCTPCREGTGWLWMIMERLKVGNAKLEEIDMLQEVTKQIEGHTICALGDAAAWPVQGLIRHFRPELERRIRERAERELLEASA

SEQ ID NO: 8388 - protein, 407 aa, Malus domestica
MKRGDWYRTKDLVIKGADWIVNEMKKSGLRGRGGAGFPSGLKWSFMPKVSDGRPSYLVVNADESEPGTCKDREIMRHDPHKLLEGCLIAGVGMRASAAYIYIRGEYVNERLNLVKARNEAYAAGLLGKNACGSGYDFDVHIHFGAGAYICGEETALLESLEGKQGKPRLKPPFPANAGLYGCPTTVTNVETVAVSPTILRRGPEWFASFGRKNNSGTKLFCISGHVNKPCTVEEEMSIPLKELLERHCGGVRGGWDNLLAVIPGGSSVPLLTKDICNDVLMDFDALKAVQSGLGTAAVIVMDKSTDIVDAIARLSYFYKHESCGQCTPCREGTGWLWMIMERMKVGNAKLEEIDMLQEVTKQIEGHTICALGDAAAWPVQGLIRHFRPELERRIRERAERELLEAAA

SEQ ID NO: 8389 - protein, 213 aa, Artemisia annua
MAPMKGILSLQRAALLRRQNGSWGLAARSFSTQSATTANTAQPPPPPPPPERTHFGGLKDEDRIFTNLYGIHDPFLKGAMKRGDWHRTKDLVIKGADWIVNEMKKSGLRGRGGAGFPSGLKWSFMPKVSDGRPSYLVVNADESEPGTCKDREIMRNDPHKLLEGCLIAGVGMRATAAYIYIRGEYVNERLNLEKARKEAYAAGLLGKNACGSG

SEQ ID NO: 8390 - protein, 486 aa, Gossypium raimondii
MAPIKGILSLQRAALLRACGERWKLGTRSFSTQGATTAGAPQAPPPPPLPEKTHFGGLKDEDRIFTNLYGLHDPFLKGAMKRGDWYRTKDLVLKGADWIVNEMKKSGLRGRGGAGFPSGLKWSFMPKVSDGRPSYLVVNADESEPGTCKDREIMRHDPHKLLEGCLIAGVGMRATAAYIYIRGEYVNERKNLERARKEAYEAGLLGKNACGSGYDFDVHIHYGAGAYICGEETALLESLEGKQGKPRLKPPFPANAGLYGCPTTVTNVETVAVSPTILRRGPEWFASFGRKNNSGTKLFCVSGHVNKPCTVEEEMSIPLKELIERHCGGVRGGWDNLLAVIPGGSSVPLLPKHICDDVLMDYDALKAVQSGLGTAAVIVMDKSTDVVDAIARLSYFYKHESCGQCTPCREGTGWLWMIMERLKVGNAKLEEIDMLQEVTKQIEGHTICALGDAAAWPVQGLIRHFRPELERRIRERAERELLEASA

SEQ ID NO: 8391 - protein, 407 aa, Ricinus communis
MKRGDWYRTKDLVLKGADWIVNEVKKSGLRGRGGAGFPSGLKWSFMPKVSDGRPSYLVVNADESEPGTCKDREIMRHDPHKLLEGCLIAGVGMRASAAYIYIRGEYVNERINLERARKEAYAAGLLGKNACGSGYDFDVHIHYGAGAYICGEETALLESLEGKQGKPRLKPPFPANAGLYGCPTTVTNVETVAVSPTILRRGPEWFASFGRKNNSGTKLFCVSGHVNKPCTVEEEMSIPLKELIERHCGGVRGGWDNLLAVIPGGSSVPLLPKHICDDVLMDYDALKAVTSGLGTAAVIVMDKSTDVVDAIARLSYFYKHESCGQCTPCREGTPWLWMIMERLKVGNAKLEEIDMLQEVTKQIEGHTICALGDAAAWPVQGLIRHFRPELERRIKERAERELLEAAA

SEQ ID NO: 8392 - protein, 486 aa, Eschscholzia californica
MGPIKNILSLQRTALVRNCSWRWDAVSRSFSTQAATTSSTPQPPPPPPPAEKTHFGGLKDEDRIFTNLYGIHDPFLKGAMKRGDWYRTKDLVLKGTDWIVNEMKKSGLRGRGGAGFPSGLKWSFMPKVSDGRPSYLVVNADESEPGTCKDREIMRHDPHKLLEGCLIAGVGMRASAAYIYIRGEYVNERLNLEKALKEAYKAGLLGKNACGSGYDFDVHIHYGAGAYICGEETALLESLEGKQGKPRLKPPFPANAGLYGCPTTVTNVETVAVSPTILRRGPEWFASFGRKNNSGTKLFCISGHVNKPCTVEEEMSIPLKELLERHCGGVRGGWDNLLAVIPGGSSVPLLPKDICDDVLMDYDALKAVQSGLGTAAVIVMDKSTDVVDAIARLSYFYKHESCGQCTPCREGTGWLWMVMERLKVGNAKLEEIDMLQEITKQIEGHTICALGDAAAWPVQGLIRHFRPELERRIKDRAARELLEAAA

SEQ ID NO: 8393 - protein, 486 aa, Flaveria ramosissima
MAPMKGILSLQRAALLRRQNVNWGLGTRLFSTQSATTANTAQPPPPPPPPEKTHFGGLKDEDRIFTNLYGIHDPFLKGAMKRGDWYRTKDLVIKGSDWIVNEMKKSGLRGRGGAGFPSGLKWSFMPKVSDGRPSYLVVNADESEPGTCKDREIMRNDPHKLLEGCLIAGVGMRATAAYIYIRGEYVNERLNLEKARKEAYAAGLLGKNACGSGYDFDVHIHFGAGAYICGEETALLESLEGKQGKPRLKPPFPANAGLYGCPTTVTNVETVAVSPTILRRGPEWFSSFGRKNNSGTKLFCISGHVNKPCTVEEEMSIPLKELLERHCGGVRGGWDNLLAVIPGGSSVPLLPKHICEDVLMDFDALKAVQSGLGTAAVIVMDKSTDVVDAIARLSYFYKHESCGQCTPCREGTGWLWMIMERMKVGNAKLEEIDMLQEVTKQIEGHTICALGDAAAWPVQGLIRHFRPELERRIRERADRELLQAAA

SEQ ID NO: 8394 - protein, 486 aa, Gossypium raimondii
MAPIKGILSLQRAAMFRASSERWKLGIRSFSTQGATTAGAPQASPPPPPPEKTHFGGLKDEDRIFTNLYGLHDPFLKGAMKRGDWYRTKDLVLKGADWIVNEMKKSGLRGRGGAGFPSGLKWSFMPKVSDGRPSYLVVNADESEPGTCKDREIMRHDPHKLLEGCLIAGVGMRATAAYIYIRGEYVNERKNLEIARKEAYEAGLLGKNACGSGYDFDVHIHFGAGAYICGEETALLESLEGKQGKPRLKPPFPANAGLYGCPTTVTNVETVAVSPTILRRGPEWFASFGRKNNSGTKLFCVSGHVNKPCTVEEEMSIPLKELIERHCGGIRGGWDNLLAVIPGGSSVPLLPKHICDDVLMDYDALKAVQSGLGTAAVIVMDKSTDVVDAIARLSYFYKHESCGQCTPCREGTGWLWMIMERLKVGNAKLEEIDMLQEVTKQIEGHTICALGDAAAWPVQGLIRHFRPELERRIRERAERELLEASA

SEQ ID NO: 8395 - protein, 486 aa, Helianthus annuus
MVPMKGILSLQRAAVLSRLNGNSRVAARLFSTQSATTANTAQPPPPPPPPEKTHFGGLKDEDRIFTNLYGIHDPFLKGAMKRGDWYRTKDLVIKGSDWIVNEMKKSGLRGRGGAGFPSGLKWSFMPKVSDGRPSYLVVNADESEPGTCKDREIMRNDPHKLLEGCLIAGVGMRATAAYIYIRGEYVNERLNLEKARKEAYAAGLLGKNACGSGYDFDVHIHFGAGAYICGEETALLESLEGKQGKPRLKPPFPANAGLYGCPTTVTNVETVAVSPTILRRGPEWFSSFGRKNNSGTKLFCISGHVNKPCTVEEEMSISLKELLERHCGGVRGGWDNLLAVIPGGSSVPLLPKHICEDVLMDFDALKAVQSGLGTAAVIVMDKSTDVVDAIARLSYFYKHESCGQCTPCREGTGWLWMIMERMKTGNAKLEEIDMLQEVTKQIEGHTICALGDAAAWPVQGLIRHFRPELERRIREHAERELLQAAA

SEQ ID NO: 8396 - protein, 485 aa, Brassica rapa
APVRGILGLQRAVSVWKESNRLAPALRSFSTQAASTSTTPQPPPPPPPPEKTHFGGLKDEDRIFTNLYGLHDPFLKGAMKRGDWHRTKDLVLKGTDWIVNEMKKSGLRGRGGAGFPSGLKWSFMPKVSDGRPSYLVVNADESEPGTCKDREIMRHDPHKLLEGCLIAGVGMRASAAYIYIRGEYVNERLNLEKARREAYAAGLLGKNACGSGYDFDVYIHFGAGAYICGEETALLESLEGKQGKPRLKPPFPANAGLYGCPTTVTNVETVAVSPTILRRGPEWFSSFGRKNNSGTKLFCISGHVNKPCTVEEEMSIPLKELIERHCGGVRGGWDNLLAIIPGGSSVPLIPKNICEDVLMDFDALKAVQSGLGTAAVIVMDKSTDVVDAIARLSYFYKHESCGQCTPCREGTGWLWMIMERMKVGNAKLEEIDMLHEVTKQIEGHTICALGDAAAWPVQGLIRHFRPELERRIRERAERELLQAAA

SEQ ID NO: 8397 - protein, 486 aa, Unknown
  Sequence found in Organisms: Brassica napus, Brassica rapa
MAPVRGILGLQRAVSVWKESNRLAPALRSFSTQAASTSTTPQPPPPPPPPEKTHFGGLKDEDRIFTNLYGLHDPFLKGAMKRGDWHRTKDLVLKGTDWIVNEMKKSGLRGRGGAGFPSGLKWSFMPKVSDGRPSYLVVNADESEPGTCKDREIMRHDPHKLLEGCLIAGVGMRASAAYIYIRGEYVNERLNLEKARREAYAAGLLGKNACGSGYDFDVYIHFGAGAYICGEETALLESLEGKQGKPRLKPPFPANAGLYGCPTTVTNVETVAVSPTILRRGPEWFSSFGRKNNSGTKLFCISGHVNKPCTVEEEMSIPLKELIERHCGGVRGGWDNLLAIIPGGSSVPLIPKNICEDVLMDFDALKAVQSGLGTAAVIVMDKSTDVVDAIARLSYFYKHESCGQCTPCREGTGWLWMIMERMKVGNAKLEEIDMLHEVTKQIEGHTICALGDAAAWPVQGLIRHFRPELERRIRERAERELLQAAA

SEQ ID NO: 8398 - protein, 486 aa, Gossypium hirsutum
MAPIKGILSLQRAALLRACGERWKLGTRSFSTQGATTAGAPQAPPPPPLPEKTHFGGLKDEDRIFTNLYGLHDPFLKGAMKRGDWYRTKDLVLKGADWIVNEMKKSGLRGRGGAGFPSGLKWSFMPKVSDGRPSYLVVNADESEPGTCKDREIMRHDPHKLLEGCLIAGVGMRATAAYIYIRGEYVNERKNLERARKEAYEAGLLGKNACGSGYDFDVHIHYGAGAYICGEETALLESLEGKQGKPRLKPPFPANAGLYGCPTTVTNVETVAVSPTILRRGPEWFASFGRKNNSGTKLFCVSGHVNKPCTVEEEMSIPLKELIERHCGGVRGGWDNLLAVIPGGSSVPLLPKHLCDDVLMDYDALKAVQSGLGTAAVIVMDKSTDVVDAIARLSYFYKHESCGQCTPCREGTGWLWMIMERLKVGNAKLEEIDMLQEVTKQIEGHTICALGDAAAWPVQGLIRHFRPELERRIRERAERELLEASA

SEQ ID NO: 8399 - protein, 486 aa, Flaveria ramosissima
MAPMKGILSLQRVALLRRQNVNWGLGTRLFSTQSATTANTAQPPPPPPPPEKTHFGGLKDEDRIFTNLYGIHDPFLKGAMKRGDWYRTKDLVIKGSDWIVNEMKKSGLRGRGGAGFPSGLKWSFMPKVSDGRPSYLVVNADESEPGTCKDREIMRNDPHKLLEGCLIAGVGMRATAAYIYIRGEYVNERLNLEKARKEAYAAGLLGKNACGSGYDFDVHIHFGAGAYICGEETALLESLEGKQGKPRLKPPFPANAGLYGCPTTVTNVETVAVSPTILRRGPEWFSSFGRKNNSGTKLFCISGHVNKPCTVEEEMSIPLKELLERHCGGVRGGWDNLLAVIPGGSSVPLLPKHICEDVLMDFDALKAVQSGLGTAAVIVMDKSTDVVDAIARLSYFYKHESCGQCTPCREGTGWLWMIMERMKVGNAKLEEIDMLQEVTKQIEGHTICALGDAAAWPVQGLIRHFRPELERRIRERADRELLQAAA

SEQ ID NO: 8400 - protein, 486 aa, Prunus persica
MAPIKGILSLPRAALARHHGEKWGLGLRSFSTQGATTATTPQPPPPPPPPEKTHFGGLKDEDRIFTNLYGSHDPFLKGAMKRGDWHRTKDIVIKGADWIVNEMKKSGLRGRGGAGFPSGLKWSFMPKVSDGRPSYLVVNADESEPGTCKDREIMRHDPHKLLEGCLIAGVGMRASAAYIYIRGEYVNERINLEKARKEAYEAGLLGKNACGSGYDFDVHIHFGAGAYICGEETALLESLEGKQGKPRLKPPFPANAGLYGCPTTVTNVETVAVSPTILRRGPEWFASFGRKNNAGTKLFCISGHVNKPCTVEEEMSIPLKELLERHCGGVRGGWDNLLAVIPGGSSVPLLTKDICNDVLMDFDALKAVQSGLGTAAVIVMDKSTDIVDAIARLSYFYKHESCGQCTPCREGTGWLWMIMERMKVGNAKLEEIDMLQEVTKQIEGHTICALGDAAAWPVQGLIRHFRPELERRIRERAERELLEAAA

SEQ ID NO: 8401 - protein, 486 aa, Fragaria vesca
MAPIKGILSLQRAVLARHHGAKWGLGYRLLSTQAASTATTPQPPPPPPPPEKTHFGGLKDEDRIFTNLYGLHDPFLKGAMKRGDWYRTKDLVIKGADWIVNEMKKSGLRGRGGAGFPSGLKWSFMPKVSDGRPSYLVVNADESEPGTCKDREIMRHDPHKLLEGCLIAGVGMRASAAYIYIRGEYVNERLSLEKARKEAYAAGLLGKNACGSGYDFDVHIHFGAGAYICGEETALLESLEGKQGKPRLKPPFPANAGLYGCPTTVTNVETVAVSPTILRRGPEWFSSFGRKNNAGTKLFCISGHVNKPCTVEEEMSIPLKELLERHCGGVRGGWDNLLAVIPGGSSVPLLTKDICNDVLMDFDALKAVQSGLGTAAVIVMDKSTDIVDAIARLSYFYKHESCGQCTPCREGTGWLWMIMERMKTGNAKLEEIDMLQEVTKQIEGHTICALGDAAAWPVQGLIRHFRPEMERRIRERAERELLEATA

SEQ ID NO: 8402 - protein, 488 aa, Chelidonium majus
MGPIKNILSLQRTAASVRQCSLRWDSVCRSFSTQAATTSSTPQAPPPPPPPEKTHFGGLKDEDRIFTNLYGIHDPFLKGAMKRGDWHRTKDLVIKGADWIVNEMKKSGLRGRGGAGFPSGLKWSFMPKVSDGRPSYLVVNADESEPGTCKDREIMRHDPHKLLEGCLIAGVGMRATAAYIYIRGEYVNERLNLEKALKECYQAGLLGKNACGSGYDFDVYIHYGAGAYICGEETALLESLEGKQGKPRLKPPFPANAGLYGCPTTVTNVETVAVSPTILRRGPEWFASFGRKNNSGTKLFCISGHVNKPCTVEEEMSISLKELLERHCGGVRGGWDNLLAVIPGGSSVPLLPKDICDDVLMDYDALKAVQSGLGTAAVIVMDKSTDVVDAIARLSYFYKHESCGQCTPCREGTGWLWMVMERLKVGDAKLEEIDMLQEITKQIEGHTICALGDAAAWPVQGLIRHFRPELERRIRERADRELLEVAAA

SEQ ID NO: 8403 - protein, 486 aa, Tripterygium wilfordii
MALMKCFLSLRRAALVQHHSERWGAGFRSFSTQGATTGTTPQPPPPPPPPEKTHFGGLKDEDRIFTNLYGLHDPFLKGAMKRGDWYRTKDLVLKGTDWIVNEMKKSGLRGRGGAGFPSGLKWSFMPKVSDGRPSYLVVNADESEPGTCKDREIMRHDPHKLLEGCLIAGVGMRATAAYIYIRGEYVNERKNLERARKEAYEAGLLGKNACGSGYDFDVHIHYGAGAYICGEETALLESLEGKQGKPRLKPPFPANAGLYGCPTTVTNVETVAVSPTILRRGPEWFASFGRKNNSGTKLFCVSGHVNKPCTVEEEMSIPLKELIERHCGGVRGGWDNLLAVIPGGSSVPLLPKHICDDVLMDYDALKAVTSGLGTAAVIVMDKSTDVVDAIARLSYFYKHESCGQCTPCREGTPWLWMIMERLKVGNAKLEEIDMLQEVTKQIEGHTICALGDAAAWPVQGLIRHFRPELERRIKERADKELLEAAA

SEQ ID NO: 8404 - protein, 119 aa, Flaveria ramosissima
MAPMKGILSLQRAALLRCQNVNWGLGSRLFSTQSATTANTPQPPPPPPPPEKTHFGGLKDEDRIFTNLYGIHDPFLKGAMKRGDWYRTKDLVIKGSDWIVNEMKNLVYVDVVVLDFHLV

SEQ ID NO: 8405 - protein, 214 aa, Ambrosia trifida
MAPMKGILSLQRAAFMRRQNVNWGLGTRLLSTQSATTANTAQPPPPPPPPEKTHFGGLKDEDRIFTNLYGIHDPFLKGAMKRGDWYRTKDLVIKGADWIVNEMKKSGLRGRGGAGFPSGLKWSFMPKVSDGRPSYLVVNADESEPGTCKDREIMRNDPHKLLEGCLIAGVGMRATAAYIYIRGEYVNERLNLGKGQKRSICSRVTWEKRLRFGL

SEQ ID NO: 8406 - protein, 486 aa, Arabidopsis thaliana
MAPVRGILGLQRAVSIWKESNRLTPALRSFSTQAASTSTTPQPPPPPPPPEKTHFGGLKDEDRIFTNLYGLHDPFLKGAMKRGDWHRTKDLVLKGTDWIVNEMKKSGLRGRGGAGFPSGLKWSFMPKVSDGRPSYLVVNADESEPGTCKDREIMRHDPHKLLEGCLIAGVGMRASAAYIYIRGEYVNERLNLEKARREAYAAGLLGKNACGSGYDFEVYIHFGAGAYICGEETALLESLEGKQGKPRLKPPFPANAGLYGCPTTVTNVETVAVSPTILRRGPEWFSSFGRKNNAGTKLFCISGHVNKPCTVEEEMSIPLKELIERHCGGVRGGWDNLLAIIPGGSSVPLIPKNICEDVLMDFDALKAVQSGLGTAAVIVMDKSTDVVDAIARLSYFYKHESCGQCTPCREGTGWLWMIMERMKVGNAKLEEIDMLQEVTKQIEGHTICALGDAAAWPVQGLIRHFRPELERRIRERAERELLQAAA

SEQ ID NO: 8407 - protein, 408 aa, Ocimum basilicum
MKRGDWYRTKDLVIKGSDWIVNEMKKSGLRGRGGAGFPSGLKWSFMPKASDGRPSYLVVNADESEPGTCKDREIMRHDPHKLLEGCLIAGVGMRASAAYIYIRGEYVNERLNLEKARKEAYAAGLLGKNACGSGYDFDVHIHFGAGAYICGEETALLESLEGKQGKSRLKPPFPANAGLYGCPTTVTNVETVAVSPTILRRGPEWFSSFGRKNNSGTKLFCISGHVNKPCTVEEEMSIPLRELLERHCGGVRGGWDNLLAVIPGGSSVPLIPKHICEDVLMDFDALKAVQSGLGTAAVIVMDKSTDVVDAIARLSYFYKHESCGQCTPCREGTGWLWMIMERMKVGNAKLEEIDMLQEVTKQIEGHTICALGDAAAWPVQGLIRHFRPELERRIRERADRELQQAAAA

SEQ ID NO: 8408 - protein, 486 aa, Citrus sinensis
MAPMKGVLSLQRASLVRCYSERLSVGLRSFSTQGASTASTPQPPPPPPPPEKTHFGGLKDEDRIFTNLYGMHDPFLKGAMKRGDWHRTKDLVLKGADWIVNEVKKSGLRGRGGAGFPSGLKWSFMPKVSDGRPSYLVVNADESEPGTCKDREIMRHDPHKLLEGCLIAGVGMRASAAYIYIRGEYVNERKNLERARQEAYAAGLLGKNACGSGYDFDVHIHYGAGAYICGEETALLESLEGKQGKPRLKPPFPANAGLYGCPTTVTNVETVAVSPTILRRGPDWFASFGRKNNSGTKLFCVSGHVNKPCTVEEEMSIPLKELIDRHCGGVRGGWDNLLAVIPGGSSVPLLPKHICDDVLMDYDALKAVQSGLGTAAVIVMDKSTDVVDAIARLSYFYKHESCGQCTPCREGTGWLWMIMERLKVGNAKLEEIDMLQEVTKQIEGHTICALGDAAAWPVQGLIRHFRPELERRIKEHAERELLEATA

SEQ ID NO: 8409 - protein, 488 aa, Papaver somniferum
MGPIKNILSLHRAAAPLRQSTRRWDAVCRSFSAQAATTATTPQPPPPPPPPEKTHFGGLKDEDRIFTNLYGLHDPFLKGAMKRGDWHRTKDLVLKGTDWIINEMKKSGLRGRGGAGFPSGLKWSFMPKVSDGRPSYLVVNADESEPGTCKDREIMRHDPHKLLEGCLIAGVGMRASAAYIYIRGEYVNERLNLEKALKEAYKAGLLGKNACGSGYDFDVHIHYGAGAYICGEETALLESLEGKQGKPRLKPPFPANAGLYGCPTTVTNVETVAVSPTILRRGPEWFASFGRKNNSGTKLFCISGHVNKPCTVEEEMSIPLKELLERHCGGVRGGWDNLLAVIPGGSSVPLLPKHICDDVLMDYDALKAVTSGLGTAAVIVMDKSTDVVDAIARLSYFYKHESCGQCTPCREGTGWLWMVMERLKVGDAKLEEIDMLQEITKQIEGHTICALGDAAAWPVQGLIRHFRPELERRIRERADRELLEVASA

SEQ ID NO: 8410 - protein, 486 aa, Eutrema halophilum
MAPVRGILGLQRAVSIWKESNRLAPALRSFSTQAASTSTTPQPPPPPPPPEKTHFGGLKDEDRIFTNLYGLHDPFLKGAMKRGDWHRTKDLVLKGTDWIVNEMKKSGLRGRGGAGFPSGLKWSFMPKVSDGRPSYLVVNADESEPGTCKDREIMRHDPHKLLEGCLIAGVGMRASAAYIYIRGEYVNERLNLEKARREAYAAGLLGKNACGSGYDFDVYIHYGAGAYICGEETALLESLEGKQGKPRLKPPFPANAGLYGCPTTVTNVETVAVSPTILRRGPEWFSSFGRKNNSGTKLFCISGHVNKPCTVEEEMSIPLKELIERHCGGVRGGWDNLLAIIPGGSSVPLIPKNICEDVLMDFDALKAVQSGLGTAAVIVMDKSTDVVDAIARLSYFYKHESCGQCTPCREGTGWLWMIMERMKVGNAKLEEIDMLQEVTKQIEGHTICALGDAAAWPVQGLIRHFRPELERRIRERAERELLQVAA

SEQ ID NO: 8411 - protein, 407 aa, Eutrema parvulum
MKRGDWHRTKDLVLKGTDWIVNEMKKSGLRGRGGAGFPSGLKWSFMPKVSDGRPSYLVVNADESEPGTCKDREIMRHDPHKLLEGCLIAGVGMRASAAYIYIRGEYVNERLNLEKARREAYAAGLLGKNACGSGYDFDVYIHFGAGAYICGEETALLESLEGKQGKPRLKPPFPANAGLYGCPTTVTNVETVAVSPTILRRGPEWFSSFGRKNNSGTKLFCISGHVNKPCTVEEEMSIPLKELIERHCGGVRGGWDNLLAIIPGGSSVPLIPKNICEDVLMDFDALKAVQSGLGTAAVIVMDKSTDVVDAIARLSYFYKHESCGQCTPCREGTGWLWMIMERMKVGNAKLEEIDMLHEVTKQIEGHTICALGDAAAWPVQGLIRHFRPELERRIRERAERELLQAAA

SEQ ID NO: 8412 - protein, 486 aa, Fagus grandifolia
MAPIKGILSLQRTALAQRHSDVWGLGFRAFSTQGATTAGTPQPPPPPPPPEKTHFGGLKDEDRIFTNLYGLHDPFLKGAMKRGDWYRTKDLVLKGTDWIVNEVKKSGLRGRGGAGFPSGLKWSFMPKVSDGRPSYLVVNADESEPGTCKDREIMRHDPHKLLEGCLIAGVGMRASAAYIYIRGEYVNERINLERARKEAYEAGLLGKNACGSGYDFDVHIHYGAGAYICGEETALLESLEGKQGKPRLKPPFPANAGLYGCPTTVTNVETVAVSPTILRRGPDWFASFGRKNNSGTKLFCISGHVNKPCTVEEEMSIPLKELIERHCGGVRGGWDNLLAVIPGGSSVPLMPKNICDDVLMDYDALKAVQSGLGTAAVIVMDKSTDVVDAIARLSYFYKHESCGQCTPCREGTGWLWMIMERLKVGNAKLEEIDMLQEVTKQIEGHTICALGDAAAWPVQGLIRHFRPELERRIRERAERELLEAAA

SEQ ID NO: 8413 - protein, 486 aa, Theobroma cacao
MAPIKGILSLQRAALFRNSSERWGLGIRSFSTQGATTTGAPQPPPPPPPPEKTHFGGLKDEDRIFTNLYGLHDPFLKGAQKRGDWHRTKDLVLKGADWIVNEMKKSGLRGRGGAGFPSGLKWSFMPKVSDGRPSYLVVNADESEPGTCKDREIMRHDPHKLLEGCLIAGVGMRATAAYIYIRGEYVNERKNLERARKEAYEAGLLGKNACGSGYDFDVHIHYGAGAYICGEETALLESLEGKQGKPRLKPPFPANAGLYGCPTTVTNVETVAVSPTILRRGPEWFASFGRKNNSGTKLFCISGHVNKPCTVEEEMSIPLKELIERHCGGVRGGWDNLLAVIPGGSSVPLLPKNICDDVLMDYDALKAVQSGLGTAAVIVMDKSTDVVDAIARLSYFYKHESCGQCTPCREGTGWLWMIMERLKIGNAKLEEIDMLQEVTKQIEGHTICALGDAAAWPVQGLIRHFRPELERRIREHAERELLEASA

SEQ ID NO: 8414 - protein, 486 aa, Tripterygium wilfordii
MAPMRSFLSLRQAALVRHHSERWGAGFRSFSTQGAPTASTPQPPPPPPPPEKTHFGGLKDEDRIFTNLYGLHDPFLKGSMKRGDWYRTKDLVLKGADWIVNEMKKSGLRGRGGAGFPSGLKWSFMPKVSDGRPSYLVVNADESEPGTCKDREIMRHDPHKLLEGCLIAGVGMRATAAYIYIRGEYVNERKNLERARNEAYEAGLLGKNACGSGYDFDVHIHYGAGAYICGEETALLESLEGKQGKPRLKPPFPANAGLYGCPTTVTNVETVAVSPTILRRGPEWFASFGRKNNSGTKLFCVSGHVNKPCTVEEEMSIPLKELIERHCGGVRGGWDNLLAVIPGGSSVPLLPKHICDDVLMDYDALKAVTSGLGTAAVIVMDKSTDVVDAIARLSYFYKHESCGQCTPCREGTPWLWMIMERLKVGNAKLEEIDMLQEVTKQIEGHTICALGDAAAWPVQGLIRHFRPELERRIRERADKELLEAAA

SEQ ID NO: 8415 - protein, 153 aa, Flaveria ramosissima
MGQFTGSNSRRFICTLLPKHICEDVLMDFDALKAVQSGLGTAAVIVMDKSTDVVDAIARLSYFYKHESCGQCTPCREGTGWLWMIMERMKVGNAKLEEIDMLQEVTKQIEGHTICALGDAAAWPVQGLIRHFRPELERRIRERADRELLQAAA

SEQ ID NO: 8416 - protein, 486 aa, Arabidopsis lyrata
MAPVRGILGLQRAVSIWKEINRVAPALRSFSTQAASTSTTPQPPPPPPPPEKTHFGGLTDEDRIFTNLYGLHDPFLKGAMKRGDWHRTKDLVLKGTDWIVNEMKKSGLRGRGGAGFPSGLKWSFMPKVSDGRPSYLVVNADESEPGTCKDREIMRHDPHKLLEGCLIAGVGMRASAAYIYIRGEYVNERLNLEKARREAYAAGLLGKNACGSGYDFDVYIHFGAGAYICGEETALLESLEGKQGKPRLKPPFPANAGLYGCPTTVTNVETVAVSPTILRRGPEWFSSFGRKNNAGTKLFCISGHVNKPCTVEEEMSIPLKELIERHCGGVRGGWDNLLAIIPGGSSVPLIPKNICEDVLMDFDALKAVQSGLGTAAVIVMDKSTDVVDAIARLSYFYKHESCGQCTPCREGTGWLWMIMERMKVGNAKLEEIDMLQEVTKQIEGHTICALGDAAAWPVQGLIRHFRPELERRIRERAERELLQAAA

SEQ ID NO: 8417 - protein, 488 aa, Brassica napus
MAPVRRILGLQRAVSVWKESNRLAPALRSFSTQAASTSTTPQPPPPPPPPPPEKTHFGGLKDEDRIFTNLYGLHDPFLKGAMKRGDWHRTKDLVLKGTDWIVNEMKKSGLRGRGGAGFPSGLKWSFMPKVSDGRPSYLVVNADESEPGTCKDREIMRHDPHKLLEGCLIAGVGMRASAAYIYIRGEYVNERLNLEKARREAYAAGLLGKNACGSGYDFDVYIHFGAGAYICGEETALLESLEGKQGKPRLKPPFPANAGLYGCPTTVTNVETVAVSPTILRRGPEWFSSFGRKNNSGTKLFCISGHVNKPCTVEEEMSIPLKELIERHCGGVRGGWDNLLAIIPGGSSVPLIPKNICEDVLMDFDALKAVQSGLGTAAVIVMDKSTDVVDAIARLSYFYKHESCGQCTPCREGTGWLWMIMERMKVGNAKLEEIDMLHEVTKQIEGHTICALGDAAAWPVQGLIRHFRPELERRIRERAERELLQAAA

SEQ ID NO: 8418 - protein, 486 aa, Brassica napus
MAPMRGILGLQRAVSTWKGSNRLAPSLRSLSTQAASTSATPQPPPPPPPPEKTHFGGLKDEDRIFTNLYGLHDPFLKGAMKRGDWYRTKDLVLKGTDWIVNEMKKSGLRGRGGAGFPSGLKWSFMPKVSDGRPSYLVVNADESEPGTCKDREIMRHDPHKLLEGCLIAGVGMRASAAYIYIRGEYVNERLNLEKARREAYAAGLLGKNACGSGYDFDVYIHFGAGAYICGEETALLESLEGKQGKPRLKPPFPANAGLYGCPTTVTNVETVAVSPTILRRGPEWFSSFGRKNNAGTKLFCISGHVNKPCTVEEEMSIPLKELIERHCGGVRGGWDNLLAIIPGGSSVPLIPKNICEDVLMDFDALKAVQSGLGTAAVIVMDKSTDVVDAIARLSYFYKHESCGQCTPCREGTGWLWMIMERMKVGNAKLEEIDMLHEVTKQIEGHTICALGDAAAWPVQGLIRHFRPELERRIRERAERELLQAAA

SEQ ID NO: 8419 - protein, 486 aa, Manihot esculenta
MAPIRGIFTLHRATFVQRHSEKLVIGIRSFSTQAATNAGNPQPPPPPPPPEKTHFGGLKDEDRIFTNLYGLHDPFLKGAMKRGDWYRTKDLVLKGTDWIVNEVKKSGLRGRGGAGFPSGLKWSFMPKVSDGRPSYLVVNADESEPGTCKDREIMRHDPHKLLEGCLIAGVGMRASAAYIYIRGEYVNERINLERARKEAYEAGLLGKNACGSGYDFDVHIHYGAGAYICGEETALLESLEGKQGKPRLKPPFPANAGLYGCPTTVTNVETVAVSPTILRRGPEWFASFGRKNNSGTKLFCVSGHVNKPCTVEEEMSIPLKELIEKHCGGVRGGWDNLLAVIPGGSSVPLLPKHICDDVLMDYDALKAVQSGLGTAAVIVMDKSTDVVDAIARLSYFYKHESCGQCTPCREGTGWLWMIMERLKVGNAKLEEIDMLQEVTKQIEGHTICALGDAAAWPVQGLIRHFRPELERRIKERAERELLEAAA

SEQ ID NO: 8420 - protein, 486 aa, Citrus sinensis
MAPMKGVLSLQRASLVRCYSERLSMGLRSFSTQGASTASTPQPPPPPPPPEKTHFGGLKDEDRIFTNLYGMHDPFLKGAMKRGDWHRTKDLVLKGADWIVNEVKKSGLRGRGGAGFPSGLKWSFMPKVSDGRPSYLVVNADESEPGTCKDREIMRHDPHKLLEGCLIAGVGMRASAAYIYIRGEYVNERKNLERARQEAYAAGLLGKNACGSGYDFDVHIHYGAGAYICGEETALLESLEGKQGKPRLKPPFPANAGLYGCPTTVTNVETVAVSPTILRRGPDWFAGFGRKNNSGTKLFCVSGHVNKPCTVEEEMSIPLKELIDRHCGGVRGGWDNLLAVIPGGSSVPLLPKHICDDVLMDYDALKAVQSGLGTAAVIVMDKSTDVVDAIARLSYFYKHESCGQCTPCREGTGWLWMIMERLKVGNAKLEEIDMLQEVTKQIEGHTICALGDAAAWPVQGLIRHFRPELERRIKEHAERELLEATA

SEQ ID NO: 8421 - protein, 277 aa, Linum usitatissimum
MAPIRGIFAMQSAALVRRHADKLGVGFRSLSTQAASNSGAPQPPPPPPPPEKTHFGGLSDEDRIFTNLYGLHDPFLKGAMKRGDWYRTKDLVLKGTDWIVNEVKKSGLRGRGGAGFPSGLKWSFMPKVSDGRPSYLVVNADESEPGTCKDREIMRHDPHKLLEGCLIAGVGMRASAAYIYIRGEYVNERNNLEIARKEAYAAGLLGKNACGSGYDFDVHIHYGAGAYICGEETALLESLEGKQGKPRLKPPFPAMLDCTAVPQQSQMWKQLLYLPPY

SEQ ID NO: 8422 - protein, 487 aa, Mimulus guttatus
MAPIKSILSLRRTAYAQRSGENWGLARKLFSTQAATTSPTPQPPPPPPPPEKTHFGGLKDEDRIFTNVYGLHDPFLKGAMKRGDWHRTKDLVIKGTDWIVNEMKKSGLRGRGGAGFPSGLKWSFMPKVSDGRPSYLVVNADESEPGTCKDREIMRHDPHKLLEGCLIAGVGMRASAAYIYIRGEYVNERLNLEKARKEAYDAGLLGKNACGSGYDFDVHIHFGAGAYICGEETALLESLEGKQGKPRLKPPFPANAGLYGCPTTVTNVETVAVSPTILRRGPEWFASFGRKNNSGTKLFCISGHVNKPCTVEEEMSIPLKELIERHCGGVRGGWDNLLAVIPGGSSVPLITKDICEDVLMDFDALKAVQSGLGTAAVIVMDKSTDVVDAIARLSYFYKHESCGQCTPCREGTGWLWMIMERMKVGNAKLEEIDMLQEVTKQIEGHTICALGDAAAWPVQGLIRHFRPELERRIRERADRELQQAAAA

SEQ ID NO: 8423 - protein, 488 aa, Papaver somniferum
MGPVKNILSLHRAAAPLRQSTRRWDSVCRSFSAQAATTATTPQPPPPPPPPEKTHFGGLKDEDRIFTNLYGLHDPFLKGAMKRGDWHRTKDLVLKGTDWIINEMKKSGLRGRGGAGFPSGLKWSFMPKVSDGRPSYLVVNADESEPGTCKDREIMRHDPHKLLEGCLIAGVGMRASAAYIYIRGEYVNERLNLEKALKEAYKAGLLGKNACGSGYDFDVHIHYGAGAYICGEETALLESLEGKQGKPRLKPPFPANAGLYGCPTTVTNVETVAVSPTILRRGPEWFASFGRKNNSGTKLFCISGHVNKPCTVEEEMSIPLKELLERHCGGVRGGWDNLLAVIPGGSSVPLLPKHICDDVLMDYDALKAVTSGLGTAAVIVMDKSTDVVDAIARLSYFYKHESCGQCTPCREGTGWLWMVMERLKVGDAKLEEIDMLQEITKQIEGHTICALGDAAAWPVQGLIRHFRPELERRIRERADRELLEVASA

SEQ ID NO: 8424 - protein, 486 aa, Raphanus sativus
MAPVRGILGLQRAVSVWKESNRLAPALRSFSTTAASTSTTPQPPPPPPPPEKTHFGGLKDEDRIFTNLYGLHDPFLKGAMKRGDWHRTKDLVLKGTDWIVNEMKKSGLRGRGGAGFPSGLKWSFMPKVSDGRPSYLVVNADESEPGTCKDREIMRHDPHKLLEGCLIAGVGMRASAAYIYIRGEYVNERLNLEKARREAYAAGLLGKNACGSGYDFDVYIHFGAGAYICGEETALLESLEGKQGKPRLKPPFPANAGLYGCPTTVTNVETVAVSPTILRRGPEWFSSFGRKNNSGTKLFCISGHVNKPCTVEEEMSIPLKELIERHCGGVRGGWDNLLAIIPGGSSVPLIPKNICEDVLMDFDALKAVQSGLGTAAVIVMDKSTDVVDAIARLSYFYKHESCGQCTPCREGTGWLWMIMERMKVGNAKLEEIDMLHEVTKQIEGHTICALGDAAAWPVQGLIRHFRPELERRIRERAEKELLQAAA

SEQ ID NO: 8425 - protein, 487 aa, Brassica napus
MAPMRGVLGLQRAVSTWKGSNRLAPSLRSFSTTQGASTSATPQPPPPPPPPEKTHFGGLKDEDRIFTNLYGLHDPFLKGAMKRGDWYRTKDLVLKGTDWIVNEMKKSGLRGRGGAGFPSGLKWSFMPKVSDGRPSYLVVNADESEPGTCKDREIMRHDPHKLLEGCLIAGVGMRASAAYIYIRGEYVNERLNLEKARREAYAAGLLGKNACGSGYDFDVYIHFGAGAYICGEETALLESLEGKQGKPRLKPPFPANAGLYGCPTTVTNVETVAVSPTILRRGPEWFSSFGRKNNAGTKLFCISGHVNKPCTVEEEMSIPLKELIERHCGGVRGGWDNLLAIIPGGSSVPLIPKNICEDVLMDFDALKAVQSGLGTAAVIVMDKSTDVVDAIARLSYFYKHESCGQCTPCREGTGWLWMIMERMKVGNAKLEEIDMLHEVTKQIEGHTICALGDAAAWPVQGLIRHFRPELERRIRERAERELLQAAA

SEQ ID NO: 8426 - protein, 356 aa, Ambrosia trifida
MKKSGLRGRGGAGFPSGLKWSFMPKVSDGRPSYLVVNADESEPGTCKDREIMRNDPHKLLEGCLIAGVGMRASAAYIYIRGEYVNERLNLEKARKEAYAAGLLGKNACGSGYDFDVHIHFGAGAYICGEETALLESLEGKQGKPRLKPPFPANAGLYGCPTTVTNVETVAVSPTILRRGPEWFSSFGRKNNSGTKLFCVSGHVNKPCTVEEEMSISLKELLERHCGGVRGGWDNLLAVIPGGSSVPLLPKHICEDVLMDFDALKAVQSGLGTAAVIVMDKSTDVVDAIARLSYFYKHESCGQCTPCREGTGWLWMIMERMKTGNAKLEEIDMLQEVTKQIEGHTICALGDAAAWPV

SEQ ID NO: 8427 - protein, 486 aa, Rosa hybrid cultivar
MAPIKGILNLQRAVLARHHGEKWGLGYRLLSTQAASSSTTPQPPPPPPPPEKTHFGGLKDEDRIFTNLYGLHDPFLKGAMKRGDWHRTKDLVIKGSDWIVNEMKKSGLRGRGGAGFPSGLKWSFMPKVSDGRPSYLVVNADESEPGTCKDREIMRHDPHKLLEGCLIAGVGMRASAAYIYIRGEYVNERLNLEKARKEAYAAGLLGKNACGSGYDFDVHIHYGAGAYICGEETALLESLEGKQGKPRLKPPFPANAGLYGCPTTVTNVETVAVSPTILRRGPEWFSSFGRKNNAGTKLFCISGHVNKPCTVEEEMSIPLKELLERHCGGVRGGWDNLLAVIPGGSSVPLLTKDICNDVLMDFDALKAVQSGLGTAAVIVMDKSTDIVDAIARLSYFYKHESCGQCTPCREGTGWLWMIMERMKVGNAKLEEIDMLQEVTKQIEGHTICALGDAAAWPVQGLIRHFRPEMERRIRERAERELLEAAA

SEQ ID NO: 8428 - protein, 486 aa, Helianthus annuus
MAPMKGILSLQRAALLRRQNVNWGLGTRLFSTQSATTANTAQPPPPPPPPEKTHFGGLKDEDRIFTNLYGIHDPFLKGAMKRGDWHRTKDLVIKGSDWIVNEMKKSGLRGRGGAGFPSGLKWSFMPKVSDGRPSYLVVNADESEPGTCKDREIMRNDPHKLLEGCLIAGVGMRATAAYIYIRGEYVNERLNLEKARKEAYAAGLLGKNACGSGYDFDVHIHFGAGAYICGEETALLESLEGKQGKPRLKPPFPANAGLYGCPTTVTNVETVAVSPTILRRGPEWFSSFGRKNNSGTKLFCISGHVNKPCTVEEEMSIPLKELLERHCGGVRGGWDNLLAVIPGGSSVPLLTKDICEDVLMDFDALKAVQSGLGTAAVIVMDKSTDIVDAIARLSYFYKHESCGQCTPCREGTGWLWMIMERMKVGNAKLEEIDMLQEVTKQIEGHTICALGDAAAWPVQGLIRHFRPELERRIRERADRELLQAAA

SEQ ID NO: 8429 - protein, 486 aa, Ambrosia trifida
MAPMKGILSLQRAALLRRQNVNWGLGTRLFSTQSATTANTAQPPPSPPPPEKTHFGGLKDEDRIFTNLYGIHDPFLKGAMKRGDWCRTKDLVIKGADWIVNEMKKSGLRGRGGAGFPSGLKWSFMPKVSDGRPSYLVVNADESEPGTCKDREIMRNDPHKLLEGCLIAGVGMRATAAYIYIRGEYVNERLNLEKARKEAYAAGLLGKNACGSGYDFDVHIHFGAGAYICGEETALLESLEGKQGKPRLKPPFPANAGLYGCPTTVTNVETVAVSPTILRRGPEWFSSFGRKNNSGTKLFCISGHVNKPCTVEEEMSIPLKELLERHCGGVRGGWDNLLAVIPGGSSVPLLTKDICEDVLMDFDALKAVQSGLGTAAVIVMDKSTDIVDAIARLSYFYKHESCGQCTPCREGTGWLWMIMERMKVGNAKLEEIDMLQEVTKQIEGHTICALGDAAAWPVQGLIRHFRPELERRIRERADRELLQAAA

SEQ ID NO: 8430 - protein, 487 aa, Brassica rapa
MAPMRGILGLQRAVSIWKESNRLAPSLRSFSTTQGASTSTTPQPPPPPPPPEKTHFGGLKDEDRIFTNLYGLHDPFLKGAMKRGDWYRTKDLVLKGTDWIVNEMKKSGLRGRGGAGFPSGLKWSFMPKVSDGRPSYLVVNADESEPGTCKDREIMRHDPHKLLEGCLIAGVGMRASAAYIYIRGEYVNERLNLEKARREAYAAGLLGKNACGSGYDFDVYIHFGAGAYICGEETALLESLEGKQGKPRLKPPFPANAGLYGCPTTVTNVETVAVSPTILRRGPEWFSSFGRKNNAGTKLFCISGHVNKPCTVEEEMSIPLKELIERHCGGVRGGWDNLLAIIPGGSSVPLIPKNICEDVLMDFDALKAVQSGLGTAAVIVMDKSTDVVDAIARLSYFYKHESCGQCTPCREGTGWLWMIMERMKVGNAKLEEIDMLHEVTKQIEGHTICALGDAAAWPVQGLIRHFRPELERRIRERAERELLQAAA

SEQ ID NO: 8431 - protein, 408 aa, Triphysaria pusilla
MKRGDWHRTKDLVLKGTDWIVNEMKKSGLRGRGGAGFPSGLKWSFMPKVSDGRPSYLVVNADESEPGTCKDREIMRHDPHKLLEGCLIAGVGMRASAAYIYIRGEYVNERLNLEKARKEAYAAGLLGKNACGSGYDFDVHIHFGAGAYICGEETALLESLEGKQGKPRLKPPFPANAGLYGCPTTVTNVETVAVSPTILRRGPEWFSSFGRKNNSGTKLFCISGHVNKPCTVEEEMSISLKELLERHCGGVRGGWDNLLAVIPGGSSVPLLPKNVCEDVLMDFDALKAVQSGLGTAAVIVMDKSTDVVDAISRLSYFYKHESCGQCTPCREGTGWLWMIMERMKVGNAKLEEIDMLQEVTKQIEGHTICALGDAAAWPVQGLIRHFRPEMERRIRERAERELQQAAAA

SEQ ID NO: 8432 - protein, 495 aa, Musa acuminata
MSAIGSGSAPIKNLCLLYRTELVHHFSGWRLSSASRSLSTQAATTGNTPQPPPPPPPPEKTHFGGLKDEDRIFTNLYGLHDPLLKGAMKRGDWYRTKDLVIKGSDWIVNEIKKSGLRGRGGAGFPSGLKWSFMPKVSDGRPSYLVVNADESEPGTCKDREIMRHDPHKLLEGCLIAGVGMKATAAYIYIRGEYVNERLTLEKARKEAYQAGLLGRNACGSGYDFDVHIHYGAGAYICGEETALLESLEGKQGKPRLKPPFPANAGLYGCPTTVTNVETVAVSPTILRRGPEWFASFGRKNNSGTKLFCISGHVNKPCTVEEEMSIPLKELLERHCGGVRGGWDNLLAVIPGGSSVPLLPKHICDDVLMDYDALKAVQSGLGTAAVIVMDKSTDVVDAIARLSYFYKHESCGQCTPCREGTGWLRMIMEKLKVGNAMLEEIDMLQEVTKQIEGHTICALGDAAAWPVQGLIRHFRPELERRIKERAQKELLEAAAA

SEQ ID NO: 8433 - protein, 483 aa, Ambrosia trifida
MKGILSLQRAALLRRQNGNSGVGARLFSTQSATTANTAQPPPPPPPPEKTHFGGLKDEDRIFTNLYGIHDPFLKGAMKRGDWYRTKDLVIKGTDWIVNEMKRSGLRGRGGAGFPSGLKWSFMPKVSDGRPSYLVVNADESEPGTCKDREIMRNDPHKLLEGCLIAGVGMRASAAYIYIRGEYVNERLNLEKARKEAYAAGLLGKNACGSGYDFDVHIHFGAGAYICGEETALLESLEGKQGKPRLKPPFPANAGLYGCPTTVTNVETVAVSPTILRRGPEWFSSFGRKNNSGTKLFCISGHVNKPCTVEEEMSISLKELLERHCGGVRGGWDNLLAVIPGGSSVPLLPKHICEDVLMDFDALKAVQSGLGTAAVIVMDKSTDVVDAIARLSYFYKHESCGQCTPCREGTGWLWMIMERMKTGNAKLEEIDMLQEVTKQIEGHTICALGDAAAWPVQGLIRHFRPELERRIKEHAERELLQATG

SEQ ID NO: 8434 - protein, 467 aa, Ambrosia trifida
NVNWGLGTRLFSTQSATTSNTAQPPPPPPPPEKTHFGGLKDEDRIFTNLYGIHDPFLKGAMKRGDWHRTKDLVIKGADWIVNEMKKSGLRGRGGAGFPSGLKWSFMPKVSDGRPSYLVVNADESEPGTCKDREIMRNDPHKLLEGCLIAGVGMRATAAYIYIRGEYVNERLNLEKARKEAYAAGLLGKNACGSGYDFDVHIHFGAGAYICGEETALLESLEGKQGKPRLKPPFPANAGLYGCPTTVTNVETVAVSPTILRRGPEWFSSFGRKNNSGTKLFCISGHVNKPCTVEEEMSIPLKELLERHCGGVRGGWDNLLAVIPGGSSVPLLTKDICEDVLMDFDALKAVQSGLGTAAVIVMDKSTDIVDAIARLSYFYKHESCGQCTPCREGTGWLWMIMERMKVGNAKLEEIDMLQEVTKQIEGHTICALGDAAAWPVQGLIRHFRPELERRIRERADRELLQAAA

SEQ ID NO: 8435 - protein, 486 aa, Arnica chamissonis
MAPMKGILSLQRAALLRRQNVNCGLGTRLFSTQSATTGNTAQPPPPPPPPEKTHFGGLKDEDRIFTNLYGIHDPFLKGAMKRGDWHRTKDLVIKGTDWIVNEMKKSGLRGRGGAGFPSGLKWSFMPKVSDGRPSYLVVNADESEPGTCKDREIMRNDPHKLLEGCLIAGVGMRATAAYIYIRGEYVNERLNLEKARKEAYAAGLLGKNACGSGYDFDVHIHFGAGAYICGEETALLESLEGKQGKPRLKPPFPANSGLYGCPTTVTNVETVAVSPTILRRGPEWFSSFGRKNNSGTKLFCISGHVNKPCTVEEEMSIPLKELLERHCGGVRGGWDNLLAVIPGGSSVPLLPKNVCEDVLMDFDALKAVQSGLGTAAVIVMDKSTDVVDAIARLSYFYKHESCGQCTPCREGTGWLWMIMERMKVGNAKLEEIDMLQEVTKQIEGHTICALGDAAAWPVQGLIRHFRPELERRIREHADRELLQAAA

SEQ ID NO: 8436 - protein, 495 aa, Musa acuminata
MSAIGSGSAPIKNLCLLYRTELVHHFSGWRLSSASRSLSTQAATTGNTPQPPPPPPPPEKTHFGGLKDEDRIFTNLYGLHDPLLKGAMKRGDWYRTKDLVIKGSDWIVNEIKKSGLRGRGGAGFPSGLKWSFMPKVSDGRPSYLVVNADESEPGTCKDREIMRHDPHKLLEGCLIAGVGMKATAAHIYIRGEYVNERLTLEKARKEAYQAGLLGRNACGSGYDFDVHIHYGAGAYICGEETALLESLEGKQGKPRLKPPFPANAGLYGCPTTVTNVETVAVSPTILRRGPEWFASFGRKNNSGTKLFCISGHVNKPCTVEEEMSIPLKELLERHCGGVRGGWDNLLAVIPGGSSVPLLPKHICDDVLMDYDALKAVQSGLGTAAVIVMDKSTDVVDAIARLSYFYKHESCGQCTPCREGTGWLWMIMEKLKVGNAMLEEIDMLQEVTKQIEGHTICALGDAAAWPVQGLIRHFRPELERRIKERAQKELLEAAAA

SEQ ID NO: 8437 - protein, 486 aa, Ricinus communis
MAPIRGIFNLQRAALIRRQSDRLAVGIRSFSTEATKSAGSSQPLPPPPPPEKTHFGGLKDEDRIFTNLYGLHDPFLKGAMKRGDWYRTKDLVLKGADWIVNEVKKSGLRGRGGAGFPSGLKWSFMPKVSDGRPSYLVVNADESEPGTCKDREIMRHDPHKLLEGCLIAGVGMRASAAYIYIRGEYVNERINLERARKEAYAAGLLGKNACGSGYDFDVHIHYGAGAYICGEETALLESLEGKQGKPRLKPPFPANAGLYGCPTTVTNVETVAVSPTILRRGPEWFASFGRKNNSGTKLFCVSGHVNKPCTVEEEMSIPLKELIERHCGGVRGGWDNLLAVIPGGSSVPLLPKHICDDVLMDYDALKAVTSGLGTAAVIVMDKSTDVVDAIARLSYFYKHESCGQCTPCREGTPWLWMIMERLKVGNAKLEEIDMLQEVTKQIEGHTICALGDAAAWPVQGLIRHFRPELERRIKERAERELLEAAA

SEQ ID NO: 8438 - protein, 466 aa, Flaveria ramosissima
MYWGLGTRLFSTQSATTANTAQPPPPPPPPEKTHFGGLKDEDRIFTNLYGIHDPFLKGAMKRGDWYRTKDLVIKGSDWIVNEMKKSGLRGRGGAGFPSGLKWSFMPKVSDGRPSYLVVNADESEPGTCKDREIMRNDPHKLLEGCLIAGVGMRATAAYIYIRGEYVNERLNLEKARKEAYAAGLLGKNACGSGYDFDVHIHFGAGAYICGEETALLESLEGKQGKPRLKPPFPANAGLYGCPTTVTNVETVAVSPTILRRGPEWFSSFGRKNNSGTKLFCISGHVNKPCTVEEEMSIPLKELLERHCGGVRGGWDNLLAVIPGGSSVPLLPKHICEDVLMDFDALKAVQSGLGTAAVIVMDKSTDVVDAIARLSYFYKHESCGQCTPCREGTGWLWMIMERMKVGNAKLEEIDMLQEVTKQIEGHTICALGDAAAWPVQGLIRHFRPELERRIREHADRELLQAAA

SEQ ID NO: 8439 - protein, 486 aa, Tropaeolum majus
MAPVKGILSLQRTAALLQQSKRWSLASRSFSTQGPATSSTPQPPPPPPPPERTHFGGLKDEDRIFTNLYGLHDPFLKGAMKRGDWYRTKDLVIKGADWIVNEMKKSGLRGRGGAGFPSGLKWSFMPKVSDGRPSYLVVNADESEPGTCKDREIMRHDPHKLLEGCLIAGVGMRATAAYIYIRGEYVNERLSLEKARKEAYAAGLLGKNACGSGYDFDVHIHFGAGAYICGEETALLESLEGNQGKPRLKPPFPANVGLYGCPTTVTNVETVAVSPTILRRGPEWFSSFGRKNNAGTKLFCISGHVNKPCTVEEEMSISLKELLERHCGGVRGGWDNLLAVIPGGSSVPLLPKEICDDVLMDFDALKAVQSGLGTAAVIVMDKSTDVVDAIARLSYFYKHESCGQCTPCREGTGWLWLMMERLKVGNAKLEEIDMLHEITKQIEGHTICALGDAAAWPVQGLIRHFRPELERRIREHAEKELLAANA

SEQ ID NO: 8440 - protein, 484 aa, Quercus alba
MAPIKGILSLQRAALAQRHSNSLGLGFRTFSTQGATTAATPPPPPPPPEKTHFGGLKDEDRIFTNLYGLNDPFLKGAMKRGDWYRTKDLVLKGADWIVNEVKKSGLRGRGGAGFPSGLKWSFMPKVSDGRPSYLVVNADESEPGTCKDREIMRHDPHKLLEGCLMAGVGMRASAAYIYIRGEYVNERLNLERARKEAYEAGFLGKNACGSGYDFDVHIHYGAGAYICGEETALLESLEGKQGKPRLKPPFPANAGLYGCPTTVTNVETVAVSPTILRRGPEWFASFGRKNNSGTKLFCVSGHVNKPCTVEEEMSIPLKELIERHCGGVRGGWDNLLAIIPGGSSVPLIPKNICDDVLMDYDALKAVQSGLGTAAVIVMDKSTDVVDAIARLSYFYKHESCGQCTPCREGTGWLWMIMERLKVGNAKLEEIDMLQEVTKQIEGHTICALGDAAAWPVQGLIRHFRPELERRIRGRAERELLEAAA

SEQ ID NO: 8441 - protein, 483 aa, Arachis hypogaea
MRGILSLKRAALASRHSEKLGVSFRLLSTQAASNASTPQPPPPPPPPEKTHFGGLKDEDRIFTNLYGLHDPFLKGAMKRGDWYRTKDLVLKGTDWIVNEMKKSGLRGRGGAGFPSGLKWSFMPKTSDGRPSYLVVNADESEPGTCKDREIMRHDPHKLLEGCLIAGVGMRASAAYIYIRGEYVNERINLEKARKEAYAAGLLGKNACGSGYDFDVHIHYGAGAYICGEETALLESLEGKQGKPRLKPPFPANAGLYGCPTTVTNVETVAVSPTILRRGPEWFASFGRKNNSGTKLFCVSGHVNKPCTVEEEMSIPLKELIERHCGGVRGGWDNLLAVIPGGSSVPLIPKNICDDVLMDYDALKAVQTGLGTAAVIVMDKSTDVVDAIARLSYFYKHESCGQCTPCREGTGWLWMIMERMKVGNAKLEEIDMLQEVTKQIEGHTICALGDAAAWPVQGLIRHFRPELEKRIRERAERELLQATG

SEQ ID NO: 8442 - protein, 482 aa, Vigna unguiculata
MRGILSLRTALVQHRSEKLGFGLRQFSTQGASTPTSPQPPPPPPPPEKTHFGGLKDEDRIFTNLYGLHDPFLKGAMKRGDWYRTKDLVTKGTDWIVNEMKKSGLRGRGGAGFPSGLKWSFMPKVSDGRPSYLVVNADESEPGTCKDREIMRHDPHKLLEGCLIAGVGMRATAAYIYIRGEYVNERKNLEKARQEAYAAGLLGKNACGSGYDFDVHIHFGAGAYICGEETALLESLEGKQGKPRLKPPFPANAGLYGCPTTVTNVETVAVSPTILRRGPEWFASFGRKNNAGTKLYCVSGHVNKPCTVEEEMSIPLKELIERHCGGVRGGWDNLLAVIPGGSSVPLLPKNICDDVLMDYDALKAVQSGLGTAAVIVMDKSTDVVDAIARLSYFYKHESCGQCTPCREGTGWLWTIMERMKVGNAKLEEIDMLQELTKQIEGHTICALGDAAAWPVQGLIRHFRPELERRIRENAERELLQATG

SEQ ID NO: 8443 - protein, 247 aa, Ambrosia trifida
MAPMKGILSLQRAALLRRQNVNWGLGTRLFSTQSATTANAAQPPPPPPPPEKTHFGGLKDEDRIFTNLYGIHDPFLKGAMKRGDWYRTKDLVIKGADWIVNEIKKSGLRGRGGAGFPSGLKWSFMPKVSDGRPSYLVVNADESEPGTCKDREIMRNDPHKLLEGCLIAGVGMRATAAYIYIRGEYVNERLNLEKPEKKPMQLGCLGKTLVVLVMILMCISTLVLVLTFVVKKQHFWRALKVNKESLD

SEQ ID NO: 8444 - protein, 168 aa, Catharanthus roseus
MKRGDWYRTKDLVLKGSDWIVNEMKKSGLRGRGGAGFPSGLKWSFMPKQSDGRPSYLVVNADESEPGTCKDREIMRHDPHKLLEGCLIAGVGMRASAAYIYIRGEYVNERKNLERARKEAYEAGLLGKMHVVLVMTLMYISTSVLEPTFVVKRRLSLRALRGNKVNLD

SEQ ID NO: 8445 - protein, 486 aa, Arnica chamissonis
MVPMKGILSLQRAALLRRQNGNWGLGARLFSTQSATTANTAQPSPPPPPPEKTHFGGLKDEDRIFTNLYGIHDPFLKGAMKRGDWHRTKDLVIKGSDWIVNEMKKSGLRGRGGAGFPSGLKWSFMPKVSDGRPSYLVVNADESEPGTCKDREIMRNDPHKLLEGCLIAGVGMRATAAYIYIRGEYVNERLNLEKARKEAYAAGLLGKNACGSGYDFDVHIHFGAGAYICGEETALLESLEGKQGKPRLKPPFPANSGLYGCPTTVTNVETVAVSPTILRRGPEWFSSFGRKNNSGTKLFCISGHVNKPCTVEEEMSISLKELLERHCGGVRGGWDNLLAVIPGGSSVPLLPKNVCEDVLMDFDALKAVQSGLGTAAVIVMDKSTDVVDAIARLSYFYKHESCGQCTPCREGTGWLWMIMERMKVGNAKLEEIDMLQEVTKQIEGHTICALGDAAAWPVQGLIRHFRPELERRIREHAERELLLAAA

SEQ ID NO: 8446 - protein, 287 aa, Flaveria ramosissima
MQLGYLEKMLVDQVMILMCISTSVAGAYICGEETALLESLEGKQGKPRLKPPFPANAGLYGCPTTVTNVETVAVSPTILRRGPEWFSSFGRKNNSGTKLFVISGHVNKPCTVEEEMSIPLKELLERHCGGVRGGWDNLLAVIPGGSSVPLLPKHICEDVLMDFDALKAVQSGLGTAAVIVMDKSTDVVDAIAWLSYFYKHESCGQCTPCREGTGWLWMIMERMKVGNAKLEEIDMLQEVTKQIEGHTICALGDAAAWPVQGLIRHFRPELERRIREHADRELLQAAA

SEQ ID NO: 8447 - protein, 486 aa, Carica papaya
MAPVKGILSLQRTASRWQQSNRWGQTMRSFSTQGAAPSNTAQPPPPPPPPEKTHFGGLKDEDRIFTNLYGLHDPFLKGAMKRGDWYRTKDLVLKGADWIVNEVKKSGLRGRGGAGFPSGLKWSFMPKVSDGRPSYLVVNADESEPGTCKDREIMRHDPHKLLEGCLIAGVGMRATAAYIYIRGEYVNERKNLERARKEAYEAGFLGKNACGSDYDFDIHIHFGAGAYICGEETALLESLEGKQGKPRLKPPFPANAGLYGCPTTVTNVETVAVSPTILRRGPEWFASFGRKNNSGTKLFCVSGHVNKPCTVEEEMSIPLKELIERHCGGVRGGWNNLLAVIPGGSSVPLLPKHICDDVLMDYDALKAVQSGLGTAAVIVMDKSTDVVDAIARLSYFYKHESCGQCTPCREGTGWLWMIMERLKVGNAKLEEIDMLQEVTKQIEGHTICALGDAAAWPVQGLIRHFRPELERRIRKRAQRELLEASA

SEQ ID NO: 8448 - protein, 485 aa, Populus trichocarpa
MAPIRGIFSLQRTALVRQSERLGVGFRSFSTQAPTNAGAPQPPPPPPPPEKTHFGGLKDEDRIFTNVYGLHDPFLKGAMKRGDWYRTKDLVLKGTDWIVNEVKKSGLRGRGGAGFPSGLKWSFMPKTSDGRPSYLVVNADESEPGTCKDREIMRHDPHKLLEGCLIAGVGMRASAAYIYIRGEYVNERINLERARKEAYEAGLLGKNACGSGYDFDVHIHYGAGAYICGEETALLESLEGKQGKPRLKPPFPANSGLYGCPTTVTNVETVAVSPTILRRGPEWFASFGRKNNSGTKLFCVSGHVNKPCTVEEEMSIPLKELIERHCGGVRGGWDNLLAVIPGGSSVPLLPKHICDDVLMDYDALKAVTSGLGTAAVIVMDKSTDVVDAIARLSYFYKHESCGQCTPCREGTGWLWMIMERLKVGNAKLEEIDMLQEVTKQIEGHTICALGDAAAWPVQGLIRHFRPELERRIKERAERELLEAAA

SEQ ID NO: 8449 - protein, 486 aa, Euonymus alatus
MAPMKCFLSLRQAALVRHHSERWGAGFRSFSTQGATPGSTPQPPPPPPPPEKTHFGGLKDEDRIFTNLYGLHDPFLKGSMKRGDWYRTKDLVLKGADWIVNEVKKSGLRGRGGAGFPSGLKWSFMPKVSDGRPSYLVVNADESEPGTCKDREIMRHDPHKLLEGCLIAGVGMRATAAYIYIRGEYVNERKNLERARKEAYEAGLLGKNACGSGYDFDVHIHYGAGAYICGEETALLESLEGKQGKPRLKPPFPANTGLYGCPTTVTNVETVAVSPTILRRGPEWFASFGRKNNSGTKLFCVSGHVNKPCTVEEEMSIPLKELIERHCGGVRGGWDNLLAVIPGGSSVPLIPKHICDDVLMDYDALKAVTSGLGTAAVIVMDKSTDVVDAIARLSYFYKHESCGQCTPCREGTPWLWMIMERLKVGNAKLEEIDMLQEVTKQIEGHTICALGDAAAWPVQGLIRHFRPELERRIKERASKELLEAAA

SEQ ID NO: 8450 - protein, 407 aa, Vaccinium corymbosum
MKRGDWYRTKDLVLKGAEWIVNEMKKSGLRGRGGAGFPSGLKWSFMPKVSDGRPSYLVVNADESEPGTCKDREIMRHDPHKLIEGCLIAGVGMRATAAYIYIRGEYVNERKNLEKALKEAYEAGLIGKNACGSGYDFDIHIHYGAGAYICGEETALLESLEGKQGKPRLKPPFPANAGLYGCPTTVTNVETVAVSPTILRRGPEWFASFGRKNNSGTKLFCVSGHVNKPCTVEEEMSIPLKELIERHCGGVRGGWDNLLAVIPGGSSVPLLPKDICDDVMMDYDALKAVQSGLGTAAVIVMDKSTDVVDAISRLSYFYKHESCGQCTPCREGTGWLWMIMERLKVGNAKLEEIDMLQEVTKQIEGHTICALGDAAAWPVQGLIRHFRPELERRIRERAERELLEAAA

SEQ ID NO: 8451 - protein, 479 aa, Cannabis sativa
MRGIMSLRRAALARGHSEKWATCFRSFSTQGAATGTTPQPPPPEKTHFGGLKDEDRIFTNLYGLHDPFLKGAMKRGDWHRTKDLVIKGADWIVNEMKKSGLRGRGGAGFPSGLKWSFMPKVSDGRPSYLVVNADESEPGTCKDREIMRHDPHKLLEGCLIAGVGMRATAAYIYIRGEYVNERLNLEKARKEAYAAGLLGKNACGSGYDFDVHIHYGAGAYICGEETALLESLEGKQGKPRLKPPFPANAGLYGCPTTVTNVETVAVSPTILRRGPEWFASFGRKNNSGTKLFCVSGHVNKPCTVEEEMSIPLKELIERHCGGVRGGWDNLLAIIPGGSSVPLLPKNICDDVLMDYDALKAVQSGLGTAAVIVMDKSTDVVDAIARLSYFYKHESCGQCTPCREGTGWLWMIMERMKVGNAKLEEIDMLQELTKQIEGHTICALGDAAAWPVQGLIRHFRPELERRIRQRAERELLEAAA

SEQ ID NO: 8452 - protein, 488 aa, Lactuca sativa
MAPMKGILSLQRAVLSRHQNANWGINATARLFSTQSATTATTAQPPPPPPPPEKTHFGGLKDEDRIFTNLYGLHDPFLKGAMKRGDWHRTKDIVIKGADWIVNEMKKSGLRGRGGAGFPSGLKWSFMPKVSDGRPSYLVVNADESEPGTCKDREIMRNDPHKLLEGCLIAGVGMRATAAYIYIRGEYVNERLNLEKARKEAYAAGLLGKNACGSGYDFDVHIHFGAGAYICGEETALLESLEGKQGKPRLKPPFPANAGLYGCPTTVTNVETIAVSPTILRRGPEWFSSFGRKNNSGTKLFCISGHVNKPCTVEEEMSIPLKELLERHCGGVRGGWDNLLAVIPGGSSVPLLTKDLCEDVLMDFDALKAVQSGLGTAAVIVMDKSTDIVDAIARLSYFYKHESCGQCTPCREGTGWLWMIMERMKVGNAKLEEIDMLQEVTKQIEGHTICALGDAAAWPVQGLIRHFRPEMERRIRERADRELLQAAA

SEQ ID NO: 8453 - protein, 486 aa, Aquilegia formosa
MGSVKKILSLPRAALLRHYSERCSTVYRSFSTQAASTSSTPQPPPPPPPPEKTHFGGLKDEDRIFTNLYGLHDPFLKGAMKRGDWHRTKDIVTKGADWIVNEMKKSGLRGRGGAGFPSGLKWSFMPKVSDGRPSYLVVNADESEPGTCKDREIMRHDPHKLLEGCLIAGVAMRATAAYIYIRGEYVNERLNLVKARNEAYQAGLLGKNACGSGYDFDVHIHFGAGAYICGEETALLESLEGKQGKPRLKPPFPANAGLYGCPTTVTNVETVAVSPTILRRGPEWFASFGRKNNAGTKLFCVSGHVNKPCTVEEEMSIPLKELIERHCGGVRGGWDNLLAVIPGGSSVPLLPKNVCEDVLMDFDALKAVQSGLGTAAVIVMDKSTDVVDAIARLSYFYKHESCGQCTPCREGTGWLWMIMERLKVGNAKLEEIDMLQEVTKQIEGHTICALGDAAAWPVQGLIRHFRPELERRIKERADRELIEAAA

SEQ ID NO: 8454 - protein, 483 aa, Castanea mollissima
MAPIKGILSLQRAALARRHSNSLGLGFRKFSTQGATTAATPPPPPPPEKTHFGGLKDEDRIFTNLYGLNDPFLKGAMKRGDWYRTKDLVLKGADWIVNEVKKSGLRGRGGAGFPSGLKWSFMPKVSDGRPSYLVVNADESEPGTCKDREIMRHDPHKLLEGCLMAGVGMRASAAYIYIRGEYVNERLNLERARKEAYEAGFLGKNACGSGYDFDVHIHYGAGAYICGEETALLESLEGKQGKPRLKPPFPANAGLYGCPTTVTNVETVAVSPTILRRGPEWFSSFGRKNNSGTKLFCVSGHVNKPCTVEEEMSIPLKELIERHCGGVRGGWDNLLAIIPGGSSVPLIPKNICDDVLMDYDALKAVQSGLGTAAVIVMDKSTDVVDAIARLSYFYKHESCGQCTPCREGTGWLWMIMERLKVGNAKLEEIDMLQEVTKQIEGHTICALGDAAAWPVQGLIRHFRPELERRIRGRAERELLEAAA

SEQ ID NO: 8455 - protein, 486 aa, Actinidia deliciosa
  misc_feature (312)..(312): Xaa can be any naturally occurring amino acid
MAPVKGILALHRTALIQRYSERWVSGSRLFSTQGATTASTSQPPPPPPPPEKTHFGDLKDEDRIFTNLYGIHDPFLKGAMKRGDWHRTKDLVLKGADWIVNEMKKSGLRGRGGAGFPSGLKWSFMPKVSDGRPSYLVVNADESEPGTCKDREIMRHDPHKLLEGCLIAGVGMRATAAYIYIRGEYVNERINLEKARKEAYQAGLLGKNACGSGYDFDVHIHYGAGAYICGEETALLESLEGKQGKPRLKPPFPANAGLYGCPTTVTNVETVAVSPTILRRGPEWFASFGRKNNSGTKLFCVSGHVNKPCTVXEEMSIPLKELIERHCGGVRGGWDNLLAVIPGGSSVPLLPKHICDDVMMDYDALKAVQSGLGTAAVIVMDKSTDVVDAIARLSYFYKHESCGQCTPCREGTGWLWMIMERLKVGNAKLEEIDMLQEVTKQIEGHTICALGDAAAWPVQGLIRHFRPELEKRIRERAERELLEAAA

SEQ ID NO: 8456 - protein, 485 aa, Papaver somniferum
MGPVKNILSLHRAAAPLRQSTRRWDAVCRSFSAQAATTATTPPPPPPPEKTHFGGLKDEDRIFTNLYGLHDPFLKGAMKRGDWHRTKDLVLKGTDWIINEMKKSGLRGRGGAGFPSGLKWSFMPKVSDGRPSYLVVNADESEPGTCKDREIMRHDPHKLLEGCLIAGVGMRASAAYIYIRGEYVNERLNLEKALKEAYKAGLLGKNACGSGYDFDVHIHYGAGAYICGEETALLESLEGKQGKPRLKPPFPANAGLYGCPTTVTNVETVAVSPTILRRGPEWFASFGRKNNSGTKLFCISGHVNKPCTVEEEMSIPLKELLERHCGGVRGGWDNLLAVIPGGSSVPLLPKHICDGVLMDYDALKAVTSGLGTAAVIVMDKSTDVVDAIARLSYFYKHESCGQCTPCREGTGWLWMVMERLKVGDAKLEEIDMLQEITKQIEGHTICALGDAAAWPVQGLIRHFRPELERRIRERADRELLEVASA

SEQ ID NO: 8457 - protein, 486 aa, Senecio madagascariensis
MAPMKGLLSLQRAALMRRHSGNWGVSARLFSTQSATTATTAQPPPPPPPPERTHFGGLKDEDRIFTNLYGIHDPFLKGAMKRGDWHRTKDLVIKGADWIVNEMKKSGLRGRGGAGFPSGLKWSFMPKVSDGRPSYLVVNADESEPGTCKDREIMRNDPHKLLEGCLIAGVGMRATAAYIYIRGEYVNERLNLEKARKEAYAAGLLGKNACGSGYDFDVHIHFGAGAYICGEETALLESLEGKQGKPRLKPPFPANSGLYGCPTTVTNVETVAVSPTILRRGPEWFSSFGRKNNSGTKLFCISGHVNKPCTVEEEMSISLKELLERHCGGVRGGWDNLLAVIPGGSSVPLLPKDVCEDVLMDFDALKAVQSGLGTAAVIVMDKSTDVVDAIARLSYFYKHESCGQCTPCREGTGWLWMIMERMKVGNAKLEEIDMLQEVTKQIEGHTICALGDAAAWPVQGLIRHFRPEMERRIRERADRELLQAAA

SEQ ID NO: 8458 - protein, 486 aa, Aquilegia formosa
MGSVKKILSLPRAALLRHYSERCSTVYRSFSTQAASTSSTPQPPPPPPPPEKTHFGGLKDEDRIFTNLYGLHDPFLKGAMKRGDWHRTKDIVTKGADWIVNEMKKSGLRGRGGAGFPSGLKWSFMPKVSDGRPSYLVVNADESEPGTCKDREIMRHDPHKLLEGCLIAGVAMRATAAYIYIRGEYVNERLNLVKARNEAYQAGLLGKNACGSGYDFDVHIHFGAGAYICGEETALLESLEGKQGKPRLKPPFPANAGLYGCPTTVTNVETVAVSPTILRRGPDWFASFGRKNNAGTKLFCVSGHVNKPCTVEEEMSIPLKELIERHCGGVRGGWDNLLAVIPGGSSVPLLPKNVCEDVLMDFDALKAVQSGLGTAAVIVMDKSTDVVDAIARLSYFYKHESCGQCTPCREGTGWLWMIMERLKVGNAKLEEIDMLQEVTKQIEGHTICALGDAAAWPVQGLIRHFRPELERRIKERADRELIEAAA

SEQ ID NO: 8459 - protein, 486 aa, Cichorium intybus
MAPMKGILSLQRAVLLSRQNVNRGLSARLFSTQSATTANTAQPPPPPPPPEKTHFGGLKDEDRIFTNLYGLHDPFLKGAMKRGDWHRTKDIVIKGADWIVNEMKKSGLRGRGGAGFPSGLKWSFMPKVSDGRPSYLVVNADESEPGTCKDREIMRNDPHKLLEGCLIAGVGMRATAAYIYIRGEYVNERLNLEKARKEAYAAGLLGKNACGSGYDFDVHIHYGAGAYICGEETALLESLEGKQGKPRLKPPFPANAGLYGCPTTVTNVETIAVSPTILRRGPEWFSSFGRKNNSGTKLFCISGHVNKPCTVEEEMSIPLKELLERHCGGVRGGWDNLLAVIPSGSSVPLLTKDLCEDVLMDFDALKAVQSGLGTAAVIVMDKSTDIVDAIARLSYFYKHESCGQCTPCREGTGWLWMIMERMKVGNAKLEEIDMLQEVTKQIEGHTICALGDAAAWPVQGLIRHFRPEMERRIRERADRELLQAAA

SEQ ID NO: 8460 - protein, 486 aa, Cirsium arvense
MAPMKCILSLQRAALLRRQNGNWVLGARSFSTQSATTATTAQPPPPPPPPERTHFGGLKDEDRIFTNLYGLHDPFLKGAMKRGDWHRTKDIVIKGADWIVNEMKKSGLRGRGGAGFPSGLKWSFMPKVSDGRPSYLVVNADESEPGTCKDREIMRNDPHKLLEGCLIAGVGMRATAAYIYIRGEYVNERLNLEKARKEAYAAGLLGKNACGSGYDFDIHIHFGAGAYICGEETALLESLEGKQGKPRLKPPFPANAGLYGCPTTVTNVETIAVSPTILRRGPEWFSSFGRKNNSGTKLFCISGHVNKPCTVEEEMSISLKELLERHCGGVRGGWDNLLAVIPGGSSVPLLPKDVCEDVLMDFDALKAVQSGLGTAAVIVMDKSTDVVDAIARLSYFYKHESCGQCTPCREGTGWLWTIMERMKVGNAKLEEIDMLQEITKQIEGHTICALGDAAAWPVQGLIRHFRPEMERRIREHADRELLQAAA

SEQ ID NO: 8461 - protein, 483 aa, Euonymus alatus
MAPMKSFLSLRQAALVRHHSERWVAGFRSFSTQGATTGSTPPPPPPPEKTHFGGLKDEDRIFTNLYGLHDPFLKGSMKRGDWYRTKDLVLKGADWIVNEVKKSGLRGRGGAGFPSGLKWSFMPKVSDGRPSYLVVNADESEPGTCKDREIMRHDPHKLLEGCLIAGVGMRATAAYIYIRGEYVNERKNLERARKEAYEAGLLGKNACGSGYDFDVHIHYGAGAYICGEETALLESLEGKQGKPRLKPPFPANTGLYGCPTTVTNVETVAVSPTILRRGPEWFASFGRKNNSGTKLFCVSGHVNKPCTVEEEMSIPLKELIERHCGGVRGGWDNLLAVIPGGSSVPLIPKHICDDVLMDYDALKAVTSGLGTAAVIVMDKSTDVVDAIARLSYFYKHESCGQCTPCREGTPWLWMIMERLKVGNAKLEEIDMLQEVTKQIEGHTICALGDAAAWPVQGLIRHFRPELERRIRERADKELLEAAA

SEQ ID NO: 8462 - protein, 482 aa, Cajanus cajan
MRGILSARTALVQRQSEKWALGFRLFSTQGASTASTPQPPPPPPPPEKTHFGGLKDEDRIFTNLYGLHDPFLKGAMKRGDWHRTKDLVLKGTDWIVNEMKKSGLRGRGGAGFPSGLKWSFMPKVSDGRPSYLVVNADESEPGTCKDREIMRHDPHKLLEGCLIAGVGMRASAAYIYIRGEYVNERKNLEKARQEAYAAGLLGKNACGSGYDFDVHIHFGAGAYICGEETALLESLEGKQGKPRLKPPFPANAGLYGCPTTVTNVETVAVSPTILRRGPEWFASFGRKNNSGTKLFCVSGHVNKPCTVEEEMSIPLKELIERHCGGVRGGWDNLLAVIPGGSSVPLIPKNICDDVLMDYDALKAVQSGLGTAAVIVMDKSTDVVDAIARLSYFYKHESCGQCTPCREGTGWLWTIMERMKVGNAKLEEIDMLQELTKQIEGHTICALGDAAAWPVQGLIRHFRPELERRIRENAERELLQATG

SEQ ID NO: 8463 - protein, 487 aa, Amborella trichopoda
GPMRNLLSFPRSSLTQHYSKGLVPFNRSFSTQAPTTSSTPQPPSPPPPPEKTHFGGLKDEDRIFTNLYGINDPFLKGAMKRGDWYQTKDLILKGSDWIVNEMKKSGLRGRGGAGFPSGLKWSFMPKVSDGRPSYLVVNADESEPGTCKDREIMRHDPHKLLEGCLIAGVGMRASAAYIYIRGEYVNERLNLLKARKEAYEVGLLGKNACGSGYDFDVHIHFGAGAYICGEETALLESLEGKQGKPRLKPPFPANAGLYGCPTTVTNVETVAVSPTILRRGPEWFASFGRKNNSGTKLFCISGHVNKPCTVEEEMSIPLKELIERHCKGVRGGWDNLLAIIPGGSSVPLLPKDICDDLLMDFDALKAVQSGLGTAAVIVMDKSTDVVDAIARLSYFYKHESCGQCTPCREGTGWLWMIMERLKVGNAKLEEIDMLQEVTKQIEGHTICALGDAAAWPVQGLIRHFRPELERRIKDRAQRELLESAAAA

SEQ ID NO: 8464 - protein, 535 aa, Brachypodium distachyon
MLRRAAHRLASRAAATGGAGSVARRTLAAAEVPVQAPADSAFVGIAANKEVEHLNYLSRPQPTRSITCARLYPAGRSFSTQAASTSSTPQPPPPPPPPEKTHFGDLKDEDRIFTNLYGLHDPFLKGAMKRGDWYRTKDLVIKGADWIVNEMKKSGLRGRGGAGFPSGLKWSFMPKVSDGRPSYLVVNADESEPGTCKDREIMRHDPHKLLEGCLIAGVGMRASAAYIYIRGEYVNERLNLEKARLEAYASGLLGKNACGSGYDFDVHIHFGAGAYICGEETALLESLEGKQGKPRLKPPFPANAGLYGCPTTVTNVETVAVAPTILRRGPEWFASFGRKNNSGTKLYCISGHVNKPCTVEEEMSIPLKELIEKHCGGVRGGWDNLLAVIPGGSSVPLLPKHICDDVLMDYDALKAVQSGLGTAAVMVMDKSTDVVDAIARLSYFYKHESCGQCTPCREGTGWLWMIMERLKVGNAKLEEIDMLQEVTKQIEGHTICALGDAAAWPVQGLIRHFRPELERRIRDRADRELLTAASA

SEQ ID NO: 8465 - protein, 488 aa, Amsonia hubrichtii
MAPIKGILSLQQTAFVRHQEGWRLGSRLFSTQATSTTSAPQAQQPPPPPPPPEKTHFGGLKDEDRIFTNLYGLNDPFLKGAMKRGDWYRTKDMVLKGSDWVVNEMKKSGLRGRGGAGFPSGLKWSFMPKQSDGRPSYLVVNADESEPGTCKDREIMRHDPHKLLEGCLIAGVGMRASAAYIYIRGEYVNERKNLEKARKEAYAAGLLGKNACGSGYDFDVHIHYGAGAYICGEETALLESLEGKQGKPRLKPPFPANSGLYGCPTTVTNVETVAVSPTILRRGPEWFASFGRKNNSGTKLFCISGHVNKPCTVEEEMSIPLKELIERHCGGVRGGWDNLLAVIPGGSSVPLIPKHICEDVLMDFDALKAVQSGLGTAAVIVMDKSTDVVDAIARLSYFYKHESCGQCTPCREGTGWLWMIMERMKVGNAKLEEIDMLQEVTKQIEGHTICALGDAAAWPVQGLIRHFRPELERRIRERADRELLEAAA

SEQ ID NO: 8466 - protein, 482 aa, Phaseolus coccineus
MKRIFSQRTALVQHRSENLGLGLRLFSTQGASTATSPQPPPPPPPPEKTHFGGLKDEDRIFTNLYGLHDPFLKGAMKRGDWYRTKDLVIKGTDWIVNEMKKSGLRGRGGAGFPSGLKWSFMPKVSDGRPSYLVVNADESEPGTCKDREIMRHDPHKLLEGCLIAGVGMRATAAYIYIRGEYVNERKNLETARLEAYAAGLLGKNACGSGYDFDVHIHYGAGAYICGEETALLESLEGKQGKPRLKPPFPANAGLYGCPTTVTNVETVAVSPTILRRGPEWFASFGRKNNAGTKLYCVSGHVNKPCTVEEEMSIPLKELIERHCGGVRGGWDNLLAVIPGGSSVPLLPKSICDDVLMDYDALKAVQSGLGTAAVIVMDKSTDVVDAIARLSYFYKHESCGQCTPCREGTGWLWTIMERMKVGNAKLEEIDMLQELTKQIEGHTICALGDAAAWPVQGLIKHFRPELERRIRENAERELLQATG

SEQ ID NO: 8467 - protein, 502 aa, Phalaenopsis aphrodite
MGYANELVLARRLKDPLRSLFALPRSHFPQSCLSKRFNVACSFFSTQAASTAGTPPPTPPPPPPPEKTHFGGLKDEDRIFTNLYGLHDPFLKGAMKRGDWYRTKDLVLKGSDWIVNEMKKSGLRGRGGAGFPSGLKWSFMPKVSDGRPSYLVVNADESEPGTCKDREIMRHDPHKLIEGCLIAGVGMRATAAYIYIRGEYVNERLNLEKARKEAYHAGFLGKNACGSGYDFDVHIHYGAGAYICGEETALLESLEGKQGKPRLKPPFPANAGLYGCPTTVTNVETVAVSPTILRRGPEWFASFGRKNNSGTKLYCISGHVNKPCTVEEEMSIPLKELIERHCGGVRGGWDNLLAIIPGGSSVPLLPKHICDDVLMDYDALKAVQSGLGTAAVMVMDKSTDVVDAIARLSYFYKHESCGQCTPCREGTGWLWMIMERLKVGNAKIEEIDMLQEVSKQIEGHTICALGDAAAWPVQGLIRHFRPELERRIRDRAARELLEAAAA

SEQ ID NO: 8468 - protein, 460 aa, Cleome gynandra
LRSLSTQAATTSNTPQPPPPPPPPEKTHFGGLKDEDRIFTNLYGLHDPFLKGAMKRGDWYRTKDLVLKGSDWIVNEMKKSGLRGRGGAGFPSGLKWSFMPKVSDGRPSYLVVNADESEPGTCKDREIMRHDPHKLLEGCLIAGVGMRARAAYIYIRGEYVNERKNLEKARREAYEAGLLGKNACGSGYDFDVYIHFGAGAYICGEETALIESLEGKQGKPRLKPPFPANAGLYGCPTTVTNVETVAVSPTILRRGPEWFASFGRKNNSGTKLFCISGHVNKPCTVEEEMSIPLKELIERHCGGVRGGWDNLLAVIPGGSSVPLIPKNVCEDVLMDFDALKAVQSGLGTAAVIVMDKSTDVVDAIARLSYFYKHESCGQCTPCREGTGWLWMIMERMKVGNAKLEEIDMLQEVTKQIEGHTICALGDAAAWPVQGLIRHFRPELERRIRERAERELLEAAA

SEQ ID NO: 8469 - protein, 487 aa, Vitis vinifera
MAPIRGILTLQRMALVSRQSKKWGPGCRAFSTQAATTASASQPPPPPPPPEKTHFGGLKDEDRIFTNLYGLHDPFLKGAMKRGDWYRTKDIVLKGSDWIVNEMKKSGLRGRGGAGFPSGLKWSFMPKVSDGRPSYLVVNADESEPGTCKDREIMRHDPHKLLEGCLIAGVGMRATTAYIYIRGEYVNERKNLERARKEAYEAGLLGKNACGSGYDFDVHIHYGAGAYICGEETALLESLEGKQGKPRLKPPFPANAGLYGCPTTVTNVETVAVSPTILRRGPEWFAGFGRKNNAGTKLYCVSGHVNKPCTVEEEMSIPLKELIERHCGGVRGGWDNLLAVIPGGSSVPLLPKHICDDVLMDYDALKAVQSGLGTAAVIVMDKSTDVVDAIARLSYFYKHESCGQCTPCREGTGWLLMMMERLKVGNANLEEIDMLQEVTKQIEGHTICALGDAAAWPVQGLIRHFRPELERRIRERAERELLEVAAA

SEQ ID NO: 8470 - protein, 486 aa, Cucumis melo
MAPFRGMLYLQHRTLARRYIDQWGIGLRAFSSQGAAAPGSPQPPPPPPPPEKTHFGGLKDEDRIFTNLYGLHDPFLKGAMKRGDWHRTKDLVLKGADWIVNEVKKSGLRGRGGAGFPSGLKWSFMPKVSDGRPSYLVVNADESEPGTCKDREIMRHDPHKLLEGCLIAGVGMRATAAYIYIRGEYVNERKNLEKARKEAYEAGLLGKNACGSGYDFDVHIHYGAGAYICGEETALLESLEGKQGKPRLKPPFPANAGLYGCPTTVTNVETVAVSPTILRRGPEWFASFGRKNNSGTKLFCVSGHVNKPCTVEEEMSIPLKELIERHCGGVRGGWDNLLAVIPGGSSVPLLPKHICDDVLMDYDALKAVQSGLGTAAVIVMDKSTDIVDAIARLSYFYKHESCGQCTPCREGTGWLWMIMERMKVGNAKLEEIDMLQEVTKQIEGHTICALGDAAAWPVQGLIKNFRPELERRIRERAERELIQAAA

SEQ ID NO: 8471 - protein, 486 aa, Citrullus lanatus
MAPFRGMLYLRRTTLARSYIDRWGVGLRAFSNQGAAATGSPQPPPPPPPPEKTHFRGLKDEDRIFTNLYGLHDPFLKGAMKRGDWYRTKDLVLKGADWIVNEVKKSGLRGRGGAGFPSGLKWSFMPKVSDGRPSYLVVNADESEPGTCKDREIMRHDPHKLLEGCLIAGVGMRATAAYIYIRGEYVNERKNLEKARKEAYEAGLLGKNACGSGYDFDVHIHYGAGAYICGEETALLESLEGKQGKPRLKPPFPANAGLYGCPTTVTNVETVAVSPTILRRGPEWFASFGRKNNSGTKLFCVSGHVNKPCTVEEEMSIPLKELIERHCGGVRGGWDNLLAVIPGGSSVPLLPKHICDDVLMDYDALKAVQSGLGTAAVIVMDKSTDIVDAIARLSYFYKHESCGQCTPCREGTGWLWMIMERMKVGNAKLEEIDMLQEVTKQIEGHTICALGDAAAWPVQGLVKNFRPELERRIRERAERELIQAAA

SEQ ID NO: 8472 - protein, 482 aa, Phaseolus coccineus
MKRIFSQRTALVQHRSEKLGLGLRLFSTQGASTATSPQPPPPPPPPEKTHFGGLKDEDRIFTNLYGLHDPFLKGAMKRGDWYRTKDLVIKGTDWIVNEMKKSGLRGRGGAGFPSGLKWSFMPKVSDGRPSYLVVNADESEPGTCKDREIMRHDPHKLLEGCLIAGVGMRATAAYIYIRGEYVNERKNLETARLEAYAAGLLGKNACGSGYDFDVHIHYGAGAYICGEETALLESLEGKQGKPRLKPPFPANAGLYGCPTTVTNVETVAVSPTILRRGPEWFASFGRKNNAGTKLYCVSGHVNKPCTVEEEMSMPLKELIERHCGGVRGGWDNLLAVIPGGSSVPLLPKSICDDVLMDYDALKAVQSGLGTAAVIVMDKSTDVVDAIARLSYFYKHESCGQCTPCREGTGWLWTIMERMKVGNAKLEEIDMLQELTKQIEGHTICALGDAAAWPVQGLIKHFRPELERRIRENAERELLQATG

SEQ ID NO: 8473 - protein, 483 aa, Medicago truncatula
MRGILSLKRAVLVRQHSEKLGLGVRLFSTQGASTASTPQPPPPPPPPEKTHFGGLKDEDRIFTNLYGLHDPFLKGAMKRGDWHRTKDLVIKGTDWIVNEMKKSGLRGRGGAGFPSGLKWSFMPKVSDGRPSYLVVNADESEPGTCKDREIMRHDPHKLLEGCLIAGVGMRATAAYIYIRGEYVNERLNLEKARKEAYAAGLLGKNACGSGYDFDVHIHYGAGAYICGEETALLESLEGKQGKPRLKPPFPANAGLYGCPTTVTNVETVAVSPTILRRGPEWFASFGRKNNAGTKLYCVSGHVNKPCTVEEEMSMPLKELIERHCGGVRGGWDNLLAIIPGGSSVPLIPKHVCDDVLMDYDALKAVGSGLGTAAVIVMDKSTDVVDAIARLSYFYKHESCGQCTPCREGTGWLWMIMERMKVGNAKLEEIDMLQEVTKQIEGHTICALGDAAAWPVQGLIRHFRPELERRIKENAQRELLQATG

SEQ ID NO: 8474 - protein, 487 aa, Antirrhinum majus
  misc_feature (7)..(7): Xaa can be any naturally occurring amino acid
  misc_feature (28)..(28): Xaa can be any naturally occurring amino acid
  misc_feature (353)..(353): Xaa can be any naturally occurring amino acid
MAPIKSXLSLQRAALVRRSSENWGLPSXLLSTQAATTSTTPQAPPPPPPPKKTHFGGLKNENRIFTNVYGIHDPFLKGAMKRGNWYRTKNLVLKGTDWIVNEMKKSGLQGRGGAGFPSGLKWSFMPKVSDGRPSYLVVNADESEPGTCKDREIMRHDPHKLLEGCLIAGVGMRARAAYIYIRGEYVNERLNLEKARREAYEAGLLGKNACGSGYDFDVHIHFGAGAYICGEETALLESLEGKQGKPRLKPPFPANAGLYGCPTTVTNVETVAVSPTILRRGPEWFASFGRKNNSGTKLFCISGHVNKPCTVEEEMSIPLKELIERHCGGVRGGWDNLLAVIPGGSSVPLIPKXLCEDVLMDFDALKAVQSGLGTAAVIVMDKSTDVVDAIARLSYFYKHESCGQCTPCREGTGWLWMIMERLKVGNAKLEEIDMLQEVTKQIEGHTICALGDAAAWPVQGLIRHFRPELERRIRERADRELQQAAAA

SEQ ID NO: 8475 - protein, 487 aa, Olea europaea
MSPMKNILSLQKTALIRLPTEKWGLASRFFSTQTATTSTTPQPPPPPPPPEKTHFGGLKDEDRIFTNVYGLHDPFLKGAMKRGDWYRTKDLVLKGTDWIVNEIKKSGLRGRGGAGFASGLKWSFMPKVSDGRPSYLVVNADESEPGTCKDREIMRHDPHKLLEGCLIAGVGMRARAAYIYIRGEYVNERLNLEKARREAYEAGLLGKNACGSGYDFDVHIHFGAGAYICGEETALLESLEGKQGKPRLKPPFPANAGLYGCPTTVTNVETVAVSPTILRRGPEWFASFGRKNNSGTKLFCISGHVNKPCTVEEEMSIPLKELLERHCGGVRGGWDNLLAVTPGGSSVPLLPKHICEDVLMDFDALKAVQSGLGTAAVIVMDKSTDVVDAIARLSYFYKHESCGQCTPCREGTGWLWMIMERLKVGNAKLEEIDMLHEVTKQIEGHTICALGDAAAWPVQGLIRHFRPELERRIREHAERELQQAAAA

SEQ ID NO: 8476 - protein, 487 aa, Unknown
  Sequence found in Organisms: Solanum tuberosum, Solanum phureja
MAPIKGLLSLQRTALAQRSSERWGLYGRLFSTQAASTASTPQPTPPPPPPERTHFGGLKDEDRIFTNLYGLHDPYLKGAMKRGDWYRTKDLVIKGSDWIVNEMKKSGLRGRGGAGFPSGLKWSFMPKTTDGRPSYLVVNADESEPGTCKDREIMRHDPHKLLEGCLIAGVGMRAKAAYIYIRGEYVNERKSLQKARQEAYEAGLLGKNACGSGYDFDVYIHFGAGAYICGEETALLESLEGKQGKPRLKPPFPANAGLYGCPTTVTNVETVAVSPTILRRGPEWFASFGRKNNAGTKLFCISGHVNKPCTVEEEMSISLKELIERHCGGVRGGWDNLLAVIPGGSSVPLLPKNICEDVLMDFDALKAVQSGLGTAAVIVMDKSTDVVDAIARLSYFYKHESCGQCTPCREGTGWLWMIMERMKVGNAKLEEIDMLQEVTKQIEGHTICALGDAAAWPVQGLIRHFRPELERRIREHAERELQQAAAA

SEQ ID NO: 8477 - protein, 487 aa, Solanum lycopersicum
MAPIKGLLSLQRTALAQRSSERWGQYGRLFSTQAASTASTPQPTPPPPPPERTHFGGLKDEDRIFTNLYGLHDPYLKGAMKRGDWYRTKDLVIKGSDWIVNEMKKSGLRGRGGAGFPSGLKWSFMPKTTDGRPSYLVVNADESEPGTCKDREIMRHDPHKLLEGCLIAGVGMRARAAYIYIRGEYVNERLSLQKARQEAYEAGLLGKNACGSGYDFDVYIHFGAGAYICGEETALLESLEGKQGKPRLKPPFPANAGLYGCPTTVTNVETVAVSPTILRRGPEWFASFGRKNNAGTKLFCISGHVNKPCTVEEEMSISLKELLERHCGGVRGGWDNLLAVIPGGSSVPLLPKNICEDVLMDFDALKAVQSGLGTAAVIVMDKSTDVVDAIARLSYFYKHESCGQCTPCREGTGWLWMIMERMKVGNAKLEEIDMLQEVTKQIEGHTICALGDAAAWPVQGLIRHFRPELERRIREHAERELQQAAAA

SEQ ID NO: 8478 - protein, 477 aa, Citrullus lanatus
MLYLQRTTLAKSYIDRCGIGLRAFSNQSAAATGNPQPPPPPEKTHFGGLKDEDRIFTNLYGLHDPFLKGAMKRGDWYRTKDLVLKGADWIVNEVKKSGLRGRGGAGFPSGLKWSFMPKVSDGRPSYLVVNADESEPGTCKDREIMRHDPHKLLEGCLIAGVGMRATAAYIYIRGEYVNERKNLEKARKEAYAAGLLGKNACGSGYDFDVHIHYGAGAYICGEETALLESLEGKQGKPRLKPPFPANAGLYGCPTTVTNVETVAVSPTILRRGPEWFASFGRKNNSGTKLFCVSGHVNKPCTVEEEMSIPLKELIERHCGGVRGGWDNLLAVIPGGSSVPLLPKHICDDVLMDYDALKAVQSGLGTAAVIVMDKSTDIVDAIARLSYFYKHESCGQCTPCREGTGWLWMIMERMKVGNAKLEEIDMLQEVTKQIEGHTICALGDAAAWPVQGLIKNFRPELERRIRERAERELIQAAA

SEQ ID NO: 8479 - protein, 488 aa, Tabernaemontana elegans
MAPIKGIISLQRAAFARRQECWRIGSRLFSTQSTATASTPQAQQPPPPPPPPEKTHFGGLKDEDRIFTNLYGLNDPFLKGAMKRGDWYRTKELVLKGSDWIVNEIKKSGLRGRGGAGFPSGLKWSFMPKQSDGRPSYLVVNADESEPGTCKDREIMRHDPHKLLEGCLIAGVGMRASAAYIYIRGEYVNERKNLEKARKEAYEAGLLGKNACGSGYDFDIHIHFGAGAYICGEETALLESLEGKQGKPRLKPPFPANAGLYGCPTTVTNVETVAVSPTILRRGPEWFASFGRKNNSGTKLFCVSGHVNKPCTVEEEMSIPLKELIERHCGGVRGGWNNLLAVIPGGSSVPLIPKNICEDVLMDFDALKAVQSGLGTAAVIVMDKSTDVVDAIARLSYFYKHESCGQCTPCREGTGWLWMIMERIKVGNAKLEEIDMLQEVTKQIEGHTICALGDAAAWPVQGLIRHFRPELERRIRERAERELLEAAA

SEQ ID NO: 8480 - protein, 488 aa, Vinca minor
MAPIKGILSLQRTAFARRQEGCRVGSKLFSTQATSTASSPQAQQPPPPPPPPEKTHFGGLKDEDRIFTNLYGLNDPFLKGAMKRGDWYRTKDLVLKGTDWIVNEMKKSGLRGRGGAGFPSGLKWSFMPKQSDGRPSYLVVNADESEPGTCKDREIMRHDPHKLLEGCLIAGVGMRASAAYIYIRGEYVNERMNLERARKEAYEAGLLGKNACGSGYDFDVHIHFGAGAYICGEETALLESLEGKQGKPRLKPPFPANAGLYGCPTTVTNVETVAVSPTILRRGPEWFSSFGRKNNSGTKLFCISGHVNKPCTVEEEMSIPLKELIERHCGGVRGGWDNLLAVIPGGSSVPLIPKNMCEDVLMDFDALKAVQSGLGTAAVIVMDKSTDVVDAIARLSYFYKHESCGQCTPCREGTGWLWMIMERMKVGNAKLEEIDMLQEVTKQIEGHTICALGDAAAWPVQGLIRHFRPELERRIRERADRELLEAAA

SEQ ID NO: 8481 - protein, 483 aa, Trigonella foenum-graecum
MRGILSLKRAALVRQHSEKLGLGVRLFSTQGASTASTPQPPPPPPPPEKTHFGGLKDEDRIFTNLYGLHDPFLKGAMKRGDWYRTKDLVIKGTDWIVNEMKKSGLRGRGGAGFPSGLKWSFMPKVSDGRPSYLVVNADESEPGTCKDREIMRHDPHKLLEGCLIAGVGMRATAAYIYIRGEYVNERLNLEKARKEAYAAGLLGKNACGSGYDFDVHIHYGAGAYICGEETALLESLEGKQGKPRLKPPFPANAGLYGCPTTVTNVETVAVSPTILRRGPEWFSSFGRKNNAGTKLYCVSGHVNKPCTVEEEMSMPLKELIERHCGGVRGGWDNLLAIIPGGSSVPLMPKHVCDDVLMDYDALKAVGSGLGTAAVIVMDKSTDVVDAIARLSYFYKHESCGQCTPCREGTGWLWSIMERMKVGNAKLEEIDMLQELTKQIEGHTICALGDAAAWPVQGLIRHFRPELERRIKENAQRELLQATG

SEQ ID NO: 8482 - protein, 487 aa, Triphysaria pusilla
MAPIKSILSLQRISFAQRVSENWAPARKLLSTQAATTSPTPQAPPPPPPPEKTHFGGLKDEDRIFTNLYGLHDPFLKGAMKRGDWHRTKDLVLKGTDWIINEMKKSGLRGRGGAGFPSGLKWSFMPKVSDGRPSYLVVNADESEPGTCKDREIMRHDPHKLLEGCLIAGVGMRASAAYIYIRGEYVNERLNLEKALKEAYAAGLLGKNACGTGYDFDVHIHFGAGAYICGEETALLESLEGKQGKPRLKPPFPANAGLYGCPTTVTNVETVAVSPTILRRGPEWFSSFGRKNNSGTKLFCISGHVNKPCTVEEEMSISLKELLERHCGGVRGGWDNLLAVIPGGSSVPLLPKNVCEDVLMDFDALKAVQSGLGTAAVIVMDKSTDVVDAISRLSYFYKHESCGQCTPCREGTGWLWTIMERMKVGNAKLEEIDMLQELTKQIEGHTICALGDAAAWPVQGLIRHFRPEMERRIKERAERELQQAAAA

SEQ ID NO: 8483 - protein, 458 aa, Aristolochia fimbriata
FSTQSATTAGTPQPAPPPPPEKTHFGGLKDEDRIFTNLYGLHDPFLKGAMKRGDWYRTKDLVLKGSDWIVNEMKKSGLRGRGGAGFPSGLKWSFMPKVSDGRPSYLVVNADESEPGTCKDREIMRHDPHKLLEGCLIAGVGMRATAAYIYIRGEYVNERRALEKARQEAYKAGLLGKNACGSGYDFDVHIHYGAGAYICGEETALLESLEGKQGKPRLKPPFPANAGLYGCPTTVTNVETVAVSPSILRRGPEWFASFGRKNNSGTKLFCVSGHVNKPCTVEEEMSISLKELIERHCGGVRGGWDNLLAVIPGGSSVPLLPKHICDDVLMDYDALKAVQSGLGTAAVIVMDKSTDVVDAIARLSYFYKHESCGQCTPCREGTGWLWMIMERLKVGNAKLEEIDMLQEVTKQIEGHTICALGDAAAWPVQGLIRHFRPELERRIRERAERELLEAAASA

SEQ ID NO: 8484 - protein, 204 aa, Elaeis guineensis
MKRGDWYGTKDLVLKGSDWIVNEMKKSGLRGRGGAGFPSGLKWSFMPKVSDGRPSYLVVNADESEPGTCKDREIMRHEPHKLLEGCLIAGVGMRATAAYIYIRGEYVNERLTLEKARKEAYQAGLLGKNACGSGYNFDVHIHYGAGAYICGEETALLESLEGKQGKPRLKPPFPANAGLYGCPTTVTNVETVAVSPTILRRGPE

SEQ ID NO: 8485 - protein, 487 aa, Amborella trichopoda
MRSLLSLPRSSLTHHCRKSCKPFYRYLNTQAPTTSSTPQLPPPPPPPEKTHFGGLKDEDRIFTNLYGMHDPFLKGAMKRGDWCRTKDLVLKGSDWIVNEMKKSGLRGRGGAGFPSGLKWSFMPKVSDGRPSYLVVNADESEPGTCKDREIMRHDPHKLLEGCLIAGVAMRASAAYIYIRGEYVNERLNLLKARKEAYEAGLLGKNACGSGYDFDVHIHFGAGAYICGEETALLESLEGKQGKPRLKPPFPANAGLYGCPTTVTNVETVAVSPTILRRGPEWFVSFGRKNNSGTKLFCISGHVNKPCTVEEEMSIPLKELIERHCGGVRGGWDNLLAIIPGGSSVPLLPKNICDDVLMDFDALKAVQSGLGTAAVIVMDKSTDVVDAIARLSYFYKHESCGQCTPCREGTGWLWMMMERLKVGNAKLEEIDMLQEITKQIEGHTICALGDAAAWPVQGLIRHFRPELERRIRSRAERELLESASAASA

SEQ ID NO: 8486 - protein, 486 aa, Cucumis sativus
MAPFRGMLYLQRRSLARCYIDQWGIGLRAFSSQGAAAPGSPQPPAPPPPPEKTHFGGLKDEDRIFTNLYGLHDPFLKGAMKRGDWHRTKDLVLKGADWIVNEVKKSGLRGRGGAGFPSGLKWSFMPKVSDGRPSYLVVNADESEPGTCKDREIMRHDPHKLLEGCLIAGVGMRATAAYIYIRGEYVNERKNLEKARKEAYEAGLLGKNACGSGYDFDVHIHYGAGAYICGEETALLESLEGKQGKPRLKPPFPANAGLYGCPTTVTNVETVAVSPTILRRGPEWFASFGRKNNSGTKLFCVSGHVNKPCTVEEEMSIPLKELIERHCGGVRGGWDNLLAVIPGGSSVPLLPKHICDDVLMDYDALKAVQSGLGTAAVIVMDKSTDIVDAIARLSYFYKHESCGQCTPCREGTGWLWMIMERMKVGNAKLEEIDMLQEVTKQIEGHTICALGDAAAWPVQGLIKNFRPELERRIRERAERELIQAAA

SEQ ID NO: 8487 - protein, 483 aa, Cicer arietinum
MRGILSLKRAVLVRQQSEKVGLGCRLFSTQGASTASTPQPPPPPPPPEKTHFGGLKDEDRIFTNLYGLHDPFLKGAMKRGDWHRTKDLVVKGTDWIVNEMKKSGLRGRGGAGFPSGLKWSFMPKVSDGRPSYLVVNADESEPGTCKDREIMRHDPHKLLEGCLIAGVGMRATAAYIYIRGEYVNERLNLEKARKEAYEAGFLGKNACGSGYDFDVHIHYGAGAYICGEETALLESLEGKQGKPRLKPPFPANAGLYGCPTTVTNVETVAVSPTILRRGPEWFASFGRKNNAGTKLFCVSGHVNKPCTVEEEMSIPLKELIERHCGGVRGGWDNLLAVIPGGSSVPLIPKNICDDVMMDYDALKAVNTGLGTAAVIVMDKSTDVVDAIARLSYFYKHESCGQCTPCREGTGWLWMIMERMKVGNAKLEEIDMLQELTKQIEGHTICALGDAAAWPVQGLIRHFRPELERRIRENAQRELLQASG

SEQ ID NO: 8488 - protein, 509 aa, Euphorbia peplus
MAPIRGIFSLQKAALLQRYSDKCYTGFRSLSTQAPGAGSSKPPPPPASAGSAQPPPPPASAGSAQPTPPPPPPEKTHFGGLKDEDRIFTNLYGLHDPFLKGAMKRGDWYRTKDLVLKGTDWIVNEVKKSGLRGRGGAGFPSGLKWSFMPKVSDGRPSYLVVNADESEPGTCKDREIMRHDPHKLLEGCLIAGVGMRASAAYIYIRGEYVNERLNLERARKEAYEAGLLGKNACGSGYDFDVHIHYGAGAYICGEETALLESLEGKQGKPRLKPPFPANAGLYGCPTTVTNVETVAVSPTILRRGPEWFASFGRKNNSGTKLFCVSGHVNKPCTVEEEMSIPLKELIERHCGGVRGGWDNLLAVIPGGSSVPLLPKHICDDVLMDYDALKAVTSGLGTAAVIVMDKSTDVVDAIARLSYFYKHESCGQCTPCREGTGWLWMIMERLKVGNAKLEEIDMLQEVTKQIEGHTICALGDAAAWPVQGLIRHFRPELERRINERAQMELLQASA

SEQ ID NO: 8489 - protein, 455 aa, Brassica juncea
TQAASTSATPQPPPPPPPPEKTHFGGLKDEDRIFTNLYGLHDPFLKGAMKRGDWYRTKDLVLKGTDWIVNEMKKSGLRGRGGAGFPSGLKWSFMPKVSDGRPSYLVVNADESEPGTCKDREIMRHDPHKLLEGCLIAGVGMRASAAYIYIRGEYVNERLNLEKARREAYAAGLLGKNACGSGYDFDVYIHFGAGAYICGEETALLESLEGKQGKPRLKPPFPANAGLYGCPTTVTNVETVAVSPTILRRGPEWFSSFGRKNNAGTKLFCVSGHVNKPCTVEEEMSIPLKELIERHCGGVRGGWDNLLAIIPGGSSVPLIPKNICEDVLMDFDALKAVQSGLGTAAVIVMDKSTDVVDAIARLSYFYKHESCGQCTPCREGTGWLWMIMERMKVGNAKLEEIDMLHEVTKQIEGHTICALGDAAAWPVQGLIRHFRPELERRIRERAERELLQAAA

SEQ ID NO: 8490 - protein, 483 aa, Pinus pinaster
MTNLVQPTRRILAYHYGRKWDSVLRSLSTQAASTSTTPQPPPPPPPPEKTHFGGLKDEDRIFTNLYGLHDPFLKGAMKRGDWYRTKDLVLKGSDWIVNEMKKSGLRGRGGAGFPSGLKWSFMPKVSDGRPSYLVVNADESEPGTCKDREIMRHDPHKLIEGCLIAGVGMRASAAYIYIRGEYVNERKALQNALNEAYAAGFLGKNACGSGYDFDVHIHFGAGAYICGEETALLESLEGKQGKPRLKPPFPANAGLYGCPTTVTNVETVAVSPTILRRGPEWFASFGRKNNSGTKLFCISGHVNKPCTVEEEMSISLKELIERHAGGVRGGWDNLLAVIPGGSSVPLLPKNICDDVLMDYDALKAVISGLGTAAVIVMDKSTDVVDAIARLSYFYKHESCGQCTPCREGTGWLWMIMERLKVGNAKLEEIDMLQELTKQIEGHTICALGDAAAWPVQGLIRHFRPELEKRIRERARMEVMEAVG

SEQ ID NO: 8491 - protein, 523 aa, Elaeis guineensis
MSAAKKAAEVATKATARSMMARLLVADEGIGAKLGRGAVKNFFCPPRAQLCHHFNGGRFNSVYRSFSTQAATTASTPQPPSPPPPPEKTHFGGLKDEDRIFTNLYGLHDPFLKGAMKRGDWYRTKDLVLKGSDWIVNEMKKSGLRGRGGAGFPSGLKWSFMPKVSDGRPSYLVVNADESEPGTCKDREIMRHDPHKLLEGCLIAGVGMRATAAYIYIRGEYVNERLTLEKARKEAYQAGLLGKNACGSGYNFDVHIHYGAGAYICGEETALLESLEGKQGKPRLKPPFPANAGLYGCPTTVTNVETVAVSPTILRRGPEWFASFGRKNNSGTKLFCISGHVNKPCTVEEEMSIPLKELIERHCGGVRGGWNNLLAVIPGGSSVPLLPKHICDDVLMDYDALKAVQSGLGTAAVIVMDKSTDVVDAIARLSYFYKHESCGQCTPCREGTGWLWMIMERLKVGNAKLEEIDMLQEVTKQIEGHTICALGDAAAWPVQGLIRHFRPELERRIRERADKELLEAAAA

SEQ ID NO: 8492 - protein, 483 aa, Pinus taeda
MRNLVQPTRRILEYHHGGKWDSVLRSLSTQAASTSTTPQPPPPPPPPEKTHFGGLKDEDRIFTNLYGLHDPFLKGAMKRGDWYRTKDLVLKGSDWIVNEMKKSGLRGRGGAGFPSGLKWSFMPKVSDGRPSYLVVNADESEPGTCKDREIMRHDPHKLIEGCLIAGVGMRASAAYIYIRGEYVNERKALQNALNEAYAAGFLGKNACGSGYDFDVHIHYGAGAYICGEETALLESLEGKQGKPRLKPPFPANAGLYGCPTTVTNVETVAVSPTILRRGPEWFASFGRKNNSGTKLFCISGHVNKPCTVEEEMSISLKELIERHAGGVRGGWDNLLAVIPGGSSVPLLPKNICDDVLMDYDALKAVISGLGTAAVIVMDKSTDVVDAISRLSYFYKHESCGQCTPCREGTGWLWMIMERLKVGNAKLEEIDMLQELTKQIEGHTICALGDAAAWPVQGLIRHFRPELEKRIRERARREVMEAVG

SEQ ID NO: 8493 - protein, 482 aa, Glycine max
MRGILSVRTALVQHHSEKLGLGFRVFSTQGASTASTPQPPPPPPPPEKTHFGGLKDEDRIFTNLYGLHDPFLKGAMKRGDWHRTKDLVVKGTDWIVNEMKKSGLRGRGGAGFPSGLKWSFMPKVSDGRPSYLVVNADESEPGTCKDREIMRHDPHKLLEGCLIAGVGMRASAAYIYIRGEYVNERKNLEKAREEAYAAGLLGKNACGSGYDFDVHIHYGAGAYICGEETALLESLEGKQGKPRLKPPFPANAGLYGCPTTVTNVETVAVSPTILRRGPEWFASFGRKNNAGTKLFCVSGHVNKPCTVEEEMSIPLKELIERHCGGIRGGWDNLLAVIPGGSSVPLIPKHVCDDILMDYDALKAVGTGLGTAAVIVMDKSTDVVDAIARLSYFYKHESCGQCTPCREGTGWLWTIMERMKVGNAKLEEIDMLQELTKQIEGHTICALGDAAAWPVQGLIKHFRPELERRIREHAERELLQATG

SEQ ID NO: 8494 - protein, 492 aa, Zostera marina
MRNLLFRPRKILAYRRYIEFFDKSGRSFSTQVATPTGAKSQVEPPPPPPPPPEKTHFGNLKDEDRIFTNLYGVHTPFLKGAMQRGDWYRTKDLVLKGSDWIVNEMKKSGLRGRGGAGFPSGLKWSFMPKVSDGRPSYLVVNADESEPGTCKDREIMRHDPHKLLEGCLIAGVGMRASAAYIYIRGEYVNERKNLEKARKEAYKAGLLGKNACGSGYDFDVYIHYGAGAYICGEETALLESLEGKQGKPRLKPPFPANAGLYGCPTTVTNVETVAVSPTILRRGPEWFASFGRKNNSGTKLFCISGHVNKPCTVEEEMSIPLKELLERHCGGVRGGWDNLLAVIPGGSSVPLLPKHICDDVMMDYDALKAVQSGLGTAAVIVLDKSCDVVDAIARLSYFYKHESCGQCTPCREGTGWLWMIMERLKVGNAKLEEIDMLQEVTKQIEGHTICALGDAAAWPVQGLIRHFRPELERRIRERAEKELAEVASAASA

SEQ ID NO: 8495 - protein, 495 aa, Beta vulgaris
MAPLRGILKLQRIGQLQRHYETWGAGYSRLFSTQAASTSNTPQPPPPPPPPEKTHFGGLKDEDRIFTNLYGIHDPFLKGAMKRGDWHRTKDLVLKGTDWIVNEMKKSGLRGRGGAGFPSGLKWSFMPKVSDGRPSYLVVNADESEPGTCKDREIMRHDPHKLLEGCLIAGVGMRASAAYIYIRGEYVNERLNLEKARKEAYAAGLLGKNACGSGYDFDVHIHYGAGAYICGEETALLESLEGKQGKPRLKPPFPANAGLYGCPTTVTNVETVAVSPTILRRGPEWFSSFGRKNNSGTKLFCISGHVNKPCTVEEEMSISLKELIERHCGGVRGGWDNLLAVIPGGSSVPLLPKHLCDDVLMDFDALKAVQSGLGTAAVIVMDKSTDVVDAIARLSYFYKHESCGQCTPCREGTGWLWMIMERMKVGNAKLEEIDMLQELTKQIEGHTICALGDAAAWPVQGLIRHFRPELERRIKDHAAKELLEAEKRGLLEAAA

SEQ ID NO: 8496 - protein, 479 aa, Vinca minor
MAPIKGILSLQRSAFARRQEACRLGNRLFSTQATSTASTPQAQQPPPPPPPPEKTHFGGLKDEDRIFTNVYGLHDPFLKGAMKRGDWYRTKDLVLKGTDWIVNEMKKSGLRGRGGAGFPSGLKWSFMPKQSDGRPSYLVVNADESEPGTCKDREIMRHDPHKLLEGCLIAGVGMRASAAYIYIRGEYVNERKNLERARKEAYEAGLLGKNACGSGYEFDVHIHFGAGAYICGEETALLESLEGKQGKPRLKPPFPANAGLYGCPTTVTNVETVAVSPTILRRGPEWFASFGRKNNSGTKLFCISGHVNKPCTVEEEMSIPLKELIERHCGGVRGGWDNLLAVIPGGSSVPLIPKNMCEDVLMDFDALKAVQSGLGTAAVIVMDKSTDVVDAIARLSYFYKHESCGQCTPCREGTGWLWMIMERMKVGNAKLEEIDMLQEVTKQIEGHTICALGDAAAWPVQGLIRHFRPELERRIRERA

SEQ ID NO: 8497 - protein, 483 aa, Abies balsamea
MRNLVLPTRRVLAHHYGRKWDSIHRVLSTQAASTSTTPQPPPPPPPPEKTHFGGLKDEDRIFTNLYGMHDPFLKGAMKRGDWYRTKDLVLKGADWIVNEMKKSGLRGRGGAGFPSGLKWSFMPKVSDGRPSYLVVNADESEPGTCKDREIMRHDPHKLLEGCLIAGVGMRASAAYIYIRGEYVNERIALQNALNEAYKAGFLGKNACGSGYDFDVHIHFGAGAYICGEETALLESLEGKQGKPRLKPPFPANAGLYGCPTTVTNVETVAVSPTILRRGPEWFASFGRKNNSGTKLFCISGHVNKPCTVEEEMSISLKELIERHAGGVRGGWDNLLAVIPGGSSVPLLPKNICDDVLMDYDALKAVISGLGTAAVIVMDKSTDVVDAIARLSYFYKHESCGQCTPCREGTGWLWMVMERLKVGNAKLEEIDMLQELTKQIEGHTICALGDAAAWPVQGLIRHFRPELERRIRERARMEVMEAVA

SEQ ID NO: 8498 - protein, 483 aa, Eucalyptus grandis
MAPMRGLLSLRKTILLRGQGIGVRSFSTEGAKTASAPPSPPPPPPPPEKTHFGGLKDEDRIFTNLYGMRDPFLKGAMKRGDWYRTKDLVLKGTDWIVSEVKKSGLRGRGGAGFSAGLKWSFMPKVSDGRPSYLVVNADESEPGTCKDREIMRHDPHKLLEGCLIAGVGMRASAAYIYIRGEYVNERINLERARKEAYEAGLLGKNACGSGYDFDVHIHYGAGAYICGEETALLESLEGKQGKPRLKPPFPANAGLYGCPTTVTNVETVAVSPTILRRGPDWFASFGRKNNAGTKLFCVSGHVNKPCTVEEEMSIPLKELIERHCGGVRGGWDNLLAVIPGGSSVPLLPKNICDDVLMDYDALKAVQSGLGTAAVIVMDKSTDVVDAIARLSYFYKHESCGQCTPCREGTGWLWMIMERLKVGNAKLEEIDMLQEVTKQIEGHTICALGDAAAWPVQGLIRHFRPELERRIRERAERELLEAAA

SEQ ID NO: 8499 - protein, 480 aa, Eucalyptus grandis
MRGLLSLRKTILLRGQGIGVRSFSTEGAKTASAPPSPPPPPPPPEKTHFGGLKDEDRIFTNLYGMRDPFLKGAMKRGDWYRTKDLVLKGTDWIVSEVKKSGLRGRGGAGFSAGLKWSFMPKVSDGRPSYLVVNADESEPGTCKDREIMRHDPHKLLEGCLIAGVGMRASAAYIYIRGEYVNERINLERARKEAYEAGLLGKNACGSGYDFDVHIHYGAGAYICGEETALLESLEGKQGKPRLKPPFPANAGLYGCPTTVTNVETVAVSPTILRRGPDWFASFGRKNNAGTKLFCVSGHVNKPCTVEEEMSIPLKELIERHCGGVRGGWDNLLAVIPGGSSVPLLPKNICDDVLMDYDALKAVQSGLGTAAVIVMDKSTDVVDAIARLSYFYKHESCGQCTPCREGTGWLWMIMERLKVGNAKLEEIDMLQEVTKQIEGHTICALGDAAAWPVQGLIRHFRPELERRIRERAERELLEAAA

SEQ ID NO: 8500 - protein, 482 aa, Glycine max
MRGILSVRTALVQHRSEKLGLGFRLFSTQGASTASTPQPPPPPPPPEKTHFGGLKDEDRIFTNLYGLHDPFLKGAMKRGDWHRTKDLVLKGTDWIVSEMKKSGLRGRGGAGFPSGLKWSFMPKVSDGRPSYLVVNADESEPGTCKDREIMRHDPHKLLEGCLIAGVGMRASAAYIYIRGEYVNERKNLEKARQEAYAAGLLGKNACGSGYDFDVHIHYGAGAYICGEETALLESLEGKQGKPRLKPPFPANAGLYGCPTTVTNVETVAVSPTILRRGPEWFASFGRKNNAGTKLFCVSGHVNKPCTVEEEMSIPLKELIERHCGGIRGGWDNLLAVIPGGSSVPLIPKHVCDDIFMDYDALKAVGTGLGTAAVIVMDKSTDVVDAIARLSYFYKHESCGQCTPCREGTGWLWTIMERMKVGNAKLEEIDMLQELTKQIEGHTICALGDAAAWPVQGLIKHFRPELERRIREHAERELLQATG

SEQ ID NO: 8501 - protein, 489 aa, Valeriana officinalis
MAPMKGIFSLRRISLTRRQNETLSLGSRLFSSQAPPAASGTTPQAPPPPPPAEKTHFGGLKDEDRIFTNLYGIHDPFLKGAMKRGDWYRTKDLVIKGTDWIVNEMKKSGLRGRGGAGFPSGLKWSFMPKVSDGRPSYLVVNADESEPGTCKDREIMRHDPHKLLEGCLIAGVGMRASAAYIYIRGEYVNERLNLEIARKEAYAAGFLGKNACGSGYDFDVHIHYGAGAYICGEETALLESLEGKQGKPRLKPPFPANAGLYGCPTTVTNVETVAVSPTILRRGPEWFSSFGRKNNSGTKLFCVSGHVNKPCTVEEEMSIPLKELIERHCGGVRGGWDNLLAVIPGGSSVPMIPKPMCEDVLMDFDALKAVQSGLGTAAVIVMDKSTDVVDAIARLSYFYKHESCGQCTPCREGTGWLWMIMERMKVGNAKLEEIDMLHEVTKQIEGHTICALGDAAAWPVQGLIRHFRPEMERRIRERADRELQQAASA

SEQ ID NO: 8502 - protein, 483 aa, Picea glauca
MRNLVQPTRRVLAHHYGRKWDSMHRSLSTQAASTSTTPQPPPPPPPPEKTHFGGLKDEDRIFTNLYGLHDPFLKGAMKRGDWYRTKDLVLKGSDWIVNEMKKSGLRGRGGAGFPSGLKWSFMPKVSDGRPSYLVVNADESEPGTCKDREIMRHDPHKLLEGCLIAGVGMRACAAYIYIRGEYVNERKALQNALNEAYAAGFLGKNACGSGYDFDVHIHFGAGAYICGEETALLESLEGKQGKPRLKPPFPANSGLYGCPTTVTNVETVAVSPTILRRGPEWFASFGRKNNSGTKLFCISGHVNKPCTVEEEMSISLKELIERHAGGVRGGWDNLLAVIPGGSSVPLLPKNICDDVLMDYDALKAVISGLGTAAVIVMDKSTDVVDAISRLSYFYKHESCGQCTPCREGTGWLWMIMERLKVGNAKLEEIDMLQELTKQIEGHTICALGDAAAWPVQGLIRHFRPELERRIRERARTEVIEAVG

SEQ ID NO: 8503 - protein, 468 aa, Citrus clementina
MLQGEWDQFTAQIEPIASTASTPQPPPPPPPPEKTHFGGLKDEDRIFTNLYGMHDPFLKGAMKRGDWHRTKDLVLKGADWIVNEVKKSGLRGRGGAGFPSGLKWSFMPKVSDGRPSYLVVNADESEPGTCKDREIMRHDPHKLLEGCLIAGVGMRASAAYIYIRGEYVNERKNLERARQEAYAAGLLGKNACGSGYDFDVHIHYGAGAYICGEETALLESLEGKQGKPRLKPPFPANAGLYGCPTTVTNVETVAVSPIILRRGPDWFAGFGRKNNSGTKLFCVSGHVNKPCTVEEEMSIPLKELIDRHCGGVRGGWDNLLAVIPGGSSVPLLPKHICDDVLMDYDALKAVQSGLGTAAVIVMDKSTDVVDAIARLSYFYKHESCGQCTPCREGTGWLWMIMERLKVGNAKLEEIDMLQEVTKQIEGHTICALGDAAAWPVQGLIRHFRPELERRIKEHAERELLEATA

SEQ ID NO: 8504 - protein, 487 aa, Nicotiana tabacum
  misc_feature (483)..(483): Xaa can be any naturally occurring amino acid
MAPIKGLLSLQRTALVQRSSERWGLYGRLFSTQAASTASTPQPTPPPPPPEKTHFGGLKDEDRIFTNLYGLHDPYLKGAMKRGDWYRTKDLVLKGSDWIVNEMKKSGLRGRGGAGFPSGLKWSFMPKTTDGRPSYLVVNADESEPGTCKDREIMRHDPHKLLEGCLIAGVGMRARAAYIYIRGEYVNERKSLEKARKEAYEAGLLGKNACGTGYDFDVYIHFGAGAYICGEETALLESLEGKQGKPRLKPPFPANAGLYGCPTTVTNVETVAVSPTILRRGPEWFASFGRKNNAGTKLFCISGHVNKPCTVEEEMSIPLKELIEKHCGGVRGGWDNLLAVIPGGSSVPLIPKNVCEDVLMDFDALKAVQSGLGTAAVIVMDKSTDIVDATARLSYFYKHESCGQCTPCREGTGWLWMIMERMKVGNAKLEEIDMLQEVTKQIEGHTICALGDAAAWPVQGLIRHFRPELERRIREHADRELQXAAAA

SEQ ID NO: 8505 - protein, 449 aa, Brassica napus
STTPQPPPPPPPPEKTHFGGLKDEDRIFTNLYGLHDPFLKGAMKRGDWHRTKDLVLKGTDWIVNEMKKSGLRGRGGAGFPSGLKWSFMPKVSDGRPSYLVVNADESEPGTCKDREIMRHDPHKLLEGCLIAGVGMRASAAYIYIRGEYVNERLNLEKARREAYAAGLLGKNACGSGYDFDVYIHFGAGAYICGEETALLESLEGKQGKPRLKPPFPANAGLYGCPTTVTNVETVAVSPTILRRGPEWFSSFGRKNNSGTKLFCISGHVNKPCTVEEEMSIPLKELIERHCGGVRGGWDNLLAIIPGGSSVPLIPKNICEDVLMDFDALKAVQSGLGTAAVIVMDKSTDVVDAIARLSYFYKHESCGQCTPCREGTGWLWMIMERMKVGNAKLEEIDMLHEVTKQIEGHTICALGDAAAWPVQGLIRHFRPELERRIRERAERELLQAAA

SEQ ID NO: 8506 - protein, 483 aa, Gnetum gnemon
MAMRNLIQSSKSIFANNKKWDLLHRGLSTQAASTSTTPQPPPPPPPPEKTHFGGLKDEDRIFTNLYGLHDPFLKGAMKRGDWYRTKDLVLKGSDWIVNEMKKSGLRGRGGAGFPSGLKWSFMPKVSDGRPSYLVVNADESEPGTCKDREIMRHDPHKLLEGCLIAGVGMRARAAYIYIRGEYVNERKVLQNALKEAYAAGFLGNNACGSGYDFDVHIHFGAGAYICGEETALLESLEGKQGKPRLKPPFPANAGLYGCPTTVTNVETVAVSPTILRRGPEWFASFGRKNNAGTKLFCISGHVNKPCTVEEEMSITLKELIERHAGGVRGGWDNLLAVIPGGSSVPLLPKHICDDVMMDFDALKAVQSGLGTAAVIVMDKSTDVVDAIARLSYFYKHESCGQCTPCREGTGWLWMIMERMKVGNAKLEEIDMLYELTKQIEGHTICALGDAAAWPVQGLIRHFRPELERRIRERAKMEVVEAAA

SEQ ID NO: 8507 - protein, 407 aa, Cephalotaxus harringtonia
MKRGDWYRTKDIVQKGSDWIVNDMKKSGLRGRGGAGFPSGLKWSFMPKVSDGRPSYLVVNADESEPGTCKDREIMRHDPHKLLEGCLIAGVGMRARAAYIYIRGEYVNERIVLQNALKEAYAAGFLGKNACGSGYDFDVHIHFGAGAYICGEETALLESLEGKQGKPRLKPPFPANAGLYGCPTTVTNVETVAVSPTILRRGPEWFASFGRKNNAGTKLFCISGHVNKPCTVEEEMSISLKELIERHAGGVRGGWDNLLAIIPGGSSVPLLPKNICDDVLMDFDALKAVQSGLGTAAVIVMDKSTDVVDAIARLSYFYKHESCGQCTPCREGTGWLWMIMERMKVGNAKLEEIDMLQEVTKQIEGHTICALGDAAAWPVQGLIRHFRPELERRIHERARQELMEAVA

SEQ ID NO: 8508 - protein, 416 aa, Sequoia sempervirens
MHDPLLKGAMKRGDWYRTKDLVQKGSDWIVNEMKKSGLRGRGGAGFPSGLKWSFMPKVSDGRPSYLVVNADESEPGTCKDREIMRHDPHKLLEGCLIAGVGMRASAAYIYIRGEYVNERKVLESALKEAYAAGYLGKNACDSGYDFDVHIHFGAGAYICGEETALLESLEGKQGKPRLKPPFPANSGLYGCPTTVTNVETVAVSPTILRRGPEWFASFGRKNNAGTKLFCISGHVNKPCTVEEEMSISLKELIERHAGGVRGGWDNLLAIIPGGSSVPLLPKNICDDVLMDFDALKAVQSGLGTAAVIVMDKSTDVVNAIARLSYFYKHESCGQCTPCREGTPWLWMMMERMKVGNAKLEEIDMLQEVTKQIEGHTICALGDAAAWPVQGLIRHFRPELERRIHERARQELMEAVA

SEQ ID NO: 8509 - protein, 483 aa, Sciadopitys verticillata
MRNLVQSSRRVLVQHYVRKWGSLNRSLSTQSASTSTTPQPPPPPPPLERTHFGGLKDEDRIFTNLYGLHDPFLKGAMKRGDWYRTKDLVLKGSDWIVNEMKKSGLRGRGGAGFPSGLKWSFMPKVSDGRPSYLVVNADESEPGTCKDREIMRHDPHKLLEGCLIAGVGMRARAAYIYIRGEYVNERKALQNALNEAYAAKFLGKNACGSGYDFDVHIHYGAGAYICGEETALLESLEGKQGKPRLKPPFPANSGLYGCPTTVTNVETVAVSPTILRRGPEWFASFGRKNNSGTKLFCISGHVNKPCTVEEEMSISLKELIERHAGGVRGGWDNLLAIIPGGSSVPLLTKDICDDVLMDFDALKAVQSGLGTAAVIVMDKSTDIVNAISRLSYFYKHESCGQCTPCREGTGWLWMIMERMKVGNAKLEEIDMLQEVTKQIEGHTICALGDAAAWPVQGLIRHFRPELERRIRERARQELMEAVA

SEQ ID NO: 8510 - protein, 494 aa, Silene vulgaris
MAPVRGILNLQKAALLQRHCDKWGAGYSRLFNTQAASTSSTPQPPPPPPPEKTHFGGLKDEDRIFTNLYGIHDPFLKGAMKRGDWYRTKDLVLKGTDWIVGEMKKSGLRGRGGAGFPSGLKWSFMPKVSDGRPSYLVVNADESEPGTCKDREIMRHDPHKLLEGCLIAGVGMRASAAYIYIRGEYVNERLNLLKARQEAYEAGYLGKNACGSGYDFDVHIHYGAGAYICGEETALLESLEGKQGKPRLKPPFPANAGLYGCPTTVTNVETVAVSPTILRRGPEWFSSFGRKNNSGTKLFCISGHVNKPCTVEEEMSIPLKELIERHCGGVRGGWDNLLAIIPGGSSVPLLPKHLCDDVLMDFDALKAVQSGLGTAAVIVMDKSTDVVDAIARLSYFYKHESCGQCTPCREGTGWLWMIMERMKVGNAKLEEIDMLQEITKQIEGHTICALGDAAAWPVQGLIRHFRPELERRIKEHAAKELIEAEKRGLLEAAA

SEQ ID NO: 8511 - protein, 495 aa, Silene vulgaris
MAPLRGILNFQRAALLQRHSDKWGAGYSRLFNTQAASTSNSPQPTPPPPPPEKTHFGGLKDEDRIFTNLYGIHDPFLKGAMKRGDWYRTKDLVLKGTDWIVGEMKKSGLRGRGGAGFPSGLKWSFMPKVSDGRPSYLVVNADESEPGTCKDREIMRHDPHKLLEGCLIAGVGMRASAAYIYIRGEYVNERLNLLKARQEAYDAGYLGKNACGSGYDFDVHIHYGAGAYICGEETALLESLEGKQGKPRLKPPFPANAGLYGCPTTVTNVETVAVSPTILRRGPEWFASFGRKNNAGTKLFCISGHVNKPCTVEEEMSIPLKELIERHCGGVRGGWDNLLAIIPGGSSVPLLPKHLCDDVLMDFDALKAVQSGLGTAAVIVMDKSTDVVDAIARLSYFYKHESCGQCTPCREGTGWLWMIMERMKVGNAKLEEIDMLQEITKQIEGHTICALGDAAAWPVQGLIRHFRPELERRIKEHAAKELIEAEKRGLLEATA

SEQ ID NO: 8512 - protein, 127 aa, Gossypium raimondii
MDYDALKAVQSGLGTAAVIVMDKSTDVVDAIARLSYFYKHESCGQCTPCREGTGWLWMIMERLKVGNAKLEEIDMLQEVTKQIEGHTICALGDAAAWPVQGLIRHFRPELERRIRERAERELLEASA

SEQ ID NO: 8513 - protein, 460 aa, Brassica juncea
MAPVRGILGLQRAVSVWKESNRLAPALRSFSTQAASTSTTPQPPPPPPPPEKTHFGGLKDEDRIFTNLYGLHDPFLKGAMKRGDWHRTKDLVLKGTDWIVNEMKKSGLRGRGGAGFPSGLKWSFMPKVSDGRPSYLVVNADESEPGTCKDREIMRHDPHKLLEGCLIAGVGMRASAAYIYIRGEYVNERLNLEKARREAYAAGLLGKNACGSGYDFDVYIHFGAGAYICGEETALLESLEGKQGKPRLKPPFPANAGLYGCPTTVTNVETVAVSPTILRRGPEWFSSFGRKNNSGTKLFCISGHVNKPCTVEEEMSIPLKELIERHCGGVRGGWDNLLAIIPGGSSVPLIPKNICEDVLMDFDALKAVQSGLGTAAVIVMDKSTDVVDAIARLSYFYKHESCGQCTPCREGTGWLWMIMERMKVGNAKLEEIDMLHEVTKQIEGHTICALGDAAAWPVQG

SEQ ID NO: 8514 - protein, 486 aa, Centaurea maculosa
  misc_feature (4)..(5): Xaa can be any naturally occurring amino acid
  misc_feature (13)..(13): Xaa can be any naturally occurring amino acid
  misc_feature (18)..(18): Xaa can be any naturally occurring amino acid
  misc_feature (24)..(24): Xaa can be any naturally occurring amino acid
  misc_feature (26)..(26): Xaa can be any naturally occurring amino acid
  misc_feature (28)..(28): Xaa can be any naturally occurring amino acid
  misc_feature (40)..(40): Xaa can be any naturally occurring amino acid
  misc_feature (46)..(47): Xaa can be any naturally occurring amino acid
  misc_feature (50)..(50): Xaa can be any naturally occurring amino acid
  misc_feature (52)..(52): Xaa can be any naturally occurring amino acid
  misc_feature (56)..(56): Xaa can be any naturally occurring amino acid
  misc_feature (69)..(69): Xaa can be any naturally occurring amino acid
  misc_feature (72)..(72): Xaa can be any naturally occurring amino acid
  misc_feature (81)..(81): Xaa can be any naturally occurring amino acid
  misc_feature (93)..(93): Xaa can be any naturally occurring amino acid
  misc_feature (98)..(98): Xaa can be any naturally occurring amino acid
  misc_feature (101)..(101): Xaa can be any naturally occurring amino acid
  misc_feature (110)..(110): Xaa can be any naturally occurring amino acid
  misc_feature (113)..(113): Xaa can be any naturally occurring amino acid
  misc_feature (115)..(115): Xaa can be any naturally occurring amino acid
  misc_feature (118)..(118): Xaa can be any naturally occurring amino acid
  misc_feature (131)..(131): Xaa can be any naturally occurring amino acid
MAPXXGILSLQRXALLRXQNGNWXLXAXLLSTQSATTGTXAQPPPXXPPXEXTHFXGLKDEDRIFTNLXGLXDPFLKGAMXRGDWHRTKDIVXKGADXIVXEMKKSGLRXRGXAXFPXGLKWSFMPKVSDXRPSYLVVNADESEPGTCKDREIMRNDPHKLLEGCLIAGVGMRATAAYIYIRGEYVNERLNLEKARKEAYAAGLLGKNACGSGYDFDVHIHYGAGAYICGEETALLESLEGKQGKPRLKPPFPANAGLYGCPTTVTNVETIAVSPTILRRGPEWFSSFGRKNNSGTKLFCISGHVNKPCTVEEEMSISLKELLERHCGGVRGGWDNLLAVIPGGSSVPLLPKDVCEDVLMDFDALKAVQSGLGTAAVIVMDKSTDVVDAIARLSYFYKHESCGQCTPCREGTGWLWMIMERMKVGNAKLEEIDMLQEVTKQIEGHTICALGDAAAWPVQGLIRHFRPEMERRIRERADRELLQAAA

SEQ ID NO: 8515 - protein, 445 aa, Scabiosa columbaria
APPPPPPPEKTHFGGLKDEDRIFTNVYGIHDPFLKGAMKRGDWYRTKDLVIKGTDWIVNEMKKSGLRGRGGAGFPSGLKWSFMPKVSDGRPSYLVVNADESEPGTCKDREIMRHDPHKLLEGCLIAGVGMRASAAYIYIRGEYVNERLNLEKARKEAYAAGFLGKNACGSGYDFDVHIHFGAGAYICGEETALLESLEGKQGKPRLKPPFPANAGLYGCPTTVTNVETVAVSPTILRRGPEWFSSFGRKNNSGTKLFCVSGHVNKPCTVEEEMSIPLKELIERHCGGVRGGWDNLLAVIPGGSSVPLIPKPLCEDVLMDFDALKAVQSGLGTAAVIVMDKSTDVVDAIARLSYFYKHESCGQCTPCREGTGWLWMIMERMKVGNAKLEEIDMLQEVTKQIEGHTICALGDAAAWPVQGLIRHFRPELERRIREHADRELQQAAAA

SEQ ID NO: 8516 - protein, 417 aa, Flaveria ramosissima
MVYMTVLKGAMKRGDWYRTKDLVIKGSDWIVNEMKKSGLRGRGGAGFPSGLKWSFMPKVSDGRPSYLVVNADESEPGTCKDREIMRNDPHKLLEGCLIAGVGMRATAAYIYIRGEYVNERLNLEKARKEAYAAGLLGKNACGSGYDFDVHIHFGAGAYICGEETALLESLEGKQGKPRLKPPFPANAGLYGCPTTVTNVETVAVSPTILRRGPEWFSSFGRKNNSGTKLFCISGHVNKPCTVEEEMSIPLKELLERHCGGVRGGWDNLLAVIPGGSSVPLLPKHICEDVLMDFDALKAVQSGLGTAAVIVMDKSTDVVDAIARLSYFYKHESCGQCTPCREGTGWLWMIMERMKVGNAKLEEIDMLQEVTKQIEGHTICALGDAAAWPVQGLIRHFRPELERRIRERADRELLQAAA

SEQ ID NO: 8517 - protein, 260 aa, Flaveria ramosissima
MKRGDWYRTKDLVIKGSDWIVNEMKKSGLRGRGGAGFPSGLKWSFMPKVSDGRPSYLVVNADESEPGTCKDREIMRNDPHKLLEGCLIAGVGMRATAAYIYIRGEYVNERLNLEKARKEAYAAGLLGKNACGSGYDFDVHIHFGAGAYICGEETALLESLEGKQGKPRLKPPFPANAGLYGCPTTVTNVETIAVSPTILRRGPEWFSSFGRKNNSGTKLFCISGHVNKPCTVEEEMSIPLKELLERHCGGVRGGWDIYWQ

SEQ ID NO: 8518 - protein, 365 aa, Ceratodon purpureus
MPKVSDGRPSYLVVNADESEPGTCKDREIMRHDPHKLLEGCLIAGVGMRARAAYIYIRGEYVNERLNLERALKECYKEGLLGKNACGSGYDFDVYIHYGAGAYICGEETALLESLEGKQGKPRLKPPFPANAGLYGCPTTVTNVETVAVSPTILRRGPEWFASFGRKNNSGTKLFCVSGHVNKPCTVEEEMSIPLKELIERHCGGVRGGWDNLLAIIPGGSSVPLLPKNVCDDVLMDFDALKAVQSGLGTAAVIVMDKSTDVVDAIARLSYFYKHESCGQCTPCREGSPWLWTMMERLKVGNAKLEEIDMLQEITKQIEGHTICALGDAAAWPVQGLIRHFRPELERRIMERAAKENEGLRVANY

SEQ ID NO: 8519 - protein, 490 aa, Physcomitrella patens
MAATRGLSRKTLAGLQRWNNATPVWSRTMSAQATSGPQATAPPPPPPPPPAEKTQFGGLKDEDRIFTNLYGIHDPFLAGAKKRGDWHRTKDLVLKGTDWIVNEMKKSGLRGRGGAGFPSGLKWSFMPKVSDGRPSYLVVNADESEPGTCKDREIMRHDPHKLLEGCLIAGVGMRARAAYIYIRGEYVNERLNLQKALHECYKEGLLGKNACGSGYDFDVYIHYGAGAYICGEETALLESLEGKQGKPRLKPPFPANAGLYGCPTTVTNVETVAVSPTILRRGPEWFSSFGRKNNSGTKLFCVSGHVNKPCTVEEEMSIPLKELIERHCGGVRGGWDNLLAIIPGGSSVPLLPKNICDDVLMDFDALKAVQSGLGTAAVIVMDKSTDVVDAIARLSYFYKHESCGQCTPCREGSPWLWTMMERLKVGNAKLEEIDMLQEVTKQIEGHTICALGDAAAWPVQGLIRHFRPELERRILERAAKENDELRVANC

SEQ ID NO: 8520 - protein, 462 aa, Physcomitrella patens
MSEKATSGSQATAPPPPPPPPPAEKTHFGGLKDEDRIFTNLYGLHDPFLAGAKKRGDWYRTKDLVHKGTDWIVNEVKKSGLRGRGGAGFPSGLKWSFMPKVSDGRPSYLVVNADESEPGTCKDREIMRHDPHKLLEGCLIAGVGMRARAAYIYIRGEYVNERLNLQKALHECYKEGLLGKNACSTGYDFDVYIHYGAGAYICGEETALLESLEGKQGKPRLKPPFPANAGLYGCPTTVTNVETVAVSPTILRRGPEWFSSFGRKNNSGTKLFCVSGHVNKPCTVEEEMSIPLKELIERHCGGVRGGWDNLLAIIPGGSSVPLLPKHICDDVLMDFDALKAVTSGLGTAAVIVMDKSTDVVDAIARLSYFYKHESCGQCTPCREGSPWLWTMMERLKVGNAKLEEIDMLQEVTKQIEGHTICALGDAAAWPVQGLIRHFRPELERRILERAARENDELRAANC

SEQ ID NO: 8521 - protein, 415 aa, Cenchrus ciliaris
HDPFLKGAMKRGDWHRTKDLVLKGADWIVNEMKKSGLRGRGGAGFPSGLKWSFMPKVSDGRPSYLVVNADESEPGTCKDREIMRHDPHKLLEGCLIAGVGMRASAAYIYIRGEYVNERLNLEKARQEAYAAGLLGKNACGSGYDFDVHIHFGAGAYICGEETALLESLEGKQGKPRLKPPFPANAGLYGCPTTVTNVETVAVSPTILRRGPEWFASFGRKNNSGTKLFCISGHVNKPCTVEEEMSIPLKELLERHCGGVRGGWDNLLAVIPGGSSVPLLPKHICDDVMMDYDALKAVQSGLGTAAVIVMDKSTDVVDAIARLSYFYKHESCGQCTPCREGTPWLWMIMERLKVGNAKLEEIDMLQEVTKQIEGHTICALGDAAAWPVQGLIRHFRPELERRIRERAERELLAASA

SEQ ID NO: 8522 - protein, 447 aa, Distylium racemosum
YPTITSPSPPPEKTHFGGLKDEDRIFTNLYGLYDPLLKGAMKRGDWYRTKDLVVKGSDWIVNEMKKSGLRGRGGAGFPSGLKWSFMPKVSDGRPSYLVVNADESEPGTCKDREIMRHDPHKLLEGCLIAGVGMRARAAYIYIRGEYVNERKVLQNALKEAYAAGFLGKNACGSGYNFDVHIHYGAGAYICGEETALLESLEGKQGKPRLKPPFPANAGLYGCPTTVTNVETVAVSPTILRRGPEWFASFGRKNNVGTKLFCISGHVNKPCTVEEEMSIPLKELIERHAGGVRGGWDNLLAIIPGGSSVPLLPRHICDDVLMDFDALKAVQSGLGTAAVTVMDKSTDIVNAIARLSYFYKHESCGQCTPCREGTPWLWMIMERMKVGNAKLEEIDMLQEVTKQIEGHTICALGDAAAWPVQGLIRHFRPELERRIRERATQELMEAVA

SEQ ID NO: 8523 - protein, 408 aa, Utricularia gibba
MKRGDWYRTKDLVLKGTDWIVNEMKKSGLRGRGGAGFPSGLKWSFMPKTSDGRPSYLVVNADESEPGTCKDREIMRHDPHKLLEGCLIAGVGMRATAAYIYIRGEYVNERRNLEIARREAYEAGLLGKNACGSGYDFDVHIHFGAGAYICGEETALLESLEGKQGKPRLKPPFPANAGLYGCPTTVTNVETVAVSPTILRRGPEWFASFGRKNNSGTKLFCISGHVNKPCTVEEEMSIPFKELIERHCGGVRGGWDNLLAVIPGGSSVPLITKDICEDVLMDYDALKAVQSGLGTAAVIVMDKSTDIVDAIARLSYFYKHESCGQCTPCREGTGWLWMIMERMKVGNAKLEEIDMLQEVTKQIEGHTICALGDAAAWPVQGLIRHFRPELERRIREHADRELQQAAAA

SEQ ID NO: 8524 - protein, 418 aa, Vinca minor
MAPIKGILSLQRTAFVRRQEGCRLGSRLLGTQATLTTSTPQAQQPPPPPPPPEKTHFGGLKDEDRIFTNVYGLNDPFLKGAMKRGDWYRTKDLVLKGTDWIVNEMKKSGLRGRGGAGFPSGLKWSFMPKQSDGRPSYLVVNADESEPGTCKDREIMRHDPHKLLEGCLIAGVGMRASAAYIYIRGEYVNERKNLEMARKEAYEAGLLGKNACGSGYDFDVHIHFGAGAYICGEETALLESLEGKQGKPRLKPPFPANAGLYGCPTTVTNVETVAVSPTILRRGPEWFASFGRKNNSGTKLFCISGHVNKPCTVEEEMSIPLKELIERHCGGVRGGWDNLLAVIPGGSSVPLIPKNMCEDVLMDFDALKAVQSGLGTAAVIVMDKSTDVVDAIARLSYFYKHESCGQCTPCREVQDGFG

SEQ ID NO: 8525 - protein, 438 aa, Lippia dulcis
PEKTHFGGLKDEDRIFTNVYGLHDPFLKGAMKRGDWYRTKDLVLKGTDWIVNEMKKSGLRGRGGAGFPSGMKWSFMPKASDGRPSYLVVNADESEPGTCKDREIMRHDPHKLLEGCLIAGVGMRARAAYIYIRGEYVNERKNLEIARKEAYKSGLLGKNACGSGYDFDVHIHFGAGAYICGEETALLESLEGKQGKPRLKPPFPANAGLYGCPTTVTNVETVAVSPTILRRGPEWFSSFGRKNNAGTKLFCISGHVNKPCTVEEEMSIPLKELIERHCGGVRGGWDNLLAVIPGGSSVPLIPKNICEDVLMDFDALKAVQSGLGTAAVIVMDKSTDIVDAIARLSYFYKHESCGQCTPCREGTGWLWMIMERMKVGNAKLEEIDMLQEVTKQIEGHTICALGDAAAWPVQGLIRHFRPELERRIREHADRELQQAAAA

SEQ ID NO: 8526 - protein, 501 aa, Orobanche aegyptiaca
MAPIKGILSVQRASFVQRSSENWGIARKLFSTQAATTSPTPQAPPPPPPPEKTHFGGLKDEDRIFTNLYGLHDPFLKGAMKRGDWYRTKDLVLKGTDWIINEMKKSGLRGRGGAGFPSGLKWSFMPKASDGRPSYLVVNADESEPGTCKDREIMRHDPHKLLEGCLIAGVGMRAQAAYIYIRGEYVNERKNLEKARREAYEAGLLGKNACGSGYDFDVHIHFGAGAYICGEETALLESLEGKQGKPRLKPPFPANAGLYGCPTTVTNVETVAVSPTILRRGPEWFSSFGRKNNSGTKLFCISGHVNKPCTVEEEMSIPLKELIERHCGGVRGGWDNLLAVIPGGSSVPLLPKNLCEDVLMDFDALKAVQSGLGTAAVIVMDKSTDVVDAIARLSYFYKHESCGQCTPCREGTGWLWMIMERMKVGNAKLEEIDMLQEVTKQIEGHTICALGMRLLGRCRGLLGILGRNSRGGLGSGRTESCNRLLLLDMILLKKELHLLFE

SEQ ID NO: 8527 - protein, 420 aa, Flaveria ramosissima
NLYGIHDPFLKDAMKRGDWYRTKDLVIKGSDWIVNEMKKSGLRGRGGAGFPSGLKWSFMPKVSDGRPSYLVVNADESEPGTCKDREIMRNDPHKLLEGCLIAGVGMRATAAYIYIRGEYVNERLNLEKARKEAYAAGLLGKNACGSGYDFDVHIHFGAGAYICGEETALLESLEGKQGKPRLKPPFPANAGLYGCPTTVTNVETVAVSPTILRRGPEWFSSFGRKNNSGTKLFCISGHVNKPCTVEEEMSIPLKELLERHCGGVRGGWDNLLAVIPGGSSVPLLPKHICEDVLMDFDALKAVQSGLGTAAVIVMDKSTDVVDAIARLSYFYKHESCGQCTPCREGTGWLWMIMERMKVGNAKLEEIDMLQEVTKQIEGHTICALGDAAAWPVQGLIRHFRPELERRIRERADRELLQAAA

SEQ ID NO: 8528 - protein, 451 aa, Sorghum bicolor
MPQVMVVARNFMDMVAALPAGKLDMLYDSAFICEAVLRSLPPLAKKYALQMLYVLAPVTAAAMEEWVLNEYAAKHKVAIDKLLQLRVFVEVRDRRRDVSYKMNQKFQGNMQKYLVDGGSLPREPLPLSVTGRLPTPADLEAYALDQWECFLLQLINSSQVEKGTSFSSSMMKTFQRGLLSSRDGEASKLTENGFQFLLMETNAQLWYIMREYISSAEERGVDPTELISFLLELSFHKLGAAYSLNTLTDVQRIAIRDLAELGLVKQQQGRTDRWFIPTQLATNLSASLSDSSSNKEGFVVVETNFRMYAYSTSKLHCEILRLFSRVEYQLPNLIVGAVTKESIYGAFENGITAEQIISFLRQNAHPRVADKIPTVPENVTDQIRLWETDRNRVEMIPSHLYEDFPSKEWFEQCCDYARDNGYLLWEDSKRMRLIVRGEFHPEMREFLRRQR

SEQ ID NO: 8529 - protein, 451 aa, Setaria italica
MPQVLVVARNFMDMVAALPASKLDMLYDSAFICEAVLRSLPPLAKKYALQMLYVLAPVAAAAMEEWVLDEYASKHRVAIDKLLQLRVFVEVRDRRKEVSYKMNQKFQGNMQKYLVDGGSLPREPIPLSVTGRLPASADLEAYALDQWECFLLQLINSSQVEKGTSFSSSMMKTFQRGLLSSRDGEAPKLTENGFQFLLMETNAQLWYIMREYISSAEERGVDPTELISFLLELSFHKLGAAYSLNTLTDVERIAIRDLAELGLVKLQQGRKDSWFIPTQLATNLSASLSDSSSSKEGFVVLETNFRMYAYSTSKLHCEILRLFSRVEYQLPNLIVGAITKESIYGAFENGITAEQIISFLRQNAHPRVVDKIPVVPENVTDQIRLWETDRNRVEMIPSHLYEDFPSKEWFEQCCDHARDHGYLLWEDSKRMRLIVRGEFHPEMREFLRRQR

SEQ ID NO: 8530 - protein, 451 aa, Panicum virgatum
MPQVLVVARNFMDMVAALPASKLDMLYDSAFICEAVLRSLPPLAKKYALQMLYVLAPVTAAAMEEWVLNEYAAKHRVAIDKLLQLRVFVEVRDRRKEVSYKMNQKFQGNMQKYLVDGGSLPREPIPLSVTGRLPASTDLEAYALDQWECFLLQLINSSQVEKGTSFSSSMMKTFQRGLLSSRDGEAPKLTENGFQFLLMETNAQLWYIMREYISSAEERGVDPTELISFLLELSFHKLGAAYSLNTLTDVQRIAIRDLAELGLVKLQQGQKDSWFIPTQLATNLSASLSDSSSSKEGFVVVETNFRMYAYSTSKLHCEILRLFSRVEYQLPNLIVGAITKESIYGAFENGITAEQIILFLKQNAHPRVADKIPAVPENVTDQIRLWETDRNRVEMIPSHLYEDFPSKEWFEQCCDHARDHGYLLWEDSRRMRLIVRGEFHPEMREFLRRQR

SEQ ID NO: 8531 - protein, 451 aa, Oryza sativa
MPQVMVVARNFMDMVAALPAAKLDMLYDSAFICEAVLRSLPPLAKKYALQMLYVSAPVAAAAMEEWVLDEYAAKHRVAIDRLLQLRVFVEVRDRRKEVSYKMNQKFQGNMQKYLVDGGSLPREPIPSSVTARLPTLAELESFALEQWECFLLQLINSSQVERGTSFSSSMMRTFQRGLLSSRDGEAPRLTENGFQFLLMETNAQLWYIMREYISSAEERGVDPTELISFLLELSFHTLGEAYSLNTLTDVQRNAIRDLAELGLVKLQQGRKDSWFIPTKLATNLSASLSDSSSNKEGFVVVETNFRMYAYSTSRLHCEILRLFSRVEYQLPNLIVGSITKESLYGAFENGITAEQIISFLQQNAHPRVADKIPAVPENVTDQIRLWETDRNRVDMTLSHLYEDFPSKDMFDQCCDYARDHGCLLWEDAKKMRLIVRVEFHSEMREFLRRLR

SEQ ID NO: 8532 - protein, 451 aa, Brachypodium distachyon
MPQVMVVARNFMDMVAALPAAKLDMLYDSAFICEAVLRSFPPLAKKYALQMLYVSAPMPAAAMEEWVLDEYASKHKVAIDRLLQLRVFVEVRDRRKEVSYKMNDKFQGNMQKYLVDGGSLPREPISSSVTGRLPTLTELENYALEQWECFLLQLINSSQVERGTSFSSSMMKTFQRGLLSSRDGDAPKLSENGFQFLLMETNAQLWYIMREYISSAEERGVDPTELISFLLELSFHTLGAAYSFNTLTDVQRIAIRDLAELGLVKVQQGRKDSWFIPTKLATNLSSSLSDSSASKEGIVVVETNFRLYAYSASRLHCEILRLFSRVEYQLPNLIVGAITKESLYGAFDNGITAEQIISFLKQNAHPRVADKIPVVPENVTDQIRLWETDRNRVDMVLSHVYEDFPSKDMFEQCCDLARDNGFLLWEDSKKMRLIVRVEFHQEMREFLRRQR

SEQ ID NO: 8533 - protein, 451 aa, Triticum aestivum
MPQVMVVARNFMDMVAALPAAKLDMLYDSAFICEAVLRSFPPLAKKYVIQMLYVSAPMLAAAMQEWVLDEYASKHKVAIDRLLQLRVFVEVRDRRKEVSYKMNNKFQANMQKYLVSGGCLPREPLPFSVTGRLPTLVELENYALDQWECFLLQLINSSQVEKGTTFSSSMMKTFQRGLLSSRDGEAAKLSENGFQFLLMETNAQLWYIMREYISSAEERGVDPTDLISFLLELSFHTQGAAYSLSTLTEVQRVAIMDLMELGLVKLQQGRKDSWFIPTKLATNLSSSLSDSAASKEGIVVVETNFRLYAYSASKLHCEILRLFSRVEYQLPNLIVGAITKESLYGAFDNGITAEQIISFLQQNAHPRVIDKIPIVPENVTDQIRLWENDRNRVEMVLSHVYEDFPSKDMFEQCCDHARDNGYLLWEDAKKMRLIVNAEFHQEMREFLRRQR

SEQ ID NO: 8534 - protein, 451 aa, Triticum aestivum
MPQVMVVARNFMDMVAALPAAKLDMLYDSAFICEAVLRSFPPLAKKYVIQMLYVSAPMPAAAMQEWVLDEYASKHKVAIDRLLQLRVFVEVRDRRKEVSYKMNNKFQANMQKYLVSGGCLPREPLPISVTGRLPTLVELENYALDQWECFLLQLINSSQVEKGTTFSSSMMKTFQRGLLSSRDGEAAKLSENGFQFLLMETNAQLWYIMREYISSAEERGVDPTDLISFLLELSFHTQGAAYSLSTLTEVQRVAIMDLMELGLVKLQQGRKDSWFIPTKLATNLSSSLSDSAASKEGIVVVETNFRLYAYSASKLHCEILRLFSRVEYQLPNLIVGAITKESLYGAFDNGITAEQIISFLQQNAHPRVIDKIPIVPENVTDQIRLWENDRNRVEMVLSHVYEDFPSKDMFEQCCDHARDNGYLLWEDAKKMRLIVNAEFHQEMREFLRRQR

SEQ ID NO: 8535 - protein, 68 aa, Brachypodium distachyon
MPQVMVVARNFMDMVAALPATKLDMLYDSAFICEAVLRDYSHKKYTLQMLYVSAPMPAAAMEEWVLAG

SEQ ID NO: 8536 - protein, 334 aa, Saccharum officinarum
MPQVMVVARNFMDMVAALPAGKLDMLYDSAFICEAVLRSLPPLAKKYALQMLYVLAPVTAAAMKEWVLNEYAAKHKVAIDKLLQLRVFVEVRDRRRDVSYKMNQKFQGNMQKYLVDGGSLPREPLPLSVTGRLPTPADLEAYALDQWECFLLQLINSSQVEKGTSFSSSMMKTFQRGLLSSRDGEASKLTENGFQFLLMETNAQLWYIMREYISSAEERGVDPTELISFLLELSFHKLGAAYSLNTLTDVQRIAVRDLAELGLVKQQQGRTDRWLFLPNWLLISQQACQIHHLTKRDLWLLRQTFECMHTLLPNCTVKFYAFFQGWSINFQTSS

SEQ ID NO: 8537 - protein, 451 aa, Hordeum vulgare
MPQVMVVARNFMDMVAALPAAKLDMLYDSAFICEAVLRSFPPLAKKYVIQMLYVSAPMPAAAMQEWVLDEYASKHKVAIDRLLQLRVFVEVRDRRKEVSYKMNNKFQANMQKYLVSGGCLPREPLPFSVTARLPTLVELENYALEQWECFLLQLINSSQVEKGTTFSSSMMKTFQRGLLSSRDGEAAKLSENGFQFLLMETNAQLWYIMREYISSAEERGVDPTDLISFLLELSFHTQGAAYSLSTLTEVQRIAVMDLMELGLVKLQQGRKDSWFIPTKLATNLSSSLSDSAASKEGIVVVETNFRLYAYSASKLHCEILRLFSRVEYQLPNLIVGAITKESLYGAFDNGITAEQIVSFLQQNAHPRVIDKIPIVPENVTDQIRLWENDRNRVEMILSHVYEDFPSKDMFEQCCDHARDNGYLLWEDAKKMRLIVSGEFHQEMREFLRRQR

SEQ ID NO: 8538 - protein, 451 aa, Secale cereale
MPQVMVVARNFMDMVAALPAAKLDMLYDSAFICEAVLRSFPPLAKKYVIQMLYVSAPMPAAAMQEWVLDEYASKHKVAIDRLLQLRVFVEVRDRRKEVSYKMNNKFQANMQKYLVSGGCLPREPLPFSVTARLPTLAELENYALEQWECFLLQLINSSQVEKGTTFSSSMMKTFQRGLLSSRDGEAAKLSENGFQFLLMETNAQLWYIMREYISSAEERGVDPTDLISFLLELSFHTQGAAYSLSTLSEVQRVAIMDLMELGLVKLQQGRKDSWFIPTKLATNLSSSLSDSAASKEGIVVVETNFRLYAYSASKLHCEILRLFSRVEYQLPNLIVGAITKESLYGAFDNGITAEQIISFLQQNAHPRVIDKIPIVPENVTDQIRLWENDRNRVEMVLSHVYEDFPSKDMFEQCCDHARDNGYLLWEDAKKMRLIVNAEFHQEMREFLRRQR

SEQ ID NO: 8539 - protein, 112 aa, Sorghum bicolor
MGRDELLRRSLVALAAAVALTGLATASLRKAAATYGFGILAIAGVLLPDWEFFDRDYSQWLTPMPASRRTAAAAAAEREHDVWKFKPYPLRVAMLTTIYGFGLYKWWMYVSS

SEQ ID NO: 8540 - protein, 112 aa, Zea mays
MGRDEMLRRSLVALAAAVALTGLATASLRKAAVTYGFGILAIAGVLLPDWEFFDRDYSQWLTPMPASRRTAAAAAADREHDVWKFKPYPLRVAMLTTIYGFGLYKWWMYVSS

SEQ ID NO: 8541 - protein, 112 aa, Setaria italica
MGRDELLRRSLVALAAVVVITGLATASLRKAAATYGFGILAIAGVLLPDWEFFDRDFSQWLTPMPASRRTAAAAAAEREHDVWKFKPYPLRMAMLTTIYGFGLYKWWMYVSS

SEQ ID NO: 8542 - protein, 112 aa, Pennisetum glaucum
MGRDELLRRSLVALAAVVVVTGLATASLRKAAATYGFGILAIAGVLLPDWEFFDRDFSQWLTPMPASRRTAAAAAAEREHDVWKFKPYPLRMAMLTTIYGFGLYKWWMYVSS

SEQ ID NO: 8543 - protein, 112 aa, Oryza sativa
MGRDEMLRRSLVALAAAVVVTGVVTASVRKAAATYGFGILAIAGVLLPDWEFFDRDYSQWLTPMPASRRTAAEAAADREHDVWKFKPYPLRMAMLTTIYGFGLYKWWMYVSS

SEQ ID NO: 8544 - protein, 112 aa, Brachypodium distachyon
MGRDELLRRSLVALAAAVVVTGVATASVRKAVATYVYGILAIAGVLLPDWEFFDRDFSQWLTPMPASRRTAAAAAAEREHDIWKFKPYPLRMTMLATIYGFGLYKWWNYVSS

SEQ ID NO: 8545 - protein, 113 aa, Unknown
  Sequence found in Organisms: Hordeum vulgare, Secale cereale, Triticum aestivum
MLGRDELLRRSLVTLAAAVVVTGVATASVRKALATYVFGILAIAGVLLPDWEFFDRDFSQWLTPMPASRRTAAAAAAEREHDIWRFKPYPLRMAVLTTIYGFGLYKWWTYVSH

SEQ ID NO: 8546 - protein, 65 aa, Saccharum officinarum
MAPRVASVLLFAMAVLVASASAQEFVAPASAPAPGPVAGAASAPASAVAVVSSALLSLLVATLMQ

SEQ ID NO: 8547 - protein, 110 aa, Saccharum officinarum
MCSGSWSWSSSKKHPSLVVVNLKRQLQKTPPPHVSVAIRRKRLRLRRLRGGAEAMEILNLKLYLENRCIIAENERLREKATALRRENLALLQNLSKTAAVPEAGAGAGTA

SEQ ID NO: 8548 - protein, 61 aa, Zea mays
MASAPALNLLSLSLRTCTVYFCCRLRLTTTRDGRFLLLLQDQEPEHMLPWWMAYTRPAPSC

SEQ ID NO: 8549 - protein, 212 aa, Panicum virgatum
MHPVSVSLQPFPATPASILVPRSAAGRNSIDFAELRRAGRSSGNLAMNSIQNPARGSETSGSEDFNVGDKDAVVIVDHGSRRQESNLVLNDFVEMFRARTGYKIVEPAHMELAEPTIKDAFGKCVQQGASRVIVSPYFLSPGRHWKQDIPALAAEASKELSNIPYIVTAPLGLHELMVDIMNDRIKYCLQHAAGNVDECTVCAGTGKCRLYS

SEQ ID NO: 8550 - protein, 212 aa, Setaria italica
MHPASVSLQPFTATPASILIPRRAAARNSIDFTELRRAGRSSGNLVMSSMPNPASGSETSGREDFNVGDKDAVVIVDHGSRRQESNLMLNDFVEMFRTRTGYKIVEPAHMELAEPTIKDAFGKCVQQGASRIIVSPYFLSPGRHWKQDIPALAAEASKEHSNVPYIVTAPLGLHELMVDIMNDRIKYCLQHVGGDVDECTVCAGTGKCRLYS

SEQ ID NO: 8551 - protein, 212 aa, Panicum virgatum
MHPVSVSLHPFTATPASVLIPRNAAVRNSINFAELGRAGRSSGNLAMNSIQNPARGSETFGTEDFTVGDKDAVVIVDHGSRRQESNLMLNDFVDMFRARTGYKIVEPAHMELAEPTIKDAFGKCVQQGASRVIVSPYFLSPGRHWKQDIPALAAEASKELSNIPYIITAPLGLHELMVDIMNDRIKYCLQHVAGDVDECKVCAGTGKCRLYS

SEQ ID NO: 8552 - protein, 210 aa, Pennisetum glaucum
MHPASVFLQPFTATPAIILIPRPAATRNSIDFAKPRRAGRSHLVMSSMPDSARGSEASGREDFTVGDKDAVVIVDHGSRRQESNLMLNDFVEMFRTRTGYKIVEPAHMELAEPTIKDAFGKCVQQGASRIIVSPYFLSPGRHWKQDIPALAAEASKEHSNVPYIVTAPLGLHELMVDIMNDRIKYCLRHVGGDVDECTVCAGTGKCRLNS

SEQ ID NO: 8553 - protein, 1084 aa, Sorghum bicolor
MPAKYLGLGAFAEDRRPDLHRQVGCVTGILQAFDRRHPLASSHKRLLPPPTATAGHALSSSPSKGGECTRYSPQIVLEKNSSKTWADSQRAPATELSQTSYSSSPSSSFSSLDGNRSTQQDLSSTDRMLFPERPFKSSPKLKSSFDSDNGLDYPDDAPTKSKNMPIVQSSLPTLGIRNLVKDSIYKDSRELSVRICTEEEVKDHPSNCGDQPRQLNGPPHDSTQGKSKGLVDINESLRVLAKLREASWTPPESAHHARLSYDAPRFSYDGKEAASKLREVPRLSLDIKEGHLWNREIDSRSNPRSADRSSNTVTGSNAAIETQQEQPACKRLPSVVAKLMGLEELPEHNQSTASSHAWKTVQESKQDAMFNPSSISSHDEHALRQQRNHDSTARNLPNSKFPVETAPWKQQERIVLPRRLPKGSKGAHAREQPAASVFSDIEKRLKDLDFQQSNKDLRALKQILDSMQAKGLLENKKREEASMPKLYDGNHDGQEVAGVNMRLNTNTNNMWMPEENNAESSFKSPIVIMKPSKSANLFSEVDSSVFPLGGPSDPTQLQTSNSTDRRKASMINRTAKEQHAKFSQKVPTSQPLVSYDRRSYGRNDDSSNNQKSSSLLVTESSSRRQQLPRDGSISMQKNKNSTSPRLLQRKLDSERRARPPIPSAEYNKIQRQSGDRNNSETVSPRSKFRRKLVRPQEGDDGMPNGLNNRTRSLNQHGNDMSTKSNGNISVASELDIISNDRSAEVNVSNFEQGIGTPSGRNPQKVKISYDASKDVPSVDPLAAISERPSPVSVLDSSFDQEDLFPTSRTPNSLAVDDERQTLEAPWKPSDRKPTEVAMQSKNNKLANVASLLEKLQQLSVNKDEDAPPVDHIAFLCETESPDHRYVSEILLASGLLMKDLGSGQAGLQLHSSGYPINPDLFHVLEQRKAGWASIPDSIHQSRSGAKSDPKRAHRKLLFDTVNELLLQKFEKETAVYSVSSYTRAKDPPSKTPSGQQLLKLISSGIEDLDMERSSIWQKEGSVIPDAEILQRLQGWSSFSKEFPGMVLEIERSIFKELVDEVVHGESADGPEMKVAGRRRRRLFA

SEQ ID NO: 8554 - protein, 1064 aa, Zea mays
MPAKYLGALAEDRRPDLYRQVGCVTGILQAFDRRHHLASSHKRLLPPTGHAPSNPSKGGECTRYSPQVVLEKNSSKTWADSQRAPATELSQTSYSSSPSSSFSSLDGNRSTQQDLSSTDRMLFPERPFKSSPKLKSSFDSDNGLDYPDDALTKSKNMPIVQSSLPTLGIRNLVKDSIYKDSHELSVRISTEEEVKDHPSNCGDQPMQLNGPHHDSTQGKSKGLMDINESLRVLAKLREASWTPPESVHHARLSYDAPRFSYDGKEATSKLREVPRLSLDIKEGHLWNREIDSRLDPSLSSADRNSNTVTGSNAAFETQQEQPACKRLPSVVAKLMGLEELPEHNQSTASSHACNTVQENKQDAMLNSLSISYQYEHAPQQERNPDSTVRNLPNSKFPVQTAPWKQQERIVLPRKLPKGSKGAHGREPAAPWNQLKDLDFQQPNKDLRALKQILDSAKGLLENKKREEAFMPKLYNGNHDDQEMASANMRLNRNTNNMWMPEESNAESSFKSPIVIMKPSKSANLYSKVDSSVFPLGGSSDLPQPQTSNSTDRRKASTINRTAKGQYAKLSPRVPTSQPLVSCDRRSYGRNDDSSNNQKSSSLLVTESSTRRQQLPRNSSVSMQKNKNSTSPKLLQRKLDPERRARPPIPSAESNKSERQSGDRNNSETVSPRSKFRRKLVRPQGDDGMPIGLNNRTRSLYQHDNDMSIRSDGSISVASELDIISNDRSTGVNISNFEQGIGTPSGRNPQKVKTSYDANMDVPSVDPSAAISERPSPVSVLDSSFDQEDLFPTSRTPNSLAVDDERETLEEPWKPSVAIQSKNNKLANVASLLEKLQQLSVNKDEDAPPVDHIAFLCETESPDHRYVSEILLASGLLMKDLGSGQTGLQLHSSGYPINPDLFHVLEQRKAGWVSTPDGIHQSRSGTKSDPRRAHRKLMFDTVNELLLQKFEKETAVYALSSFTRAKDPPAKTFSGQQLPKFISSGIEELDMERSSISQKDSSVIPDAEILRRLQGWTSFSKELPGMVLEIERSIFKELVDEVVHGESADGPEMKAAGRRRRRLFA

SEQ ID NO: 8555 - protein, 1079 aa, Setaria italica
MPAKYLGALAEDRRPDLHRQVGCVTGILQAFDRRHPLASSHKRLLPPTAGHALSSSPSVGGDCTRFSPQIVLEKNSSKTWADNQRAPAAELSQTSYSSSPSSSFSSLDGNRSTQQDLSSTDRMLFPERPFKCSPMLKSSFDSENGLDYPDDVLTKPDNMPTAQSSLPTLGIKNLVKDSIYKDSRDLSVRVCNGEEVKDHPFNFGDPSRQLDGPPRDSTQGKSKGLMDINESLRVLAKLREATWTPSESGHHARLSYDAPRFSYDGKEPASKLREVPRLSLDIKEGHHWNREMNSRSKPSLSSSDRSSSNATGSNAALETQQEQPACKRLPSVVAKLMGLEELPERSESTASLQACKAVKESKEATLNPLSISSHNEPAPRQQRNQDSTVRNLPNSKFPVETAPWKQQERIVLPRKPPRGSKGAHGREPVASVFSDIEKRLKDLDFQQSNKDLRALKQILDSMQAKGLLENKKREEASMSKLYDGSHDDQETTNLNTRLNSNTNSMWVPEESNAESSFKSPIVIMKPSKSANLYSEVDSSVIPLGGSSDLPQLQTGNSTDKRKASTVNRTAKEQHAKWSPRVPTSQPLVSYDRKSNGRNDDSSNKQKSSSLLVTESSSRRQQLPRDSSISLQKNKNSTSPRLLQRKLDSERRARPPVPSAESNKSQRQSGDRNNLDTVSPRSKFRRKPVRAQEGDDGMPNGLNNRTRSLNQQGNDMSTRSDGSMCVASEVDIEVISNDRSTEVNVSNFEQGNGTPSGRNTQKVKTSYDASKDVSSVDPSAAISERPSPVSVLDPLFDQEDLFPSSRTSDSLAADDEHHTSEEPWKPSDTKLREVAMQSKNNKLANVASLLEKLQQLSVNKDEDAPPVDHIAFLCETESPDHRYVSEILLASGLLMKDLGSGHAGLQLHPSGYPINPDLFHVLEQRKAGWVSKPDGIHQSRVKCDPKRAHRKLMFDSVNEILLQKFEKETAVYSASSFTRAKDLPAKTLSGQQLVKFVSSGIEDLEMEQSRICQKEGSVIPDAEILERLQGWTSFCRELPGLVLEIERSVFKELVDEVVHGESADGPLMKAAIRRRRRLFA

SEQ ID NO: 8556 - protein, 95 aa, Saccharum officinarum
MISEMGTLPCPWRSGHLFAFITFALLFSTSFAGRHYSFLTDQDALRQQGEAARTEQKEPLVPLVQARRLNVKTNDYSSYDPSPSMDKPHSKLIPN

SEQ ID NO: 8557 - protein, 88 aa, Sorghum bicolor
MGTLPCPWRSGHLFAFITFALLFSTSFAGRHYSFLTDQGALRQQGEAARKEALVPLVQVRRLNVKTNDYSSYDPSPSMDKPHFKLIPN

SEQ ID NO: 8558 - protein, 96 aa, Saccharum officinarum
MISEMGTLPCPWRSGHLFAFITFALLFSTSFAGRHYSFLTDQDALMRQQGEAARTEQKEPLVPLVQARRLNVKTNDYSSYDPSPSMDKPHFKLIPN

SEQ ID NO: 8559 - protein, 86 aa, Triticum aestivum
TLPCPWRSGHLFAFITFALLFSTSFAGRHYSFLTDQGALRQQGEAARKEALVPLVQVRRLNVKTNDYSSYDPSPSMDKPHFKLIPN

SEQ ID NO: 8560 - protein, 530 aa, Sorghum bicolor
MATTLTALLKEAAAAFPARRAVAVPGKLELTHAALDALVDAAAARLAVDAGVLPGHVVALAFPNTVELVIMFLAVIRARAVAAPLNPAYTQEEFEFYLSDSEARLLITNAEGNAAAQAAAAKLGLVHAAATLHDAAGPVHLAGLPLALANGNGTKSNGSHQGGAAEGSPNDNDPSDVALFLHTSGTTSRPKGVPLTQRNLAASVRNIRSVYRLSESDATVVVLPLFHVHGLLCALLSSLASGASVALPAAGRFSGSTFWADMRASGATWYTAVPTIHQIILDRHASRPEAEGYPALRFIRSCSASLAPAILERLEAAFGAPVLEAYAMTEASHLMTSNPLPEDGARKPGSVGRAVGQELAVLDEEGRRVAAGSPGEVCIRGDNVTAGYKGNPEANEAAFRFGWFHTGDIGVVDEEGYVRLVGRIKELINRGGEKISPIEVDAVLLGAPGVAQAVSFGVPDDKYGEEINCAVIPRDGSALREEEVLAHCRRNLASFKVPKKVFITDDLPKTATGKIQRRIVAQHFVQPASA

SEQ ID NO: 8561 - protein, 528 aa, Setaria italica
MAEEAPTLTALLKKAAAAFPSRRAVTVPGKLELTHAALDALVDAAAARLAADAGVRPGHVVALSFPNTVELVIMFLAVIRARAVAAPLNPAYTQEEFEFYLSDSESRLLLTNAEGNPAAQAAAAKLGLPHAAATLKDAAGPVHLHGLAAANAANGNGFHQEKDDHNEASDVALFLHTSGTTSRPKGVPLTQANLAASVGNIRSVYRLAETDATVVVLPLFHVHGLLCGLLSSLASGASVRLPAAGRFSASTFWADMRAAGATWYTAVPTIHQIILDRHASKPEAAGYPALRFIRSCSASLAPVILEKLEAAFGAPVLEAYAMTEASHLMTSNPLPEDGPRKPGSVGRPVGQEMAILDEEGARVAAGKPGEVCVRGANVTAGYKGNPEANEAAFRFGWFHTGDIGVVDEEGYLHLVGRIKELINRGGEKISPIEVDAVLLDHPAVKQAVSFGVPDDKYGEEINCAVIPREGLVIGEDDVVAHCRKNLASFKVPKKVFVTDDLPKTATGKIQRRIVAQHFVVQPKAGSAA

SEQ ID NO: 8562 - protein, 137 aa, Saccharum officinarum
MASAASSAAGAGKSLFQGLRRFLKKPWEITGPCASPEYRSALPDALEYRVKCPATVRDDRDKAIVPTSDPETVYDIKYFTRDRRRNRPPVRRTLLRKPELERYMATKQFDPTKDFPVPYVNTTVEEDDNTVGGGYQK

SEQ ID NO: 8563 - protein, 137 aa, Zea mays
MASAASSAAAAGKSLFQGFRRFLKKPWEITGPCASPEYRSALPGALEYRVKCPATVRDDRDKAIVPTSDPETVYDIKYFTRDRRRNRPPVRRTLLRKPDLERYMVTKQFDPTKDFPVPYVNTTVEEDDNTVGGGYQK

SEQ ID NO: 8564 - protein, 137 aa, Sorghum bicolor
MASAASSATGAGKSLFQGLRRFLKKPWEITGPCASPEYRSALPDALEYRVKCPATVRDDRDKAIVPTSDPETVYDIKYFTRDRRRNRPPVRRTLLRKPELERYMATKQFDPTKDFPVPYVNTTVEEDDNTIGGGYQK

SEQ ID NO: 8565 - protein, 137 aa, Panicum virgatum
MASAASSAAGAGKSLFQGLRRFLKKPWEITGPCASPEYRSALPGALEYRVKCPATVRDERDKAIVPTSDPETVYDIKYFVRDRRRNRPPVRRTLLRKPDLERYMAAKQFDPTKDFPVPYVNTTVEEDDNTLGGGYQK

SEQ ID NO: 8566 - protein, 125 aa, Triticum aestivum
MASAASSAVGAGKSLFQGLRRFLKKPWEITGPCASPEYRSALPGALEYRVKCPATVRDDRDKAIVPTSDPETVYDIKYFTRDRRRSRPPVRRTLLRKPISRVHGHQAFDPTNDSPYHTSTHRRGG

SEQ ID NO: 8567 - protein, 391 aa, Setaria italica
MRPSRCCVPLFLLLLSHLAFARPLFPLPSKTKNEEKRPIQTFRPYNIAHRGSNGEIPEETAVAYLRAIEEGADFIETDILASKDGTLICFHDVTLDETTDVAEHKEFANRRRTYEVEWSNVTGWFVVDFTLEELKTLKVKQRYSFRDQQYNGMFSIITFEEFISIALDADRTVGIYPEIKDPVFINKHVKWADGKKFEDKFVDTLLKYGYKGQYMSENWLKQPLFIQSFAPTSIIYVSKLIDSPKVFLIDDITVRTQDTNQSYWEITSDDYLAYIGKYVVGLGPWKDTIVPAAGNYLMPPSDLVARAHAHNLQVHPYTYRNENQFLHFNFHQDPYAEYDFWIKNVGVDGLFTDFTGTLHQYQELTSPHRKDETANSLLVKISQMISAYEGL

SEQ ID NO: 8568 - protein, 137 aa, Setaria italica
MASAASSAAGAGKSLFQGLRRFLKKPWEITGPCASPEYRSALPNALEYRDKCPATIRDDRDKAIVPTSDPETVYDIKYFTRDRRRNRPPVRRTLLRKPDLERYMAAKQFDPTKDFPVPYVNTTVEEDDNTIGGGYQK

SEQ ID NO: 8569 - protein, 137 aa, Pennisetum glaucum
MASAAPSAAGAGKSLFQGLRRFLKKPWEITGPCASPEYRSALPGALEYRDKCPATIRDDRDKAIVPTSDPETVYDIKYFTRDRRRNRPPVRRTLLRKPDLERYMAAKQFDPTKDFPVPYVNTTVEEDDNTIGGGYQK

SEQ ID NO: 8570 - protein, 137 aa, Panicum virgatum
MASAASSAAGAGKSLFQGLRRFLKKPWEITGPCASPEYRGALPSALEYRVKCPATVRDDRDKAIVPTSDPETVYDIKYFVRDRRRNRPPVRRTLLRKPDLERYMAAKQFDPTKDFPVPYVNTTVEEDDNAVGGGYQK

SEQ ID NO: 8571 - protein, 162 aa, Triticum aestivum
  misc_feature (127)..(127): Xaa can be any naturally occurring amino acid
  misc_feature (131)..(131): Xaa can be any naturally occurring amino acid
  misc_feature (137)..(137): Xaa can be any naturally occurring amino acid
  misc_feature (143)..(143): Xaa can be any naturally occurring amino acid
  misc_feature (145)..(145): Xaa can be any naturally occurring amino acid
  misc_feature (148)..(148): Xaa can be any naturally occurring amino acid
  misc_feature (150)..(150): Xaa can be any naturally occurring amino acid
MASAASSAAAAGKSLFQGFRRFLKKPWEITGPCASPEYRSALPGALEYRVKCPATVRDDRDKAIVPTSDSETVYDIKYFTRDRRRNRPPVRRTLLRKPDSSATWSPSSLTPQRIPVPYVNTTVKEDXNTVXGGYQNXQGKLRXMXVIXRXPVCLAHNSANFF

SEQ ID NO: 8572 - protein, 129 aa, Saccharum officinarum
MAKYNVVQKNKRQWKQDRKRAAHGEPGTGKLKQRTAPVSMSGKRKRKLERRLNREQKEAAMIKALENNMGDVDMVSAEESSEAAKGKSQVKFSVKKNSRIQIKRLKGKGRKKAKNAKQPAKEKVDAMVE

SEQ ID NO: 8573 - protein, 128 aa, Sorghum bicolor
MAKFNVVQKNRRQWKQDRKRAAHGEPGTGKLKQRTAPVSMSGKRKRKLERRLNREQKEAAMIKALENMGDVDMVSAEESSEAAKGKSQVKFSVKKNSRIQIKRLKGKGRKKAKNAKPPAKEKVDAMVE

SEQ ID NO: 8574 - protein, 129 aa, Cenchrus ciliaris
  misc_feature (48)..(48): Xaa can be any naturally occurring amino acid
  misc_feature (126)..(126): Xaa can be any naturally occurring amino acid
MAKFNVVQKNKRQWKQDRKRAAHGEPGTGKLKQRTAPVSMSGKRKRKXERRLNREQKEAAMIKALENNMGDVDMVSAEDSSEAAKGKSQVKFSVKKNSRIQIKRLKGKGRKKAKNAKPPTKDKVDXMVE

SEQ ID NO: 8575 - protein, 129 aa, Pennisetum glaucum
MAKFNVVQKNKRQWKQDRKRAAHGEPGTGKLKQRTAPVSMSGKRKRKIERRLNREQKEAAMIKALENNMGDVDMVSAEDSSEAAKGKSQVKFNVKKNSRIQIKRLKGKGRKKAKNAKPPTKDKVDAMVE

SEQ ID NO: 8576 - protein, 129 aa, Setaria italica
MAKFNVVQKNKRQWKQDRKRAAHGEPGTGKLKQRTAPISMSGKRKRKIERRLNRDQKEAAMIKALENNMGDVDMVSAEESSEAAKGKSQVKVSVKKSSRIQIKRLKGKGRKKAKNAKPPTKGKVDAMVE

SEQ ID NO: 8577 - protein, 123 aa, Saccharum officinarum
VQKTKRQWKQDRKRAAHGEPGTGKLKQRTAPVSMSGKRKRKLERRLNREQKEAAMIKALENNMGDVDMVSAEESSEAAKGKSQVKFSVKKNSKIQIKRLKGKGRKKAKNAKPPAKEKVDAMVE

SEQ ID NO: 8578 - protein, 108 aa, Panicum virgatum
  misc_feature (34)..(34): Xaa can be any naturally occurring amino acid
  misc_feature (38)..(38): Xaa can be any naturally occurring amino acid
  misc_feature (69)..(69): Xaa can be any naturally occurring amino acid
MAKFNVVQKNKRQWKQDRKRAAHGEPGTGKLKQXTAPXSMSGKRKRKLERRLNREQKEAAMIKALENNXGDVDMVSAEESSEAAKGKPQVKLTVKKNSRVQIKRLKER

SEQ ID NO: 8579 - protein, 129 aa, Oryza sativa
MAKFNVVQKNRREWKQDRKRQAHGDPKTGKLKQRTAPVSVSGKRQRKLLRRLSREQKEAVMAKALENNMGDVEMVSAEGSSEAAKDKSQLKFNVKKNSRVQIKRLKGKGRKKAKNAKPPTKDKVDAMVE

SEQ ID NO: 8580 - protein, 165 aa, Zea mays
MSHFAAAMKSPLAVAVAAPAGAADAKSPLFCPKPRRPAAPLRCHQSGGFSDAGTDLLDLLLSKGDESGLSSASPQPPLFCGSPPRRASNPVVHDSRFGADCPPMPVPGLPVHRPSPRPSTAAPSMSPRGCARARFAFQPAAVRVEGFDCLDRGRGGRGHGITAMA

SEQ ID NO: 8581 - protein, 2265 aa, Sorghum bicolor
MANTRSGGGGDAQLANGRETRSTTAAAAAASAQTPNLRRSTRENKGKHKSRQLPATPSSRRSAKTPTKDDTAIATPKSTSSPNNPKDSTEKPSRVRNTSVSPSPSKHDSNGTSTTASTKRKIQDDAQTASTPSKKQKRLMHTKSYVALFSTGQGQPESQVLAPLRQDKEKASDVQPEGDGAVLAHEESNALEQPNQEPSNVSAGKVLGGHSSDLHETEVILEGDGLKIGSHQSDVVLESCILTETCSLNKAVESIPMLETGEQAIGDSNQNSLLELQNSACSTAHHEEANKSLEDGDSVGVQGACTSRNIEAIQCDETGYNDNICVGCRSREISDILKSCGGKGCKRHYHLSCMDPPLDVSLGIWLCRMCIKKRLQFGVYSVSEGIESLWDVKEGAENSKQYFVKYKNLSHVHNRWISESDIVDSTPQGSDLISKFSKRIHKEKTIRWKQEWAEPHRLLKRRLLMPPKEAEVFFNSLGDKFVYCNVEWLVKWKDLGYEHATWELESSSFLCTTEAEELKRSYEDRFKAARKASDPSKVDKVKGGIFQQLQRLPDGCPPGLDNDHLRSLNQLREFWHNSRGAVFIDDQERVIKTILFVASILPHICRPLLIVSTTTSLSLWETKFNRLAASINVVVYNGEKDVRKSIQDLEFYEDGSVMLQVLLSHPDAILEDIKAIERINWEAVIVDDCQNSRVSKCLEQLKRLPTNFRMVLLSSSLKESIAEHINLLSFLNPEENGTLSVSNGVYFDTAGTLAVLKAKLARYVAFERKGDSSKLLEYWVPARLSPVQLEMYCYILLSNSPALRSHSKTDSVGALRNILISLRKCCDHPYLVDQSLQSTLTKDHPITDILDIGVRSCGKLLLLDRMLQQIRIQGLRVLILSQSGGGSGNPMGDILDDFVRQRFGYESYERVERGLLLQKKQTAMNMFNDKTKGRFIFLIDSRACGSSIKLSSVDAIIIYGSDWNPMNDLRALQKVSMESQSEPVPIFRLYSSCTVEEKALILAKHDHILDSNILNITPSLSHCLLSWGASFLFNRLEELQNPSYSNVSGDELFTDNVALEFLTKLLSKVEPSTESGNVAISQAYLRGSFYSRAVVVAGEREGISSVDGDLPKFCAYWLSLLNGRSPHWQHISEPVQRSRRKIYNAEQQLKNTEEQLKIPTEETDEARIKRRRIGEIMDSSPKDSPGKNKETTILPENNTPSSSHQISVEDTWQELERNNLHGTQKGLHVQLKPELSKLYKLLQLPENVKSLCEEFLEYILKNHQISQEPKGILHAFNLALCWRAASLSKHKINHTESLTLAVENLNYECKEELAEFVYAKLKILKRKFARRAGEVSKQNSMASVNNISTCEQDTSVRLRNDELIPSQVTLTDDNFENGSHHVATGDFWTEEMVSGEKELLSGPVTHEGEQLSRDELLSKIMDKRIKLVDKVFSLRGRSIQDKHSNEVSFLDMHRQKEVAKLKGACSLVVEHLRSSQNHIAQEDGDGKIKLIIEWFTMLLYAFLEHMKCQRDKLDMQQSVSRFKESQLKEETLQAAKRGQLDQNFDQHIPSPDFEFAMEEFRHFREIVGSCHVHAAALAPESLDDNSAMEITLVRSANAPEVIEEEALNRPAKVLVQGPAPEVVGPSVNVICNYSDGINSQGDAYLAVPSLEPSSDDLSTDHVEENTVGSPVQGDTSEHLGDAAMEVETGNRNTALADSPHFDTPALTAPSRQATLLVSREIEMQSNLVDQCAQQSLVSSQPLQREPEQADLSSAASDQPLQSERQQSIPPPNNLLERAQLGQSQPNYQTDVAPGSAQSAELFPVTSMMFNHPPIDAEPLKNELHKLRLHMDALNKVHEIKKTQLQTECSQELEKVKRKYDLLIKEHDSTHLQQKKALDGFYEKVQRNQSLAEDFRAKFISPSAAQGAAKAHTPPVRRTPQATPQVMRPPLLDSASSIALSSACRPPVPRPRVQAPQVDQASSSLLQLSRPSLPSLQVVQPPNLEQGNLFRTTATTLSHMPPPRGSYGVQSELAPRSPAPHLQFRSPRAHSMPPPGNQQQLPATRVEAMSSRTQPMLAASSCPSDIHVGHLAASAMSSLHSVLPSTSLPSSLHPSHLAQRVLPTPNPTLQAAAPSGSNTTMPSIPTGMQPPDSGSLSLDAWLAANLGLNDDASTAPAKNTASLGLRSDAPRAAPATNTASLGLSSDVPMGTAPATNTASLGLSSDVPRGMASATNTASLRLSSDSPRVTVPATSTASLRLSSESPGATAPAINGPEIDLVCLSDDE

SEQ ID NO: 8582 - protein, 157 aa, Saccharum officinarum
MGFVSFVGRVLFVAAFLLSAYQEFNEFGTDGGPAAKALQPKFNVFVKNISAHLGVAVPHIELKHVIAATIGLKGLGSLLFILSSSLGAYLLLFYLALITPIIHDFYNYDMEKAEFAQLFGKFTQDVALIGALLFFLGMKNSIPKRQGKKKAPKAKTN

SEQ ID NO: 8583 - protein, 158 aa, Zea mays
MGFVSFVGRVLFVAAFLLSAYQEFNEFGADGGPAAKALRPKFNVFVKNVSAHLGVAVPHIELKHVIAATIGLKGLGSLLFILSSSLGAYLLLLYLALITPIIHDFYNYDMEKAEFAGLFAKFTQDLALIGALLFFLGMKNSIPKRQGGKKKAPKAKTN

SEQ ID NO: 8584 - protein, 157 aa, Sorghum bicolor
MGFVSFVGRVLFVAAFLLSAYQEFNEFGTDGGPAAKALQPKFNVFVKNISAQLGVAVPHIELKHVIAATIGLKGLGSLLFILSSSLGAYLLLFYLALITPIIHDFYNYDMEKAEFAQLFGKFTQDVALIGALLFFLGMKNSIPKRQGKKKAAKAKTN

SEQ ID NO: 8585 - protein, 157 aa, Cenchrus ciliaris
MGFVSFVGRVLFVAAFLLSAYQEFNEFGTDGGPAAKALQPKFNVFVKNISSHLGVAVPHIELKHVIAATIALKGLGGLLFILSSSLGAYLLLLYLAFITPIVHDFYNYDMEKAEFAQIFGKFTQDLALIGALLFFLGMKNSIPKRQAKKKAPKAKTN

SEQ ID NO: 8586 - protein, 157 aa, Setaria italica
MGFVSFVGRVLFVAAFLLSAYQEFNEFGTDGGPAAKALQPKFNVFVKNISSHLGVAVPHIELKHVIAATIALKGLGGLLFILSSSLGAYLLLLYLAFVTPIVHDFYNYDMEKAEFAQIFGKFTQDLALIGALLFFLGMKNSIPKRQAKKKAPKAKTN

SEQ ID NO: 8587 - protein, 157 aa, Pennisetum glaucum
MGFVSFVGRVLFVAAFLLSAYQEFNEFGTDGGPAAKALKPKFNVFVKNISSHLGVAVPHVELKHVIAATIALKGLGGLLFILSSSLGAYLLLLYLAFITPIVHDFYNYDMEKAEFAQIFGKFTQDLALIGALLFFLGMKNSIPKRQAKKKASKAKTN

SEQ ID NO: 8588 - protein, 157 aa, Panicum virgatum
MGFVSFVGRVLFVAAFLLSAYQEFNEFGTDGGPAAKALQPKFNVFVKNISSHLGVAVPHIELKHVIAATIALKGLGGLLFILSCSLGAYLLLLYLAIVTPIVHDFYNYDMEKAEFAQIFGKFTQDLALIGALLFFLGMKNSIPKRQAKKKAPKAKTN

SEQ ID NO: 8589 - protein, 157 aa, Panicum virgatum
MGFVSFVGRVLFVAAFLLSAYQEFNEFGTDGGPAAKALQPKFNVFVKNISSHLGVAVPHIELKHVIAATIALKGLGGLLFILSCSLGAYLLLLYLAFVTPIVHDFYNYDMEKAEFAQIFGKFTQDLALIGALLFFLGMKNSIPKRQAKKKAPKAKTN

SEQ ID NO: 8590 - protein, 157 aa, Panicum virgatum
MGFVSFVERVLFVAAFLLSAYQEFNEFGTDGGPAAKALQPKFNVFVKNISSHLGVAVPHIELKHVIAATIALKGLGGLLFIFSCSLGAYLLLLYLAFVTPIVHDFYNYDMEKGEFAQIFGKFTQDLALIGALLFFLGMKNSIPKRQAKKKAPKAKTN

SEQ ID NO: 8591 - protein, 157 aa, Zea mays
MGSVSFVGRVLFVAAFLLSAYQELNEFGANGGPTSKAIQPKFNVFIKNVSAHLGVAVPHIELKHVIAATIGLKGLGSLLFILSSSLGAYLLLLYLALITPIIHDFYNYDMEKAEFAGLFAKFTQDLALIGALLFFLGMKNSIPKRQGRQEVPKAKTN

SEQ ID NO: 8592 - protein, 157 aa, Oryza sativa
MGFVSFAGRVLFASVFLLSAYQEFSEFGADGGPAAKALRPKYNVFTKNISAHLGVAVPHVELKHIVAATIGLKGLGGLLFILSSSFGAYLLLIYLAFITPVVYDFYNYDMEKSEFVQLFMKFTQNLALFGALLFFLGMKNSIPKRQAKKKAPKSKTN

SEQ ID NO: 8593 - protein, 157 aa, Festuca arundinacea
MGFVSFIGRVLFASVFLLSAYQEFNEFGTDGGPAAKALKPKFNSFTKNISAQLGVVVPHVELKHVIAATIGLKGLGGLLFIVSSSFGAYLLALYLAFITPVVYDFYNYDMEKAEFVQLFIKFTQNVALFGALLFFLGMKNSIPKRQPKKKTAKSKTN

SEQ ID NO: 8594 - protein, 231 aa, Oryza sativa
MGGGGECDGAENQRWPPWLKPLLATSFFGQCKLHADSHKSECNMYCLDCMNGALCSQCLSYHRDHHAIQIRRSSYHDVIRVSEIQKVLDITGVQTYIINSARVVFLNERPQPRPGKGVTNTCEVCERSLLDTFRFCSLGCKIVGTSGDYRGRKRHAGGGIKKTKKLHKGAAAVPSDSDDSSTTTSGGSDKSSVVQSFTPSTPPATANSYRTGKRRKGVPHRSPFGSLMVEF

SEQ ID NO: 8595 - protein, 234 aa, Sorghum bicolor
MGGGGCDGAENQRWPPWLKPLLGTSFFGQCKVHADAHKSECNMYCLDCMNGALCSQCLAYHRDHHAIQIRRSSYHDVIRVSEIQKVLDITGVQTYIINSARVVFLNERPQPRPGKGVTNTCEVCERSLLDTFRFCSLGCKIVGTSGDFRIRKKHVVVTKKKKQAQHQHQHRGAAAASESEDDSSTSTSGGSDKSSVVQSFTPSTPPATANSFRTGKRRKGVPHRSPFGNLMVEF

SEQ ID NO: 8596 - protein, 230 aa, Panicum virgatum
MGGGECGGAENQRWPPWLKPLLGTSFFGQCKLHADAHKSECNMYCLDCMNGALCSQCLAYHRDHHAIQIRRSSYHDVIRVSEIQKVLDITGVQTYIINSARVVFLNERPQPRPGKGVTNTCEVCERSLLDTFRFCSLGCKIVGTSGEFRIRKKHAAIRRKKRPQHKVGAAAASDSEGDSSTSTSGGSDKSSVVQSFTPSTPPATANSFRAGKRRKGVPHRSPFGSLMVEF

SEQ ID NO: 8597 - protein, 232 aa, Setaria italica
MGGGECDGAENQRWPPWLKPLLGTSFFGQCKLHADAHKSECNMYCLDCMNGALCSQCLAYHRDHHAIQIRRSSYHDVIRVSEIQKVLDITGVQTYIINSARVVFLNERPQPRPGKGVTNTCEVCERSLLDTFRFCSLGCKIVGTSGEFRIRKKHAAIKKKKKLPHKGGAAAAAASDSEDDSSTSTSGGSDKSSVVQSFTPSTPPATANSFRTGKRRKGVPHRSPFGSLMVEF

SEQ ID NO: 8598 - protein, 235 aa, Zea mays
MGGGECDGAENQRWPPWLKPLLGTSFFGQCKLHADAHKSECNMYCLACMNGALCSQCLAYHRDHHAIQIRRSSYHDVIRVSEIQKVLDISGVQTYIINSARVVFLNERPQQRPGKGVTNTCEVCQRSLLDTFRFCSLGCKIVGTSGDLRIRKKQAVVKKHQKKKKQQAQQHRGAALDSEDDSSSTSTSRGSDRSSVVQSFTPSTPPATANSFRTGKRRKGVPHRSPFGSLMVEEF

SEQ ID NO: 8599 - protein, 235 aa, Pennisetum glaucum
MGGAECDGPENQRWPPWLKPLLATSFFGPCKLHADAHKSECNMYCLDCMNGALCSQCLAYHRDHHAIQIRRSSYHDVIRVSEIQKVLDITGVQTYIINSARVVFLNERPQPRPGKGVTNTCDVCERSLLDTFRFCSLGCKIVGTSGEFRVRKKHAAVKKKKKLPSHKGGAAAAAAMASDSEDDSSTSTSGGSDKSSVVQSFTPSTPPATANSFRTGKRRKGVPHRSPFGSLMVEF

SEQ ID NO: 8600 - protein, 479 aa, Sorghum bicolor
SDLTVRFGSVTGGGTVTEAASKADAAAMRVVSRRGAVRLVLVSAIAWAMLGLVALAFHLRPCSSPVAFLSALCKKDSKVVSVLDSMGLQSKPLHRCPIPVVDDPDAVVIPKRTPNTIVKKLSYITVDKQDKDPSPLFGGRQNWKQREQSFKLNSTMKVHCGFMKSSGADMDIIDVKYIQKCKFVVASGIFDGYDIPHQPSNISRRSQKLFCFLMVVDEVSLDFIEKNTTVKIDNAGGKWVGLWRLITVHRLPFDEPRRNGKIPKILTHRLFPQAWYSIWIDGKMELIVDPLLILERYLWRGKYTFAVAAHKHHRSIYEEGDAIKRRKRYARPLVDLQMKMYYYEGMEPWSPKKKMPSDVPEGAVLIREHTTMTDLFSCLWFNEVNLFTPRDQISFGYVVHRLGDALKFFMFPNCEYNSLFILHRHTREHSSKVEWAKTIDEIVKKGLKESRGGLGLWTPYPADLSSVELPAVKRTSPAG

SEQ ID NO: 8601 - protein, 473 aa, Setaria italica
MAKRSRGGGGAEAALKADSAAMRLVWRRGAVRLVLVSAIAWAMLVLLALAFHLWSCSSSVAFLSALCKKDSKVLNVLDSMGLSSKPLHRCPIPVADDPNAVAIPKRTPNTIIKKLSYITIDKQDKDPSPLFGGRQNWKQREESFKLNSTMKVHCGFMKNSGADMDSVDVKYIQKCKFVVASGIFDGYDIPHQPSNISRRSQKLFCFLMVVDEVSLDFIEKNTTVKIDSNGGKWVGIWRLITVHRLPFDEPRRNGKIPKILTHRLFPQAWYSIWIDGKMELIVDPLLILERYLWRGKYTFAVAVHKHHRSIYEEGDAIKRRKRYARPLVDLQMKMYYYEGMEPWSSKKKMPSDVPEGAVLIREHTTMTDLFSCLWFNEVNLFTPRDQISFGYVVHRLGDSLKFFMFPNCEYNSLFILHKHTREHSSKVEWAKTIDEILKKGLKESRGGLGLWTPYPADLSSVELPAVKRISPAG

SEQ ID NO: 8602 - protein, 474 aa, Zea mays
MARRSRGGGIVTEAALKAHAAAVRVVSRRGAVRLVLVSAIAWAMLGLVALAFHLRPCSSPVAFLSALCEKDSKVFSVLDSMGLSSKPLHRCPIPVANDPNAIAIPKRTPNTIVKKLSYITVDKQDKDPSPLFGGHQNWKQREESFKLNSTMKVHCGFMKNSGADMDTIDLKYIQKCRFVVASGIFDGYDIPHQPSNISHRSQKLFCFLMVVDEVSLDFVQKNASVKIDSAGGKWVGIWRLIRVHRLPFDEPRRNGKIPKILTHRLFPEAWYSIWIDGKMELIVDPLLILERYLWRGKNTFAVAAHKHHRSIYEEGDAIKRRKRYARPLVDLQMKLYYYEGMEPWSPKKKMPSDVPEGAVLIREHTTMTDLFSCLWFNEVNLFTPRDQISFGYVVHRLGGALKFFMFPNCEYNSLFILHGHTREHSSKVEWAKTTDEIVKKGLKESRGGLGLWTPYPADLSSVEVPAVKRTSPAG

SEQ ID NO: 8603 - protein, 468 aa, Oryza sativa
MARRSKGGGAEGDGMRMQVVWRKGAVRLVLVSAIAWALLVILALAFHLWSCNSDVPFLSALCKKDSKVLYALDSIRSSSKPLHRCPIPVADDPDSITIPKRTPNTIVKRLSYITVDKQDKDPSPLFGGRQSWKQREDSFKLNATMKVHCGFMKNSGADMDDVDVKYIQKCKFVVASGIFDGYDIPHQPSNISIRSQKLFCFLMVVDEVSLDFIEKNTTVKFDKAGGKWVGIWRLITLHRLPFDEPRRNGKVPKILTHRLFPQAWYSIWIDGKMELIVDPLLILERYLWRGKYTFAVAVHKHHKSIYEEGDAIKRRKRYARPLVDLQMKMYYHEGMEPWNPKKRMPSDVPEGAVLIREHTTMSDLFSCLWFNEVNLFTPRDQLSFGYVVYRLGDALKFFMFPNCEYNSLFILHRHTREHSSKVEWAKTIDEIVKKGLKESKGGLGLWTPYPADLSSVELPSVKRTSPAG

SEQ ID NO: 8604 - protein, 472 aa, Brachypodium distachyon
MGRRSRGGDAAAAAAAKGEGMRVVWRKGAVRLVFVSAIAWALLVLLSLAFHLWSCTSSVSFLSALCKTDSKVLQVLDSMEVSSKPLHRCSIPVADDPDAVVIPKRTPNAIVKKLSYITVDKQDKDSPPLFGGRQNWKQREESFKLNATMKVHCGFMKNSGADMDDVDVEYIQKCKFVVASGIFDGYDIPHQPSNISLRSQKLFCFLMVVDEVSLDFIEKNVTVKVDSAGGKWVGIWRLVTLHRLPFDEPRRNGKVPKILTHRLFPRAWYSIWIDGKMELMVDPLLILERYLWRGKYTFAVAVHKHHRSIYEEGDAIKRRKRYARPLVDLQMKIYYHEGMEPWDANKRMPSDIPEGAVLIREHTTIADLFSCLWFNEVNLFTPRDQLSFGYVVYRLGDTLRFFMFPNCEYNSLFILHRHTREHSSKVEWAKTIDEIVKKGLKESRGGLGLWTPYPADLSSVELPAVKRTSQAG

SEQ ID NO: 8605 - protein, 465 aa, Secale cereale
MARRGKSGGGGGVGDAAWRRGSARPRLLAVSAVAWALLLLAFHLWSCASPAAYSLSALCGKDSKVLRASDPTGPASKPLHRCSIPVADDPDAVVIPERTPNAIVKKLSYLTVDKRDKDSPPLFGGRQSWKQREESFKLNATMKVHCGFMKNSGADMDEIDVEYIQKCKFVVASGIFDGYDIPHQPSNISLRSQKLFCFLMVVDEVSLDFIEQNVTVKVDSAGGKWVGIWRLVTLHRPPFDEPRRNGKVPKILTHRLFPQAWYSIWIDGKMELMVDPLLILERYLWRGKYTFAVAVHKHHRSIYEEGDAIKRRKRYARPLVDLQMKIYYHEGMEPWEAKKRTPSDIPEGAVLIREHTTITDLFSCLWFNEVNLFTPRDQLSFGYVVHRLGDALRFFMFPNCEYNSLFILHRHTREHSSKVEWAKTLDEIVKKGLKESRGGLGLWTPYPADLNSVDLPAVKRTSQAG

SEQ ID NO: 8606 - protein, 170 aa, Sorghum bicolor
MDQVLNKVGSYWFSKRASKEIDSIGDDISSISSSIGGSAKWMVNKIKGKMQKALPDLLKEYDMPAGLFPRDATNYEFNEETKKLTVYIPSACDVGYKDSSVLRFFTCVTGYLEKGKFSDIEGMKTKVLVWTKVTAIKTEGPKVHFTAGVKKTRSRDAYEVVRDGITIDKF

SEQ ID NO: 8607 - protein, 170 aa, Saccharum officinarum
MDQVLNKVGSYWFSKRASKEIDSIGDDISSISSSIGGSAKWMVNKIKGKMQKALPDLLKEYDMPAGLFPRDATNYEFNEETKKLTVYIPSACDVGYKDSSVLRFFTCVTGYLEKGKFSDIEGMKTKVLVWTKVTAIKTEGPKVHFTAGVKKTRSRDAYDVVRDGITIDKF

SEQ ID NO: 8608 - protein, 83 aa, Setaria italica
MDQVLNKVGSYWFSKRASKEIDSIGSDISSISSSIGGSAKWMVNKIKGKMQKALPDLSRNMTCQQASSHVMQLTMSSMRRQRS

SEQ ID NO: 8609 - protein, 170 aa, Panicum virgatum
MDQVLNKVGSYWFGKRASKEIDSIGDDISSISSSIGGSAKWMVNKIKGKMQKALPDLLKEYDMPAGLFPRDATNYEFNEETKKLTVYIPSACDVGYKDSSVLRFFTCVTGYLEKGKFSDIEGMKTKVLVWTKVTTIKTEGSKVHFTAGVKKTRSRDAYEVVRDGITIDKF

SEQ ID NO: 8610 - protein, 170 aa, Pennisetum glaucum
MDQVLNKVGSYWFSKRASKEIDSIGSDISSISSSIGGSAKWMVNKIKGKMQKALPDLLKEYDMPAGLFPRDATNYEFNEETKKLTVYIPSACDVGYKDSSVLRFFTCVTGYLEKGKFSDIEGLKTKVLVWTKVTAIKAEGPKVHFTAGVKKTRSRDAYEVVRDGIPIDKF

SEQ ID NO: 8611 - protein, 170 aa, Panicum virgatum
MDQVLNKVGSYWFSKRASREIDSIGDDISSISSSIGESAKWMVNKIRGKMQKALPDLLKEYDMPAGLFPRDATNYEFNEETKKLTVYIPSACDVGYKDSSVLRFFTCVTGYLEKGKFSDIEGMKTKVLVWTKVTTIKTEGSKVHFTAGVKKTRSRDAYEVVRDGITIDKF

SEQ ID NO: 8612 - protein, 170 aa, Oryza sativa
MDQVLNKVGSYWFSKRASKEIDSIGDDISSISTSIGTGAKWMVNKIKGKMQKALPDLLKEYDMPAGLFPRDATNYEFNEETKKLTVYIPSACDVGYKDSSVLRFFTCVTGYLEKGKLSDIEGLKTKVLVWTKVTAIKTEGSKVHFTAGVKKTRSRDAYEVVRDGIPIDKF

SEQ ID NO: 8613 - protein, 170 aa, Cynodon dactylon
MDQVLNKVGSYWFSKRANKEIDSIGDDISSISSSIGESAKWMVNKLKGKMQKALPELLKEYDLPAGLFPRDATNYEFNEETKKLTVYIPSSCDVGYKDSSVLRFFTCVTGYLEKGKFSDIEGLKTKVLVWTKVTAIKTEGSKVHFTAGMKKTRSRDAYEVVRDGITIDKF

SEQ ID NO: 8614 - protein, 170 aa, Eragrostis curvula
  misc_feature (161)..(161): Xaa can be any naturally occurring amino acid
MDQVLNKVGSYWFSKRANKEIDSIGNDISSISTSIGDGAKWMVNKLKGKMQKALPELLKEYDMPAGLFPRDATNYEFNEETKKLTVYIPSACDVGYKDSSVLRFFTCVTGYLEKGKFSDIEGMKTKVLVWTKVTAIKTEGSKVHFTAGVKKTRSRDAYEVXRDGITIDKF

SEQ ID NO: 8615 - protein, 170 aa, Unknown
  Sequence found in Organisms: Lolium multiflorum, Pseudoroegneria spicata, Secale cereale, Triticum aestivum
MDQVLNKVGSYWFSKRASKEIDSIGDDLNSVSSSIGGGAKWMVNKIKGKLQKALPDLLKEYDMPAGLFPRDTTNYEFNEETKKLTVYIPSACDVGYKDSSVVRFFTCVTGYLEKGKLSDIEGMKTKVLVWTKVTSIKTEGSKVHFTAGMKKTRSRDAYEVVRDGIIIDKF

SEQ ID NO: 8616 - protein, 170 aa, Avena sativa
MDQVLNKVGSYWFGKRASKEIDSIGDDLSSVSSSIGGGAKWMVNKIKGKLQKALPDLLKEYDMPAGLFPRDTTNYEFNEETKKLTVYIPSACDVGYKDSSVVRFFTCVTGYLEKGKLSDIEGMKTKVLVWTKVTSIKTEGSKVHFTAGMKKTRSRDAYEVVRDGIIIDKF

SEQ ID NO: 8617 - protein, 170 aa, Hordeum vulgare
MDQVLNKVGSYWFSKRATKEIDSIGDDLNSVSSSIGGGAKWMVNKIKGKLQKALPDLLKEYDMPAGLFPRDTTNYEFNEETKKLTVYIPSACDVGYKDSSVVRFFTCVTGYLEKGKLSDIEGMKTKVLVWTKVTSIKTEGSKVHFTAGMKKTRSRDAYEVVRDGIIIDKF

SEQ ID NO: 8618 - protein, 170 aa, Festuca arundinacea
  misc_feature (139)..(139): Xaa can be any naturally occurring amino acid
MDQVLNKVGSYWFSKRASKEIDSIGDDLNSVSSSIGGGAKWMVNKIKGKLQKALPDLLKEYDMPAGLFPRDTTNYEFNEETKKLTVYIPSACDVGYKDSSVVRFFTCVTGYLEKGKLSDIEGMKTKVLVWTKVTSIKTXGSKVHFTAGMKKTRSRDAYEVVRDGIIIDKF

SEQ ID NO: 8619 - protein, 170 aa, Avena sativa
MDQVLNKVGSYWFGKRASKEIDSIGDDLSSVSSSIGGGAKWMVNKIKGKLQKALPDLLKEYDMPAGLFPRDTTNYEFNEEIKKLTVYIPSACDVGYKDSSVVRFFTCVTGYLEKGKLSDIEGMKTKVLVWTKVTSIKTEGSKVHFTAGMKKTRSRDAYEVVRDGIIIDKF

SEQ ID NO: 8620 - protein, 170 aa, Triticum aestivum
MDQVLNKVGSYWFSKRASKEIDSIGDDLNSVSSSIGGGAKWMVNKIKGKLQKALPDLLKEYDMPAGLFPRDTTNYEFNEETKKLTVYIPSACDVGYKDSSVVRFFTCVTGYLEKGKLSEIEGMKTKVLVWTKVTSIKTEGSKVHFTAGMKKTRSRDAYEVVRDGIIIDKF

SEQ ID NO: 8621 - protein, 170 aa, Brachypodium distachyon
MDQVLNKVGSYWFSKKASKEIDSIGDDLNSVSSSIGGGAKWMVNKIKGKLQKALPDLLKEYDMPTGLFPRDTTNYEFNQETKKLTVYIPSACDVGYKDSSVVRFFTCVTGYLEKGKLSDIEGMKTKVLVWTKVTSIKTEGSKLHFTAGMKKTRSRDAYEVIRDGIVIDKF

SEQ ID NO: 8622 - protein, 170 aa, Elaeis guineensis
MDQILNKVGSYWFSKRANKEISSVGDDINSLSSSIEGGAKWLVNKIKGKMQKPLPDLLREYDLPAGLFPRDATNYEFNEETGKLTVFIPSVCEVGYKDSSVLRFFTSVTGYLEKGKLADIEGMKTKILVWAKVTGVTTEGSKVNFTSSVKKTRSRDAYEVLRDGISVDKF

SEQ ID NO: 8623 - protein, 96 aa, Brachypodium distachyon
VLNKVGSYWFSKKASKQIHSISDDLNSVYSSIGGGAKWMVNKIKGKLQKALPDLLKEYDMPAGLFPRDTTNYEFNQETKNLTVGTRTHQLCGSSPV

SEQ ID NO: 8624 - protein, 375 aa, Sorghum bicolor
MPAIPTAPAPSPSSFLLARRHSLHVSYPSPSSNHQRLPPRLLRLPARPQAAPMSAVARAPASPVAPPAHPTYDLKAVIALALAEDAGDRGDVSCLATIPSDVEAEATFIAKADGVIAGISLADMIFNQVDPSLKVEWFESDGNYVHKGLQFGKVYGCARSIIVAERVVLNFMQRMSGIATLTKAMSDAARPACILETRKTAPGLRLVDKWAVLIGGGKNHRLGLFDMVMIKDNHISVAGGIANAMRSVDQFLQKEKLTIPVEVETRTIEEVKDLLKYAAENKTSLTRIMLDNMAVPLANGDVDVSMLKDAVQLINGRFETEASGNVTIDTVKKIGETGVTYISSGALTHSVKALDISLKIDTELALQVGRRTNRA

SEQ ID NO: 8625 - protein, 348 aa, Setaria italica
MPAIPAAPDCFLLARRHRLAFTSPSPSSNHQRLHPTRLLRLPARPRAAPMAAEARAPAPPVLGDVSCLATIPSDVEAEATFIAKADGVIAGISLADMIFNQVDPSLKVEWFESDGNYVHKGLQFGKVYGCARSIIVAERVVLNFMQRMSGIATLTKAMSDAARPASILETRKTAPGLRLVDKWAVLIGGGKNHRLGLFDMVMIKDNHISVAGGIANAMRSVDQFLEKEKLTIPVEVETRTIEEVKDVLKYAAENKTSLTRIMLDNMVVPLTNGDVDVSMLKDAVQLINGRFETEASGNVTIDTVKKIGETGVTYISSGALTHSVKALDISLKIDTELALQVGRRTNRA

SEQ ID NO: 8626 - protein, 369 aa, Brachypodium distachyon
MPAIPAAAAPSPDAVVARHHLLHPAPISFSSSTRLRLPARPRAAPSMSAEARPAPSAVAPPAHPTYDLSAVIALALSEDAGDRGDVSCLATIPTDVKAEATFIAKEDGVIAGINLAEMIFNQVDPLLKVEWLEGDGNYVCKGLQFGKVYGCARSIIVAERVVLNFMQRMSGIATMTKAMADAARPACILETRKTAPGLRLVDKWAVLIGGGKNHRLGLFDMVMIKDNHISVAGGITNAMVSVDQFLESEKLAVPVEVETRTLEEVKDLLKYTDENKTSLTRIMLDNMVVPLPNGDIDVSMLKDAVQLINGRFETEASGNVTIDTVKKIGETGVTYISSGALTHSVKALDISLKIDTELALQVGRRTNRA

SEQ ID NO: 8627 - protein, 371 aa, Oryza sativa
MPAAAAAAAPPNPNVLQLAPRLRGLVSFPSSYSSSSPFSNRLRLRLPRAASMSAEARVPVAPPAHPTYDLKAVINLALSEDAGDRGDVSCLATIPSDVKAEATFIAKEDGVVAGISLADMIFKQVDPSLKVEWFESDGNYVHKGLQFGRVYGCARNIIVAERVVLNFMQRMSGIATMTKAMADAAHPACILETRKTAPGLRLVDKWAVLIGGGKNHRIGLFDMVMIKDNHISVAGGITNAMKFVDRFLAKEKLALPVEVETRTLQEVKDLLEYAAENNTSLTRIMLDNMVVPLGNGDIDVSMLKDAVELINGRFETEASGNVTIDTVKKIGETGVTYISSGALTHSVKALDISLKIDTELALQVGRRTNRA

SEQ ID NO: 8628 - protein, 358 aa, Secale cereale
HLPSSSSSSSARSGNPRPSARLRLPARPRAAPSASMSAEARPAPSPVPPPAHPTYDLSAVIALALSEDAGDRGDVSCLATIPTDVKAEATFIAKEDGVIAGISLAEMIFNQVDPSLKVEWFEADGNYVHKGLQFGKVYGCAQSIIVAERVVLNFMQRMSGIATMTKAMADAARPACILETRKTAPGLRLVDKWAVLIGGGKNHRLGLFDMVMIKDNHISVAGGITNAMTSVDQFLEKENLAVPVEVETRTLEEVRDLLKYTDENKTSLTRIMLDNMVVPLPNGDLDVSMLRDAVQLINGRFETEASGNVTIDTVKKIGETGVTYISSGALTHSVKALDISLKIDTELALQVGRRTNRA

SEQ ID NO: 8629 - protein, 316 aa, Pennisetum glaucum
PAPPVAPPAHPTYDLRAVIALALSEDAGDRGDVSCLATIPSDVEAEATFIAKADGVIAGISLADMIFNQVDPSLKVEWFVSDGNYVHKGLQFGKVYGCARSIIVAERVVLNFMQRMSGIATLTKAMSDAAHPACILETRKTAPGLRLVDKWAVLIGGGKNHRLGLFDMVMIKDNHISVAGGIANAIRSVDQFLEKEKLTIPVEVETRTIEEVKDILKYAAENKTSLTRIMLDNMVVPLPNGDVDVSMLKDAVQLINGRFETEASGNVTIDTVKKIGETGVTYISSGALTHSVKALDISLKIDTELALQVGRRTNRA

SEQ ID NO: 8630 - protein, 357 aa, Secale cereale
APPLLLLLLGALRQPAPIRPPAPARAPPRRPLGIHVRRGAAGPSPVPPPAHPTYDLSAVIALALSEDAGDRGDVSCLATIPTDVKAEATFIAKEDGVIAGISLAEMIFKQVDPSLKVEWFEADGNYVHKGLQFGKVYGCAQSIIVAERVVLNFMQRMSGIATMTKAMADAARPACILETRKTAPGLRLVDKWAVLIGGGKNHRLGLFDMVMIKDNHISVAGGITNAMTSVDQFLEKENLAVPVEVETRTLEEVRDLLKYTDENKTSLTRIMLDNMVVPLPNGDLDVSMLEDAVQLINGRFETEASGNVTIDTVKKIGETGVTYISSGALTHSVKALDISLKIDTELALQVGRRTNRA

SEQ ID NO: 8631 - protein, 153 aa, Zea mays
MSPVEFEPSVSDDLVLEKKSGNGQHDVRGTHHHRTSMKPEKPIDLLRKVDGNNMCANCGASEPDWASLNPGALLCIECSGVHRNLGVHISKVRSLTLDVRVWEPSVINLFQSLSNMFVNSIWEETLPDDNSSADGSDTSQYLSVSKPNLFMRI

SEQ ID NO: 8632 - protein, 824 aa, Sorghum bicolor
MYFSKLDDSPMFRTQIQSLEESAELLRERCLKFHKGCRKYTEGLGEAYDGDIAFASSLETFGGGHNDPISVAFGGPVMTKFTIALREIGTYKEVLRSQVEHMLNDRLLNFVDIDLHDVKDAHKRFDKASLLYDQIREKYLSLKKGTRPDITTAIEDELHSARSSFEQARFNLVTSLSHVEAKKRFEFLEAVSATMDSHLRYFKQGYELLHQMEPYINQVLAYAQQSRERANKEQASLVERMHEYKRQIDRESRSSINGLNDSYNGDGIQTIGRSSHKQIEAVMQSTSKGKVQTIRQGYLSKRSSNLRADWKRRFFVLDSRGMLYYYRKQITRPPAGCSMQRSVNPPEHGSGLLSRLFSSHYHGIIHDEKSVARHTVNLLTSTIKVDAEQSDLRFCFRIISPTKIYTLQAESAVDQMDWIEKITGVIASLLSSQSPEQCFLSSPKGSGHDRSTSDGSSFTSSVEFEPSTIDDLVLEKYSGNGQHDVRGTHHHRTSVKPEKPIDLLRKVDGNNMCADCGASEPDWASLNLGALLCIECSGVHRNLGVHISKVRSLTLDVRVWEPSVINLFQSLGNMFVNNIWEEMLPDDNSSADGSDTSQYLSVSKPKHKDVFSAKEKFIHAKYVNKEFIRNHSMDENQLAQQMWNSVAANDKKAAYSLIVRSRPNVNLVYGEMPSSPFLTLGKALQQEQPASPHDGSPRFFDCNSHDKISPREPLSPASTSSRTDDMEDTCEGLSLFHLACRVADVGMVELLLQYGASVNMNDSRGRTPLHHCILKGRHQHAKLLLSRGADSQAMDRDGRTALQYAIDSGTSDEDILALLEDHSR

SEQ ID NO: 8633 - protein, 381 aa, Saccharum officinarum
NLLTSTIKVDAEQSDLRFCFRIISPTKIYTLQAESAVDQMDWIEKITGVIASLLSSQSPEQCFMSSPKGSGHDRSTSDASSFTSSVEFEPSVIDDLVLEKNSGNGQHDVRGTHHHRTSMKPEKPIDLLRKVDGNNMCADCGASEPDWASLNLGALLCIECSGVHRNLGVHISKVRSLTLDVRVWEPSVINLFQSLGNMFVNNIWEEMLSDDNSSADGSDTSQYLSVSKPKHKDVFSAKEKFIHAKYVDKEFIRNHGMDENQLAQQMWNSVAANDKKAAYSLIVRSRANVNLVYGEMPSSPFLTLGKALQQEQPASPHDGSPRFFDCNSHDKISPREPLSPASTKSRTDEKEDKCEGLPLLHLAYRVANVGMVELLLHMVLM

SEQ ID NO: 8634 - protein, 303 aa, Zea mays
FVMYYFQVQTIRQGYLSKRSSNLRADWKRRFFVLDSRGMLYYYRKQITRPPAGCSMQRSVNPPEHGSGLLSRLFSSHYHGIVHDEKSVARHTVNLLTSTIKVDADQSDLRFCFRIISPTKIYTLQAESAVDQMDWIEKITGVIASLLNSQSPEQCFLSSPKGSGHDRSTSDGSSFTSSVEFEPSVSDDLVLEKKSGNGQHDVRGTHHHRTSTKPEKPIDLLRKVDGNNMCADCGASEPDWASLNLGALLCIECSGVHRNLGVHISKVRSLTLDVRVWGAICNQSLSVIRQHVCQQYLGRDAAR

SEQ ID NO: 8635 - protein, 172 aa, Zea mays
DLCMSPVEFQPSVSEDLVLEKKSGNGQHDVRGTHHHRTNMKPEKPIDLLRKVDGNNMCADCGASEPDWASLNLGALLCIECSGVHRNLGVHISKVRSLTLDVRVWEPSVINLFQSLGNMFVNSIWEETLPDDNSSADGSDTSQYLSVSKPKHKDVFSAKEKFIHAKVFTTFT

SEQ ID NO: 8636 - protein, 128 aa, Saccharum officinarum
MDGKNLSNKQQAEQKNPDAVTDSIPSQDQEALNPFPDSDDGNTSPLNGHEADVNMEAAISTEDVIRAGGFGAKDDIGSLLPTAIDSTDFEASLRDARDFEGEKEAPAHPGLGWKGEKVDDGSKLSDVA

SEQ ID NO: 8637 - protein, 127 aa, Sorghum bicolor
MDGKNFSNKQQAEQKNPDAVTDSVPSQSQEALNPSDDGNTSPINGHEADVNMEASISTEDVIRAGGFGAKDDIGSLLPTAIDSTDFEASLRDARDFEGEKEAPSHPGLGWKGDKADDGSKLSDVPQQ

SEQ ID NO: 8638 - protein, 201 aa, Sorghum bicolor
MELCVSTTTASVRATTAAPISFAPPRRGGASASTALPVHHRRIPTRGWRCAASAAVPDPVPSEEPASASYTVVVTDKPDTPADDKVEEVSAAPSGSAEAPVAELVSSEASPSPDGGGLDEILSKLNIEVTPTLILTGSAAFVALWILSSVVAAIDSVPLLPKLLELVGTGYSIWFIARYLLFKESRDDLFAKFEDLIQRIV

SEQ ID NO: 8639 - protein, 211 aa, Sorghum bicolor
MELCVSTTTASVRATTAAPISFAPPRRGGASASTALPVHHRRIPTRGWRCAASAAVPDPVPSEEPASASYTVVVTDKPDTPADDKVEEVSAAPSGSAEAPVAELVSSEASPSPDGGGLDEILSKLNIEVTPTLILTGSAAFVALWILSSVVAAIDSVPLLPKLLELVGTGYSIWFIARYLLFKVHLFLMELFKESRDDLFAKFEDLIQRIV

SEQ ID NO: 8640 - protein, 198 aa, Zea mays
MELCVSTTASVRATAAPISFAPPRRGASASTALPLHRRIPTRGWCCASAAVPDPAPSEELASASYTVVVADKPDSPADDKVDEVSAAPSGSAEAPVAEPVSSEASPSPSTDDGGLDEILSKLNIEVTPILILTGSGAFVALWILSSVVSAVDSVPLLPKLLELVGTGYSIWFTARHLLFKESRDGMFAKFKDIKERII

SEQ ID NO: 8641 - protein, 211 aa, Saccharum officinarum
MELCVSTTASSVRATAAPISFAPPRRGASASTAVPLHRRIPTRGWRCASAAVPDPVSSEEPASASASYTVVVTDKPDTPANDKVEGVSAAPSGSAEAPVAELVSSEASPSPSPDDGGLDEILSKLNIEVTPTLILTGSAAFVALWVLSSVVAAIDSVPLLPKLLELVGTGYSIWFITRYLLFKVHLFLMELFKESRDDLFAKFEDLIQRII

SEQ ID NO: 8642 - protein, 332 aa, Zea mays
MASSKPLFPFPVPAPDPSDEVVREFGPLLRVYKSGRIERPLVAPPVEPGHDAATGVQSKDVHLGSYSARLYLPPVADAGAKLPVVVFVHGGGFVAESAASPNYHLFLNRLAAACPALAVSVDYRLAPEHPLPAGYDDCLAALKWVLSAADPWVAAHGDLARVFVAGDSAGGNVCHYLAIHPDVVQAQQQGCPPPLKGAVLIHPWFWGSEAVGEEPRDPAVRTMGAGLWFFACPDANSMEDPRMNPMAPAAPGLHTLACERVMVCTAEGDFLRWRGRAYAEAVAAARGGRLGQAAGVELLETMGEGHVFFLFKPDCDKAKEMLDKMAAFINAP

SEQ ID NO: 8643 - protein, 341 aa, Sorghum bicolor
MASSKPSLSLPFPIPAPDPSDEVVREFGPLLRIYKSGRIERPLVAPPVDPGHDAATGVQSKDVHLGSYSARLYLPPVAASSAKLPVVVYVHGGGFVAESAASPGYHLFLNRLAAACPALVVSVDYRLAPEHPLPAGYDDCLAALKWVLSAADPWVAAHGDLARVFVAGDSAGGNVCHYLAIHPDVVVVAGPQPRPLKGAVLIHPWFWGSEAVGEETTDPAARAMGAGLWFFACPDTSGMDDPRMNPMAPAAPGLHTLACDRVLVCAAEGDFLRWRGRAYAEAVAAARGGGGGGLGDANANAGGGVELLETMGEGHVFYLFKPDCDKAKEMMDKMVAFINAP

SEQ ID NO: 8644 - protein, 546 aa, Sorghum bicolor
MGEPLLTSLSMENSNSHPCTLLSMDPAGSHPASAESSGGGGVATNGVGVGVGSGGDRELFIIPRRESAHPGPPDINLPLSADPLPPPPSWSLDTFDILDVTLGTHNYESEVALALPKSTGNSNGNGSATIGVGARKCAKRGDSIWGAWFFFNHYFKPALVEKPKGKMTRDASGSISGFDKSDLRLDVFLVQHDMENMYMWVFKERPDNALGKMQLRSFMNGHSKHGEPSFPFSADKGFARSHRMQRKHYRGLSNPQCLHGIEIVGSPNLSAVPEADLKRWAELTGRELNFSIPSEASDFESWRNLPSTDFELDRPHPPAAKSATHGSHSHKKGLNGSGLNLSTPPSSDDGMDLSPKCAKRRKDFFGHSVEEDCVMANNSCSDREQEVEAHTGEPSWMHEFTGVAKHASGPVTAAKTIYEDEEGYLIVVSMLFSDPHSVKVSWRNTLTHGIVKITCVSTARMPYIKRHDRMFKLTDPFPEHCPPGEFVREIPLATRIPEDAKIEAYYDETGTGLEIMVPKHRVGPEEHEVQVCMRPPHLGDNDLVLS

SEQ ID NO: 8645 - protein, 542 aa, Zea mays
MGEPLLTSLSMENSNSHPCTLLSMDPAGSRPASAESSGGGGAATNGVGSGGDRELFIVPRRESAHPGPPDINLPLSADPLPPPPSWSLDTFDILDVTLGTHNYESEVALTLPKSTGNGNGSATATVSVGTRKCAKRGDSIWGAWFFFNHYFKPALVEKPKGKVTRDASGSISGFDKSDLRLDVFLVQHDMENMYMWVFKERPDNALGKMQLRSFMNGHSKHGEPSFPFSADKGFSRSHRMQRKQYRGLSNPQCLHGIEIVGSPNLSAVPDADLKRWAELTGRELNFSIPSEASDFEAWRNLPSTDFELDRPHPPAAKSATHGSHSHKKGLNGSGLNLSTPPSSDDGMDLSPKCAKRRKGFFGHGVEEDCVMANNSCSDREQEVEAHAGEPSWMHEFTGVAKHASGPVTAAKTIYEDEEGYLIVVSMLFSDPHSVKVSWRNTLTHGIVKITCVSTARMPYIKRHDRTFKLTDPSPEHCPPGEFVREIPLATRIPEDAKIEAYYDETGTGLEIMVPKHRVGPEEHEVRVCMRPPHLGDSDLVLS

SEQ ID NO: 8646 - protein, 537 aa, Setaria italica
MGEPLLTSLSMENSNSHPCTRLSMDPAGSHPASTGSSGGGGATNGVGSGGDREPFVIPLRESARPGAPDINLPLSADPSQPPPSWSLDAFEILDVTLGTHNYESEVVLTLPKSTGNGSATVGVGARKCAKRGDSIWGAWFFFNHYFRPALVEKPKGKVTRDASGCISGFDKSDLRLDVFLVQHDMENMYMWVFKERPDNALGKMQLRSFMNGHSKHGEPSFPFSADKGFARSHRMQRKHYRGLSNPQCLHGIEIVVSPNLSAVPEAELKRWAELTGRELNFSIPSEASDFESWRNLPSTDFELDRPHPPASKSAAHGSHSHKKGLNGSGLNLSTPPSSDDGMDLSPKCAKRRKDFFGHGVEEDCVMANNSCSDREQEVEAHTGEPSWMHEFTGVAKHASGPVTAAKTIYEDDEGYLIVVSMLFSDPHSVRVTWRNTLTHGIVKITCVSTARMPVIKRHDRTFKLTDPFPEHCPPGEFVREIPLATRIPEDAKIEAYYDETGTGLEIMVPKHRVGPEEHEVQVCMRPPHLGDNDLVLS

SEQ ID NO: 8647 - protein, 540 aa, Secale cereale
MGGEPLLTSLSMENSNSHPCTLLSMDPAGSHPASADSSGGGGAVNGVGAGADRELFIIPRHESVRQGPPDINVPLSADPSPPPALWSLDTFDIFDVGLGTHTHESEVALTLPKSSGNGSAAVGVGARKCAKRGDSIWGAWFFFNHYFRPALVEKAKEKVTRDASGSITGFDKSDLRLDVFLVQHDMENLYMWVFKERPDNALGKMQLRSFMNGHSKHGEPSFPFSADKGFSRSHRMQRKHYRGLSNPQCLHGIEIVNSPNLSAVPEADMKRWAELTGRELNFSIPSEASDFESWRNLPSTDFELDRPQPAVSKSVAHTSHNNNHKKALNGSGLNLSTPPSSDDGMDLSPKCHKRRKDFFGHGVEEDCAMANNSCSEREQEVEVHTGEPSWMHDFTGVAKHASGPVTAAKTIYEDDEGYLIMVSMLLSDPHSVKVTWRNTLTHGVVKITCVSTARMPFVKRHDRTFKLTDPSPEHCPPGEFVREIPLATRIPENAKIEAYYDETGTGLEIMVPKHRVGPEEHEVQVCMRPPHLGDNDLVLS

SEQ ID NO: 8648 - protein, 540 aa, Triticum aestivum
MGGEPLLTSLSMENSNSHPCTLLSMDPAGSHPASAESSGGGGAVNGVGASADRELFIIPRHESVRQGPPDINVPLSADPSPPPALWSLDTFDIFDVGLGTHTHESEVALTLPKSSGNGSAAVGVGARKCAKRGDSIWGAWFFFNHYFRPALVEKAKEKVTRDASGSITGFDKSDLRLDVFLVQHDMENLYMWVFKERPDNALGKMQLRSFMNGHSKHGEPSFPFSADKGFSRSHRMQRKHYRGLSNPQCLHGIEIVNSPNLSAVPEADMKRWAELTGRDLNFSIPAEASDFESWRNLPSTDFELDRPQPAASKSVAHTSHNNNHKKTLNGSGLNLSTPPSSDDGMDLSPKCHKRRKDFFGHGVEEDCAMANNSCSEREQEVEVHTGEPSWMHDFTGVAKHASGPVTAAKTIYEDDEGYLIMVSMLLSDPHSVKVTWRNTLTHGVVKITCVSTARMPFIKRHDRTFKLTDPSPEHCPPGEFVREIPLATRIPENAKIEAYYDETGTGLEIMVPKHRVGPEEHEVQVCMRPPHLGDNDLVLS

SEQ ID NO: 8649 - protein, 540 aa, Triticum aestivum
MGGEPLLTSLSMENSNSHPCTLLSMDPAGSHPASAESSGGGGAVNGVGASADRELFIIPRHESVRQGPPDINVPLSADPSPPPALWSLDTFDIFDVGLGTHTHESEVALTLPKSSGNGSAAVGVGARKCAKRGDSIWGAWFFFNHYFRPALVEKAKEKVTRDASGSITGFDKSDLRLDVFLVQHDMENLYMWVFKERPDNALGKMQLRSFMNGHSKHGEPSFPFSADKGFSRSHRMQRKHYRGLSNPQCLHGIEIVNSPNLSAVPEADMKRWAELTGRDLNFSIPAEASDFESWRNLPSTDFELDRPQPAASKSVAHTSHNNNHKKALNGSGLNLSTPPSSDDGMDLSPKCHKRRKDFFGHGVEEDCAMANNSCSEREQEVEVHTGEPSWMHDFTGVAKHASGPVTAAKTIYEDDEGYLIMVSMLLSDPHSVKVTWRNTLTHGVVKITCVSTARMPFIKRHDRTFKLTDPSPEHCPPGEFVREIPLATRIPENAKIEAYYDETGTGLEIMVPKHRVGPEEHEVQVCMRPPHLGDNDLVLS

SEQ ID NO: 8650 - protein, 541 aa, Hordeum vulgare
MGGEPLLTSLSMENSNSHPCTLLSMDPAGSHPASADSSGGGGGVNGVGASADRELFIIPRHESVRQGPPDINVPLSADPSPPPVLWSLDTFDIFDVGLGTHTHESEVALTLPKATGNGSAAVGVGARKCAKRGDSIWGAWFFFNHYFRPALVEKAKEKVTRDASGSISGFDKSDLRLDVFLVQHDMENLYMWVFKERPDNALGKMQLRSFMNGHSKHGEPSFPFSADKGFSRSHRMQRKHYRGLSNPQCLHGIEIVNSPNLTAVPEADMKRWAELTGRELNFSIPSEASDFESWRNLPSTDFELDRPQPAASKSVAHTSHNNNNHKKALNGSGLNLSTPPSSDDGMDLSPKCHKRRKDFFGHGVEEDCVMANNSCSDREQEVEVHTGEPSWMHDFTGVAKHASGPVTAAKTIYEDDEGYLIMVSMLLSDPHSVKVTWRNTLTHGVVKITCVSTARMPFVKRHDRTFKLTDPSPEHCPPGEFVREIPLATRIPENARIEAYYDETGTGLEIMVPKHRVGPEEHEVQVCMRPPHLGDNDLILS

SEQ ID NO: 8651 - protein, 541 aa, Secale cereale
MGGEPLLTSLSMENSNSHPCTLLSMDPAGSHPASADSSGGGGAVNGVGAGADRELFIIPRHESVRQGPPDINVPLSADPSPPPALWSLDTFDIFDVGLGTHTHESEVALTLPKSSGNGSAAAVGVGARKCAKRGDSIWGAWFFFNHYFRPALVEKAKEKVTRDASGSITGFDKSDLRLDVFLVQHDMENLYMWVFKERPDNTLGKMQLRSFMNGHSKHGEPSFPFSADKGFSRSHRMQRKHYRGLSNPQCLHGIEIVNSPNLSAVPEADMKRWAELTGRELNFSIPSEASDFESWRNLPSTDFELDRPQPAVSKSVAHTSHNNNHKKALNGSGLNLSTPPSSDDGMDLSPKCHKRRKDFFGHGVEEDCAMANNSCSEREQEVEVHTGEPSWMHDFTGVAKHASGPVTAAKTIYEDDEGYLIMVSMLLSDPHSVKVTWRNTLTHGVVKITCVSTARMPFVKRHDRTFKLTDPSPEHCPPGEFVREIPLATRIPENAKIEAYYDETGTGLEIMVPKHRVGPEEHEVQVCMRPPHLGDNDLVLS

SEQ ID NO: 8652 - protein, 548 aa, Brachypodium distachyon
MGGEPLLTSLSMENNSNNSHPCTLLSMDTAGSHPASAESSGGGGVVNGSAVGAGGGDRELFVIPRHESVRRHGPPDINLPLSADPSPPPTSWSLDPFDILDVGLGTQTYESEVALTLPPKSSGNGGSAAVGVGARKCAKRGDSIWGAWFFFDHYFRPALVEKPKGKVTRDASGSISGFDKSDLRLDVFLVQHDMENMYMWVFKERPDSALGKMQLRSFMNGHSKHGEPSFPFSADKGFSRSHRMQRKHYRGLSNPQCLHGIEIVNSPNLSAVPEADMKRWAELTGREINFSIPPEASDFESWRNLPSTDFELDRPQPPSSKTIAHSSHNHKKALNGSGLNLSTPPSSDDGMDLSPKCAKRRKDLFGHCAEEDCVMANNSCSDREQEVEVHTVTGEPSWMHDFTGVAKHASGPVTAAKTIYEDDEGYLIMVSMLFSDPHSVKVSWRNTLTHGIVKISCVSTARMPFVKRHDRMFKLTDPAPEHCPPGEFVREIPLATRIPENAKLEAYYDETGTGLEIMVPKHRVGPEEHEVQVCMRPPHLGDSDLVLS

SEQ ID NO: 8653 - protein, 547 aa, Oryza sativa
MGEPLLTTLSMENTNSHPCTRLSMDPAGSHAASGDSSGGGGGGGSTGAGGGGGGGGGDRELFIIPRRESAHPGPPDINLPLSADPSPPPPPHPPSWGIDQFDMLDVGLGTQTYESEVALTLPKLTGNGNTAVGVGARKCAKRGDSIWGAWFFFNHYFKPALVEKPKGKVTRDSSGSVSGFEKSDLRLDVFLVQHDMENMYMWVFKERPDNALGKMQLRSFMNGHSKHGEPSFPFSADKGFARSHRMQRKHYRGLSNPQCLHGIEIVSSPNLSAVPEAEMKRWAELTGRELNFSIPPEASDFESWRNLPSTDFELDRPLPLSSKITHGSHSHKKALNGSGLNLSTPPSSDDGMDLSPKCAKRRKDFFAHGADEDCVMANNSCSDREQEIEVHTGEPSWMHEFTGVAKHASGPVTAAKTIYEDDEGYLIMVSMLFSDPHSVKVSWRNTLTHGIVKISCVSTARMPFVKRHDRTFKLTDPFPEHCPPGEFVREIPLATRIPEDAKLEAYYDETGTGLEIMVPKHRVGPEEHEVQVCMRPPHLGENDLLLS

SEQ ID NO: 8654 - protein, 916 aa, Brachypodium distachyon
MGGEPLLTSLSMENNSNNSHPCTLLSMDTAGSHPASAESSGGGGVVNGSAVGAGGGDRELFVIPRHESVRRHGPPDINLPLSADPSPPPTSWSLDPFDILDVGLGTQTYESEVALTLPPKSSGNGGSAAVGVGARKCAKRGDSIWGAWFFFDHYFRPALVEKPKGKVTRDASGSISGFDKSDLRLDVFLVQHDMENMYMWVFKERPDSALGKMQLRSFMNGHSKHGEPSFPFSADKGFSRSHRMQRKHYRGLSNPQCLHGIEIVNSPNLSAVPEADMKRWAELTGREINFSIPPEASDFESWRNLPSTDFELDRPQPPSSKTIAHSSHNHKKALNGSGLNLSTPPSSDDGMDLSPKCAKRRKDLFGHCAEEDCVMANNSCSDREQEVEVHTVTGEPSWMHDFTGVAKHASGPVTAAKTIYEDDEGYLIMVSMLFSDPHSVKVSWRNTLTHGIVKISCVSTARMPFVKRHDRMFKLTDPAPEHCPPGEFVREIPLATRIPENAKLEAYYDETGTGLEIMVPKHRVGPEEHEVQRAEAALYTLADAAVVAGAAGGDLDQAVQKKGGWFGFISDAMEVVLKVLKDGLSAVHVPYSYGFAIILLTIVVKAATLPLTKQQVESTLAMQNLQPQLKAIQQRYAGNQERIQLETARLYKQAGVNPLAGCLPTLATIPVWIGLYQALSNVANEGLLTEGFFWIPSLGGPTTIAARQSGAGISWLFPFVDGHPPIGWHDTIAYLVLPVLLVASQFVSMEIMKPPQSTDPSQKNTQLILKFLPFMIGYFSLSVPSGLSIYWFTNNVLSTAQQVWLRKLGGAKPIVNEGGSGIITAGRAKRSSAQSGQGGERFKQLKEEESRRKATKALAAGDTKASVETSEDEETDDEITEEGGAVEETYASGSDKKLPTYSGKKGKRSKRKRIVQ

SEQ ID NO: 8655 - protein, 169 aa, Sorghum bicolor
MAASLWRAVMDSVSGSSSSPSALDAPPGGGVEFWHGAERAGWLNKQGEYIKTWRRRWFVLKQGRLFWFKDPVVTRASVPRGVIPVASCLTVKGAEDVLNRQFAFELSTPAETMYFIADSEKEKEEWINSIGRSIVQHSRSVTDAEVVDYDSRPQPPPQPKASEESEPAA

SEQ ID NO: 8656 - protein, 167 aa, Panicum virgatum
MAASLWRAVMDSVSGSSSPSAPDAASGGVEFWHGAERAGWLNKQGEYIKTWRRRWFVLKQGRLFWFKDPAVTRASVPRGVIPVASCLTVKGAEDVLNRQFAFELSTPAETMYFIADSEKEKEEWINSIGRSIVQHSRSIADAEVVDYDSRPQATTQSKDSQETEPAA

SEQ ID NO: 8657 - protein, 114 aa, Saccharum officinarum
MAARLWRAVMDSVSGSSSSPSALDAALGGGVEFWHGAERAGWLNKQGEYIKTWRRRWFVLKQGRLFWFKDPAVTRASVPRGVIPVASCLTVKGAEDVLNRQFGLKLSRPAETCT

SEQ ID NO: 8658 - protein, 168 aa, Panicum virgatum
MAASLWRAVMDSVSGSSSSPSAPDAASGGVEFWHGAERAGWLNKQGEYIKTWRRRWFVLKQGRLFWFKDPAVTRASVPRGVIPVASCLTVKGAEDVLNRQFAFELSTPAETMYFIADSEKEKEEWINSIGRSIVQHSCSIADAEVVDYDSRPQATTQPKDSQETEPAA

SEQ ID NO: 8659 - protein, 170 aa, Setaria italica
MAASLWRAVMDSVSGSSSSSSPTAPDAASGGVEFWHGAERVGWLNKQGEYIKTWRRRWFVLKQGRLFWFKDPAVTRASVPRGVIPVASCLTVKGAEDVLNRQFAFELSTPAETMYFIADSEKEKEEWINSIGRSIVQHSSSIADAEVVDYDSRPKATTQPKDSEESEPAA

SEQ ID NO: 8660 - protein, 216 aa, Brachypodium distachyon
MAASLWRAVMGSSSAGADDPATGGVEFWHGAERAGWLTKQGEYIKTWRRRWFVLKQGRLFWFKDPVVTRASVPRGVIPVSSCLTVKGAEDVLNRQFAFELSTPTETMYFIADAEKEKEEWINSIGRSIVQHSRSVTDAEVVDYDSRPQPSPRAKKSEASEPSERTHLSAPPSPPSPRGRAVPHRRNPPKYHHPLSVDSRTAGADSLTRPPRRHLAS

SEQ ID NO: 8661 - protein, 163 aa, Brachypodium distachyon
MAASLWRAVMGSSSAGADDPATGGVEFWHGAERAGWLTKQGEYIKTWRRRWFVLKQGRLFWFKDPVVTRASVPRGVIPVSSCLTVKGAEDVLNRQFAFELSTPTETMYFIADAEKEKEEWINSIGRSIVQHSRSVTDAEVVDYDSRPQPSPRAKKSEASEPSE

SEQ ID NO: 8662 - protein, 164 aa, Triticum aestivum
MAASLWRAVMGSSSSGGGDDPAAGGVEFWHGAERAGWLTKQGEYIKTWRRRWFVLKQGRLFWFKDAAVTRGSVPRGIIPVSSCLTVKGAEDVLNRQFAFELSTPAETMYFIADAEKEKEEWINSIGRSIVQHSRSVTDAEVVDYDSRPQPPPQPKKSEASEPSE

SEQ ID NO: 8663 - protein, 166 aa, Secale cereale
MAASLWRAVMGSSSSSGGGDDPAAGGVEFWHGAERAGWLTKQGEYIKTWRRRWFVLKQGRLFWFKDAAVTRGSVPRGIIPVSSCLTVKGAEDVLNRQFAFELSTPTETMYFIADAEKEKEEWINSIGRSIVQHSRSVTDAEVVDYDSRPQPPPPQPKKSEASEPSE

SEQ ID NO: 8664 - protein, 172 aa, Oryza sativa
MAVSLWRAVMGAAGGGGSSSSSAAGGDAGGGVEFWHGGERTGWLNKQGEYIKTWRRRWFVLKQGRLFWFKDAAVTRGSVPRGVIPVATCLTVKGAEDVINRQFAFELSTPTDTMYFIADSEKEKEEWINSIGRSIVQHSRSVTDAEVVDYDSRPNSKPPPQPKTSEESEPSA

SEQ ID NO: 8665 - protein, 159 aa, Avena sativa
MAVSLWRAVMGSSSSGGDDPATGGVEFWHGAERAGWLTKQGEYIKTWRRRWFVLKQGRLFWFKDPAITRASVPRGVIPVSSCLTVKGAEDVLNRQFAFELSTPTETMYFIADAEKEKEEWINSIGRSIVQHSRSVTDGEVVDYDSRPQPAPKPKSEPAE

SEQ ID NO: 8666 - protein, 170 aa, Hordeum vulgare
MAASLWRAVMGSSSSSSGGGDDPAAGGVEFWHGAERAGWLTKQGEYIKTWRRRWFVLKQGRLFWFKDAAVTRGSVPRGIIPVSSCLTVKGAEDVLNRQFAFELSTPAETMYFIADAEKEKEEWINSIGRSIVQHSRSVTDAEVIDYDSRPQPPPQPKPKPKTSDASEPSE

SEQ ID NO: 8667 - protein, 164 aa, Triticum aestivum
MAASLWRAVMGSSSSGGGDDPAAGGVEFWHGAERAGWLTKQGEYIKTWRRRWFVLKQGKLFWFKDSAVTRASVPRGVIPVSSCLTVKGAEDVLNRQFAFELSTPGETMYFVADSEKEKEDWINSIGRSIVQHSRSMTDDEIVDYDSGPQPPPQPKKSEASEPSE

SEQ ID NO: 8668 - protein, 159 aa, Lolium multiflorum
MAASLRRAVMGSSSSGGDDPALGGVEFWHGAERAGWLTKQGEYIKTWRRRWFVLKQSRLFWFKDPAVTRASVPRGVIPVSSCLTVKGAEDVPNRQFAFELSTPTETMYFIADAEKEKEEWINSIGRSIVQHSRSVTDGEVVDYDSRPQPSPKSKSEPSE

SEQ ID NO: 8669 - protein, 293 aa, Sorghum bicolor
MSVGAGFSYKKFVHFALEQTRHRSTLVPHPSQEKFKFIKPNEDNTVLSALSFSTSKVRLLRSLTIEQKNSAQVLDFAAFSEPEYDLPIFCANAFSSPARSIVVLDLNPLYDTTEHKDYREKYYRNLMPLIHKYSELLPWGGKITSESLRFFSPIVIWTIFEPTEANLQALYSAFMDYYKVWLELMDGAVRETNEEKIDRNREAQHKYLTWRAEKDPGYSLLKKLIGESGAKDLVREFLFEGVSSLGTKSFLDYFPEYAQEDGTVNRKRSMAGKSFGTRPWDVHGRFVGGDASC

SEQ ID NO: 8670 - protein, 298 aa, Setaria italica
MSGGSGGLGAGFSYQKFVHVALEQTRLRTALAPHPSQEKFKFIKTNEDNTIFNALSFSAPKIRLLRSLTIEQKNSVQVLDFAAFSEPEYDLPIFCANAFTSPARSIVVLDLNPLYDTTEHKDYRGKYYRNLMPLIHKYSELLPWGGKITSESLRFFSPIVIWTILEPTEANHQVLYSAFMDYFKVWLELMDEAVQGTSVEKIDRNREAQHKYLTWRAEKDPGYPLLKKLIGECAAKELVREFLFEGVDSLGTKSFLEYFPEYAQEDGTVNKKRSMVGKSFETRPWDAHGQFVGDAGDG

SEQ ID NO: 8671 - protein, 187 aa, Panicum virgatum
VSLSSPPFPSCPSSISLLAHPQPYHLGAEMSGGGGGGGLGAGFSYQKFVHVALERTRLHTALASHPSQEKFKFIKPKEDNTDMNALSFSAPKIRLLRSLTIEQKNSVQVLDFAAFSEPEYDLPIFCANAFTSPARSIVVLDLNPLYDTTEHEDYREKYYRNLMPLIHKYSEMKCSFCPGVAKLQASL

SEQ ID NO: 8672 - protein, 242 aa, Zea mays
MDEDWELLLASPKAAPAEPYAGGGGDGEVDAGAIKHDYFDLGSDAKYPRRASPSKGSEEECAEEGPFAASDNAGWVEPDPDDLLFPGRDRAALWSHSSSDGERPEVEVEVEAADQVERAGVTAAADAGEGAVAKGGGPAQWWRLPLDVLRVWALRAARSVWSVPLAVALLGFAVLGRRLYRMRRQSKAVARVRLVLDEKKVSQFKGQGSRLNESMTVARRTPIIKPMLPANGVTPWPVLGHL

SEQ ID NO: 8673 - protein, 232 aa, Zea mays
MEVGRAPRRRVSPAAAAAAVPSLLLFAVLFAGRAAAFGHLQGAGATALYKHASFFDRDGDGVVSFSETYGAFRALGFGFGLSSVSAALINGALGSKCRPQNATSSKLDIYIEDIQKGKHGSDSGSYDAEGRFVPDKFEEIFAKHAKTVPDALTSDEIDQLLQANREPGDYSGWAGAEAEWKTLYSLGKDKDGLLRKDVARSVYDGTLFHMLAPNWKSPDEEEEQELSVIRES

SEQ ID NO: 8674 - protein, 92 aa, Panicum virgatum
MAIRGVASSREDMTLEEFKEWLKQFDADGDGRISRNELREALRRRGGWFTTWRSCRALRHADKNNSGFLDDSEIENLVAFAQKDLGMKVSTW

SEQ ID NO: 8675 - protein, 92 aa, Sorghum bicolor
MAIRGVASTREDMTVEEFKEWLKQFDADGDGRISRNELREALRRRGGWFTTWKSSRALRQADKNNSGFLDDSEIENLVAFAQKDLGMKISTW

SEQ ID NO: 8676 - protein, 92 aa, Setaria italica
MAIRGVASSREDMTLEEFKEWLKQFDADGDGKISRNELREALRRRGGWFTTWRSGRALRQADKNNSGFLDDSEIENLVAFAQKDLGMKVSTW

SEQ ID NO: 8677 - protein, 359 aa, Sorghum bicolor
MEDAASEISDWEVLSATSACGGGDDDDEVLIVSGGAGDVVLDHFALTPDPAAACHGDGEGSWSAPGGVWQGLELLDGFDPIPESIASGVRSQQSPPPIGGVDNAPKEGLILQPTVARGATRIAYGNQAEVVDAEIEQESDSVISRGELCPVLQPAHHGAGETLDSDAATPTGALLQSEVSESSLVQLDDGGIGAGVESSCLEDAVSSDGIHGEQEEQEQEQGSNANAATGCDEPDGEAKDGALPLAHTPGAEEGEKQFVVWWRLPFKLLHFCAWKVKPVWSFSIAAAFLGLVVLGRRMYRMKRKARGLPQIKIAFDDKRASQFADRAARLNEAFLVARRVPMLRTSSGATLPWSMVQDR

SEQ ID NO: 8678 - protein, 274 aa, Saccharum officinarum
MEDAASEISDWEVLSATSACGGGDDDEVLVVSGGGGDVVLDHFALTPDPAAACPGDGEGSWSGPGGAWQGLELLDGFDPIPESSFNLATGVRSQQPPIGGVDNAREEGSILQATLARGAARSADRNQAEEVVDAEIEQESNSVISRGELCPVLQPAHHGVGETLDSDAATPAGASLQCEASESSLVQLDDGEIVAGVESSCLEDAVSSDGIHGEQEEQVQGSNANAATGCDEPDGEAKDGALPLAHTPGTEEERSNLLSGGGCRSSCCTTVLGR

SEQ ID NO: 8679 - protein, 256 aa, Zea mays
MEDDASKISDWEVLSATSSRGGGDDDEVLTVSGGGGDVVLLDHFVLTPDPAASCPGDGEGSWSDDRGAWQGLELLDGFDPIPEASFDLAVGVRSQQLLISDVDDAREEGSIVQATVARGATRSAEGNQDDVVEVEIEQESSSVISRGALCPVLQVAADHGVEETLDSEAVTPTGGSLQSQVSESSLVQLDDGGIGAGEKRSCLEDAVSSDEIHGEQEEQEQGSNANAAIGCDEPDGEAKDDALPLAHTPGTEEGEK

SEQ ID NO: 8680 - protein, 826 aa, Sorghum bicolor
MDGSGSWDAIDWNQIEDPRPRRSGQAVKESMDDFLLEDEEVLAQGHGVVLLNNREAGTLSVTNFRLLFVSQAKKCVIELGTIPLTTIEKLNDDVKLQPLPHLSDKNRPRELLQVIGKDMRIIVFAFVPKTKQKNEVFDALRRYTKPANLWDLYAFSCDPSAIKNDSEPKWRLLREYFRLFRRSLPLQGVEEVSFCNEWWRLTRVNSSYSLCSTYPSELIVPRSISDEDLFQASTFRSGKRLPVISWCDPGSGAVLARSSQPMVGLMMNFRNNADEKLVCALSSRTTDEKGSPRKLYIIDARPRANALANGAKGGGSESSSNYPRSEVLFLGIQNIHTMRDSLSRLRDYVDAHGSISSNGSPSAVSVVGDRRNRGSTWGGGNLNSMTSFSSTLGEWLNHIQNILVGASWIAAQISEEAASVLVHCSDGWDRTTQLVALACLLLDPYYRTFSGFQALVEKDWLAFGHPFAERMGVPTVAENVGSQYELLRQPSLGNLSSSPSRNTLGPSGPSSNPSVQSQTSNNSSPILLQWLDCISQLLRLYPSAFQFSSKFLVDFMDCVLSCRFGNFLCNSEREREQSGVTNSCRCMWSYLANLRASGGSFHEHYNPFYDPVKHNGALLPPAAALAPTLWPQFYLRWTCPIESQGGDLESQWHAMNKKYADAMKAKDIAEWRAKDIKLKLESMKQDLQREKRASSTALATAQSAQRENAAIKKAIESIGCTIKFSTSEDEDKTEVLSCSLRRGADGRAQQDENGDFSVSISAIEDSLVSDAPGDHFCESLCPFRTREGCRWPDAPCAQLGSQFVGLKANFDAFDRLSIQDCYFGPE

SEQ ID NO: 8681 - protein, 826 aa, Setaria italica
MDGSGSWDAIDWNQIEDPRPRRLVQSVKESMDDFLLEDEEVIAQGHGVVLLNNREPGTLSVTNFRLLFVSQARKCVMELGTIPLTTIERLNDDVKLQPLPHLSDKSRPLELLQVIGKDMRIIVFAFLPKQKKEVFDALRRCTKPANLWDLYAFSCDPSTIKNDSEPKWRLLREYFRLFRKSLPQLRGVEEVSLSNDWWRLTRVNSSYALCSTYPSELIVPRGISDEDLFQASTFRSGKRLPVISWCDPGTGAVLARSAQPMVGLMMNFRNNADEKLVCALSSRTTNDKVSPRKLYIIDARPRANALANGAKGGGSESSSNYPRSEVLFLGIQNIHTMRDSLSRLRDYVDAHGSISSNGTPSAVSVVGDRRNRGSTWGGGNLNSMTSFSSTLGEWLNHIQNILVGASWIAAQIAEEAASVLVHCSDGWDRTTQLVALACLLLDPYYRTFSGFQALVEKDWLAFGHPFAERMGVPTVAENGGSQYELLRQPSLGNLSSSPSRTPLGPSGPSSNASVQSQTSNNSSPILLQWLDCISQLLRLYPSAFQFSSKFLVDFMDCVLSCRFGNFLCNSEREREQSGVTNSCRCMWSYLADLRASGGSFHEHYNPFYDPVKHNGALLPPAAALAPTLWPQFYLRWTCPNESQGGDLESQWHAMNKKYAEAMKAKDIAEWRAKDIKMKMESVKQDLQRERHASNTASATAQSAQRENAAIKKAIESIGCTIKFSTSENQEDRTEVLSCSLRRGTDARGQEDENGDFSVSISAIEDSLVSEAPGDHFCESLCPFRTRDGCRWPDAPCAQLGSQFVGLKANFDAFDRLSIQDCYFGPE

SEQ ID NO: 8682 - protein, 709 aa, Zea mays
MGRKDTSSSSAATGGGKKEKPMSVSAMLASMDAPAAKAKSSKAKAKAKPSKAPASSYMGDIDLPPSDDEDEEEARLAAAAKPKPARAAVVDLSAGAAPSHKDAKKKDKREAVAAAAAEAARQEALRDDRDAFSVVIGARVPGSSADDGAVDDNVRDVVLENFSVSARGKELLKGASLRISHGRRYGLVGPNGMGKSTLLKLLAWRQVPVPRNIDVLLVEQEIIGDDRSALEAVVAADEELTALRAEQARLEVSNDADDNERLLEVYEKLNLRDSDAARARASKILAGLGFDQAMQARSTKSFSGGWRMRISLARALFMQPTLLLLDEPTNHLDLRAVLWLEEYLCSQWKKTLIVVSHDRDFLNTVCNEIIHLHDKSLHVYRGNFDDFESGYEQKRKEMNRKFEVYEKQMKAARKSGSKAAQDKVKGQALSKAAKEAAKNKGKGKSAADDDDDQKHVAVPQKWRDYSVEFHFPEPTELTPPLLQLIEVGFSYPGRPDFKLSGVDVGIDMGTRVAIVGPNGAGKSTILNLLAGDLTPTEGEVRRSQKLRIGRYSQHFVDLLTMEENAVQYLLRLHPDQEGMSKAEAVRAKLGKFGLPGHNHLTPIVKLSGGQKARVVFTSISMSQPHILLLDEPTNHLDMQSIDALADALDEFTGGVVLVSHDSRLISRVCDDEQRSEIWVVEDGSVDKYDGTFEDYKDELMEEIKKEVEE

SEQ ID NO: 8683 - protein, 713 aa, Sorghum bicolor
MGRKDTSSSSAAAGGGKKDKPMSVSAMLASMDAPAAKPNKSSKSAAPSKAKAKPSKAPASSYMGDIDLPPSDDEDEEEAAQRAAAKPKAARAAVVDLSAGAAPSQKDAKKKDKREAVAAAAAEAARQEALRDDRDAFSVVIGARVTGDDGGGGVDDNVRDIVLENFSVSAGGKELLKSASLRISHGRRYGLVGPNGMGKSTLLKLLAWRQVPVPRNIDVLLVEQEIIGDDRSALEAVVAADEELTALRAEQARLEASNDADDNERLVEVYEKLNLRDSDAARARASKILAGLGFDQAMQARSTKSFSGGWRMRISLARALFMQPTLLLLDEPTNHLDLRAVLWLEEYLCSQWKKTLIVVSHDRDFLNTVCNEIIHLHDKSLHVYRGNFDDFESGYEQKRKEMNKKFVMYEKQMKAARKSGSKAAQDKVKGQALSKAAKEAAKNKGKGKSAADDDDDQKQVAVPQKWRDYSVEFHFPEPTELTPPLLQLIEVGFSYPGRPDFKLSGVDVGIDMGTRVAIVGPNGAGKSTLLNLLAGDLTPTEGEVRRSQKLRIGRYSQHFVDLLTMEENPVQYLLRLHPDQEGMSKAETVRAKLGKFGLPGHNHLTPIVKLSGGQKARVVFTSISMSQPHILLLDEPTNHLDMQSIDALADALDEFTGGVVLVSHDSRLISRVCEDEQRSEIWVVEDGTVNRYDGTFEDYKDELMEEIKKEVEE

SEQ ID NO: 8684 - protein, 716 aa, Setaria italica
MGRKDSSSSSSSAAAGGGKKDKPMSVSAMLASMDAPAAKGKSSKSAAPSKPKGKPSKAPASSYMGDIDLPPSDDEEDEAELAAAAAKPKPSRAATVDLSSGVAPTQKDAKKKDKREAMAAAAAEAARQEALRDDRDAFSVVIGARVPGSATADDGAVDDNVKDIVLENFSVSARGKELLKSASLRISHGRRYGLVGPNGMGKSTLLKLLAWRQVPVPRNIDVLLVEQEIIGDDRSALEAVVAADEELTALRAEQARLEASNNADDNERLVEVYEKLNLRDSDAARARASKILAGLGFDQSMQARSTKSFSGGWRMRISLARALFMQPTLLLLDEPTNHLDLRAVLWLEEYLCSQWKKTLIVVSHDRDFLNTVCNEIIHLHDKSLHVYRGNFDDFESGYEQKRKEMNRKFEVYEKQMKAARKSGSKAAQDKVKGQALSKAAKEAAKNKGKGKNTADDDDDQKQAAVPQKWRDYSVEFHFPEPTELTPPLLQLIEVGFSYPCRPDFKLSDVDVGIDMGTRVAIVGPNGAGKSTLLNLLAGDLTPTEGEVRRSQKLRIGRYSQHFVDLLTMEENAVQYLLRLHPDQEGMSKAEAVRAKLGKFGLPGHNHLTPIVKLSGGQKARVVFTSISMSNPHILLLDEPTNHLDMQSIDALADALDEFTGGVVLVSHDSRLISRVCEDEQRSEIWVVEEGTVKKYDGTFEDYKDELMEEIKKEVEE

SEQ ID NO: 8685 - protein, 714 aa, Pennisetum glaucum
MGRKDSSSSSAAAGGGKKEKPMSVSAMLASMDAPAAKGKSAKSAAPSKPKGKPSKAPASSYMGDIDLPPSDEEEDEAELAAAAAKPKPSRAAAVDLSSGVAPTQKDAKKKDKREAMAAAAAEAAKQEALRDDRDAFSVVIGARVPGSASADDGAVDDNIKDIVLENFSVSARGKELLKSASLRISHGRRYGLVGPNGMGKSTLLKLLAWRQVPVPRNIDVLLVEQEIIGDDRSALEAVVAADEELTALRAEQARLEASTNADDDERLAEVYEKLNLRDSDAARARASKILAGLGFDQSMQARSTKSFSGGWRMRISLARALFMQPTLLLLDEPTNHLDLRAVLWLEEYLCSQWKKTLIVVSHDRDFLNTVCNEIIHLHDKSLHVYRGNFDDFESGYEQKRKEMNRKFEVYEKQMKAARKSGSKAAQDKVKGQALSKAAKEAAKNKGKGKNAADDDDDQKQLAVPQKWRDYSVEFHFPEPTELTPPLLQLIEVGFSYPGRPDFKLSDVDVGIDMGTRVAIVGPNGAGKSTLLNLLAGDLTPTEGEVRRSQKLRIGRYSQHFVDLLTMEENAVQYLLRLHPDQEGMSKAEAVRAKLGKFGLPGHNHLTPIVKLSGGQKARVVFTSISMSNPHILLLDEPTNHLDMQSIDALADALDEFTGGVVLVSHDSRLISRVCEDEQRSEIWVVEEGTVKKYDGMFEDYKDELMEEIKKEVEE

SEQ ID NO: 8686 - protein, 710 aa, Oryza sativa
MGRKDTSSSSSAAGGKKDKPMSVSAILASMDAPASKAKPSKAASKPKPSKAPASSYMGDIDLPPSDEEEDDADLVAMATKPKAARATVDLNAIAPSQKDAKKKDKREAMAAAQAEAAKQEALRDDRDAFSVVIGARVAGSAGASEGDSAAADDNIKDIVLENFSVSARGKELLKNASLRISHGRRYGLVGPNGMGKSTLLKLLSWRQVPVPRSIDVLLVEQEIIGDNRSALEAVVAADEELAALRAEQAKLEASNDADDNERLAEVYEKLNLRDSDAARARASKILAGLGFDQAMQARSTKSFSGGWRMRISLARALFMQPTLLLLDEPTNHLDLRAVLWLEQYLCSQWKKTLIVVSHDRDFLNTVCNEIIHLHDKNLHVYRGNFDDFESGYEQKRKEMNRKFEVFEKQMKAAKKTGSKAAQDKVKGQALSKANKEAAKSKGKGKNVANDDDDMKPADLPQKWLDYKVEFHFPEPTLLTPPLLQLIEVGFSYPNRPDFKLSGVDVGIDMGTRVAIVGPNGAGKSTLLNLLAGDLTPTKGEVRRSQKLRIGRYSQHFVDLLTMEENAVQYLLRLHPDQEGMSKAEAVRAKLGKFGLPGHNHLTPIVKLSGGQKARVVFTSISMSHPHILLLDEPTNHLDMQSIDALADALDEFTGGVVLVSHDSRLISRVCDDEQRSEIWVVEDGTVNKFDGTFEDYKDELLEEIKKEVEE

SEQ ID NO: 8687 - protein, 708 aa, Hordeum vulgare
MSRKNASSSSSAAGAAGKKEKPLSVSAMLASMDGTGPKSKPAKAAPKAKPSKAPASSYMGGIDLPPSDDEEDEADVAAVAAKPKPARATVDLNALAPSDKDSKKKEKREMMAAAVAEAAKREALRDDRDAFSVVIGARVPGSAEGDAAIDGNIKDIVLDNFSVSARGKELLKGASLRISHGRRYGLVGPNGMGKSTLLKLLSWRQVPVPKNIDVLLVEQEIVGDDRSATEAVVAANEELTALRAEQAKLEASNDPDDNDKLAEVYEKLNLCDSDAARARASKILAGLGFDQAMQARSTKSFSGGWRMRISLARALFMQPTLLLLDEPTNHLDLRAVLWLEQYLCSQWKKTLIVVSHDRDFLNTVCNDIIHLHDKSLHVYRGNFDDFESGYEQKRKEMNRKFEVYEKQMKAARKTGSKAAQDKVKDQAMSKAHKEVAKGKGKGKNVANDDDNVKPADLPQKWHDYKVEFHFPEPTLLTPPLLQLIEVGFGYPNRPDFKLSDVDVGIDMGTRVAIVGPNGAGKSTILNLLAGDLTPSEGEARRSQKLRIGRYSQHFVDLLTMEENAVQYLLRLHPDQGGMSKAEAVRGKLGKFGLPGHNHLTPIVKLSGGQKARVVFTSISMSNPHILLLDEPTNHLDMQSIDALADALDEFTGGVVLVSHDSRLISRVCDDEQKSQIWVVEDGTVTKYDGSFEDYKDELMAEIKKEVEE

SEQ ID NO: 8688 - protein, 712 aa, Brachypodium distachyon
MSRKNSSSSSSSSSGAGGGKKEKPLSVSAMLASMDGPAPNARPSKAASKPKPSKQPASSYVDDIDLPPSDEEEDEADVAAITAKPKSSRATVDLNALAPSDKDSKKKDKRESMAAAAAEAAKREALRDDRDAFSVVIGARVPGSAGAVDGDAADGNIKDIVLENFSVSARGKELLKSASLRISHGRRYGLVGPNGMGKSTLLKLLAWRQVPVPKNIDVLLVEQEIVGDDRSATEAVVAANEELTALRAEQVKLEASDDPDDNEKLAEIYEKLNLCDSDAARARAAKILAGLGFDQAMQARSTKSFSGGWRMRISLARALFMQPTLLLLDEPTNHLDLRAVLWLEQYLCSQWKKTLIVVSHDRDFLNTVCNDIIHLHDKSLHVYRGNFDDFESGYEQKRKEMNKKFEVYEKQMKAARKTGSKAAQDKVKGQALSKAHKEVAKGKGKGKNVANDDDSVKPADLPQKWLDYKVEFHFPEPTLLTPPLLQLIDVGFSYPGRPDFKLSDVDVGIDMGTRVAIVGPNGAGKSTLLNLLAGDLTPGDGEARRSQKLRIGRYSQHFVDLLTMEENAVQYLLRLHPDQEGMSKAEAVRAKLGKFGLPGHNHLTPIVKLSGGQKARVVFTSISMSHPHILLLDEPTNHLDMQSIDALADALDEFTGGVVLVSHDSRLISRVCDDEQKSQIWVVEDGTVNKYDGSFEDYKDELMAEIKKEVEE

SEQ ID NO: 8689 - protein, 402 aa, Secale cereale
MRISLARALFMQPTLLLLDEPTNHLDLRAVLWLEQYLCSQWKKTLIVVSHDRDFLNTVCNDIIHLHDKSLHVYRGNFDDFESGYEQKRKEMNKKFEVYEKQMKAARKTGSKAAQDKVKDQAMSKAHKEVAKGKGKGKNVANDDDNVKPADLPQKWHDYKVEFHFPEPTLLTPPLLQLIDVGFGYPNRPDFKLSDVDVGIDMGTRVAIVGPNGAGKSTILNLLAGDLNPSEGEARRSQKLRIGRYSQHFVDLLTMEENAVQYLLRLHPDQGGMSKAEVVRAKLGKFGLPGHNHLTPIVKLSGGQKARVVFTSISMSNPHILLLDEPTNHLDMQSIDALADALDEFTGGVVLVSHDSRLISRVCDDEEKSQIWVVEDGTVTKFDGSFEDYKDELMAEIKKEVEE

SEQ ID NO: 8690 - protein, 722 aa, Triticum aestivum
MSRKNASSSTSAAATSRKNAPSSSSAAGAAGKKEKPLSVSAMLASMDGTAPKSKPAKAAPKPKPSKAPASSYMGGIDLPPSDDEEDEADVAAVAAKPKPSRATVDLNALAPSDKDSKKKEKREMMAAAVAEAAKREALRDDRDAFSVVIGARVPGSAADGDAADGNIKDIVLDNFSVSARGKELLKGASLRISHGRRYGLVGPNGMGKSTLLKLLSWRQVPVPKNIDVLLVEQEIVGDDRSATEAVVAANEELTALRAEQAKLEASNDPDDNDKLAEVYEKLNLCDSDAARARASKILAGLGFDQAMQARSTKSFSGGWRMRISLARALFMQPTLLLLDEPTNHLDLRAVLWLEQYLCSQWKKTLIVVSHDRDFLNTVCNDIIHLHDKSLHVYRGNFDDFESGYEQKRKEMNKKYEVYEKQMKAARKTGSKAAQDKVKDQAMSKAHKEVAKGKGKGKNVANDDDNVKPADLPQKWHDYKVEFHFPEPTLLTPPLLQLIDVGFGYPNRPDFKLSDVDVGIDMGTRVAIVGPNGAGKSTILNLLAGDLNPSEGEARRSQKLRIGRYSQHFVDLLTMEENAVQYLLRLHPDQGGMSKAEAVRGKLGKFGLPGHNHLTPIVKLSGGQKARVVFTSISMLNPHILLLDEPTNHLDMQSIDALADALDEFTGGVVLVSHDSRLISRVCDDEEKSQIWVVEDGTVTKYDGSFEDYKDELMAEIKKEVEE

SEQ ID NO: 8691 - protein, 595 aa, Panicum virgatum
AAEAARQEALRDDRDAFSVVIGARVPGSATADDGAVDDNVKDIVLENFSVSARGKELLKSASLRISHGRRYGLVGPNGMGKSTLLKLLAWRQVPVPRNIDVLLVEQEIIGDDRSALEAVVAADEELTALRAEQARLEASNNADDNDRLVEVYEKLNLRDSDAARSRASKILAGLGFDQAMQARSTKSFSGGWRMRISLARALFMQPTLLLLDEPTNHLDLRAVLWLEEYLCSQWKKTLIVVSHDRDFLNTVCNEIIHLHDKSLHVYRGNFDDFESGYEQKRKEMNRKFEVYEKQMKAARKSGSKAAQDKVKGQALSKAAKEAAKNKGKGKNAADDDDDQNQVAVPQKWRDYSVEFHFPEPTELTPPLLQLIEVGFSYPGRPDFKLSDVDVGIDMGTRVAIVGPNGAGKSTLLNLLAGDLSPTEGEVRRSQKLRIGRYSQHFVDLLTMEENAVQYLLRLHPDQEGMSKAEAVRAKLGKFGLPGHNHLTPIVKLSGGQKARVVFTSISMSQPHILLLDEPTNHLDMQSIDALADALDEFTGGVVLVSHDSRLISRVCEDEQRSEIWVVEDGTVKKYDGTFEDYKDELMEEIKKEVEE

SEQ ID NO: 8692 - protein, 184 aa, Zea mays
MGALCLLYPSTPPRCPCGARADATAAFAPSPFLSSCAATGAQTRLQLCGRSQRRGGVARVGGGGGGGKGESGKNGAAAFFDEDGVVDDMDGYLNYLSLEYDSVWDTKPAWCQPWTILLTGTGAVACSWVLIQSAVITAGVSFVICAWWYIFLYSYPKAYTEMIAERRRNVASGAEDTYGMEKIQ

SEQ ID NO: 8693 - protein, 179 aa, Sorghum bicolor
MGALCLLCPCPSTPPPCPCGTRATAPSPFFSCAPTAAATRLQLCGRSQRRAGVARVGGGGGGKGESGKTGAAAFFDEDGVVDDMDGYLNYLSLEYDSVWDTKPAWCQPWTILLTGTVVVACSWVLIQSAVITAGVSFVICAWWYIFLYSYPKAYTEMIAERRRKVASGAEDTYGMEKIQ

SEQ ID NO: 8694 - protein, 249 aa, Setaria italica
MEVVGGVSLRPSSAQAPARIGKLSPVDVGGRFVLRAAPRRQPARRALVVEARGRSWSERQMEQQRRMPQLPKIEDDGNPRFVIFIRTANVYFWYPLNIITGGTTAKIMLAAKDNFLGKYIYKDTLARNLAAVIYKDEDVIIDTAKEQYRVLKTENEFRYGYKVVENGNVRSALTTSNVIELPKKDELKTVVDKVKDFFGDVTAGAKESFAQITGSAVTKEDEEAQGKEKFRSKRRKKQRKSKQGLKTEK

SEQ ID NO: 8695 - protein, 376 aa, Setaria italica
MSCSHLSTAWSSSALASSASSTRRRSSAPRSGGSGLVVRCSLRELRSRIDSVRNTQKITEAMKLVAAAKVRRAQEAVVSSRPFSEALVEVLYNMNQEIQTEDIDLPLTRTRPVKKVALVVLTGERGLCGSFNNNVLKKADTRIDELKQLGLEYTSSAWGRRATPTSSAALHPAGAGAGGERRAHREGLAGHLRPGVLALRLRGGGQGGAALLQVRVPGALRPHHPDAAAHVPQGGDLRRQRRVRGRHGGRAVPPHHQGGEAHRGAREGEDRDAALLPRGAVRAGPRADPRRAAPALPQQPDPPRPAGVARQRARRPDERHEQRHRQRHRAPQEPLHRLQPPAPGQDHRGDPRDRRRRRRPRWLSLSRPPYTKTEPS

SEQ ID NO: 8696 - protein, 358 aa, Saccharum officinarum
MSCSHLSTAWSSSALASSASTTQRRSAPRSGLVVRCSLRELRTRIDSVKNTQKITEAMKLVAAAKVRRAQEAVVSSRPFSEALVEVLYNMNQEIQTEDIDLPLTRTRPVKKVALVVLTGERGLCGSFNNNVLKKAETRIEEFKQLGLQYSVISVGKKGNAYFQRRPYIPLERDLEVNGVPTVKDSQAICDLVYSLFVSEEVDKVELLYSKFVSLVRSDPIIQTLLPMSPKGEICDINGVCVDATEDELFRLTTKEGKLTVEREKVKIETQPFSPVVQFEQDPVQILDALLPLYLNSQILRALQESLASELAARMSAMSSATDNAIELAKTLSISYNRQRQAKITGEILEIVAGAEALA

SEQ ID NO: 8697 - protein, 360 aa, Sorghum bicolor
MSCSHLSTAWSSSALASSASTTQRRGSSAPRSGLVVRCSLRELRTRIDSVKNTQKITEAMKLVAAAKVRRAQEAVVSSRPFSEALVEVLYNMNQEIQTEDIDLPLTRTRPVKKVALVVLTGERGLCGSFNNNVLKKAEARIEELKQLGLQYSVISVGKKGNAYFQRRPYIPLERDLEVNGVPTVKDSQSICDLVYSLFVSEEVDKVELLYSKFVSLVRSDPIIQTLLPMSPKGEICDINGVCVDATEDELFRLTTKEGKLTVEREKVKIETQPFSPVVQFEQDPVQILDALLPLYLNSQILRALQESLASELAARMSAMSSATDNAIELAKNLSIAYNRQRQAKITGEILEIVAGAEALA

SEQ ID NO: 8698 - protein, 363 aa, Panicum virgatum
MSCSHLSTAWSSSALASSASSTRRRSSAPRSGGSGFVVRCSLRELRSRIDSVRNTQKITEAMKLVAAAKVRRAQEAVVSSRPFSEALVEVLYNMNQEIQTEDIDLPLTRTRPVKKVALVVLTGERGLCGSFNNNVLKKADTRIEELKQLGLEYTVISVGKKGNAYFTRRPYIPLERELEVNGVPTVKDSQAICDLVYSLFVSEEVDKVELLYSKFVSLVRSDPIIQTLLPMSPKGEICDVNGVCVDATEDELFRLTTKEGKLTVEREKVKIETQPFSPVVQFEQDPVQILDALLPLYLNSQILRALQESLASELAARMSAMSSATDNAIELRKNLSIAYNRQRQAKITGEILEIVAGADALAG

SEQ ID NO: 8699 - protein, 363 aa, Panicum virgatum
MSCSHLSTAWSSSALASSASSTRRRSSAPRSGGSGFVVRCSLRELRSRIDSVRNTQKITEAMKLVAAAKVRRAQEAVVSSRPFSEALVEVLYNMNQEIQTEDIDLPLTRTRPVKKVALVVLTGERGLCGSFNNNVLKKADTRMEELKQLGIEYTVISVGKKGNAYFMRRPYIPLERELEVNGVPTVKDSQAICDLVYSLFVSEEVDKVELLYSKFVSLVRSDPIIQTLLPMSPKGEICDVNGVCVDATEDELFRLTTKEGKLTVEREKVKIETQPFSPVVQFEQDPVQILDALLPLYFNSQILRALQESLPSELAARMSAMSSATDNAIEFRKNLSIAYNRQRQAKITGEILEIVAGADALAG

SEQ ID NO: 8700 - protein, 358 aa, Oryza sativa
MSCSHLSTAWSSSALATRRRSAPSCGSSGRLQVVRCSLRELRSRIDSVRNTQKITEAMKLVAAAKVRRAQEAVVSSRPFSEALVEVLYNMNQEIQTEDIDLPLTRIRPVKKVALVVLTGERGLCGSFNNNVLKKAETRIEELKQLGLEYTVVSVGKKGNAYFIRRPFIPTERTLEVNGIPTVKDSQSICDLVYSLFVSEAVDKVELLYSKFVSLVRSDPIIQTLLPMSPKGEICDINGVCVDATEDELFRLTTKEGKLTVEREKVKIETQPFSPVVQFEQDPVQILDALLPLYLNSQILRALQESLASELAARMSAMSSATDNAIELRKNLSMVYNRQRQAKITGEILEIVAGADALA

SEQ ID NO: 8701 - protein, 360 aa, Brachypodium distachyon
MSCSHLSTAWSSSALASSSTRRRGASSSSSSSLVVRCSLRDLRNRIESVRNTQKITEAMKLVAAAKVRRAQEAVVSSRPFSEALVEVLYNMNQEIQTEDIDLPLTRQRSVKRVALVVLTGERGLCGAFNNNVLKKAESRMEELRQLGVEYTVISVGKKGNAYFQRRPYIPSERFLELAGIPTVKDSQAICDLVYSLFVAEEVDKVELLYSKFVSLVRSDPIIQTLLPMSPKGEICDVNGICVDATEDELFKLTTKEGKLTVEREKIKIETQPFSPVVQFEQDPVQILDALLPLYLNSQILRALQESLASELAARMSAMSSATDNAIDLRKNLSIIYNRRRQAKITGEILEIVAGADALSG

SEQ ID NO: 8702 - protein, 358 aa, Triticum aestivum
MSCSHLSTAWSSSALASTSTRRRASTGSSSLVVRCSLRDLRNRIDSVRNTQKITEAMKLVAAAKVRRAQEAVVSSRPFSEALVEVLYNMNQEIQSEDIDLPLTRQRAVKRVAIVVLTGERGLCGAFNNNVLKKAEARMEDLRQLGVDYTVISVGKKGNAYFQRRDYIPTERFLELAGIPTVKDSQAICDLIYSLFVAEEVDKVELVYSKFVNLVRSDPIIQTLLPMSPKGEICDVNGICVDATEDELFKLTTKEGKLTVEREKIKIEMQPFSPVVQFEQDPVQILDALLPLYLNSQILRALQESLASELAARMSAMSSATDNAIDLRKNLSMVYNRRRQAKITGEILEIVAGADALSG

SEQ ID NO: 8703 - protein, 357 aa, Hordeum vulgare
MSCSHLSTAWSSSALASTSTRRRASTGSSLVVRCSLRDLRNRIDSVRNTQKITEAMKLVAAAKVRRAQEAVVSSRPFSEALVEVLYNMNQEIQSEDIDLPLTRQRAVKRVAIVVLTGERGLCGAFNNNVLKKAEARMEDLRQLGVEYKVISVGKKGNAYFQRRDYIPTERFLELAGIPTVKDSQAICDLIYSLFVAEEVDKVELVYSKFVNLVRSDPIIQTLLPMSPKGEICDVNGICVDATEDELFKLTTKEGKLTVEREKIKIEMQPFSPVVQFEQDPVQILDALLPLYLNSQILRALQESLASELAARMSAMSSATDNAIDLRKNLSMVYNRRRQAKITGEILEIVAGADALSG

SEQ ID NO: 8704 - protein, 360 aa, Secale cereale
MSCSHLSTAWSSSALASTSTRRRASTGSSSSSLVVRCSLRDLRNRIDSVRNTQKITEAMKLVAAAKVRRAQEAVVSSRPFSEALVEVLYNMNQEIQSEDIDLPLTRQRAVKRVAIVVLTGERGLCGAFNNNVLKKAEARMADLRQLGVDYTVISVGKKGNAYFQRRDYIPTERFLELAGIPTVKDSQAICDLIYSLFVAEEVDKVELVYSKFVNLVRSDPIIQTLLPMSPKGEICDVNGICVDATEDELFKLTTKEGKLTVEREKIKIEMQPFSPVVQFEQDPVQILDALLPLYLNSQILRALQESLASELAARMSAMSSATDNAIDLQKNLSMVYNRRRQAKITGEILEIVAGADALSG

SEQ ID NO: 8705 - protein, 361 aa, Avena sativa
MSCSHLSTAWSSSALASSSTRRRASTGGSSSSSLVVRCSLRDLRNRIDSVRNTQKITEAMKLVAAAKVRRAQEAVVSSRPFSEALVEVLYNMNQEIQTEDIDLPLTRQRAVKRVAIVVLTGERGLCGAFNNNVLKKAEARMEDLRQLGVDYKVISVGKKGNAYFQRREYIPTERFLELAGIPTVKDSQAICDLIYSLFVAEEVDKVELVYSKFVNLVRSDPIIQTLLPMSPKGEICDVNGICVDASEDELFKLTTKEGKLTVEREKIKIEMQPFSPVVQFEQDPVQILDALLPLYLNSQILRALQESLASELAARMSAMSSATDNAIDLRKNLSMVYNRRRQAKITGEILEIVAGADALSG

SEQ ID NO: 8706 - protein, 362 aa, Leymus cinereus x Leymus triticoides
MSCSHLSTAWSSSALASTSTRRRASTGGGSSSSSLVVRCSLRDLRNRIDSVRNTQKITEAMKLVAAAKVRRAQEAVVSSRPFSEALVEVLYNMNQEIQSEDIDLPLTRQRPVKRVAIVVLTGERGLCGAFNNNVLKKAEARMDDFRQLGVDYTVISVGKKGNAYFQRREYIPTERFLELAGIPTVKDSQAICDLIYSLFVAEEVDKVELVYSKFVNLVRSDPIIQTLLPMSPKGEICDVNGICVDATEDELFKLTTKEGKLTVEREKIKIEMQPFSPVVQFEQDPVQILDALLPLYLNSQILRALQESLASELAARMSAMSSATDNAIDLQKNLSMVYNRRRQAKITGEILEIVAGADALSG

SEQ ID NO: 8707 - protein, 331 aa, Pennisetum glaucum
RCSLRELRSRIDSVRNTQKITEAMKLVAAAKVRRAQEAVVSSRPFSEALVEVLYNMNQEIQTEDIDLPLTRTRPVKKVALVVLTGERGLCGSFNNNVLKKAETRIDEFKQLGLQYTVISVGKKGNAYFQRRPYIPVERELEVGAIPTVKDSQAICDLVYSLFVSEEVDKVELLYSKFVSLVRSDPIIQTLLPMSPKGEICDVNGVCVDATEDELFRLTTKEGKLTVEREKVKIETQPFSPVVQFEQDPVQILDALLPLYLNSQILRALQESLASELAARMSAMSSATDNAIELRKNLSIAYNRQRQAKITGEILEIVAGADAHLDEPSSLY

SEQ ID NO: 8708 - protein, 356 aa, Sorghum bicolor
LFCFPPARRRPLVIPVAADQQQQPCRAPTSPPPGPPRRSPAAPPPPSGAEAPPRAMKLVAAAKVRRAQEAVVSSRPFSEALVEVLYNMNQEIQTEDIDLPLTRTRPVKKVALVVLTGERGLCGSFNNNVLKKAEARIEELKQLGLQYSVISVGKKGNAYFQRRPYIPLERDLEVNGVPTVKDSQSICDLVYSLFVSEEVDKVELLYSKFVSLVRSDPIIQTLLPMSPKGEICDINGVCVDATEDELFRLTTKEGKLTVEREKVKIETQPFSPVVQFEQDPVQILDALLPLYLNSQILRALQESLASELAARMSAMSSATDNAIELAKNLSIAYNRQRQAKITGEILEIVAGAEALA

SEQ ID NO: 8709 - protein, 375 aa, Festuca arundinacea
  misc_feature (366)..(366): Xaa can be any naturally occurring amino acid
MSCSHLSTAWSSSALASSSTRRRASTGGSSSSSLVVRCSLRDLRNRIDSVRNTQKITEAMKLVAAAKVRRAQEAVVSSRPFSEALVEVLYNMNQEIQTEDIDLPLTRQRSVKRVAIVVLTGERGLCGAFNNNVLKKAESRMEDLKQLGVDYTVISVGKKGNAYFQRREYIPTERFLELAGIPTVKDSQAICDLIYSLFVAEEVDKVELVYSKFVSLVRSDPIIQTLLPMSPKGEICDVNGICVDATEDELFKLTTKEGKLTVEREKIKIETQPFSSVVQFEQDPVQILDALLPLYLNSQILRALQESLASELAARMSAMSSATDNAIDLRKNLSMVYNRRRQAKITGEISRSLLAPTPSPADSSSXPELSCRSYI

SEQ ID NO: 8710 - protein, 304 aa, Panicum virgatum
EAMKLVAAAKVRRAQEAVVSSRPFSEALVEVLYNMNQEIQTEDIDLPLTRTRPVKKVALVVLTGERGLCGSFNNNVLKKADTRIEELKQLGIEYTVISVGKKGNAYFMRRPYIPLERELEVNGVPTVKDSQAICDLVYSLFVSEEVDKVELLYSKFVSLVRSDPIIQTLLPMSPKGEICDVNGVCVDATEDELFRLTTKEGKLTVEREKVKIETQPFSPVVQFEQDPVQILDALLPLYLNSQILRALQESLASELAARMSAMSSATDNAIELRKNLSIAYNRQRQAKITGEILEIVAGADALAG

SEQ ID NO: 8711 - protein, 79 aa, Triticum aestivum
MSCSSGKCDCGSSCSCGSSCNCMSPNVETAAASSIKTTVLAAPTTKASAGGSRRPPRAAAATATPATAAPAAVSCCNCN

SEQ ID NO: 8712 - protein, 557 aa, Sorghum bicolor
MDNTEFSETSSEVSGSERTRPVDSKNASSVLDTISIKKKLKLFSRMATLKDDGTVVVDIPTNIEAASLDLPSEDHHNVAFGGGTLDSSDLQYRPPMQIAMLIVGTRGDVQPFIAIGKRLQDYGHRVRLATHANFKDFVMTTGLEFYPLGGDPKILAGYMVKNKGFLPATPSEIPIQRKQIRDIIFSLLPACKDPDIDTGVSFSADAIIANPAAYVQLLTEMSAYTGHVHVAEALNIPIHIIFTMPWTPTCEFPHPFSHVKQPAGYRLSYQIVDSFVWLGIRDMINDLRKRKLKLRPVTYLSGTHAYSNDIPHAYIWSPYLVPKPKDWGPKIDVVGFCFLDLASNYEPPEPLLRWLGSGESPIYIGFGSLPIPEPDKLTRIIVQALEITGQRGIINKGWGGLGNLEESKEFVYVLDNVPHDWLFLQCKAVVHHGGAGTTAAGLKAGCPTTIIPFFGDQFFWGSMVHARGLGAPPIPVEQLQLQSLIDAIKFMIDPKVKERAVQLAKAIESEDGVDGAVKSFLKHLPQKRDSEATPTAPQSTFMQPLLLPVKRCFGMAS

SEQ ID NO: 8713 - protein, 466 aa, Brachypodium distachyon
MVLAVLIGVLVGIVLVSSLLLRWNEVRYSRKQGLPPGTMGWPLFGETTEFLKQGPSFMKARRLRYGSLFRTHILGCPTVVCMDPELNRQMLQQGEGRGFVPGYPQSMLDILGRNNIAAVHGPLHRAMRGSMLALVRPASIRSSLLPKIDAFMRSHLHGWAGDLVDIQDKTKEMALLSALRQIAGITAGPLSDALKTELYTLVLGTISLPINLPGTSYYQGFQARKKLVSMLEKMIAERRSSGLVHNDMLDALLSGNDGTRERLSDEQIIDLIITLIYSGYETMSTTSMMAVKYLSDHPKALEELRKEHFDIRKGKSPEEAIDYNDFKSMTFTRAVIFETLRLATVVNGLLRKTTQDVEMNGYVIPKGWRIYVYTREINYDPCLYPDPMTFNPWRWLEKNMESHPHFMLFGGGGRMCPGKEVGTAEIATFLHYFVTRYRWEEEGTNTILKFPRVEAPNGLHIRVQNY

SEQ ID NO: 8714 - protein, 465 aa, Setaria italica
MAVLLLVAVLAAAVLASSLLLRWNEVRYSRRRGLPPGTMGWPLFGETTEFLKQGPSFMKARRLRYGSLFRTHILGCPTVVCMDPELNRRTLASEGAGFVPGYPQSMLDILGPNNIAAVHGPLHRAMRGAMLALTRPTMIRAALLPKIDAFMRAHLHGWAGRRVDIQEMTKEMALLSALRQIAGISAGPLSDALKAELYTLVLGTFSLPINIPGTNYSKGLQARKKLVAMLRQMIADRRSSGCAQDDMLDALLSGNEGTRAKLNDDQIIDLLITLIYSGYETVSTTSMMAVKYLSDNPKALEQIRKEHLDIRKGKSPEDALDWNDYKSMTFTRAVIYETLRLATVVNGLLRKTTQDVEMNGYVIPKGWRIYVYTREINYDPFLYPEPMVFNPWRWLEKGLESHPHFMLFGGGARMCPGKEVGTVEIATFLHYFVTRYRWEEEGNNTISKFPRVAAPNGLHIRVQDY

SEQ ID NO: 8715 - protein, 473 aa, Triticum aestivum
MALLLLVLVGVVVGVVVASSLLLRWNEVRYGNGRRKEGRLPPGTMGWPLFGETTEFLKQGPSFMKQRRLRYGRLFRTHILGCPTVVCMDPELNRRMLLQGEAGGLVPGYPQSMLDILGRNNIAAVHGPLHRVMRGAMLGLVRPAMLRTSLLPKIDAFMRDHLSGWAGSVVDVQAKTKEMALLSALRQIAGITAGPLSDALKTELCTLVLGTISLPINLPGTSYYQGFQARKKLVSMLEQMIAERRCSGEVHDDMLDALLRSGNDGTREKLTDEQIIDLLIALIYSGYETMSTTSMMAVKYLSDHPQALEELRREHLDIRKGKSPEEAISYEDFKSMAFTRAVIFETLRLATVVNGLLRKTTKDVEMNGYVIPKGWRIYVYTREINYDPFMYPDPMTFNPWRWLEKNMESHPHFMLFGGGGRMCPGKEVGTAEIATFLHYFVTRYRWEEEGKNTILKFPRVEAPNGLHIRVQDY

SEQ ID NO: 8716 - protein, 473 aa, Triticum aestivum
MALLLLVLVGVVVGVVVASSLLLRWNEVRYGNGRRKEGRLPPGTMGWPLFGETTEFLKQGPSFMKQRRLRYGRLFRTHILGCPTVVCMDPELNRRMLLQGEAGGLVPGYPQSMLDILGRNNIAAVHGPLHRVMRGAMLGLVRPAMLRTSLLPKIDAFMRDHLSGWAGSVVDVQAKTKEMALLSALRQIAGITAGPLSDALKTELCTLVLGTISLPINLPGTSYYQGFQARKKLVSMLEQMIAERRCSGEVHDDMLDALLRSGNDGTREKLTDEQIIDLLIALIYSGYETMSTTSMMAVKYLSDHPQALEELRREHLDIRKGKSPEEAISYEDFKSMAFTRAVIFETLRLATVVNGLLRKTTKDVEMNGYVIPKGWRIYVYTREINYDPFMYPDPMTFNPWRWLEKNMESHPHFMLFGGGGRMCPGKEVGTAEIATFLHYFVTRYRWEEEGKNTILKFPRVEAPNGLHIRVHDY

SEQ ID NO: 8717 - protein, 465 aa, Zea mays
MALLLLLLAVLGVVLASSLLLRWNELRYSRRRGLPPGTMGWPLFGETTEFLKQGPSFMKQRRLRYGSLFRTHILGCPTVVCMEPELNRRALASEGAGFVPGYPQSMLDILGPNNIAAVHGPLHRAMRGAMLALTRPHMIRAALLPKIDAFMRAHLHGWAGRRVDIQEMTKEMALLSALRQIAGISAGPLSDALKAELYTLVLGTFSLPINVPGTNYSKGLQARKKLVAMLRQMIADRRSSGCARDDMLDALLSGNEGTRAKLSDDQIIDLLITLIYSGYETVSTTSMMAVKYLSDNPKALGQIRKEHLDIRKAKSPEDPLDWNDYKSMTFTKAVIYETLRLATVVNGLLRKTTHDVEMNGYVIPKGWRIYVYTREINYDPFLYPEPMVFNPWRWMETNLESHPHFMLFGGGARMCPGKEVGTVEIATFLHYFVTRYRWEEEGNNTISKFPRVAAPNGLHIRVQDY

SEQ ID NO: 8718 - protein, 465 aa, Sorghum bicolor
MAVLLLLVAVLGVVLASSLLLRWNELRYSRRRGLPPGTMGWPLFGETTEFLKQGPSFMKQRRLRYGSLFRTHILGCPTVVCMEPELNRRTLASDGAGFVPGYPQSMLDILGPNNIAAVHGPLHRAMRGAMLALTRAHMIRAALLPKIDAFMRAHLHGWAGRRVDIQEMTKEMALLSALRQIAGISAGPLSDALKAELYTLVLGTFSLPINIPGTNYSKGLQARKKLVAMLRQMIADRRSSGCAQDDMLDALLSGNEGTRAKLTDDQIIDLLITLIYSGYETVSTTSMMAVKYLSDNPKALEQIRKEHLDIRKAKSPDDALDWNDYKSMTFTKAVIYETLRLATVVNGLLRKTTQDVEMNGYVIPKGWRIYVYTREINYDPFLYPEPMVFNPWRWLETNLESHPHFMLFGGGARMCPGKEVGTVEIATFLHYFITRYRWEEEGNNTISKFPRVAAPNGLHIRVQDY

SEQ ID NO: 8719 - protein, 472 aa, Hordeum vulgare
MALLLLALVVVGVVASSLLLRWNEVRYGNGRRKHGDACLPPGTMGWPLFGETTEFLKQGPSFMKQRRLRYGRLFRTHILGCPTVVCMDPELNRRMLLQGEAGGMVPGYPQSMLDILGRNNIAAVHGPLHRVMRGAMLGLVRPAALRQSLLPKMDAFMRHHLAGWAGTVVDVQAKTKEMALLSALRQIAGITAGPLSDALQTELYTLVLGTISLPINLPGTSYYQGFQARTKLVSMLEQMIAERRSSGEAHDDMLDALLRSGDDGTREKISDEQIIDLLIALIYSGYETMSTTSMMAVKYLSEHPRALQELRREHLDIRKGKLPEEAIGYDDFKSMSFTRAVIFETLRLATVVNGLLRKTTQDVEMNGYVIPKGWRIYVYTREINYDPFMYPDPMTFNPWRWLEKNMESHPHFMLFGGGSRMCPGKEVGTAEIATFLHRFVTQYRWEEEGKNTILKFPRVEAPNGLHIRVQDY

SEQ ID NO: 8720 - protein, 361 aa, Secale cereale
MLDILGRNNIAAVHGPLHRLMRGAMLGLVRPAMLRQSLLPKIDAFMRDHLQGWAGSVVDVQAKTKEMALLSALRQIAGITAGPLSDALKTELYTLVLGSISLPINLPGTSYYQGFQARKKLVSILEQMIAERRSSADAHDDMLDALLRSGDDGTREKISDEQIIDLLIALIYSGYETMSTTSMMAVKYLSEHPRALEELRREHLDISKGKSPEEAISYDDFKSMAFTRAVIFETLRLATVVNGLLRKTTQDVEMNGYVIPKGWRIYVYTREINYDPFMYPDPMAFNPWRWLEKNMESHPHFMLFGGGGRMCPGKEVGTAEITTFLHYFVTRYRWEEEGKNTILKFPRVEAPNGLHIRVQDY

SEQ ID NO: 8721 - protein, 245 aa, Zea mays
MASSACLLQASTAFAPRFSLPSRPQPPLHLRLRGSPNRRRGISLTASSAASPEVEKESSPSSSPQESLSAVADSVKVLKVAAKTRKVPAPEILSALSKIKKAKLDTSAFFETLGGTESPGRTWMLIFTAKGRLEKGQYFPVTAVQRFDAAGKRIENGIYLGPIGCLTFEGRLSWKKKILAFIFERVRIKVGPFGPLEISLGSGDGGREPSTKDPFFVWFYVDEEIAVAQGRGGGVAYWCRCQRVP

SEQ ID NO: 8722 - protein, 249 aa, Setaria italica
MASSAALLQASTAFAPVFCPLPCRPQPAPRLHLRGSPNRRRRGVALAASSAASSEVEKEPSTSPSSSPQESESAVADSVKVLKEAAKTRKVPASEVLSALSKIKKAKLDTSTFFETLGGTESPGRTWMLIFTAKGRLEKGQYFPVTAVQRFDAAGKRIENGIYLGPIGCLTFEGRLSWKKKILAFIFERVRIKVGPFGPLEIGLGSGDDGREPSTKDPFFVWFYVDEEIAVAQGRGGGVAYWCRCQRVP

SEQ ID NO: 8723 - protein, 221 aa, Avena sativa
MAARLLGGARRVALLPNVRRRATNSWAAVRDTFFSTKEVFESHRVVFTVGTSIASVLTAWAGYSFRHMQQSKIDKRLHSIEQSLKDTHRNEHDEIKKIVTSYNISTPACIATALTTSVVGYALGWRGGAWYARRAFRREQQKLMGQIKSHNRWHWRPFSKLRNRLRSNRHASKSSDAPRLPGNGAEAPSINGASTKGLGTEVPLSNGSSASVSSSSQAAAG

SEQ ID NO: 8724 - protein, 212 aa, Oryza sativa
MLPVLSADLRRAPTPFSLLPLALAPPPPPPPTLLRRRPLLLPRAISSSTSPPPVQEMEAAYKFGPYKIDAREVFHSTPLSYAMVNLRPLLPGHVLVCPKREVKRFADLSSNEISDLWVTAKEVGIRLEQYHKASSLTFAIQDGPQAGQTVPHVHIHVIPRKKGDFEKNDEIYDAIDVKERELKEKLDLDIERKDRTMKEMAHEANEYRGLFS

SEQ ID NO: 8725 - protein, 85 aa, Eragrostis curvula
MATAQAASDSPTHRAYSPATSNPPYPSAARIADSACFPQYTASLKCLEAHQDKSKCQQQFDDYKECKKKEREARLESNKTRSLFG

SEQ ID NO: 8726 - protein, 88 aa, Pennisetum glaucum
MATAQAASASPTHHHRASPGTSPPQPPYPSAARIADSDCFPQYTASLKCLEANQDKSKCQQQFDDYKECKKKEREARLERNKSRSLFG

SEQ ID NO: 8727 - protein, 87 aa, Sorghum bicolor
MATAQAASAAPTHHRASPGTSPPQPPYPSAARIADSACFPQYTASLKCLEANQDKSKCQQQFDDYKECKKKEREARLERNKTRSLFG

SEQ ID NO: 8728 - protein, 87 aa, Panicum virgatum
  misc_feature (37)..(37): Xaa can be any naturally occurring amino acid
  misc_feature (82)..(82): Xaa can be any naturally occurring amino acid
MATAQAASASPTHHRASPGTSPPQPPYPSAARIADSXCFPQYTASLKCLEANQDKSKCQQQFDDYKECKKKEREARLERNKXRSLFG

SEQ ID NO: 8729 - protein, 85 aa, Secale cereale
MAAAHAAAASPTHRASVQATSTPPYPSAARIADSSCFPQYTASLKCLETNQDKSKCQQQFDNYKECKKREREARLERNRSRTLFG

SEQ ID NO: 8730 - protein, 85 aa, Pseudoroegneria spicata
  misc_feature (19)..(19): Xaa can be any naturally occurring amino acid
  misc_feature (21)..(21): Xaa can be any naturally occurring amino acid
MAAARAAAASPTHRASIQXTXTPPYPSAARIADSSCFPQYTASLKCLETNQDKSKCQQQFDDYKECKKREREARLERNRSRTLFG

SEQ ID NO: 8731 - protein, 87 aa, Zea mays
MATAQAASASPTHHRASPGMSPPQPPYPSAARIADSACFPQYTASLKCLEANQDKTKCQQQFDDYKECKKKEREARLERNKTRSLFG

SEQ ID NO: 8732 - protein, 86 aa, Brachypodium distachyon
MAAAHAAAAASPTHRASSQATSTPPYPSAARIADSSCFPQYTASLKCLESNQNKSKCQQQFDDYKECKKKEREARLERNRSRTLFG

SEQ ID NO: 8733 - protein, 86 aa, Triticum aestivum
MAAAHAEAAASPTHRASIQATSTPPYPSAARIADSSCFPQYTASLKCLETNQDKSKCQQQFDDYKECKKREREARLERNRSQTLFG

SEQ ID NO: 8734 - protein, 86 aa, Triticum aestivum
MAAAHAEAASPTHRASIQATSTPPYPSAARIADSSCFPQYTASLKCLEINHQDKSKCQQQFDDYKECKKREREARLERNRSRTLFG

SEQ ID NO: 8735 - protein, 86 aa, Triticum aestivum
MAAAHAEAASPTHRASIQATSTPPYPSAARIADSSCFPQYTASLKCLETNHQDKSKCQQQFDDYKECKKREREARLERNRSRTLFG

SEQ ID NO: 8736 - protein, 85 aa, Secale cereale
MAAAHAAAASPTHRASVQATSTPPYPSAARIADSSCFPQYTASLKCLETNQDKSKCQEQFDNYKECKKREREARLERNRSRTLFG

SEQ ID NO: 8737 - protein, 87 aa, Lolium multiflorum
MAAAHAAAAAASPTHRASLQATSTPPYPSAARIADSSCFPQYTASLKCLETSQDKSKCQQQFDDYKECKKKEREARLERNRSRTLFG

SEQ ID NO: 8738 - protein, 85 aa, Avena sativa
MAAAHAAAASPTHRASVQATSTPPYPSAARIADSSCFPQYTASLKCLETSQDKSKCQQQFDNYKECKKKEREARLERNRSRTLFG

SEQ ID NO: 8739 - protein, 87 aa, Secale cereale
GIMAAAHAAAASPTHRASVQATSTPPYPRAARIADSSCFPQYTASLKCLETNQDKSKCQEQFDNYKECKKREREARLERNRSRTLFG

SEQ ID NO: 8740 - protein, 471 aa, Sorghum bicolor
MGDGRAGGANRPAWLQQYELIGKIGEGTYGLVFLARLKPSHPAPGRRGPPIAIKKFKQSKEGDGVSPTAIREIMLLREINHENVVKLVNVHINHADMSLYLAFDYAEHDLYEIIRHHREKLSSSINPYTVKSLLWQLLNGLNYLHSNWIIHRDLKPSNILVMGEGDEHGIIKIADFGLARIYQAPLKPLCDNGVVVTIWYRAPELLLGGKHYTSAVDMWAVGCIFAELLTLKPLFQGVEAKNTPNPFQLDQLDKIFKVLGHPTVEKWPTLANLPWWQNDQQHIQGHKYDNPGLHNIVHLPPKSPAFDLLSKMLEYDPRKRITAAQALEHEYFRMEPLPGRNALLPSQPGEKIVPYPVRPVDTTTDFEGTTSLQPTQPPSGNAPPGGQSVARPMPRQMPQQPMVGGMPRVAAGANMAAFNAASQAGMAGLNPGNIPMQRGAGGQSHPHQLRRKADQGMGMQNPGYPQQKRRF

SEQ ID NO: 8741 - protein, 290 aa, Sorghum bicolor
MAAGSASATASLSVAAAAAAALRVRRPCARARAWAPSQRPQQGALLSLKPCASLAPHAPLWRAESDAAGGGAGAGDVMGLLLRERIVFLGNEIEDFLADAVVSQLLLLDAIDPDSDIRLFVNSPGGSSFSATMAIYDVMQLVRADVSTIGMGIAGSTASIILGGGTKGKRFAMPNTRIMIHQPVGGASGQALDVEVQAKEILTNKRNVIRIVSGFTGRTLEQVEKDIDRDRYMGPLEAVDYGLIDGVIDGDSIIPLEPVPERVKPKYNYEELYKDPQKFLTPDVPDDEIY

SEQ ID NO: 8742 - protein, 289 aa, Zea mays
MATGSASAIASFSVAAAAAAALRVRRPCARACAWAPSQRPQQGALVSLKPCASLAPQAPLWRAESDAAGGGAGAGDVMGLLLRERIVFLGNEIEDFLADAVVSQLLLLDAIDPDSDIRLFVNSPGGSLSATMAIYDVMQLVRADVSTIGMGIAGSTASIILGGGTKGKRFAMPNTRIMIHQPVGGASGQALDVEVQAKEILTNKRNVIRIVSGFTGRTPEQVEKDIDRDRYMGPLEAVDYGLIDGVIDGDSIIPLEPVPERVKPKYNYEELYKDPQKFLTPDVPDDEIY

SEQ ID NO: 8743 - protein, 287 aa, Saccharum officinarum
AGSASATASLSVAAAAAAALRVRRPCARSQAWAPSQRQQKGALLSLKPCASLAPHAPMWRAESDAAGGGAGAGDVMGLLLRERIVFLGNEIEDFLADAVVSQLLLLDAIDPDSDIRLFVNSPGGSLSATMAIYDVMQLVRADVSTIGMGIAGSTASIILGGGTKGKRFAMPNTRIMIHQPVGGASGQALDVEVQAKEILTNKRNVIRIVSGFTGRTPEQVEKDIDRDRYMGPLEAVDYGLIDGVIDGDSIIPLEPVPERVKPKYNYEELYKDPQKFLTPDVPDDEIY

SEQ ID NO: 8744 - protein, 289 aa, Setaria italica
MAAGSASATASLSVAAAAAAALRVRRPCARARAWAPSQPTQQGSLLRLKPCASLAPHAPVWRAESDGAGGGAGAGDVMGLLLRERIVFLGNEIEDFLADAVVSQLLLLDAIDPDSDIRLFVNSSGGSLSATMAIYDVMQLVRADVSTIGLGIAGSTASIILGGGTKGKRFAMPNTRIMIHQPVGGASGQALDVEVQAKEILANKRNVIRLVSGFTGRTLEQVEKDIDRDRYMGPLEAVDYGLIDGVIDGDSIIPLEPVPERVKPKYNYEEMYKVPQKFLTPDVPDDEIY

SEQ ID NO: 8745 - protein, 288 aa, Panicum virgatum
MAAGSASATASLSVAAAAAALRVRRPCAGARAWVPSQPAQQGSLLRLRPCAALAPHAPLWRAESDGARGGAGAGDVMGLLLRERIVFLGNEIEDFLADAVVSQLLLLDALDPDSDIRLFVNSPGGSLSATMAIYDVMQLVRADVSTIGLGIAGSTASIILGGGTKGKRFAMPNTRIMIHQPVGGASGQALDVEVQAKEILANKRNVIRLVSGFTGRTPEQVEKDIDRDRYMGPLEAVDYGIIDGVIDGDSIIPLEPVPERVKPKYNYEELYKDPQKFLTPDVPDDEIY

SEQ ID NO: 8746 - protein, 286 aa, Pennisetum glaucum
MAVGSASATASLSVAAAALRVGRPCARARAWAPSQPTQQGSLLRLKPCAALAPHAPVWRAESDGAGGGAGSGDVMGLLLRERIVFLGNEIEDFLADAVVSQLLLLDAIDPDSDIRLFVNSSGGSLSATMAIYDVMQLVRADVSTIGLGIAGSTASIILGGGTKGKRFAMPNTRIMIHQPVGGASGQALDVEVQAKEILSNKRNVIRLVSGFTGRTLEQVEKDIDRDRYMGPLEAVDYGIIDGVIDGDSIIPLEPVPERVKPKYNYEEMYKVPQNYLTPDVPDDEIY

SEQ ID NO: 8747 - protein, 293 aa, Oryza sativa
MSAASASATASLSAAAAVAVAAAALRPTQQRRLRVVAPPRPLRLTSLNPPRAASAPSTPLWEAGVRAESSDSPGAGAGGDVMGLLLRERIVFLGNEIEDFLADAVVSQLLLLDAVDPNSDIRLFVNSPGGSLSATMAIYDVMQLVRADVSTIGLGIAGSTASIILGGGTKGKRFAMPNTRIMIHQPVGGASGQALDVEVQAKEILTNKRNVIRLISGFTGRTPEQVEKDIDRDRYMGPLEAVDYGLIDSVIDGDSIIPLEPVPERVKPKYNYEELYKDPQKFLTPDVPDDEIY

SEQ ID NO: 8748 - protein, 291 aa, Avena sativa
MAATSASAAASLSVAASLGHRQLCSSARVTAQPHPLLKLNRRSHAVSASAASLSPLSLWEGQGIRAESDAHGGAASGDVMGLLLRERIIFLGNEIEDFLADAVVSQLLLLDAMDSESDIRLFVNSPGGSLSATMAIYDVMQLVRADVSTIGMGMAGSTASILLGGGTKGKRFAMPNTRIMMHQPVGGASGQALDVEVQAKEILTSKRNVIRIISGFTGRTLEQVEKDIDRDRYMGPLEAVDYGIIDGVIDADSIIPLEPVPERVKPKYNYEELYKDPQKFLTPDVPDDEIY

SEQ ID NO: 8749 - protein, 294 aa, Brachypodium distachyon
MAATTATASFSVTSAALRLRHRQLCARVSGPAQPYPLLKLNRRSHAVSASAPAAASSLSPLWEGLGIRAESDGPGGGASGDVMGLLLRERIIFLGNEIEDFLADAVVSQLLLLDAMDSESDIRLFVNSPGGSLSATMAIYDVMQLIRADVSTIGMGIAGSTASIILGGGTKGKRFAMPNTRIMMHQPVGGASGQALDVEVQAKEILTSKRNVIRLISGFTGRTLEQVEKDIDRDRYMGPHEAVDYGLIDGVIDGDRIIPLEPVPERVKPKYNYEELYKDPQKFLTPDVPDDEIY

SEQ ID NO: 8750 - protein, 296 aa, Hordeum vulgare
MAATSASAAASLSVTAAAHRLRHRQLCACARGPAARPHPLLKLNRRSYAASASSAAAMSPLSRWEGQGIRAELDAPGGVASGDVMGLLLRERIIFLGNEIEDFLADAVVSQLLLLDAMDSESDIRLFVNSPGGSLSATMAIYDVMQLVRADVSTIGMGIAGSTASILLGGGAKGKRFAMPNTRIMMHQPVGGASGQALDVEVQAKEILASKRNVIRLISGFTGRTLEQVEKDIDRDRYMGPLEAVDYGIIDGVIDEDSIIPLEPVPERVKPKYNYEEMYKDPQKFLTPDVPDDEIY

SEQ ID NO: 8751 - protein, 461 aa, Zea mays
MASATTSISSHPAALRDVKAARIGGLRQQQASVAPSAAAARGQRARAVRSLRAAEPARQPVAASAAAAAPAAPVADEAAALAAVDYEALARELEGASPLEIMDRALAMFGSEIAIAFSGAEDVALIEYAKLTGRPFRVFSLDTGRLNPETYQLFDKVEKHYGIRIEYMFPDASEVQELVRTKGLFSFYEDGHQECCRVRKVRPLRRALKGLRAWITGQRKDQSPGTRASIPLVQVDPSFEGLDGGAGSLVKWNPVANVDGKDIWTFLRTMDVPVNTLHAQGYVSIGCEPCTRPVLPGQHEREGRWWWEDAKAKECGLHKGNIDKDAQAAAPRSANGNGSAGAPDIFESPAVVSLTRTGIENLLRLENRAEPWLVVLYAPWCPFCQAMEASYVELAEKLAGSGVKVAKFRADGEQKPFAQAELQLQSFPTVLLFPGRTARPIKYPSEKRDVDSLLAFVNSLR

SEQ ID NO: 8752 - protein, 459 aa, Setaria italica
MASATASISSHPAALRDVKAARIGAVRQQVAVAPSAAARGQRARAVRPLRAAEQGRQPVSASAASAAPVAPVADEAAAPAAVDYEALARELEGASPLQVMDRALAMFGSEIAIAFSGAEDVALIEYAKLTGRPFRVFSLDTGRLNPETYQFFDKVEKHYGIRIEYMFPDAGEVQELVRTKGLFSFYEDGHQECCRVRKVRPLRRALKGLRAWITGQRKDQSPGTRASIPVVQVDPSFEGQDGGAGSLIKWNPVANVDGKDIWTFLRTMDVPVNTLHAQGYVSIGCEPCTRPVLPGQHEREGRWWWEDAKAKECGLHKGNIEKDGQAAAPKSANGNGSAGAPDIFESPAVVSLTRTGIENLLGLENRAEPWLVVLYAPWCPFCQAMEASYVELAEKLADSGVKVARFRADGEQKPFAQAELQLQSFPTVLLFPSRTARPIKYPSEKRDVDSLLAFVNSLR

SEQ ID NO: 8753 - protein, 456 aa, Zea mays
MASATTSISSHPAALRDVKAARIGGALRQVGVAARGQRARAVPPLRAAEPARRPVAASAAAAPPAAPVADEAAVDYEALARELEGASPLEIMDRALAMFGSEIAIAFSGAEDVALIEYAKLTGRPFRVFSLDTGRLNPETYQLFDRVEKHYGIRIEYMFPDASEVQELVRTKGLFSFYEDGHQECCRVRKVRPLRRALRGLRAWITGQRKDQSPGTRASIPLVQVDPSFEGLDGGAGSLVKWNPVANVDGKDIWTFLRTMDVPVNALHAQGYVSIGCEPCTRPVLPGQHEREGRWWWEDAKAKECGLHKGNIDKDGQAAAAAAAPRTANGNGSAGAPDIFESPAVVSLTRAGVENLLRLESRAEPWLVVLYAPWCPFCQAMEASYVELAERLAGSGGVKVARFRADGEQKPFAQAELQLQSFPTVLLFPSRTARPIKYPSEKRDVDSLLAFVNSLR

SEQ ID NO: 8754 - protein, 463 aa, Brachypodium distachyon
MASATASISSHAIALRDLKAARIGAVRQQVAAAPAAPAVRSQRARAVRPLCAAEPARKPLSASAAAAPVAPVLVEEEASAVPAAVDYEALAQELQGASPLEIMDRALSMFGSEIAIAFSGAEDVALIEYAKLTGRPFRVFSLDTGRLNPETYQLFDKVEKHYGIHIEYMFPEAAEVQELVRNKGLFSFYEDGHQECCRVRKVRPLRRALKGLKAWITGQRKDQSPGTRASIPVVQVDPSFEGLDGGAGSLIKWNPVANVEGKDIWTFLRTMDVPVNTLHAQGYVSIGCEPCTRPVLPGQHEREGRWWWEDATAKECGLHKGNIEKEGQAPKVGVNGNGSAEASAPDIFQSQAVVSLTRPGIENLLKLENRTEPWLTVLYAPWCPYCQAMEASYLELAEKLSGSGVKVAKFRADGEQKPFAQAELQLQSFPTILLFPSRTARPIKYPSEKRDVESLLAFVNSLR

SEQ ID NO: 8755 - protein, 463 aa, Triticum aestivum
MASATASISSHSIALRDLKATRIGAVRQQVAVVPAGLPATAPKGQRARAVRPLCAAEPARKPVSASAASSPVAPVEEEASAAAAVDYEALAQELVGASPLEIMDRALDMFGSEIAIAFSGAEDVALIEYAKLTGRPFRVFSLDTGRLNPETYQLFDKVEKHYGIHIEYMFPEASEVQDLVRSKGLFSFYEDGHQECCRVRKVRPLRRALKGLKAWITGQRKDQSPGTRASIPVVQVDPSFEGLDGGAGSLIKWNPVANVDGKDIWTFLRTMDVPVNTLHAQGYVSIGCEPCTRPVLPGQHEREGRWWWEDATAKECGLHKGNIDKEGQAPKVGVNGNGSAEASAPDIFQSQAIVNLTRPGIENLLRLENRAEPWLTVLYAPWCPYCQAMEASYVELAEKLSGSGIKVAKFRADGEQKPFAQAELQLQSFPTILLFPGRTVKPIKYPSEKRDVQSLLAFVNSLR

SEQ ID NO: 8756 - protein, 458 aa, Hordeum vulgare
MASATASISSHSIALRDLKAARIGAVRQQVAVPAAAPKGQRARAVRPLCAAEPSRKPVSASAASAPVAPVEEEASAAASVDYEALALELVDASPLEIMDRALDMFGSEIAIAFSGAEDVALIEYAKLTGRPFRVFSLDTGRLNPETYQLFDKVEKHYGIHIEYMFPEASEVQDLVRTKGLFSFYEDGHQECCRVRKVRPLRRALKGLKAWITGQRKDQSPGTRASIPVVQVDPSFEGLDGGAGSLIKWNPVANVDGKDIWTFLRTMDVPVNTLHAQGYVSIGCEPCTRPVLPGQHEREGRWWWEDATAKECGLHKGNIDKEGQTPKVGVNGNGSAEASAPDIFQSQAIVNLTRPGIENLLRLENRAEPWLAVLYAPWCPYCQAMEASYVELAEQLSGSGIKVAKFRADGEQKSFAQAELQLQSFPTILLFPGRTVKPIKYPSEKRDVQSLLAFVNTLR

SEQ ID NO: 8757 - protein, 466 aa, Leymus cinereus x Leymus triticoides
  misc_feature (168)..(168): Xaa can be any naturally occurring amino acid
  misc_feature (394)..(394): Xaa can be any naturally occurring amino acid
MASATASISSHSIALRDLKAARIGAVRQQVAVVPAGLPATAPKGQRARAVRPLCAAEPARKPVSASAVSAPVAPVEEEASAAAPAAAVDYEALAQELLGASPLEIMDRALDMFGSEIAIAFSGAEDVALIEYAKLTGRPFRVFSLDTGRLNPETYQLFDKVEKHYGIXIEYMFPEASEVQDLVRTKGLFSFYEDGHQECCRVRKVRPLRRALKGLKAWITGQRKDQSPGTRASIPVVQVDPSFEGLDGGAGSLIKWNPVANVDGKDIWTFLRTMDVPVNTLHAQGYVSIGCEPCTRPVLPGQHEREGRWWWEDATAKECGLHKGNIDKEGQAPKVGVNGNGSAEASAPDIFQSQAVVNLTRPGIENLLRLENRAEPWLTVLYAPWCPYCQAMEXSYVELAEKLSGSGIKVAKFRADGEQKPFAQAELQLQSFPTILLFPGRTVKPIKYPSEKRDVQSLLAFVNTLR

SEQ ID NO: 8758 - protein, 463 aa, Triticum aestivum
MASATASISSHSIALRDLKAARIGAVRQQVAVVPAGLPATAPKGQRARAVRPLCAAEPARKPVSASAASSPVAPVEEEASAVAAVDYEALAQELVGASPLEIMDRALDMFGSEIAIAFSGAEDVALIEYAKLTGRPFRVFSLDTGRLNPETYELFDKVEKHYGIHIEYMFPEASEVQDLVRSKGLFSFYEDGHQECCRVRKVRPLRRALKGLKAWITGQRKDQSPGTRASIPVVQVDPSFEGLDGGAGSLIKWNPVANVDGKDIWTFLRTMDVPVNTLHAQGYVSIGCEPCTRPVLPGQHEREGRWWWEDATAKECGLHNGNIDKEGQAPKVGVNGNGSAEASAPDIFQSQAIVNLTRPGIENLLRLENRAEPWLTVLYAPWCPYCQAMEASYVELAEKLSGSGIKVAKFRADGEQKPFAQAELQLQSFPTILLFPGRTVKPIKYPSEKRDVQSLLAFVNSLR

SEQ ID NO: 8759 - protein, 475 aa, Oryza sativa
MASATASISSHSVALRDLKAARIGAVKQQVAAAPAAGTAAARAQRARAVRPLRAAEPARQPVSASAAAAPAAAPVAEDAAAAAVDAPAPAVDYEALAQELQGASPLEIMDRALAMFGSDIAIAFSGAEDVALIEYAKLTGRPFRVFSLDTGRLNPETYQLFDKVEKHYGIRIEYMFPDAGEVQALVRAKGLFSFYEDGHQECCRARKVRPLRRALRGLRAWITGQRKDQSPGTRAAIPVVQVDPSFEGLAGGAGSLVKWNPVANVDGKDVWTFLRAMDVPVNALHAQGYVSIGCEPCTRPVLPGQHEREGRWWWEDAKAKECGLHKGNIDDQGGAAAAAAHKAGGANGNGSAGAPDIFESSGVVSLTRAGVENLLRLESRAEPWLVVLYAPWCPFCQAMEASYLELAERLGGAGGGVKVGKFRADGEQKAFAQQELQLQSFPTILLFPSRTARPIKYPSEKRDVDSLLAFVNSLR

SEQ ID NO: 8760 - protein, 459 aa, Secale cereale
MASATASISSHSIALRDLKAARIGAVRQQVAVVPAGLPATAPKGQRARAVRPLCAAEPARKPVSASAASSPVAPVEEAVAVEYEALAQELVGASPLEIMDRALDMFGSEIAIAFSGAEDVALIEYAKLTGRPFRVFSLDTGRLNPETYELFDKVEKHYGIHIEYMFPEASEVQDLVRSKGLFSFYEDGHQECCRVRKVRPLRRALKGLKAWITGQRKDQSPGTRASIPVVQVDPSFEGLDGGAGSLIKWNPVANVDGKDIWTFLRTMDVPVNTLHAQGYVSIGCEPCTRPVLPGQHEREGRWWWEDATAKECGLHKGNMDKEGQAPKVGVNGNGSAEASAPDIFESQAIVNLTRPGIENLLRLENRAEPWLTVLYAPWCPYCQAMEASYVELAEKLSGSGIKVAKFRADGEHKPFAQAELQLQSFPTILLFPGRTVKPIKYPSEKRDVQSLLAFVNSLR

SEQ ID NO: 8761 - protein, 460 aa, Avena sativa
MASATASISSHAIALRDLKAVRIGGVRQQVAVVPAGPTVKSQRARAVRPLCAAEPARKPLSASAASAPVAPVEEEEASAAAVDYEALAQELVGASPLEIMDRALDLFGSEIAIAFSGAEDVALIEYAKLTGRPFRVFSLDTGRLNPETYQLFDKVEKHYGIHIEYTFPEAGEVQDLVRSKGLFSFYEDGHQECCRVRKVRPLRKALKGLKAWITGQRKDQSPGTRASIPVVQVDPSFEGLDGGAGSLIKWNPVANVEGKDVWTFLRTMDVPVNALHAQGYVSIGCEPCTRPVLPGQHEREGRWWWEDAAAKECGLHKGNIEKDGQGPKVGVNGNGSAEASAPDIFQSQAIVNLTRPGIENLLRLENRTEPWLTVLYAPWCPYCQAMEAPYVELAEKLSGSGIKVAKFRADGEQKPFAQAELQLQSFPTILLFPSRTVRPIKYPSEKRDVDSLLAFVNSLR

SEQ ID NO: 8762 - protein, 394 aa, Saccharum officinarum
AAPAAPVADEAAALAAVDYEALARELEGASPLEIMDRALAMFGSEIAIAFSGAEDVALIEYAKLTGRPFRVFSLDTGRLNPETYQFFDKVEKHYGIRIEYMFPDASEVQELVRTKGLFSFYEDGHQECCRVRKVRPLRRALKGLRAWITGQRKDQSPGTRASIPLVQVDPSFEGLDGGAGSLIKWNPVANVDGKDIWTFLRTMDVPVNTLHAQGYVSIGCEPCTRPVLPGQHEREGRWWWEDAKAKECGLHKGNIEKDAQAAAPRSANGNGSAGAPDIFESPAVVPLTRAGIENLLRLENRAEPWLVVLYAPWCPFCQAMEASYVELAEKLAGSGVKVAKFRADGEQKPFAQAELQLQSFPTVLLFPSRTARPIKYPSEKRDVDSLLAFVNSLR

SEQ ID NO: 8763 - protein, 461 aa, Triticum aestivum
MASATASVSSHSSALRDLKAARIGAVRQQVAVVPAGLPAKAPKGQRARAVRPLCAAEPARKPVSASAASSPVAPVEEEEASAVDYEALAQELVGASPLEIMDRALDMFGSEIAIAFSGAEDVALIEYAKLTGRPFSVFSLDTGRLNPETYELFDKVEKHYGIHIEYMFPEASEVQDLVRSKGLFSFYEDGHQECCRVRKVRPLRRALKGLKAWITGQRKDQSPGTRASIPVVQVDPSFEGLHGGAGSLIKWNPVANVDGKDIWTFLRTMDVPVNTLHAQGYVSIGCEPCTRPVLPGQHEREGRWWWEDATAKECGLHKGNIDREDQAPKVGVNGNGSAEARAPDIFQSQAIVNLTRPGIENLLRLENRAEPWLTVLYAPWCPYCQAMEASYVELAEKLSGSGIKVAKFRADGEQKPFAQAELQLQSFPTILLFPGRTVKPIKYPSEKRDVQSLLAFVNSLR

SEQ ID NO: 8764 - protein, 392 aa, Pennisetum glaucum
PVAPVADEAAAPAAVDYEALARELEGASPLQVMDRALAMFGSEIAIAFSGAEDVALIEYAKLTGRPFRVFSLDTGRLNPETYQFFDKVEKHYGIRIEYMFPDSGEVQELVRTKGLFSFYEDGHQECCRVRKVRPLRRALKGLRAWITGQRKDQSPGTRASIPVVQVDPSFEGQDGGAGSLIKWNPVANVDGKDIWTFLRTMDVPVNTLHAQGYVSIGCEPCTRPVLPGQHEREGRWWWEDAKAKECGLHKGNIEKDGQAAAPKSANGNGSAGAPDIFESPAVVSLTRAGIENLLRLENRAEPWLVVLYAPWCPFCQAMEASYVELAEKLAGSGVKVGRFRADGEQKPFAQAELQLQSFPTVLLFPSRTARPIKYPSEKRDVDSLLAFVNSLR

SEQ ID NO: 8765 - protein, 199 aa, Saccharum officinarum
MESSSHKRAREVVDLAAGGPGEASALPEAADAKRLRPQDLLDMLDDDTDAAAAGDLASVMRSLEEEIASFDEAVAAPTQQQQQPELGFLLEASDDELGLPPAGASASSSEEAGGLAGAPESAGAALDGQIWGFEDEIDGGEIDGGAGFGGYSPEAAAAAAAAAAWDDDGFDAGLFAFGENDAYGPSDLAALRHETMPAV

SEQ ID NO: 8766 - protein, 192 aa, Setaria italica
MESSSHKRAREAAADLSAGEGGALPEADAKRLRPEDLLDMLDDDTDAATAGDLASVMRSLEEEIASFDEAGATAAAAPPAHHQQQPELGFLLEASDDELGLPPAGASSSSEDAGGAAGEEPDVAAGLDGQIWGFEDEIDGGFGGYSPEAAAAAAAAAAWDDDGFDAGLFAFGDDACGPSDLAALRHETMPAV

SEQ ID NO: 8767 - protein, 279 aa, Zea mays
MTMAGSCAAVPVAGLPSLRTPMPTHLRLGGFMPCSSAARSRGAAVLGCALGARKQTPGVLNQLLCRYMRRDGHEGDVSNQGRDGAVMFGPDDDGVKIPTQVETLVKGTAAVAEPEYKQIPDVDYLQELLAIQQQGPRAIGFFGTRNMGFMHQQLIEILSYAMVITKNHIFTSGASGTNAAVIRGALRAEKPELLTVILPQSLKKQPPESQELLSKVQNLLEKPQYDHLPLIEASRLCNMDIISKVQQVICFAFHDSKLLMETCQEAMNLRKIVTLFYLD

SEQ ID NO: 8768 - protein, 284 aa, Setaria italica
MTMAGSCAAAPVAGLPSLRTPPPTNLRLGGFFHCSSASRSPGGAVLGWTQGAKKQTPTPPAVARLNRLLCGYMRRDGHEGDVRSQGRDDAIMFGPDDDGVKIPTQTETLVKGTAMVAEPEYKPIPDLDYLQELLAIQQQGPRAIGFFGTRNMGYMHQQLIEILSYAMVITKNHIFTSGASGTNAAVIRGALRAEKPELLTVILPQSLKKQPPESQELLSKVQNLIEKPQYDHLPLIEASRLCNMDIISKVQQVICFAFHDSKLLMETCQEAKNLRKIVTLFYLD

SEQ ID NO: 8769 - protein, 280 aa, Setaria italica
MTMAGSCAAAPVGGLPSLRTPPRMNLRLGGFLHCSSAARSPGGVLLGWAQATKQPPAVARLNRLLCGYMQRDGHEGDVRSQGRDDTIMFGPDDDGVKIPTQTETLVKGTAMVAEPEYKPIPDLDYLQELLAIQQQGPRAIGFFGTRNMGYMHQQLIEILSYAMVITKNHIFTSGASGTNAAVIRGALRAEKPELLTVILPQSLKKQPPESQELLSKVQNLIEKPQYDHLPLIEASRLCNMDIISKIQQVICFAFHDSKLLMETCQEAKNLRKIVTLFYLD

SEQ ID NO: 8770 - protein, 212 aa, Panicum virgatum
MRRDGHEGYVTSQGRDDAIMFGPDDDGLKIPTQTETLVKGTAMVAEPENKAIPDLDYLQELLAIQQQGPRAIGFFGTRNMGFMHQQLIEILSYAMVTTKNHIFTSGASGTNAAVIRGALRAEKPELLTVILPQSLKKQPPESQELLSKVQNLIEKPQYDHLPLIEASRLCNMDIISKVQQVICFAFHDSKLLMETCQEAKNLRKIVTLFYLD

SEQ ID NO: 8771 - protein, 161 aa, Zea mays
MTSSTAFSQLFPSAAAVSPVPRCVSLQLFCASGGVVPGWRRRCRRMAMVRAATADAAAPAYTSDSLILYFKAEGTMEERAIPKITESLEGMEGVKDLEVLIEEGIGSVVLTKETTVQATGVASNLVEAIQGAGFKLQTLSLSFDDFDEPAAGAGGTVQSSE

SEQ ID NO: 8772 - protein, 156 aa, Setaria italica
MMSLPASTHLLPSAAAVSLLPRRVSLQLSYATGWRAGSRRPAVVRAATAEAAAPAYTSDSLILYFKAEGTMEERAIPKITESLEGMEGVKDLEVLIEEGIASVVLTKETTVQATGVASNLVEAIQGAGFKLQTLSLSFNDFDEATAGVGGGVQSSE

SEQ ID NO: 8773 - protein, 174 aa, Saccharum officinarum
LRPTRPNRDKSKIMSSTAFSHLFPSAAVAAVSLLPGRVSLQLFCNSGEVAPGWRRRSPRMAVVRAATADAAAPAYTSDSLILYFKAEGTMEERAIPKITESLEGMEGVKDLEVLIEESITSVVLTKETTVQATGVASNLVEAIQGAGVKLQTLSLSFDDFDDITAAGGNVQPSE

SEQ ID NO: 8774 - protein, 189 aa, Zea mays
MEAFLAGLFRAPPRAVPAPRGTPLPSLPLFYGRRRRRPSSSVVCMAEPYLIAKLDSAEKAWKEMSVRLADPDIVSDPSEYQKIAQSVSELDQVVTTYRQFKDCERQLEATKALEKENEGDPDMLEMIASELEALSNQLAELEEKMKFLLLPSDPLDSRNILLEVRAGAGGDEAGIWAGDLVGSHVPEIL

SEQ ID NO: 8775 - protein, 413 aa, Setaria italica
MEAFLAGFFRAPPRCGPAARAAPTFSGLPLFHGRRRRRPSSSVVCMAEPYLIAKLDSAEKAWKEMSVRLADPDIVSDPSEYQKLAQSVAELDQVVTTYRQFKDCERNLEETKALEKENEEDPDMAEMIASELEALSNQLAELEEKLKLLLIPSDPLDARNILLEVRAGAGGDEAGIWAGDLVRMYQRYCERNNWKFKPVSCSEAEMGGYKTYVMEVKGKQVYSKLKFESGVHRVQRVPQTETMGRVHTSTATVAIMPEADEVDVVIDPKDIELKTARSGGAGGQNVNKVETAVDLIHKPTGIRIFCTEERSQLQNRERAFQLLRAKLYEIKLREQQESIRNQRKLQVGTGARSEKIRTYNYKDNRVTDHRLKMNFELTSFLLGDIESAVQSCATLEQQELLEEMASSVGVAKV

SEQ ID NO: 8776 - protein, 416 aa, Oryza sativa
MEAFLAGFRAPRPRVPAVSAAARSLPPNTSFFSGGRRRRRLLSSSVVCMAEPYLIAKLDSAEKAWKEMSVRLADPDIVSDPSEYQKLAQSVAELDQVVSTYRQFKDCEKQIEETKVLQKENEDDPDMAEMIDSEMESLSNQLEELEEKLKLLLLPNDPLDARNILLEVRAGAGGDEAGIWAGDLVRMYQKYCERNSWKFKPVSSSEAEKGGFKTYVMEVKGKQVYSKLKFESGVHRVQRVPQTETMGRVHTSTATVAIMPEADEVDVVIDPKDIELKTARSGGAGGQNVNKVETAVDLIHKPTGIRIFCTEERSQLQNRERAFQLLRAKLYEIKLREQQESIRNQRKLQVGTGARSEKIRTYNYKDNRVTDHRLKMNFELTGFLMGDIESAVQSCSSMEQKELLEEMATSVGAAKV

SEQ ID NO: 8777 - protein, 412 aa, Triticum aestivum
MEAFLAGFRAPPRASAVPTARSPPPSPFFLGTRRRKPSSSASVVCMAEPHLISKLDSTEKAWKEMSIRLGDPDIVSDPSEYQKLAQSVSDLGEVVTAYREFKECERQIEETKALQKENGDDPDMAEMIASELESLSDQLAELEERLTVLLLPSDPLNSRNILLEVRAGTGGDEAGIWAGDLVRMYQRYCELNNWKFKPVSCSEAEKGGYKTYVMEVKGKQVYSKLKFESGVHRVQRVPQTETMGRVHTSTATVAIMPEADEVDVVIDPKDIELKAARSGGAGGQNVNKVETAIDLIHKPTGIRIFCTEERSQLQNKERAFQLLRAKLYEIKLREQQESIRTQRLLQVGTGARSEKIRTYNYKDNRVTDHRLKMNFVLSSFLLGDIESAVQSCAALEQKELLEEMATSSAVKA

SEQ ID NO: 8778 - protein, 411 aa, Brachypodium distachyon
MEAFLAGFRAPPRAPTASTARSPPPSPFFLGSKRRRKPSSSVVCMAEPHLISKLESTEKAWKEMSARLGDPDIVSDPSEYQKLAQSVADLGEVVSAYRQFKECERQIEETKALQKENGDDPDMAEMIASELESLSNQLAELEEKLTVLLLPSDPLNSRNILLEVRAGTGGDEAGIWAGDLVRMYQKYCELNNWKFKPVSCSEAEKGGYKTYVMEVKGKQVYSKLKFESGVHRVQRVPQTETMGRVHTSTATVAIMPEADEVDVVIDPKDIELKTARSGGAGGQNVNKVETAIDLIHKPTGIRIFCTEERSQLQNKERAFQLLRAKLYEIKLREQQESIRTQRLLQVGTGARSEKIRTYNYKDNRVTDHRLKMNFVLSSFLIGDIESAVQSCAAMEQKELLEEMATSSAVKA

SEQ ID NO: 8779 - protein, 412 aa, Triticum aestivum
MEAFLAGFRAPPRASAVPTARSPPPSPFFLGTRRSKPSSSASVVCMAERHLISKLDSTEKAWKEMSIRLGDPDIVSDPSEYQKLAQSVSDLGEVVTAYREFKECERQIEETKALQKENGDDPDMAEMIASELESLSDQLAELEERLTVLLLPSDPLNSRNILLEVRAGTGGDEAGIWAGDLVRMYQRYCELNNWKFKPVSCSEAEKGGYKTYVMEVKGKQVYSKLKFESGVHRVQRVPQTETMGRVHTSTATVAIMPEADEVDVVIDPKDIELKAARSGGAGGQNVNKVETAIDLIHKPTGIRIFCTEERSQLQNKERAFQLLRAKLYEIKLREQQESIRTQRLLQVGTGARSEKIRTYNYKDNRVTDHRLKMNFVLSSFLLGDIESAVQSCAALEQKELLEEMATSSAVKA

SEQ ID NO: 8780 - protein, 92 aa, Zea mays
MNIPDWQKILGVEYRDHHRAGEWEPGADDDDDDDGSSYGRARGGAEMVPPHELAWRSRAASLSVHEGIGRTLKGRDLSRVRDAVWKKTGFED

SEQ ID NO: 8781 - protein, 538 aa, Panicum virgatum
MEAGTWWAVAAAAVAVYMAWFWRMSRGLSGPRVWPLVGSLPGLVRHAEDMHEWIAANLRRAGGTYQTCIFAVPGVARRGGLVTVTCDPRNLEHVLKARFDNYPKGPFWHAVFGDLLGDGIFNSDGETWVAQRKTAALEFTTRTLRTAMSRWVSRSIHGRLLPILGDAAADGAAVDLQDLLLRLTFDNICGLAFGKDPETLARGLPENDFASAFDRATEATLNRFIFPECVWRCKKWLGLGMETTLARSVRHVDRYLSAVIKARKLELTAGRKGDDTPHDDLLSRFMRKGTYSDESLQHVALNFILAGRDTSSVALSWFFWLVSTHPAVERKVVRELCAVLAASRGVDDPALWLAAPFDFEELDRLVYLKAALSETLRLYPSVPEDSKHVVADDVLPDGTFVPAGSSVTYSIYSAGRMKTVWGEDCLEFRPERWLSADGTRFEPHDSYRFVAFNAGPRICLGKDLAYLQMKNIAGSVLLRHRLAVAPGHRVEQKMSLTLFMKHGLRMEVRPRDLAPFVDELRGAGAEYDAAARATAACA

SEQ ID NO: 8782 - protein, 536 aa, Zea mays
MEAGTWAAAAVAAVALYVAWFWRMSRGLSGPRVWPLLGSLPGLVQHAEDMHEWIAANLRRAGGTYQTCIFAVPGVARRGGLVTVTCDPRNLEHVLKARFDNYPKGPFWHAVFRDLLGDGIFNSDGDTWVAQRKTAALEFTTRTLRTAMSRWVSRSIHARLLPILADAHVVDLQDLLLRLTFDNICGLAFGKDPETLARGLPDNAFASAFDRATEATLNRFIFPECVWRCKKWLGLGMETTLARSVRHVDRYLSAVIKARKLELSAATRKDLLSATPHDDLLSRFMRKGTYSDESLQHVALNFILAGRDTSSVALSWFFWLVSTHPAVERNIVRELCAVLAGSRGVEDPALWLAAPLDFEELDRLVYLKAALSETLRLYPSVPEDSKHVVADDVLPDGTFVPAGSSVTYSIYSAGRMKTVWGEDCLQFRPERWLSDDGTRFQPHDSYRFVAFNAGPRICLGKDLAYLQMKNIAGSVLLRHRLTVAPGHRVEQKMSLTLFMKHGLRMEVRPRDLSVVIDELRGAGEYDAAARATAASA

SEQ ID NO: 8783 - protein, 545 aa, Oryza sativa
MEAGTWAVVVAAVAAYMAWFWRMSRGLSGPRVWPVVGSLPGLVRHAEDMHEWIAANLRRTRGTYQTCIFAVPGLARRGGLVTVTCDPRNLEHVLKSRFDNYPKGPFWHGVFGDLLGDGIFNSDGETWVAQRKTAALEFTTRTLRTAMSRWVSRSIHSRLLPILSDAAAAGGGGGGATVDLQDLLLRLTFDNICGLAFGKDPETLARGLPENDFASAFDRATEATLNRFIFPECVWRFKKWMGLGMETTLARSVQHVDRYLSAVIKARKLELAAGNGKGDASSATPHDDLLSRFMRKGTYSDESLQHVALNFILAGRDTSSVALSWFFWLVSTHPAVERKIVRELCTVLAASRGADDPALWLAAPLNFEELDQLVYLKAALSETLRLYPSVPEDSKHVVADDVLPDGTFVPAGSSVTYSIYSAGRMKTVWGDDCLEFRPERWLSADGTKFEPHDSFRFVAFNAGPRICLGKDLAYLQMRNIAGSVLLRHRLAVAPGHRVEQKMSLTLFMKHGLRMEVRPRDLAPIVDELRGAGEYAAAARATAACA

SEQ ID NO: 8784 - protein, 531 aa, Triticum aestivum
MEAGTWAVVVAAAAAYLAWFWRMSRGLSGPRVWPLVGSLPGLLQHAEDMHEWIVGNLRRTGGTYQTCIFAVPGVARRGGLVTVTCDPRNLEHVLKARFDNYPKGPFWHGVFSDLLGDGIFNSDGDTWVAQRKTAALEFTTRTLRTAMSRWVSRSIHHRMLPILSDAAASGAHVDLQDLLLRLTFDNICGLAFGKDPETLARGLPENAFATSFDRATEATLNRFIFPEFVWRCKKWLGLGMETTLARSVAHVDRYLSAVIKTRKLELASKSDGSTPHDDLLSRFMRKGTYSDDSLQHVALNFILAGRDTSSVALSWFFWLVSTHPDVERKIVRELCAVLAASRGADDPALWLAAPFDYEELDRLVYLKAALSETLRLYPSVPEDSKHVVADDYLPDGTFVPAGSSVTYSIYSAGRMKTVWGEDCLEFRPERWLSADGTKFEPHDSYRFVAFNAGPRICLGKDLAYLQMKNIAGSILLRHRLAVAPGHRVEQKMSLTLFMKHGLRMVVRPRDLAPTLDELRAAAAAPAVAACA

SEQ ID NO: 8785 - protein, 532 aa, Triticum aestivum
MEAGTWAVVVAAAAAYLAWFWRMSRGLSGPRVWPLVGSLPGLLQHAEDMHEWIVGNLRRTGGTYQTCIFAVPGVARRGGLVTVTCDPRNLEHVLKARFDNYPKGPFWHGVFSDLLGDGIFNSDGDTWVAQRKTAALEFTTRTLRTAMSRWVSRSIHHRMLPILSDAAASGAHVDLQDLLLRLTFDNICGLAFGKDPETLARGLPENAFATSFDRATEATLNRFIFPEFVWRCKKWLGLGMETTLARSVAHVDRYLSAVIKTRKLELAGKIDGSGATTPHDDLLSRFMRKGTYSDDSLQHVALNFILAGRDTSSVALSWFFWLVSTHPDVERKIVRELCAVLAASRGADDPALWLAAPFDYEELDRLVYLKAALSETLRLYPSVPEDSKHVVADDYLPDGTFVPAGSSVTYSIYSAGRMKTVWGEDCLEFRPERWLSADGTKFEPHDSYRFVAFNAGPRICLGKDLAYLQMKNIAGSILLRHRLAVAPGHRVEQKMSLTLFMKHGLRMVVRPRDLAPTLDELPAAAPAVAACA

SEQ ID NO: 8786 - protein, 407 aa, Secale cereale
MEAGTWAVVVAALAAYLAWFWRMSRGLSGPRVWPLVGSLPGLLQHAEDMHEWIVGNLRRTGGTYQTCIFAVPGVARRGGLVTVTCDPRNLEHVLKARFDNYPKGPFWHGVFSDLLGDGIFNSDGDTWVAQRKTAALEFTTRTLRTAMSRWVSRSIHHRMLPILSDAAAAGAHVDLQDLLLRLTFDNICGLAFGKDPETLARGLPENAFATSFDRATEATLNRFIFPECVWRCKKWLGLGMETTLARSVAHVDRYLSAVIKTRKLELAGKSDGSGATTPHDDLLSRFMRKGTYSDDSLQHVALNFILAGRDTSSVALSWFFWLVSTHPGVERKIVRELCAVLAASAAQTTRHCGWPPRSTTRSWTASCTSRRRSRRRSACIRPCRRTRSTWWPTTTSPTARSCRPGRR

SEQ ID NO: 8787 - protein, 532 aa, Oryza sativa
MEVGTWAVVVAVAAAYMTWFWRMSRGLSGPRVWPVVGSLPGLVQHAENMHEWIAANLRRAGGTYQTCIFAVPGVARRGGLVTVTCDPRNLEHVLKSRFDNYPKGPFWHAVFRDLLGDGIFNSDGETWVAQRKTAALEFTTRTLRTAMSRWVSRSIHHRLLPILDDAAAGKAHVDLQDLLLRLTFDNICGLAFGKDPETLAKGLPENAFASAFDRATEATLNRFIFPEYLWRCKKWLGLGMETTLASSVAHVDQYLAAVIKARKLELAGNGKCDTVAMHDDLLSRFMRKGSYSDESLQHVALNFILAGRDTSSVALSWFFWLVSTHPAVERKVVHELCAVLAASRGAHDPALWLAAPFTFEELDSLVYLKAALSETLRLYPSVPEDSKHVVADDYLPDGTFVPAGSSVTYSIYSAGRMKTVWGEDCLEFRPERWLSADGSKFEPHDSYKFVAFNAGPRICLGKDLAYLQMKNIAGSVLLRHRLAVAQGHRVEQKMSLTLFMKNGLRMEVRPRDLAPVADELRGADVRATAPCA

SEQ ID NO: 8788 - protein, 542 aa, Sorghum bicolor
MEVGTWAVVVAAAAAYLAWFWRLSRGLSGPRVWPVLGSLPGLVQHAEDMHEWIVGNLRRTGGTYQTCIFAVPGVARRGGLVTVTCDPRNLEHVLKARFDNYPKGPFWHAVFRDLLGDGIFNSDGDTWVAQRKTAALEFTTRTLRTAMSRWVSRSIHLRLLPILDEAASEGTHVDLQDLLLRLTFDNICGLAFGKDPETLAPGLPENAFATAFDRATEATLNRFIFPECLWRCKKWLGLGMETTLARSVAHVDQYLAAVIKARKLELAGNGKCDSDTTAPVAAHDDLLSRFMRKGSYSDESLQHVALNFILAGRDTSSVALSWFFWLVSTHPDVERKIVRELCAALAVSRGSHDPALWLASPFTFEELDRLVYLKAALSETLRLYPSVPEDSKHVVADDYLPDGTFVPAGSSVTYSIYSAGRMKTVWGEDCLDFRPERWLSADGTRFEPHDSYRFVAFNAGPRICLGKDLAYLQMKNIAGSVLLRHRLAVAQGHRVEQKMSLTLFMKHGLRMEVHPRDLAPVIDELRGAGAGAAARLATAPCA

SEQ ID NO: 8789 - protein, 530 aa, Hordeum vulgare
MEAGTWAVVVAAVAAYLAWFWRMSRGLSGPRVWPLVGSLPGLLQHAEDMHEWIVGNLRRTGGTYQTCIFAVPGVARRGGLVTVTCDPRNLEHVLKARFDNYPKGPFWHGVFRDLLGDGIFNSDGDTWVAHRKTAALEFTTRTLRTAMSRWVSRSIHHRMLPILSDAAGAGAHVDLQDLLLRLTFDNICGLAFGKDPETLARGLPDNAFATSFDRATEATLNRFIFPEFVWRCKKWLGLGMETTLARSVAHVDRYLSAVIKTRKLELAGKSDGPTPHDDLLSRFMRKGTYSDDSLQHVALNFILAGRDTSSVALSWFFWLVSTHPAVERKIVREICAVLAASRGADDPALWLAAPFDYEELDRLVYLKAALSETLRLYPSVPEDSKHVVADDYLPDSTFVPAGSSVTYSIYSAGRMKTVWGEDCLEFRPERWMSADGTKLEPHDSYRFVAFNAGPRICLGKDLAYLQMKNIAGSILLRHHLAVAPGHRVEQKMSLTLFMKHGLRMVVRPRDLAPTVDELRAAAAPAVAACA

SEQ ID NO: 8790 - protein, 895 aa, Sorghum bicolor
MPPWWGKSSSKEVKKTAKENLIDTFQRLISSNEQKGSRKSRGSRKHGKDTAGDKGCWSTAQSRSTSPSKEVSRCQSFAADRPPAQPLPLPKSRARVTRTSSDITNSKSTLEKHGKGQLLPLPPTQPRKRPEATEPVTEVATASVSSNCSIDSDDPGDSRLQSPVGNEVENATRITATSSSSVLHKERSSAITKKSTKEVAKPNNAFLSNQILSTSPRGTVADGYQSNLQSPRQIALESAPNSLMSSPSRSPRIICPDQIPTSAFWAVKPHTDITFLGSGQCSSPGSGQTSGHNSVGGDMLGPIFWQPSRGSPECSPIPSPRMTSPGPSSRVHSGSVSPLHPRAGGVTPESPTNRHAEGNKKQTHRLPLPPISTANISTFLPNSSTPASPISRSPGRTENPPSPGSRWKKGKLIGRGTFGHVYVGFNSDRGEMCAMKEVTLFADDPKSKESAKQLCQEISLLSRLQHPNIVRYYGSETVDDKLYIYLEYVSGGSIHKLLQEYGQFGEQAIRSYTKQILLGLAYLHAKNTVHRDIKGANILVDPNGRVKLADFGMAKHINGQQCPFSFKGSPYWMAPEVIKNASGCNLAVDIWSLGCTVLEMATSKPPWSQYEGIAAMFKIGNSKELPPIPDHLSEEGKDFIRKCLQRDPSSRPTAVDLLQHAFVRNAPPLEKSSASHPLEVEQLTAISCRTNSKVVEHARNMSSLGLEGQSILQRRAAKFSLPISDIHIRSNISCPVSPCGSPLLRSRSPQHQNGRMSPSPISSPRTTSGASTPLTGGSGAVPLNHVRQPAYRNEGFTVTSRGFDDHIPSRPVDPVHGRFIRVQQFSAGRQERVVSEADILSSQFGKMRHANVWDSHDRPLPSERSSQQCFGDHVKLKPSLDLRSGPRHPGRNHGH

SEQ ID NO: 8791 - protein, 537 aa, Brachypodium distachyon
MEAGTWAVVVAAVAAYMAWFWRMSRGLRGPRVWPVLGSLPGLVQHAEDMHEWIAGNLRRAGGTYQTCIFAVPGVARRGGLVTVTCDPRNLEHVLKARFDNYPKGPFWHAVFLDLLGDGIFNSDGETWVAQRKTAALEFTTRTLRTAMSRWVSRSIHHRLLPILADASAGKAHVDLQDLLLRLTFDNICGLAFGKDPETLAQGLPHNEFASAFDRATEATLNRFIFPECLWRCKKWLGLGLETTLTRSMAHVDQYLAAVIKARRLELAGKCGDTAVHDDLLSRFMRKGSYSDESLQHVALNFILAGRDTSSVALSWFFWLVSTHPAVEHKIVRELCSVLAASRGAGGERVDPALWLAEPFTYEELDRLVYLKAALSETLRLYPSVPEDSKHVVADDYLPDGTFVPAGSSVTYSIYSAGRMKTVWGEDCLEFRPERWLSADGTKFEPHDSYKFVAFNAGPRICLGKDLAYLQMKNIAGSVLLRHRLAVAPGHRVEQKMSLTLFMKDGLRMEVRPRDLSAALDEPCGAAADAKRATAPCA

SEQ ID NO: 8792 - protein, 1452 aa, Brachypodium distachyon
MEAGTWAVVVAAVAAYMAWFWRMSRGLRGPRVWPVLGSLPGLVQHAEDMHEWIAGNLRRAGGTYQTCIFAVPGVARRGGLVTVTCDPRNLEHVLKARFDNYPKGPFWHAVFLDLLGDGIFNSDGETWVAQRKTAALEFTTRTLRTAMSRWVSRSIHHRLLPILADASAGKAHVDLQDLLLRLTFDNICGLAFGKDPETLAQGLPHNEFASAFDRATEATLNRFIFPECLWRCKKWLGLGLETTLTRSMAHVDQYLAAVIKARRLELAGKCGDTAVHDDLLSRFMRKGSYSDESLQHVALNFILAGRDTSSVALSWFFWLVSTHPAVEHKIVRELCSVLAASRGAGGERVDPALWLAEPFTYEELDRLVYLKAALSETLRLYPSVPEDSKHVVADDYLPDGTFVPAGSSVTYSIYSAGRMKTVWGEDCLEFRPERWLSADGTKFEPHDSYKFVAFNAGPRICLGKDLAYLQMKNIAGSVLLRHRLAVAPGHRVEQKMSLTLFMKDGLRMEVRPRDLSAALDEPCGAAADAKRATAPCALYDLITLLWIYSSVNSCTTNFIFNMPPWGGKSSSKEVKKTARENIIDTFQQFISPSEHKGSTKSRGNRGRCKDSTAEKGCWSTAQSRSTSPSKEVSRCQSFAADRPNAQPLPLPRSRAGVTRTVSDVTDSKPILQRHDKGQQLPLPTQNRLQKRPETTECVAELATASVSSNCSIDSDDCGDSQFHSPVGNDAENVTKVTTMISSSVVHKECSSAITTKSTKEVTKLGSAFLRNQILPTSPTGTVSDRYQTNLQNTCQVALESAPNSLMSSPSQSPRTIFPDQIPSSAFWAVKPHADITFLGSGQCSSPGSGQTSGHNSVGGDMLAQLFWQPSRGSPECSPIPSPRMMSPGPSSRVHSGSVSPLHPRAGGMAPESPTNRHDEVKKKQTHRLPLPPLSISNSSTFLPNNSAPTSPISRSPGRAENPPSPGSRWKKGKLIGHGTFGHVYVGFNSDRGEMCAMKEVTLFSDDPKSKESARQLGQEILVLSRLQHPNIVRYYGSETVDNKLYIYLEYVSGGSIHKLLQEYGRFGEQAIRSYTKQIRLGLAYLHAKNTVHRDIKGANILVDPNGRVKLADFGMAKHINGQQCPFSFKGSPYWMAPEVIKNSTGCNLAVDVWSLGCTVLEMATSKPPWSQYEGIAAMFKIGNSKELPPIPDHLSEEGKDFIRQCLQRDPSSRPTAVDLLQHSFIRSALPPGKSVASTPLEQLDDISCKPSSKVVGHVRNMSSLGLEGQSIYQRRAAKFSLTHSDIHIRSNISCPVSPCGSPLLRSRSPQQQNGTMSPSPISSPRTTSGASTPLTGGNGTIPPNHTRQLAYSNKGVTIASRVLDEHWASRPPDPVLGHLVRAQQLSTSIRGRVVSEAGIRGPQFGKRRQRNLHDRPLASEHASQHGFGDNLKLKPSVDMTSGNPHLIRNHGH

SEQ ID NO: 8793 - protein, 534 aa, Zea mays
MEVSTWVMLVAAAAAYMAWFWRLSRGLSGPRVWPVLGSLPGLVQHAEDMHEWIVGNLRRTGGTYQTCIFAVPGVARRGGLVTVTCDPRNLEHVLKARFDNYPKGPFWHAVFRDLLGDGIFNSDGDTWVAQRKTAALEFTTRTLRTAMSRWVSRSIHLRLLPILDEAATEKTHVDLQDLLLRLTFDNICGLAFGKDPETLAPGLPENAFATAFDRATEATLNRFIFPECLWRCKKWLGLGMESTLARSVAHVDQYLAAVIKARKLELAGNGKCDAPAHDDLLSRFMRKGSYSDESLQHVALNFILAGRDTSSVALSWFFWLVSTHPDVERQIVLELCAALAASRGSHDPALWLASPLTFEELDRLVYLKAALSETLRLYPSVPEDSKHVVADDYLPDGTFVPAGSSVTYSIYSAGRMKTVWGEDCLEFRPERWLSADGTRFEPHDSYRFVAFNAGPRICLGKDLAYLQMKNIAGSVLLRHRLAVARGHRVEQKMSLTLFMKHGLRMEVHPRDLAPVIDELRGAGAARPAMAPCCA

SEQ ID NO: 8794 - protein, 541 aa, Triticum aestivum
MEVGTWAVVASAVAAYMAWFWRMSRGLRGPRVWPVLGSLPGLVQHAEDMHEWIAGNLRRAGGTYQTCIFAVPGVARRGGLVTVTCDPRNLEHVLKARFDNYPKGPFWHGVFRDLLGDGIFNSDGDTWLAQRKTAALEFTTRTLRTAMSRWVSRSIHGRLLPILADAAKGKAQVDLQDLLLRLTFDNICGLAFGKDPETLAQGLPENEFASAFDRATEATLNRFIFPECLWRCKKWLGLGMETTLTSSMAHVDQYLAAVIKKRKLELAAGNGKCDTAATHDDLLSRFMRKGSYSDESLQHVALNFILAGRDTSSVALSWFFWLVSTHPAVERKIVRELCSVLAASRGAHDPALWLAEPFTFEELDRLVYLKAALSETLRLYPSVPEDSKHVVADDYLPDGTFVPAGSSVTYSIYSAGRMKGVWGEDCLEFRPERWLSADGTKFEQHDSYKFVAFNAGPRVCLGKDLAYLQMKNIAGSVLLRHRLTVAPGHRVEQKMSLTLFMKGGLRMEVRPRDLAPVLDEPCGLDAGAATAAAASATAPCA

SEQ ID NO: 8795 - protein, 60 aa, Zea mays
MHDECKKGKRATQPTRYRMMPRPLAHEEVMRLPRSTEGGSSTRSMAPWPALPRPRHGAHR

SEQ ID NO: 8796 - protein, 541 aa, Triticum aestivum
MEVGTWAVVASAVAAYMAWFWRMSRGLRGPRVWPVLGSLPGLVQHAEDMHEWIAGNLRRAGGTYQTCIFAVPGVARRGGLVTVTCDPRNLEHVLKARFDNYPKGPFWHGVFRDLLGDGIFNSDGDTWLAQRKTAALEFTTRTLRTAMSRWVSRSIHGRLLPILADAAKGKAQVDLQDLLLRLTFDNICGLAFGKDPETLAQGLPENEFASAFDRATEATLNRFIFPEFLWRCKKWLGLGMETTLTSSMAHVDQYLAAVIKKRKLELAAGNGKCDTAATHDDLLSRFMRKGSYSDESLQHVALNFILAGRDTSSVALSWFFWLVSTHPAVERKIVRELCSVLAASRGAHDPALWLAEPFTFEELDRLVYLKAALSETLRLYPSVPEDSKHVVADDYLPDGTFVPAGSSVTYSIYSAGRMKAVWGEDCLEFRPERWLSADGTKFEQHDSYKFVAFNAGPRVCLGKDLAYLQMKNIAGSVLLRHRLTVAPGHRVEQKMSLTLFMKDGLRMEVRPRDLAPVLDEPCGLDAGAATAAAASATAPCA

SEQ ID NO: 8797 - protein, 545 aa, Hordeum vulgare
MEAGTWAVVVSAVAAYMAWFWRMSRGLRGPRVWPVLGSLPGLVQHAEDMHEWIAGNLRRAGGTYQTCIFAVPGVARRGGLVTVTCDPRNLEHVLKSRFDNYPKGPFWHGVFQDLLGDGIFNSDGDTWLAQRKTAALEFTTRTLRTAMSRWVSRSIHGRLLPILAEAAAGKAHVDLQDLLLRLTFDNICGLAFGKDPETLAQGLPENEFASAFDRATEATLNRFIFPECLWRCKKWLGLGMETTLTSSMAHVDQYLAAVIKTRKLELAAGNGKCDTVATHDDLLSRFMRKGSYSDESLQHVALNFILAGRDTSSVALSWFFWLVSTHPAVERKVVRELCSVLAASRGAHDPALWLAEPFTFEELDRLVYLKAALSETLRLYPSVPEDSKHVVADDYLPDGTFVPAGSSVTYSIYSAGRMKAVWGEDCLEFRPERWLSADGSKFEQHDSYKFVAFNAGPRVCLGKDLAYLQMKNIAGSVLLRHRLTVAPGHCVEQKMSLTLFMKDGLRMEVCPRDLAPVLDEHCGLDAAAAAATATAAAASATAPCA

SEQ ID NO: 8798 - protein, 256 aa, Zea mays
MAAVTSTASICPAAAGALSSLPSFITRKPTSGSRRLQQAAATTVCHCRSARVEEGLLGRRDALLLGIVFSAATPPLLAPAGALADEATAESQEGFTTYEDEANKFSIQVPQGWLVGAGEASGIKSVTAFYPEQAATDSNVSVAITGIGPDFTSLKSFGDVDAFAEGLVNGLDRSWQRPPGLAAKLIDSRAANGLYYLEYTLQNPGERRRHIVSAIGMAFNGWYNRLYTVTGQYIDDDDSEKYRPQIEKAVGSFRLT

SEQ ID NO: 8799 - protein, 247 aa, Setaria italica
MAAVTSTAFLCPAAGGLSPSPPFRRNPGSSSSRRRLQLQVCHCRPARVEGLDRREALLGVALSAAAPALFAPAAALAAEATELQEGFTTYEDEANKFSIVVPQGWLIGAGESSGIKSVTAFYPEQAADSNVSVAITGIGPDFTSLKSFGDVDAFAEGLVNGLDRSWQRPPGLAAKLIDSKAANGLYYVEYTLQNPGERRRHILSAIGMAFNGWYNRLYTVTGQYIDDEESEKFRPQIEKAVRSFRLT

SEQ ID NO: 8800 - protein, 222 aa, Saccharum officinarum
  misc_feature (172)..(173): Xaa can be any naturally occurring amino acid
  misc_feature (185)..(185): Xaa can be any naturally occurring amino acid
  misc_feature (201)..(201): Xaa can be any naturally occurring amino acid
MAAVTSTASLCPAAAGGLSSSSSFTRKPSSRRLQQGASTVCHCRPARVEGLDRRDALLGIVLSAAVAPLLAPAGALADEATTESQEGFTTYEDEANKFTIQVPQGWLVGAGEASGIKSVTAFYPEQAAADSNVSVAITGIGPDFTSLKSFGDVDSFAEGLVNGLDRSWQKPXXLAAKLIDSRAAXGLYYLEYTLQNPRERXRHIVSAIGMASTAGTTALHVT

SEQ ID NO: 8801 - protein, 275 aa, Zea mays
MALALPLARLVPACQCQPWPHLRFRKRHVSFAAHASSRAAFAACAAAPALQVQAPEAEAEAETVEQVGPKTRLVAQNIPWDCTADEMRALFESHGSVVGVELSMYSANKNRGLAFVTMGSEEEALAALTHLNSTILNDRKIKVDFARPRKKQPKQPAVVSDDTEKYVVFVGNLTWRVRNRHLRELFASAPGVVSAEVIFHTTTPRRSAGYAFVSFSSKESAGAAISAFNGKILMGRPINVMFKDENGEKNEPSSVPKKAEVEPSDDQSDKLSMNC

SEQ ID NO: 8802 - protein, 274 aa, Setaria italica
MALPLARLLLPALPACQCQPPLRLRFPERHVAPAAARSRGHRGAFAARAAASAPAAPAPAAPEAEEQVGPRTRLVAQNIPWDYTGDDMRALFEKHGSVVGVELSMYNASKNRGLAFVTMGSEEEALAALNNLNSTTLDDRKIKVDFARPRKKQPKQVKQPVVVSDSTEKYILFVGNLTWRVRNRHLRELFASAPGVLSAEVIFHTTTPRRSAGYAFVSFSSKEAAEAAISSLNGQKLMGRPINVMFKEESAKKNESSVPKEEEAEEESSEQSDS

SEQ ID NO: 8803 - protein, 753 aa, Zea mays
MHRVGSAGNTAGSTRPRKEKRFTYVLNDADDKKHCAGINCLAYLDGSIFSTSDHLFSGSRDGTLKRWELNNGDASFSGTFESHVDWVNDAIIVGDKLVSCSSDTTIKVWNCFSDGACTRTLRRHSDYVICLAAAENNSNIVASGGLGGEVFIWDLDAALAPVAKSVDAKEDEVPNGNSGPALTTLCSINSSSNIASSNGQSHGYSPIAAKGHKDSVYALAMNDTGTLLLSGGTEKVVRVWDPRTGSKNMKLRGHTDNIRALLVDSTGRYCLSGSSDSMIRLWDLGQQRCVHSYAVHTDSVWALASTPAFGHVYSGGRDQSVYLTDLSTRESLLLCTNEYPVLQLSLQDDTIWVATTDSSVYGWPAEGRTPQKVFEKGASFLAGNLSFSRARASLEGSAPVPVYKEPSFVIPGVPAIIQHEIMNNRRHVLTKDTTGSVKLWEITRGAVIEDFGKVSFEDKKKELFEMVSIPAWFTMDARLGCLSVHLDTPQCFSAEIYAVDLNVAGAQEDLKINLAQETLRGLLIHWSKRKQKSSSHSLCNGDSSIGKDVPSKDSPRSRPEVDDATQNHATHVLPSFEFSTVSPPSIITEGSSGGPWRKRITDLDVTEGDLPWWCVDCITLNRYPKENTKCGFYLHPAEGSPAPNITQGKLSAPRILRIHKVANYVVEKLVLDKPLDGGSDAFVMGLSSAQSQLSVLDSSSRLGLKPWQKTKPCIEILCNNQVLSPEMSLATVRTYIWKKPEDLILHYRVVQPR

SEQ ID NO: 8804 - protein, 751 aa, Zea mays
MHRVGSAGNTAGSTRPRKEKRFTYVLNDADDKKHCAGINCMAYLNGSTFSTSDYLFSGSRDGTLKRWELNNGDASFSATFESHVDWVNDAIIVGEKLVSCSSDTTIKVWNCFSDGACTRTFRQHSDYVICLAAAEKNSNIVASGGLGGEVFVWDLDAALAPVAKSVDAKEDEVPNGNSGPPLTTLCSVNSSSNIASSNSQSHGYSPIAAKGHKDSVYALAMNDTGTLLLSGGTEKVVRVWDPRTGSKNMKLRGHTDNIRALLVDSTGRYCLSGSSDSMIRLWDLGQQRCVHSYAVHTDSVWALATTHSFGHVYSGGRDQSVYLTDLSTRESVLLCTNECPILQLSLQDDTIWVATTDSSVYGWPAEGLTPQKVFQKGGSFLAGNLSFSRARASLEGSAPVPVYKEPSFVVPGVPAIVQHEIMNNRRHVLTKDTTGSVKLWEITRGAVIEDFGKVSFEDKKKELFEMVSIPAWFTMDARLGCLSVHLDTPQCFSAEIYAVDLNVSGAQEDLKINLAHDTLCGLLVHWSKRKQKSSSHGLPNGDSSIGKDVPSKDSHRSRTEVDDTTENHTTHVLPSFEFSTVSPPSIITEGSSGGPWRKRITDLDGTEGDLPWWCVDCVTHNRYPKENTKCGFYLHPAEGSPAPNITQGKLSAPRILRIHKVANYVVEKLVLDKPLDGGSDSTFVMGLSSAQSQLSQLDSSSRLGLKPWQKTKPCIEVLCNNQANMSLATVRTYIWKKPEDLILHYRVVQSR

SEQ ID NO: 8805 - protein, 754 aa, Setaria italica
MHRVGSAGNTAGSTRPRKEKRFTYVLNDADAKKHCAGINCLAYLNGSANSTSDYLFSGSRDGTLKRWELNNGDASFSATFESHVDWVNDAIIVGEKLVSCSSDTTLKVWNCFSDGACTRTLRQHSDYVICLAAAEKNSNIVASGGLGGEVFIWDLDAALAPVAKSADAKEDEVPNGNSGPALTTLCNVNSSSNIASSNGQSHGYSPIAAKGHKDSVYALAMNDTGTLLVSGGTEKVVRVWDPRTGSKKMKLRGHTDNIRTLLLDSTGRYCLSGSSDSMIRLWDLGQQRCVHSYAVHTDSVWALASTPSFGHVYSGGRDQSVYLTDLSTRESVLLCTNEYPILQLSLQDDTIWVATTDSSVYGWPAEGHTPQKVFEKGGSFLAGNLSFSRARASLEGSAPVPVYKEPSLVIPGVPAIIQHEIMNNRRHVLTKDTAGSVKLWEITRGAVIEDFGKVSFEDKKKELFEMVSIPAWFTMDARLGCLSVHLDTPQCFSAEIYAVDLNVSGAQEDLKINLAQETLRGLLVHWSKRKQKSGSHSLSNGDSSSGKDLPSKDSPRSRSEVDDGTENHATHVLPSFEFSTVSPPSIITEGSSGGPWRKRITDLDGTEGDLPWWCVDCVTHNRYPKENTKCGFYLHPAEGSPAPNITQGKLSAPRILRIHKVANYVVEKLVLEKPLDGGSDSTFAMGLSSGQSQLSALDSSSRIGLKAWQKLKPCVEILCNNQVLSPEMSLATVRTYIWKKPEDLILHYRVVQSR

SEQ ID NO: 8806 - protein, 729 aa, Pennisetum glaucum
VLNDADAKKHCAGINCLAYLNGSPFSTSDYLFSGSRDGTLKRWELNNGDASFSATFESHVDWVNDAIIVGEKLVSCSSDTTLKVWNCFSDGACTRTLRQHSDYVICLAAAEKNSNIVASGGLGGEVFIWDLDAALAPVAKSVDAKEDEVPNGNSGPALTTLCNVNSSSTIASSNGQSHGYSPIAAKGHKDSVYALTMNDTGTLLVSGGTEKVVRVWDPRTGSKKMKLRGHTDNIRTLLLDSTGRYCLSGSSDSMIRLWDLGQQRCVHSYAVHTDSVWALASTPSFGHVYSGGRDQSVYLTDLSTRESVLLCTNEYPILQLSLQDDTIWVATTDSSVYGWPAEGRTPQKVFEKGGSFLAGNLSFSRARASLEGSAPVPVYKEPSLVIPGVPAIIQHEIMNNRRHVLTKDTAGSVKLWEITRGAVIEDFGKVSFEDKKKELFEMVSIPAWFTMDARLGCLSVHLDTPQCFSAEIYAVDLNVSGAQEDLKINLAQETLRGLLVHWSKRKQKSSSHSLSNGDSSSGKDLPSKDSPRSRSEVDDGTENHATQVLPSFEFSTVSPPSIITEGSSGGPWRKRITDLDGTEGDLPWWCVDCVMHNRYSKENTKCGFYLHPAEGSPAPNITQGKLSAPRILRIHKVANYVVEKLVLEKPLDGGSESTFAMGLSSGQPLSVLDSSSRIGLKAWQKLKPSIEILCNNQVLSPEMSLATVRTYIWKKPEDLILHYRVVQSR

SEQ ID NO: 8807 - protein, 751 aa, Triticum aestivum
MHRVGSAGNTAGSSRPRKEKRFTYVLNDADNKKHCAGINCLSYLNASASGTSDYLFTGSRDGTLKRWEYQNGDANFSATFESHVDWVNDAIIVGQNLVSCSSDTTLKVWNCLADGACTKTLRQHSDYVICLAAAEKNSNIVASGGLGGEVFIWDLDAAIAPIAKSVDAKEDEVPNGNSGPALSTLCNVNSSGNIVSTNGKSHGYSPIAAKGHKDSVYALDMNDTGTLLVSGGTEKVVRVWDPRTGSKNMKLRGHTDNIRALLIDSTGRYCLSGSSDSMIRLWDLGQQRCVHSYAVHTDSVWALASTPSFGHVYSGGRDQSVYLTDLSTRESVLLCTNEHPILQLSLQDDTIWVATTDSSVYGWPAEGQTPQKVFQKGGSFLAGNLSFSRARASLEGSAPVPVYKEPSFTIPGVPAIVQHEIMNNRRHVLTKDTVGSVKLWEITRGAVIEDFGKVSFDDKKKELFEMVSIPAWFTMDARLGCLSVHLDTPQCFSAEIYAVDLNVTGAQEDLKINLAHETLRGLLVHWSKRRPKPGPHSLSNGDSSIGKDVSLKNLPHPRSDVDDGSENHANNVLPSFEFSTVSPPSIITESSSGGPWRKRITDLDGTEDDLPWWCVDCAENGRFPKENTKCGFYLHPAEGSPAPNITQGKLSAPRILRVLKVANYVVEKLVLEKPLDGSPDSTFAMGLTSGTSALDSSSRLGLKPWQKLKPSVEILCNNQVLSPEMSLATVRTYIWKKPEDLILNYRVVQSR

SEQ ID NO: 8808 - protein, 751 aa, Hordeum vulgare
MHRVGSAGNTAGSSRPRKEKRFTYVLNDADNKKHCAGINCLSYLNASASGTSDYLFTGSRDGTLKRWEYQNGDANFSATFESHVDWINDAIIVGQNLVSCSSDTTLKVWNCLADGACTKTLRQHSDYVICLAAAEKNSNIVASGGLGGEVFIWDLDAAIAPIAKSVDAKEDEVPKGNSGPALSTLCNVSSSGNIVSTNGKSHGYSPIAAKGHKDSVYALDMNDTGTLLVSGGTEKVVRVWDPRTGSKNMKLRGHTDNIRALLIDSTGRYCLSGSSDSMIRLWDLGQQRCVHSYAVHTDSVWALASTPSFGHVYSGGRDQSVYLTDLSTRESVLLCTNEHPILQLSLQDDTIWVATTDSSVYGWPAEGQSPQKVFQKGGSFLAGNLSFSRARASLEGSAPVPVYKEPSFTIPGVPAIVQHEIMNNRRHVLTKDTVGSVKLWEITRGAVIEDFGKVSFDDKKKELFEMVSIPAWFTMDARLGCLSVHLDTPQCFSAEIYAVDLNVTGAQEDLKINLAHETLRGLLVHWSKRRPKPGPHSLSNGDSSIGKDVSLKNLPHPRSDVDDGSENHANNVLPSFEFSTVSPPSIITESSSGGPWRKRITDLDGTEDDLPWWCVDCAENGRFPKENTKCGFYLHPAEGSPAPNITQGKLSAPRILRVLKVANYVVEKLVLEKPLDGSPDSAFAMGLTSGTSALDSSSRLGLKPWQKLKPSVEILCNNQVLSPEMSLATVRTYIWKKPEDLILNYRVVQSR

SEQ ID NO: 8809 - protein, 754 aa, Brachypodium distachyon
MHRVGSAGNTGGSSRPRKEKRFTYVLNDADNKKHCAGINCLSYLNASASGTSDYLFTGSRDGTLKRWEFQNGNANFSATFESHVDWVNDAIIVGQNLVSCSSDTTIKVWNNLSDGACTKTLRQHSDYVICLAAAEKNSNIVASGGLGGEVFIWDLDAALAPVAKSVDAKEDDIPNGNPGPALSTLCNVNSSGNISSTNGKSHGYSPIAAKGHKDSVYALAMNDTGSLLVSGGTEKVVRVWDPRTGTKTSKLRGHTDNIRTLLLDSTGRYCLSGSSDSMIRLWDLGQQRCVHSYAVHTDSVWALASTPSFAHVYSGGRDQSVYLTDLATRESVLLCTNEHPILQLSLQDDTIWVATTDSSVHGWPAEECTPQKVFQKGSSFLAGNLSFSRARASLEGSAPVPVYKEPSLTIPGVPAIIQHEIMNNRRHVLTKDTAGSVKLWEITRGAVIEDFGKVSFDDKKKELFEMVSIPAWFTMDARLGCLSVHLDTPQCFSAEIYAVDLNVSGAQEDLKINLAHETLRGLLVHWSKRRPKPGSHSLSNGDGSIGKDVSLKNLPHPRSDVDDGTENHASNVLPSFEFSTVSPPSVITESSSGGPWRKRITDLDGTEDDLPWWCVDCAENNRFPKENTKCGFYLHPAEGSPAPNITQGKLSAPRILRILKVANYVVEKLVLEKPLDGSPDSTFAMGLTSGQSQLSALDSSSRLGLKPWQKLKPSVEILCNNQVLSPEMSLATVRTYIWKKPEDLILNYRVVQSR

SEQ ID NO: 8810 - protein, 752 aa, Oryza sativa
MHRVGSAGNTAGSSRPRKEKRFTYVLNDADNKKHCAGINCLSYLNASTSGTSDYLFTGSRDGTLKRWEPKNGVASFSATFESHVDWVNDAIIVGQNLVSCSSDTTLKVWNCLSDGACTRTLRQHSDYVICLAASEKNSNIVASGGLGGEVFIWDLDSSLAPVAKSVDAKEDEAPNGNSGPALTTLCNVNSSSNLASTNGQSHGYSPITAKGHKDSVYALAMSDTGNTLVSGGTEKVVRVWDPRTGSKKMKLRGHTDNIRALLLDPTGRYCLSGSSDSMIRLWDLGQQRCIHSYAVHTDSVWALASTPSFSHVYSGGRDQSVYLTDLSNRESVLLCTNEHPILQLSLQDDMIWVATTDSSVNGWKAEAHEPLKLFQKGSSFLAGNLSFSRARASLEGSAPVPIHKEPSSIIPGVPAITQHEILNNRRHVLTKDTAGSVKLWEITRGAVIEDFGKVSFEDKKKELFEMVSIPAWFTMDARLGCLSVHLDTPQCFSAEIYAVDLNVAGAQEDLKINLAQETLRGLLVHWSKKKQRSGSHGLSNGDTSTGKDVSLKNLPHPRSEVDDGAENHASQMLPSFEFSTVSPPSIITEGSSGGPWRKRITDLDGTESDIPWWIVDCVEHNRFPKENTKCGFYLHPAEGSPAPNITQGKLSAPRILRIHKVANYVVEKLDRPLDGNADSTFGMGLTSGQSQFSALDSSSRLGLKPWQKLKPSVEILCNSQVLAPEMSLATVRAYVWKKPEDLILNYKVVQSR

SEQ ID NO: 8811 - protein, 263 aa, Panicum virgatum
  misc_feature (63)..(63): Xaa can be any naturally occurring amino acid
  misc_feature (93)..(93): Xaa can be any naturally occurring amino acid
  misc_feature (253)..(253): Xaa can be any naturally occurring amino acid
MKLDREMEMLLNEIPLLHHGGLLGGGDAGGADDDADLSFLIHELAAMGVVDGDDEPPAPPAAXGLGFSGFIYPTKGDSPVASHPFSIANYCAXMPSLFDPVPFDAAGAAADGWDIRCSPPPSAPPAATPRARCKSARRKNGGCGAMAASPKKCGAAAAAAKPHGESLAGLRGFMYHVARDQHGCRFLQQRLDDGKREVDLIFAGVSRHAAQLMVDPFGNYLMQKLLAVCDAGQRMALVLTLTADPFVLVRYPXTSMGHGQCRS

SEQ ID NO: 8812 - protein, 485 aa, Setaria italica
MKLDREMEMLLNEIPLLHHGGLLGVGDAGADADADADLSYLIHELAAMGVVDGDDDPPAPAAADSLGLPSFIYHKKGDNLVPSHPFAIANYRAHMPSLFDPVSFDATAATDVWDIWCSPPPSTPPAATPRARCKNGRRKNAMAASPKKCGAAAAAAAAKPRGESLVGLRGFMYHVARDQHGCRFLQQRLDDGKREVDLIFAGVSRHAAQLMVDPFGNYLMQKLLAACDAGQRMELVLTLTADPFVLVRISLNVHGTRAVQKLIESLRTREEINLVIDALRPGFLELIKDPNGNHVVQKCLQSFEADDNKAIFEAASVHCLDIGMQCHGCCVLQRCIARSRGEHREKLVAAIARNGFELAQDAYGNYVVQYVIDLKIPNANSSLAQQFEGRYIHLSMQKFSSNVVEKCLKVFKEADKAKIILELLAMPQLEQLLQHPYANYVIYSALQNSKGSLHSALTNAIRPHVELLRTSPYCKRIYSRALLKK

SEQ ID NO: 8813 - protein, 479 aa, Zea mays
MKVDREMEILLNEIPLLHHVGLLGGSEAGADDDADLSFLIHELAAMGLVDGDDELPAPGAATGYGFPTKGENLVAMHSFSMASHYAHMRSLFVPVTFDDAAAADGWDIRCSPPPYVPLPSPATPRARCKSVRRKNGSVMTTSPKKCGAAAAAKWHGESLAGLRGVMYHMARDQHGCRLLQQRLDDGKREVDYIFAGVSRHAAQLMVDPFGNYLMQKLLAVCDDGQRMTLVLTLTADPFALVRISLNVHGTRAVQKLIERLSAREEIGLVMDALRPGFLELIKDTNGNHVVQKCLHSFASNDNKAIFAAAALHCVDIGMQIHGCCVLQRCIARSRGEHRDKLVAAIAHNGFKLAEDAYGNYVVQVVLDLKIPTANSSLAQQFGGKYIHLSMQKFSSNVVEKCLKVFKEVDKAKIILELLATPHLEQLLPHCYANYVVYSALKNSKGSLHSALINAILPHEELLRTSPYCKRIYSKFFLKN

SEQ ID NO: 8814 - protein, 251 aa, Saccharum officinarum
MGFPDERVQVDALERHLLTGLSSNDYNGSFEDEVLYDASFAEMEDNFVKYQIAQWTLLSLLLIVAWGVGLLMLLYIPIRVYVCRSDFRSRKLYLTPHAVIYKVNKPFAFPCFGVFKKEKYCILPSISDVVVEQNSLQSFFGVYSIRIENISVRKPRSYDVKITGVAHPHDFRKAVLVHLLNTRKLKFSQKASSDDQQSTSLSSTASSSVCLQEAPLEDLMLEKLDEVVISVKKMQALLEGAETSKIKTTSS

SEQ ID NO: 8815 - protein, 243 aa, Zea mays
MELPDERVQVDALERHLLAGLSSNDYDGSFEDEVLYDASFAEMEDNFVKYQIAQWTLLSLLLIVAWGVGVLMLLYLPIGVYVCRRDFRSRKLYLTPHAVIYKVNKPFAFPCFGVSKKEKYWILPSISDVVVEQDYLQSIFGVYSIRIENISVRKPPSCDVKITGVAHPHDFRKAVVVHLLNTRNQKTSSDDQQSTNLNYAASSSEASLGDLMLEKLDEVEISVKKMQALLQGPEISKFKTTSG

SEQ ID NO: 8816 - protein, 247 aa, Setaria italica
MGSPDERVQVDALERLLLAGSSSNDYNISIEDEVLHDASFAEMEDNFVKYQIAQWILLSVLLVLAWGVGVLMLLYLPIRIYVCRRDFRSRKLYLTPHAIVYKVNKPVAFPCFGVFKKEKYVILPSISDVVVEQGYLESFFGIYSIRIENVGVRKPASDDVKITGVSHPHDFRKAVLVHLLNTRNLNFSRKAPSDGQQSTSLNPIASAWEPPLGDLILEKLDEVEISVKKMQAMVQGIETSKTKTRSS

SEQ ID NO: 8817 - protein, 358 aa, Sorghum bicolor
MAHLITNCSFSTSPAVQTFSSSPNYCRSVGQLQNSKSSNLSLKSCSRRQKKSYVSCASAAVQGQTQTPLTGSQQAYEHSSSKPKKVMVIGGDGYCGWATALHLSNKGYEVAIVDNLVRRLFDHQLGLDSLTPITSIQNRVRRWKSLTGKTIQLFIGDICDFEFLSEAFKSFEPDAAVHFGEQRSAPYSMIDRSRAVYTQHNNVIGTLNVLFAIKEYSDECHLVKLGTMGEYGTPNIDIEEGFITITHNGRTDTLPYPKQASSFYHLSKVHDSHNIAFTCKAWGIRATDLNQGVVYGVRTDETALHEELSNRFDYDGVFGTALNRFCVQAAVGHPLTVYGKGGQVCPGISGHQRHCTVR

SEQ ID NO: 8818 - protein, 270 aa, Panicum virgatum
MAHLVTHCSFSASPAVKTFSRSPGYCCNVSQLQNSKSSNLSLKSSLKRQKKSYVTCASAAVQGQTQTPLTGSQEASGHSSSKPKKVMVIGGDGYCGWATALHLSNKGYEVAIVDNLVRRLFDHQLGLESLTPITSIQNRVRRWKSLTGKTIQLFIGDICDFDFLSEAFKSFEPDVAVHFGEQRSAPYSMIDRSRAVYTQHNNVIGTLNVLFAIKEYSEECHLVKLGTMGEYGTPNIDIEEGFITITHNGRTDTLPLPEASKFLLPSKQSA

SEQ ID NO: 8819 - protein, 473 aa, Setaria italica
MAHLITNCTFSASPAVKTLSGSPSYCCNVGRLQNSKSSNLSLKSSSKRQKKSYVTCASAAVQGHTQTPLAGSQEASSSKPKKVMVIGGDGYCGWATALHLSNKGYEVAIVDNLVRRLFDHQLGLDSLTPITSIQNRVRRWKSLTGKTIQLFIGDICDFEFLSEAFKSFEPDAAVHFGEQRSAPYSMIDRSRAVYTQHNNVIGTLNVLFAIKEYSEECHLVKLGTMGEYGTPNIDIEEGFITITHNGRTDTLPYPKQASSFYHLSKVHDSHNIAFTCKAWGIRATDLNQGVVYGVRTDETAMHEELSNRFDYDGVFGTALNRFCVQAAVGHPLTVYGKGGQTRGYLDIRDTVQCVELAIANPAKPGEFRVFNQFTEQFSVNELAKLVTAAGAKLGLDVQTKSVPNPRVEAEEHYYNAKHTKLIELGLEPHLLSDSLLDSLLNFAVQYKDRVDIAQIMPSVSWKKMGAKPRTVSV

SEQ ID NO: 8820 - protein, 474 aa, Pennisetum glaucum
MAHLITNCTFSASPAVKTFSISPSYCCNVGQSQNSKSSNLSLKYSSKRQKKSYVTCASAAVQGQKTQTPLTGSQEASSSKPKKVMIIGGDGYCGWATALHLSNKGYEVAIVDNLVRRLFDHQLGLDSLTPITSIQNRVRRWKSLTGKTIQLFIGDICDFEFLSEAFKSFEPDAAVHFGEQRSAPYSMIDRSRAVYTQHNNVIGTLNVLFAIKEYSEECHLVKLGTMGEYGTPNIDIEEGFITITHNGRTDTLPYPKQASSFYHLSKVHDSHNIAFTCKAWGIRATDLNQGVVYGVRTDETAMHEELSNRFDYDGVFGTALNRFCVQAAVGHPLTVYGKGGQTRGYLDIRDTVQCVELAIANPAKPGEFRVFNQFTEQFSVNELAKLVTAAGAKLGLDVQTKSVPNPRVEAEEHYYNAKHTKLIELGLEPHLLSDSLLDSLLNFAVQYKDRVDTAQIMPSVSWKKMSAKPRTVSV

SEQ ID NO: 8821 - protein, 370 aa, Oryza sativa
MAHMVTNCSFSPSPAVKTYSKSPGYCCNVTQFQSSKCSNLVLKSCTATRPNRPFVARASAAVQGQTQTPLTGSQQASGHSSSKPKKVMVIGGDGYCGWATALHLSNKGYEVAIVDNLVRRLFDHQLGLDSLTPIASIQNRIRRWKALTGKTIQLYVGDICDFDFLSEAFKSFEPDSAVHFGEQRSAPYSMIDRSRAVFTQHNNVIGTLNVLFAIKEFSEECHLVKLGTMGEYGTPNIDIEEGFITITHNGRTDTLPYPKQASSFYHLSKVHDSHNIAFTCKAWGIRATDLNQGVVYGVRTDETAMHEELSNRFDYDGVFGTALNRFCVQAAVGHPLTVYGKGGQVCPWISGHQGYSAMRRARNRQPSQTR

SEQ ID NO: 8822 - protein, 477 aa, Oryza sativa
MAHMVTNCSFSPSPAVKTYSKSPGYCCNVTQFQSSKCSNLVLKSCTATRPNRPFVARASAAVQGQTQTPLTGSQQASGHSSSKPKKVMVIGGDGYCGWATALHLSNKGYEVAIVDNLVRRLFDHQLGLDSLTPIASIQNRIRRWKALTGKTIQLYVGDICDFDFLSEAFKSFEPDSAVHFGEQRSAPYSMIDRSRAVFTQHNNVIGTLNVLFAIKEFSEECHLVKLGTMGEYGTPNIDIEEGFITITHNGRTDTLPYPKQASSFYHLSKVHDSHNIAFTCKAWGIRATDLNQGVVYGVRTDETAMHEELSNRFDYDGVFGTALNRFCVQAAVGHPLTVYGKGGQTRGYLDIRDTVQCVELAIANPAKPGEFRVFNQFTEQFSVNELAKLVTAAGAKLGLEVQTKSVPNPRVEAEEHYYNAKHTKLMELGLEPHLLSDSLLDSLLNFAVQYKDRVDTAQIMPSVSWKKMGAKPKTVSV

SEQ ID NO: 8823 - protein, 481 aa, Brachypodium distachyon
MAHLVTNCSFSPSPAVKTHPKSPNCGHNSIRFQNSKSSSSSLIAKSCSKRSKKLYVTRASASVQAPADKTQTPLTGSQQESAHSSSKPKKVMVIGGDGYCGWATALHLSNKGYEVAIVDNLVRRLFDHQLGLDSLTPIASIQNRIRRWKSLTGKTIQLFIGDICDFEFLSEAFKSFEPDSAVHFGEQRSAPYSMIDRSRAVFTQHNNVIGTLNVLFAMKEFSQECHLVKLGTMGEYGTPNIDIEEGFITITHNGRTDTLPYPKQASSFYHLSKVHDSHNIAFTCKAWGIRATDLNQGVVYGVRTDETAMHEELSNRLDYDGIFGTALNRFCVQAAVGHPLTVYGKGGQTRGYLDIRDTVQCVELAIANPAKPGEFRVFNQFTEQFSVNELAKLVTAAGAKLGLEVQTKSVPNPRVEAEEHYYNAKHSKLSELGLVPHLLSDSLLDSLLNFAVQYKDRVDTAQIMPSVSWKKMGAKTKTLSV

SEQ ID NO: 8824 - protein, 478 aa, Unknown
  Sequence found in Organisms: Secale cereale, Triticum aestivum
MANLVTNCGFSPSPAVKAHCNSPSYGHNFIRLQNSKSSTSSLNLKSSSKRSNKLYVTCASTAVQGQTQTPLTGSQQASGQSSSKPKKVMVIGGDGYCGWATALHLSNKGYEVAIVDNLVRRLFDHQLGLDSLTPIASIQNRIRRWKSLTGKTIQLFIGDICDFEFLSEAFKSFEPDSAVHFGEQRSAPFSMIDRSRAVYTQNNNVIGTLNVLFAMKEFSEECHLVKLGTMGEYGTPNIDIEEGFLTITHNGRTDTLPYPKQASSFYHLSKVHDSHNIAFTCKAWGIRATDLNQGVVYGIRTDETAMHEELSNRLDYDGIFGTALNRFCVQAAVGHPLTVYGKGGQTRGYLDIRDTVQCVELAIANPAKPGEFRVFNQFTEQFSVNELAKLVTAAGAKLGLDVQTKSVPNPRVEAEEHYYNAKHSKLSELGLVPHLLSDSLLDSLLNFAVQYKDRVDTAQIMPSVSWKKMGAKPKTVSV

SEQ ID NO: 8825 - protein, 363 aa, Brachypodium distachyon
MAHLVTNCSFSPSPAVKTHPKSPNCGHNSIRFQNSKSSSSSLIAKSCSKRSKKLYVTRASASVQAPADKTQTPLTGSQQESAHSSSKPKKVMVIGGDGYCGWATALHLSNKGYEVAIVDNLVRRLFDHQLGLDSLTPIASIQNRIRRWKSLTGKTIQLFIGDICDFEFLSEAFKSFEPDSAVHFGEQRSAPYSMIDRSRAVFTQHNNVIGTLNVLFAMKEFSQECHLVKLGTMGEYGTPNIDIEEGFITITHNGRTDTLPYPKQASSFYHLSKVHDSHNIAFTCKAWGIRATDLNQGVVYGVRTDETAMHEELSNRLDYDGIFGTALNRFCVQAAVGHPLTVYGKGGQVCPWIPGHQGYRAMR

SEQ ID NO: 8826 - protein, 478 aa, Hordeum vulgare
MANLVTNCGFSPSPAVKAHCNSPSYGHNFIRLQNSKSSTSSLNLKSSSKRSNKLYVTCASTSVQGQTQTPLTGSQQASGHSSSKPKKVMVIGGDGYCGWATALHLSNKGYEVAIVDNLVRRLFDHQLGLDSLTPIASIQNRIRRWKSLTGKTIQLFIGDICDFEFLSEAFKSFEPDSAVHFGEQRSAPFSMIDRSRAVYTQNNNVIGTLNVLFAMKEFSEECHLVKLGTMGEYGTPNIDIEEGFLTITHNGRTDTLPYPKQASSFYHLSKVHDSHNIAFTCKAWGIRATDLNQGVVYGIRTDETAMHEELSNRLDYDGIFGTALNRFCVQAAVGHPLTVYGKGGQTRGYLDIRDTVQCVELAIANPAKPGEFRVFNQFTEQFSVNELAKLVTAAGAKLGLDVQTKSVPNPRVEAEEHYYNAKHSKLSELGLVPHLLSDSLLDSLLNFAVQYKDRVDTAQIMPSVSWKKMGAKPKTISV

SEQ ID NO: 8827 - protein, 478 aa, Triticum aestivum
MANLVTNCGFSPSPAVKAHCNSPSYGHNFIRLQNSKSSTSSLNLKSSCKRSNKLYVTCASTAVQGQTQTPLTGSQQASGQSSSKPKKVMVIGGDGYCGWATALHLSNKGYEVAIVDNLVRRLFDHQLGLDSLTPIASIQNRIRRWKSLTGKTIQLFIGDICDFEFLSEAFKSFEPDSAVHFGEQRSAPFSMIDRSRAVYTQNNNVIGTLNVLFAMKEFSEECHLVKLGTMGEYGTPNIDIEEGFLTITHNGRTDTLPYPKQASSFYHLSKVHDSHNIAFTCKAWGIRATDLNQGVVYGIRTDETAMHEELSNRLDYDGIFGTALNRFCVQAAVGHPLTVYGKGGQTRGYLDIRDTVQCVELAIANPAKPGEFRVFNQFTEQFSVNELAKLVTAAGAKLGLDVQTKSVPNPRVEAEEHYYNAKHSKLSELGLVPHLLSDSLLDSLLNFAVQYKDRVDTAQIMPSVSWKKMGAKPKTVSV

SEQ ID NO: 8828 - protein, 478 aa, Triticum aestivum
MANLVTNCGFSPSPAVKAHCNSPSYGHNFIRLQNSKSSTSSLNLKSSSKRSNKLYVTCASTAVQGQTQTPLTGSQQASGQSSSKPKKVMVIGGDGYCGWATALHLSNKGYEVAIVDNLVRRLFDHQLGLDSLTPIASIQNRIRRWKSLTGKTIQLFIGDICDFEFLSEAFKSFEPDSAVHFGEQRSAPFSMIDRSRAVYTQNNNVIGTLNVLFAMKEFSEECHFVKLGTMGEYGTPNIDIEEGFLTITHNGRTDTLPYPKQASSFYHLSKVHDSHNIAFTCKAWGIRATDLNQGVVYGIRTDETAMHEELSNRLDYDGIFGTALNRFCVQAAVGHPLTVYGKGGQTRGYLDIRDTVQCVELAIANPAKPGEFRVFNQFTEQFSVNELAKLVTAAGAKLGLDVQTKSVPNPRVEAEEHYYNAKHSKLSELGLVPHLLSDSLLDSLLNFAVQYKDRVDTAQIMPSVSWKKMGAKPKTVSV

SEQ ID NO: 8829 - protein, 481 aa, Brachypodium distachyon
MAHLVTDCSFSPSPAVKTHPKSPNYGHNGIRFQNSKSSSSSLISKSCSKRSKKLFVTHASASVQAPADKTQTPLTGSQQASAHSSSKPKKVMVIGGDGYCGWATALHLSNKGYVVAIVDNLVRRLFDHQLGLDSLTPIASIQNRIRRWKSLTGKTIQLFIGDICDFEFLSEAFKSFEPDSAVHFGEQRSAPYSMIDRSRAVFTQHNNVIGTLNVLFAMKEFSEECHLVKLGTMGEYGTPNIDIEEGFITITHNGRTDTLPYPKQASSFYHLSKVHDSHNIAFTCKAWGIRATDLNQGVVYGVRTDETAMHEELSNRLDYDAIFGTALNRFCVQAAVGHPLTVYGKGGQTRGYLDIRDTVQCVELAIANPAKPGEFRVFNQFTEQFSVNELAKLVTAAGAKLGLEVQTKSVPNPRVEAEEHYYNAKHSRLSELGLVPHLLSDSLLDSLLNFAVQYKDRVDTAQIMPSVSWKKMGAKPKTLSV

SEQ ID NO: 8830 - protein, 478 aa, Triticum aestivum
MANLVTNCGFSPSPAVKAHCNSPSYGHNFIRLQNSKSSTSSLNLKSSSKRSNKLYVTCASTAVQGQTQTPLTGSQQASGHSSSKPKKVMVIGGDGYCGWATALHLSNKGYEVAIVDNLVRRLFDHQLGLDSLTPIASIQNRIRRWKSLTGKTIQLFIGDICDFDFLSEAFKSFEPDSAVHFGEQRSAPFSMIDRSRAVYTQNNNVIGTLNVLFAMKEFSEECHLVKLGTMGEYGTPNIDIEEGFLTITHNGRTDTLPYPKQASSFYHLSKVHDSHNIAFTCKAWGIRATDLNQGVVYGIRTDETAMHEELSNRLDYDGIFGTALNRFCVQAAVGHPLTVYGKGGQTRGYLDIRDTVQCVELAIANPAKPGEFRVFNQFTEQFSVNELAKLVTAAGAKLGLDVQTKSVPNPRVEAEEHYYNAKHSKLSELGLAPHLLSDSLLDSLLNFAVQYKDRVDMAQIMPSVSWKKMGAKPKTVSV

SEQ ID NO: 8831 - protein, 390 aa, Secale cereale
MVIGGDGYCGWATALHLSNKGYEVAIVDNLVRRLFDHQLGLDSLTPIASIQNRIRRWKSLTGKTIQLFIGDICDFEFLSEAFKSFEPDSAVHFGEQRSAPFSMIDRSRAVYTQNNNVIGTLNVLFAMKEFSEECHLVKLGTMGEYGTPNIDIEEGFLTITHNGRTDTLPYPKQASSFYHLSKVHDSHNIAFTCKAWGIRATDLNQGVVYGIRTDETAMHEELSNRLDYDGIFGTALNRFCVQAAVGHPLTVYGKGGQTRGYLDIRDTVQCVELAIANPAKPGEFRVFNQFTEQFSVNELAKLVTAAGAKLGLDVQTKSVPNPRVEAEEHYYNAKHSKLSELGLVPHLLSDSLLDSLLNFAVQYKDRVDTAQIMPSVSWKKMGAKPKTVSV

SEQ ID NO: 8832 - protein, 496 aa, Secale cereale
MANLVTNCGFSPSPAVKAHCNSPSYGHNFIRLQNSKSSISSLNLKSSPKRSNKLYVTCASTAVQGQTQTPLTGSQQASGQSSSKPKKVMVIGGDGYCGWATALHLSNKGYEVAIVDNLVRRLFDHQLGLDSLTPIASIQNRIRRWKSLTGKTIQLFIGDICDFEFLSEAFKSFEPDSAVHFGEQRSAPFSMIDRSRAVYTQNNNVIGTLNVLFAMKEFSEECHLVKLGTMGEYGTPNIDIEEGFLTITHNGRTDTLPYPKQASSFYHLSKVHDSHNIAFTCKAWGIRATDLNQGVVYGIRTDETAMHEELSNRLDYDGIFGTALNRFCVQAAVGHPLTVYGKGGQTRGYLDIRDTVQCVELAIANPAKPGEFRVFNQFTEQFSVNELAKLVTAAGAKLGLDVQTKSVPNRAWRRRSTTTTPSTRSCRSWGWCPTCCRTRSSTRCSTSRSSTRTGSTRRRSCPACRGRRWGPSRRRSLYRASEVGEGKGLPLLLCGV

SEQ ID NO: 8833 - protein, 363 aa, Brachypodium distachyon
MAHLVTDCSFSPSPAVKTHPKSPNYGHNGIRFQNSKSSSSSLISKSCSKRSKKLFVTHASASVQAPADKTQTPLTGSQQASAHSSSKPKKVMVIGGDGYCGWATALHLSNKGYVVAIVDNLVRRLFDHQLGLDSLTPIASIQNRIRRWKSLTGKTIQLFIGDICDFEFLSEAFKSFEPDSAVHFGEQRSAPYSMIDRSRAVFTQHNNVIGTLNVLFAMKEFSEECHLVKLGTMGEYGTPNIDIEEGFITITHNGRTDTLPYPKQASSFYHLSKVHDSHNIAFTCKAWGIRATDLNQGVVYGVRTDETAMHEELSNRLDYDAIFGTALNRFCVQAAVGHPLTVYGKGGQVCPWILGHQRYCAMR

SEQ ID NO: 8834 - protein, 506 aa, Hordeum vulgare
MANLVTNCGFSPSPAVKAHCNSPSYGHNFIRLQNSKSSTSSLNLKSSSKRSNKLYVTCASTSVQGQTQTPLTGSQQASGHSSSKPKKVMVIGGDGYCGWATALHLSNKGYEVAIVDNLVRRLFDHQLGLDSLTPIASIQNRIRRWKSLTGKTIQLFIGDICDFEFLSEAFKSFEPDSAVHFGEQRSAPFSMIDRSRAVYTQNNNVIGTLNVLFAMKEFSEECHLVKLGTMGEYGTPNIDIEEGFLTITHNGRTDTLPYPKQASSFYHLSKVHDSHNIAFTCKAWGIRATDLNQGVVYGIRTDETAMHEELSNRLDYDGIFGTALNRFCVQAAVGHPLTVYGKGGQVCPWIPGHQGYRAVRGASNRKPSQTWRVQGLQPIHRAVLRERASQAGDRRGSEARAGRADQVGAQPARRGGGALLQRQALEALGARAGAPPAVGLAPRLAAQLRRPVQGQGRHSADHAQRVVEEDGGQAEDDLCIEGGTELPLCYVAYDVNHAIDIISCCV

SEQ ID NO: 8835 - protein, 482 aa, Avena sativa
MANLVANCGFCLSPAVKTHCSSQSHGHNNVIRFQNSKSSASSLNLRSCSKRSNKLFVTRASAAVQGQTNVTQTPLTGGQQASGQSSSRPKKVMVIGGDGYCGWATALHLSNKGYEVAIVDNLVRRLFDHQLGLDSLTPIASIQNRIRRWKALTGKTIQLFIGDICDFEFLSEAFKSFEPDSAVHFGEQRSAPYSMIDRSRAVYTQHNNVIGTLNVLFAMKEYSEECHLVKLGTMGEYGTPNIDIEEGFLTITHNGRTDTLPYPKQASSFYHLSKVHDSHNIAFTCKAWGIRATDLNQGVVYGVRTDETAMHEELSNRLDYDGVFGTALNRFCVQAAVGHPLTVYGKGGQTRGYLDIRDTVQCVELAIANPAKPGEFRVFNQFTEQFSVNELARLVTAAGAKLGLEVQTKSVPNPRVEAEEHYYNAKHSKLSELGLVPHLLSDSLLDSLLNFAVQYKDRVDTAQIMPSVSWKKMGAKPKTVSV

SEQ ID NO: 8836 - protein, 307 aa, Setaria italica
MASAARALGALLHRASSLSSSASALRRASLLHGIEPIGNAGLFRRHAARRRISTFQPLCMGRRSCKIAGRKDAQNLKKMKRNSKIGKEIVSAIKKGGPSPSSNTALAAILEKARELDIPKEILERNIKRASEKDQDTYTEKVYEVYGFGGVGMIVEVLTDKITRSVADIRNVVKDCGAKLADPGSVTFRFRQARVVNIKVTDAGKDQLLSIALDAGADDVLEPNFDDDDDSEEEIERFYKIVTTSDNYPVVLSKLQEEGLKFETDNGYELLPLNPIEVDDEAMELNKELVSKLLELDDVDAVYTDQK

SEQ ID NO: 8837 - protein, 308 aa, Panicum virgatum
MASAARALGALLHRASSLSSSASALRRASVLRGNEAMGNAGLFRRHEARRRISTFQPLCMGRRSCKIAGRKDAQNLKKMKRNSKIGKEIVAAIKKGGPSPSSNTALAAILEKARELDIPREILERNIKRASEKDQDTYTEKVYEVYGFGGVGMIVEVLTDKITRSVADIRNVVKDCGAKLADPGSVTFRFKQARVVNIKVTDADKDQLLSVALDAGADDVLEPNFDDDDDGSEEEIERFYKIVTTSENYPVVLSKLQEEGVKFETDNGYELLPLNPIEVDDEAMELNKELVSKLLELDDVDAVYTDQK

SEQ ID NO: 8838 - protein, 92 aa, Zea mays
MASATRALGALLHRASSLSSSAPALRGASLLRGDGPIGSAGLFRRHAARRRISSFQPLCMGRRSCKIAGRKDAQNLKKMKRNSKIGKEIVAA

SEQ ID NO: 8839 - protein, 307 aa, Triticum aestivum
MASAARALGALIHRASSLSSSASALRSASLVHRNGPTGGASLFQGHVARRRISTFQPLCMGRRSCKIAGRKGAQNLKKMKRNSKIGKEIVAAIKKGGPSPSSNTALAAILEKVRELDVPKEVVERNIKRASEKGQDTYTEKIYEVYGFGGVGMVVEVLTDKITRSIADIRNVVKDCGAKLADPGSVTFRFRQARVVNIKVTDADKDQLLSVALDAGADDVIEPNFDDEDDSEEVLERFYKIVTTSENYPVVLSKLQEEGLKFETDNGYELLPLNPIEVDDEAMELNKDLVLKLLELDDVDAVYTDQK

SEQ ID NO: 8840 - protein, 308 aa, Triticum aestivum
MASAARALGALIHRASSLSSSASALRSASLVHRNSPTGGASLFQGHVARRRIWTFQPLCMGRRSCKIAGRKGAQNLKKMKRNSKIGKEIVAAIKKGGPSPSSNTALAAILEKVRELDVPKEVVERNIKRASEKGQDTYTEKIYEVYGFGGVGMVVEVLTDKITRSIADIRNVVKDCGAKLADPGSVTFRFRQARVVNIKVTDADKDQLLSVALDAGADDVIEPNFDDEDDSEEEVLERFYKIVTTSENYPVVLSKLQEEGLKFETDNGYELLPLNPIEVDDEAMELNKDLVLKLLELDDVDAVYTDQK

SEQ ID NO: 8841 - protein, 308 aa, Secale cereale
MASAARALGALLHRASSLSSSASALRSASLVHRNGPTGGASLFQGHVARRRIWTFQPLCMGRRSCKIAGRKGAQNLKKMKRNSKIGKEIVAAIKKGGPSPSSNTALAAILEKVRELDVPKEVVERNIKRASEKGQDTYTEKIYEVYGFGGVGMVVEVLTDKITRSIADIRNVVKDCGAKLADPGSVTFRFRQARVVNIKVTDADKDQLLSVALDAGADDVIEPNFDDEDDSEEDVLERFYKIVTTSENYPVVLSKLQEEGLKFETDNGYELLPLNPIEVDDEAVELNKDLVCKLLELDDVDAVYTDQK

SEQ ID NO: 8842 - protein, 317 aa, Oryza sativa
MASAARALGALVHKASSLSSSAAALRSAAVLHGRGSAGGSARLFQRHAARRRISTFQPLCMGRRSCKIAGRKDAQNLKKMKRNSKIGKEIVAAIKKGGPSPSSNTTLAAILEKARELDIPKEILERNIKRASEKGQDTYTEKVYEVYGFGGVGMVVEVLTDKITRSIADIRNVVKDCGAKLADPGSVTFRFRQARVVNIKVTDADKDQLLTVALDAGADDVIEPNFDDDDDDDDDYDDDSSEDVSERFYKIVTTSENYPVVLSKLQEEGLKFETDNGYELLPLNPIEVDDEAMELNKVLVSKLLELDDVDAVYTDQR

SEQ ID NO: 8843 - protein, 307 aa, Brachypodium distachyon
MASAARALGALLQRASSLSSSASALRSSSLLHRSGSTQEGSLYQWHLGRRRIWTFQPLCMGRRSCKIAGRKDAQNLKKMKRNSKIGKEIVAAINKGGPNPSSNTALAAILEKVRELDVPKEVVERNMKRASEKGQDTYTEKVYEVYGFGGVGMVVEVLTDKITRSIADIRNVVKDCAAKLADPGSVTFRFRQVRVVNIKVTDADKDELLSVALDAGADDVIEPNFDYDDDSEEVTERFYKIVTTSENYPVVLSKLQEEGIKFETDNGYELLPLNPIEVDDEAMELNKDLVSKLLELDDVDAVYTDQK

SEQ ID NO: 8844 - protein, 249 aa, Pennisetum glaucum
MGRRSCKIAGRKDAQNLKKMKRNSKIGKEIVAAIKKGGSSPSSNTALAAILEKARELDIPKEILERNIKRASEKDQDTYTEKVYEVYGFGGVGMIVEVLTDKITRSVADIRNVVKDSGAKLADPGSVTFRFRQARVVNIKVTDADKDKLLSIALDAGADDVLEPNFDDDDDDSEEEIERFYKIVTTSENYPVVLSKLQEEGLKFETDNGYELLPLNPIEVDDEAMELNKELVSKLLELDDVDAVYTDQK

SEQ ID NO: 8845 - protein, 164 aa, Saccharum officinarum
MLPLRSAAAAPCSVAGLLLHRFSSCSSSSVYSVRHHASPAVSSQPTTCSTTTWSPSPHSSSPRIRGFAAWASAPGQAGSADSPATKALEAKIKEQLEADTVTVVDTSGDGRHVCIDVVSKVFEGKSAVNRQRMVYKAIWEELQSTVHAVDQMTTKTPDEAGANK

SEQ ID NO: 8846 - protein, 164 aa, Panicum virgatum
MLPMRSAAAAPCSLAALLLRRLSSHSSSSVYSVSRHAPSALSSQPSATYLTTSPPCPLSSSRRTRGFAAWASAPGPAGPAESPATKALEAKIKEQLEADAVTVVDTSGDGRHVCIDVVSKAFEGKSAVNRQRMVYKAIWEELQSTVHAVDQMTTKTPDEAAANK

SEQ ID NO: 8847 - protein, 326 aa, Zea mays
MGSDFKSIPLIDIGPLVEKIDDPSMANDKDLLQVVRLLDDACKEAGFFYVKGHGIDESLMREVRNVTREFFQLPYEEKLKIKMTPQSGYRGYQRIGENITKGKPDMHEAIDCYTPIRPGKYGDLAKPMEGSNLWPKYPSNFEVLLENYIKLCRDISRKIMRGIALALGGAIDAFEGDTAGDPFWVLRLIGYPVDIPEEQRTDTGCGAHTDYGLLTLVNQDDDICALEVQNRSGEWIYATPIPGTFVCNIGDMLKVWTNGIYQPTLHRVVNNSQHYRVSVAFFYESNFDAAVEPVEFCREKTGGAAKYEKVVYGEHLVQKVLTNFVM

SEQ ID NO: 8848 - protein, 326 aa, Panicum virgatum
MASDFKAIPLIDVGPLVEKIDDPNMANDADLLEVVRMLDDACKEAGFFYVKGHGIAESLMKEVRDVTRKFFHLPYEEKLKIKMTPESGYRGYQRIGENVTKGKPDMHEAIDCYTPIRPGKYGDLAKPMEGSNLWPENPSNFEALLENYINLCRDLSRKIMRGIALALGGAIDAFEGETAGDPFWVLRLIGYPVDIPEEQRTDTGCGAHTDYGLLTLVNQDDDICALEVQNRSGEWIYATPIPGTFVCNIGDMLKVWSNGIYQPTLHRVVNNSPRYRVSVAFFYESNFDAAIEPVEFCREKTGGAAKYEKVVYGEHLVKKVLTNFVM

SEQ ID NO: 8849 - protein, 326 aa, Cenchrus ciliaris
  misc_feature (140)..(140): Xaa can be any naturally occurring amino acid
MGSDFKAIPLIDIGPLVEKIDDPRMANDADLLEVVRMLDDACRKAGFFYVKGHGITESLMKEVRDVTRKFFQLPYEEKLKIKMTPQSGYRGYQRIGENITKGKPDMHEAIDCYTPIRPGKYGDLAKPMEGSNLWPENPSXFEALLENYINLCRDLSRKIMRGIALALGGAIDAFEGETAGDPFWVLRLIGYPVDIPEDQRTDTGCGAHTDYGLLTLVNQDDDICALEVQNRCGEWIYATPIPGTFVCNIGDMLKVWSNGIYQSTLHRVVNNSPRYRVSVAFFYESNLDAAIEPVEFCREKTGGAAKYEKVVYGEHLVKKVLTNFVM

SEQ ID NO: 8850 - protein, 326 aa, Pennisetum glaucum
MGSDFKAIPLIDIGPLVEKIDDPSMANDADLMEVVRMLDDACKEAGFFYVKGHGITESLMKEVRDVTRKFFQLPYEEKLKIKMTPHSGYRGYQMIGENITKGKPDMHEAIDCYTPIKPGRYGDLAKPMEGSNLWPENPSNFEALLENYINLCRDLSRKIMRGIALALGGAIDAFEGETAGDPFWVLRLIGYPVDIPEDQRTDTGCGAHTDYGLLTLVNQDDDICALEVQNRSGEWIYATPIPGTFVCNIGDMLKVWSNGIYQSTLHRVVNNSPRYRISVAFFYESNFDAAIEPVQFCREKTGGAAKYEKVVYGEHLVKKVLTNFVM

SEQ ID NO: 8851 - protein, 326 aa, Setaria italica
MGSDFKAIPLIDIGPLVEKIDDPRMANDADLLEVVRMLDDACKEAGFFYVKGHGITESLLKEVRDVTRKFFQLPCEEKLKIKMSPQSGYRGYQRIGENITKGKPDMHEAIDCYTPIKPGKYGDLAKPMEGSNLWPENPSNFEALLENYINLCRDLSRKIMRGIALALGGAIDAFEGETAGDPFWVLRLIGYPVEIPEEQRTDTGCGAHTDYGLLTLVNQDDDICALEVQNRSGEWIYATPIPGTFVCNIGDMLKVWSNGIYESTLHRVVNNSPRYRISVAFFYESNFDAAIEPVQFCREKTGGAAKYEKVVYGEHLVKKVLTNFVM

SEQ ID NO: 8852 - protein, 328 aa, Oryza sativa
MGSDFKAIPLIDISPLVGKIDDPSMVNDEDLLQVVQMLDDACREAGFFYVKGHGIADSLMKQVRDVTQKFFQLPYEEKLKIKMTPQSGYRGYQRVGENITKGKPDMHEAIDCYTPIEPGKYGDLAKPMVGSNLWPKYPSNFDVLLENYISLLRDLSRKIMRGIALALGAPVDAFEGTTAGDPFWVCRLIGYPVSTDIPEEQRTDTGCGAHTDYGLLTLVNQDDDICALEVRNQSGEWIYAKPIPGTFVCNIGDMLKVWSNGIYQPTLHRVVNNSPRYRVSVAFFYESNFDAAVEPVEFCRERTGGVAKYEKVVYGEHLVQKVLTNFVM

SEQ ID NO: 8853 - protein, 328 aa, Secale cereale
MGSDFKAIPLIDIGPLVEKIDDPAMAGDEGLLDVVRMLDDACREAGFFYVKGHGISESLMTEVRDVTRKFFQLPREEKLKIKMTPQSGYRGYQRVGENVTKGKPDMHEAIDCYTPIEPGKYGDLAKPMEGSNLWPDYPSNFDALLENYIRLLRDLSRKIMRGIALALGAPLDAFEGGVAGDAFWVLRLIGYPVSDDIPQEERTDIGCGAHTDYGLLTLVNQDDDICALEVRNQSGEWIYAKPVPGTFVCNIGDMLKVWSNGIYQPTLHRVINNSPRYRVSVAFFYESNFDAAVEPVEFCREKTGGVAKYEKVVYGEHLVQKVLTNFVM

SEQ ID NO: 8854 - protein, 328 aa, Secale cereale
MGSDFKAIPLIDIGPLVEKIDDPAMAGDEGLLDVVRMLDDACREAGFFYVKGHGISESLMTEVRDVTRKFFQLPREEKLKIKMTPQSGYRGYQRVGENVTKGKPDMHEAIDCYTPIEPGKYGDLAKPMEGSNLWPDYPSNFDALLENYISLLRDLSRKIMRGIALALGAPLDAFEGGVAGDAFWVLRLIGYPVSDDIPQEERTDIGCGAHTDYGLLTLVNQDDDICALEVRNQSGEWIYAKPVPGTFVCNIGDMLKVWSNGIYQPTLHRVVNNSPRYRVSVAFFYESNFDAAVEPAEFCREKTGGVAKYEKVVYGEHLVQKVLTNFVM

SEQ ID NO: 8855 - protein, 328 aa, Triticum aestivum
MGSDFKAIPLIDISPLVEKIDDPAMAGDEGLLDVVRMLDDACREAGFFYVKGHGISESLMTEVRDVTRKFFQLPREEKLKIKMTPQSGYRGYQRVGENVTKGKPDMHEAIDCYTPIEPGRYGDLAKPMEGSNLWPDYPSNFDALLENYISLLRDLSRKIMRGIALALGAPLDSFEGGVAGDAFWVLRLIGYPVSDDIPQEERTDIGCGAHTDYGLLTLVNQDDDICALEVRNQSGEWIYAKPVPGTFVCNIGDMLKVWSNGIYQPTLHRVVNNSPRYRVSVAFFYESNFDAAVEPVEFCREKTGGVAKYEKVVYGEHLVQKVLTNFVM

SEQ ID NO: 8856 - protein, 328 aa, Triticum aestivum
MGSDFKAIPLIDIGPLVEKIDDPAMADDKALLDVVQMLDDACREAGFFYVKGHGISESLMTEVRDVTRKFFQLPREEKLKIKMTPQSGYRGYQRVGENVTKGKPDMHEAIDCYTPIEPGKYGDLAKPMEGSNLWPDYPSNFDALLENYISLLRDLSRKIMRGIALALGAPLDAFEGGVAGDAFWVLRLIGYPVSDDIPQEERTDIGCGAHTDYGLLTLVNQDDDICALEVRNQSGEWIYAKPVPGTFVCNIGDMLKVWSNGIYQPTLHRVVNNSPRYRVSVAFFYESNFDAAVEPVEFCREKTGGVAKYEKVVYGEHLVQKVLTNFVM

SEQ ID NO: 8857 - protein, 328 aa, Triticum aestivum
MGSDFKAIPLIDISPLVEKIDDPAMAGDEGLLDVVRMLDDACREAGFFYVKGHGISEPLMTEVRDVTRKFFQLPREEKLKIKMTPQSGYRGYQRVGENVTKGKPDMHEAIDCYTPIEPGRYGDLAKPMEGSNLWPDYPSNFNALLENYISLLRDLSRKIMRGIALALGAPLDAFEGGVAGDAFWVLRLIGYPVSDDIPQEERTDIGCGAHTDYGLLTLVNQDDEICALEVRNQSGEWIYAKPVPGTFVCNIGDMLKVWSNGIYQPTLHRVVNNSPRYRVSVAFFYESNFDAAVEPVEFCREKTGGVAKYEKVVYGEHLVQKVLTNFVM

SEQ ID NO: 8858 - protein, 328 aa, Triticum aestivum
MGSDFKAIPLIDISPLVEKIDDPAMAGDEGLLDVVWMLDDACREAGFFYVKGHGISESLMTEVRDVTRKFFQLPREEKLKIKMTPQSGYRGYQRVGENVTKGKPDMHEAIDCYTPIEPGRYGDLAKPMEGSNLWPDYPSNFDALLENYISLLRDLSRKIMRGIALALGAPLDSFEGGVAGDAFWVLRLIGYPVSDDIPQEERTDIGCGAHTDYGLLTLVNQDDDICALEVRNQSGEWIYAKPVPGTFVCNIGDMLKVWSNGIYQPTLHRVVNNSPRYRVSVAFFYESNFDAAVEPVEFCREKTGGVAKYEKVVYGEHLVQKVLTNFVM

SEQ ID NO: 8859 - protein, 328 aa, Triticum aestivum
MGSDFKAIPLIDISPLVEKIDDPAMAGDEGLLDVVRMLDDACREAGFFYVKGHGISEPLMTEVRDVTRKFFQLPREEKLKIKMTPQSGYRGYQRVGENVTKGKPDMHEAIDCYTPIEPGRYGDLAKPMEGSNLWPDYPSNFDALLENYISLLRDLSRKIMRGIALALGAPLDAFEGGVAGDAFWVLRLIGYPVSDDIPQEERTDIGCGAHTDYGLLTLVNQDDEICALEVRNQSGEWIYAKPVPGTFVCNIGDMLKVWSNGIYQPTLHRVVNNSPRYRVSVAFFYESNFDAAVEPVEFCREKTGGVAKYEKVVYGEHLVQKVLTNFVM

SEQ ID NO: 8860 - protein, 328 aa, Avena sativa
MGSDFKAIPLIDIGPLVEKIDDPGMAGDEGLLGVIRMLDDACKDAGFFYVKGHGIPESLLTEVRDVTRKFFHLPHEEKLKIKMTPQSGYRGYQRVGENVTKGKPDMHEAIDCYTPIEPGKYGALAKPMEGSNLWPDHPPNFDALLENYISLLRDLSRKIMRGIALALGAPLDAFEGGTAGDPFWVLRLIGYPVSADIPQEQRTDTGCGAHTDYGLLTLVNQDDDVCALEVRNMSGEWIYAKPVPGTFVCNIGDMLKVWSNGIYQPTLHRVVNNSPRYRVSVAFFYESNFDAAVEPVEFCREKTGGVAKYEKVVYGEHLVQKVLTNFVM

SEQ ID NO: 8861 - protein, 330 aa, Pseudoroegneria spicata
  misc_feature (3)..(4): Xaa can be any naturally occurring amino acid
TTXXSDFKAIPLIDVSPLVEKIDDPDMAKDEGLLDVVRMLDDACREAGFFYVKGHGISESLMTDVRDVTRKFFQLPHEEKLKIKMTPQSGYRGYQRVGENVTKGKPDMHEAIDCYTPIKPGRYGDLAKPMEGSNLWPDYPSNFDALLENYISLLRDLSRKIMRGIALALGAPLDAFEGGTAGDPFWVLRLIGYPVSADIPQEQRTDIGCGAHTDYGLLTLVNQDDDICALEVRNQSGEWIYAKPVPGTFVCNIGDMLKVWSNGIYQPTLHRVVNNSPRYRVSVAFFYESNFDATVEPVEFCREKTGGVAKYEKVVYGEHLVQKVLTNFVM

SEQ ID NO: 8862 - protein, 328 aa, Brachypodium distachyon
MGSDFKAIPLIDIGPLVEKIDDPDMVGDEGLLGVVRKLDDACREAGFFYVKGHGIAESLMTEVRDVTRKFFQLPDEEKLKIKMTPQSGYRGYQRVGENVTKGKPDMHEAIDCYTPIEPGKYGDLAKPMEGSNLWPDYPSNFKVLLEEYLSLVRDLSRKIMRGIALALGAPLDAFEGGMAGDAFWVFRLIGYPVSADIPQEQRTDIGCGAHTDYGLLTLVNQDDDICALEVRNQSGEWIYAKPVPGTFVCNIGDMLKVWSNGIYQPTLHRVVNNSPRYRVSVAFFYESNFDTTVEPVEFCREKTGGVAKYEKVVYGEHLVQKVLTNFVM

SEQ ID NO: 8863 - protein, 328 aa, Triticum aestivum
MGSDFKAIPLIDISPLVEKIHDPAMAGDEGLLDVVRMLDDACREAGFFYVKGHGISESLMTEVRDITRKFFHLPREEKLKIKMTPQSGYRGYQRVGENVTKGKPDMHEAIDCYTPIEPGRYGDLAKPMEGSNLWPDYPSNFDALLENYISLLRDLSRKIMRGIALALGAPLDAFEGGVAGDAFWVLRLIGYPISDDIPQEERTDIGCGAHTDYGLLTLVNQDDDICALEVRNQSGEWIYAKPVPGTFVCNIGDMLKVWSNGIYQPTLHRVVNNSPRYRVSVAFFYESNFDAAVEPVEFCREKTGGVAKYEKVVYGEHLVQKVLTNFVM

SEQ ID NO: 8864 - protein, 328 aa, Hordeum vulgare
MGSDFKAIPLIDIGPLVEKIDDPAMAGDEGVLGVVRMLDAACREAGFFYVKGHGISESLMTEVRDVTRKFFQLPHQEKLKIKMTPQSGYRGYQRVGENVTKGKPDMHEAIDCYTPIEPGRYGDLAKPMEGSNLWPDYPSNFDALLENYISLLRDLSRKIMRGIALALGAPLDAFEGGVAGDAFWVLRLIGYPVSDDIPQEERTDIGCGAHTDYGLLTLVNQDDDICALEVRNQSGEWIYAKPVPGTFVCNIGDMLKVWSNGIYQPTLHRVVNNSPRYRVSVAFFYESNFDAAVEPVEFCREKTGGVAKYEKVVYGEHLVQKVLTNFVM

SEQ ID NO: 8865 - protein, 328 aa, Oryza sativa
MASDFKAIPLIDISPLVEKIDDPNMANDKDLLQVVRLLDDACREAGFFYVKGHGIAESLMKEVRDVTHKFFQLPYEEKLKIKMTPQNGYRGYQRLGENITNGKPDMQEAIDYYAPIEPGKYGDLAKPMEGTNLWPKYPSNFDALLKNYISLLRDLSRKIMQGIALALGGPVDAFEGRTAGDPFWVCRLIGYPVSTDILEEHRTDTGCGAHTDYGLLTLVNQDDDICALEVKNQSGEWIYAKPIPGTFVCNIGDMLKVWSNGIYQPTLHRVVNNSPRYRVSVAFFYESNFDAAIEPVEFCRERTGGVAKYEKVVYGEHLIKKVLNNFIK

SEQ ID NO: 8866 - protein, 315 aa, Cynodon dactylon
MGSDFQAIPLIDICPLVEKIDDPSTANDKDLLEVVRMLDEACKEAGFFYVTGHGISESLLREVRDVTRKFFQLPYEEKMKIKMTPQSGYRGYQRVGENVTKGKPDMHEAIDCYTPVKPGKYGDLGKPMEGSNLWPEYPSNFEGLLENYVNLCRDLSRKIMRGIALALGGKVDAFEGETAGDPFWVLRLIGYPVDIPAEQRTDTGCGAHTDYGLLTLVNQDDDICALEVQNRSGDWIYAKPIPGTFVCNIGDMLKVWSNGIYLSTLHRVVNNSPRYRVSVAFFYESNFDAAIEPVDFCREEDRWCPKVRKGCVWEA

SEQ ID NO: 8867 - protein, 322 aa, Avena sativa
MGSDFKAIPLIDIGPLVEKIDDPAMAGDEGLLGVIRMLDDACKDAGFFYVKGHGIPESLLTEVRDVTRKFFHLPHEEKLKIKMTPQSGYRGYQRVGENVTKGKPDMHEAIDCYTPIEPGKYGAVAKPMEGSNLWPDHPPNFDALLENYISLLRDLSRKIMRGIALALGAPLDAFEGGTAGDPFWVLRLIGYPVSADIPQEQRTDTGCGAHTDYGLLTLVNQDDDICALEVRNLSGEWIYAKPVPGTFVCNIGDMLKVWSNGIYQPTLHRVVNNSPRYRVSVAFFYESNFDAAVEPVEFCREKTGGVASTRRWSTGSIWCRKS

SEQ ID NO: 8868 - protein, 85 aa, Saccharum officinarum
ASSSLTELATSERASKKGSKRSNGVLVPLQRRQRLQQGEEAAAQEGPAQAADRQDPARQPRGAGRQEPGSRLREISSASRRRVAS

SEQ ID NO: 8869 - protein, 78 aa, Zea mays
EKQRREGPAQEEGSKQEGNKEGSKQAIGAMEHGYPCNGCGKEKRPPLKRGQLKLQIARTLLGSLAAPVAKNRDRAFGR

SEQ ID NO: 8870 - protein, 137 aa, Panicum virgatum
LSQSRLLHSTSKQRRRTSGAKEEGGRASNGVRVPLQRLRRQQGEEAAAQAWAAQAADRQDPAGQPCGAGRQEQGPQLREISKAGALEQCLQCQLPEDMHPVLLEIGIVQTEEFFFFNSLIRYPLVLSFAPFCSPSGF

SEQ ID NO: 8871 - protein, 485 aa, Zea mays
MGSSAQLRRLKPLYQLVVNNILTIVAVPLAAAVLLKAAELGPEEILARARALRPAHMLLAGFLPAVATVLYLTLRPRAVYLVDYACFRTNPNCRVPFATFLEHSRVWPGFDERSVRFMTRLLERSGLGEETCLPYAQHYIPPSRDLESSRAEAELVIFSAIDDLLAKTGVSPQDIDILVVNCSLFAPTPSFADMVMRRYGLRGDVRSVHLAGMGCSAGLISVELARNLLQVAPRGARALVVSTETITPNYYMGKERAMLLPNCLFRMGGAAALLSTDGAGARFRLARVVRTLRGASDAAYRCVYQEEDERGNVGINLSKDLMSIAGDALKANITAMGPLVLPASEQLLFALSFIARKVLNDRVKPYIPDFRTAFEHFCIHAGGRAVIDELQRSLTLSDEQVEASRMTLHRFGNTSSSSLWYELAYIEAKGRMRRGDRVWMIGFGSGFKCNSAAWECIRPAANADDGPWANCIHRYPVHIPDVLKH

SEQ ID NO: 8872 - protein, 480 aa, Zea mays
MGSPVQLRRLKPLYQLVVNNILAIVAVPLAAAVLLKASSLGPEEILALRPAHMFLAAFLPAAATVLYLMLRPRAVYLVDYACFRTSPNCRVPFATFLEHSRVWPGFDERSVRFMTRLLERSGLGEETCLPYAQHYIPPSRDLESSRAEAELVIFSAIDDLLAKTGVSPRDIDILVVNCSLFAPTPSFADMVAHRYRLRGDVRNVHLAGMGCSAGLVSVELARNLLQVAPRGARALVVSTETITPNYYMGEERAMLLPNCLFRMGGAAALLSTDGAGARFRLARVVRTLRGASDGAYRCVYQEEDERGNVGINLSKDLMSIAGDALKANITAMGPLVLPASEQLLFALSFIARKVLNNRIRPYIPDFRTAFEHFCIHAGGRAVIDELQRSLTLSDEQVEASRMTLHRFGNTSSSSLWYELAYVEAKGRMRRGDRVWMIGFGSGFKCNSAAWECIRPAANADGPWANCIHRYPVHIPDVLKH

SEQ ID NO: 8873 - protein, 484 aa, Setaria italica
MVSSAQLRRLKPLYQLEVNNILAIVTEPFAAAAVLKAAELGPGEILERLRALRPAHMFLAAFLRAAAAALYLRLRPRAVYLVDYACFRTNPNCRVPFATFLEHSRVWPGFDERSVRFMTRLLERSGLGEETCLPYAQHYIPPSRDLESSRAEAELVIFSAIDDLLAKTGLSPQDIDILVVNCSLFAPTPSFTDMIMRRYKLREDVRAVHLAGMGCSAGLISVELARNLLQVAPRGAHALVVSTETITPNYYMGQERAMLLPNCLFRMGGAAALLSTNGANARFRLARVVRTLRGASDSAYRCVYQEEDDRGNVGINLSKDLMNIAGDALKANITAMGPLVLPASEQLLFALSFIARKVLNNRIKPYIPDFRTAFEHFCIHAGGRAVIDELQRSLTLSDEQVEASRMTLHRFGNTSSSSLWYELAYIEAKGRMRRGDRVWMIGFGSGFKCNSAAWECIRPAANADGPWANCIHRYPVHIPDVLKH

SEQ ID NO: 8874 - protein, 614 aa, Panicum virgatum
MGSSAQLKRLKPLYQLVVNNILAIVAVPLAAAVVLKAAELGPAEILARLRALRPAHMFLAAFLPAAAAVLYLWLRPRAVYLVDYACFRTNPNCRVPFATFLEHSRVWPGFDERSVRFMTRLLERSGLGEETCLPYAQHYIPPSRDLESSRAEAELVIFSAIDDLLAKTGMSPQDIDILVVNCSLFAPTPSFTDMIMRRYKLREDVRNVHLAGMGCSAGLISVELARNLLQVAPRGAHALVVSTETITPNYYMGQERAMLLPNCLFRMGGAAALLSTSGAQRAVPAGARGAHAPRRRGQRVSVRVPGGGRAGQRRDQPVQGSDEHRWRRAEGKHHGDGAAGAAGVGAAAVRAVLHGAQGAQQADQALHPGLPDGVRALLHPRRRARRHRRAAEEPAAVGAARGGVAHDAAPLRQHLQQLALVRARLHRGQGPHAPRRPRLDDRFRLRVQVQQRSLGVHPPRRQRRRALGQLHPPVPRPHPRRAQALTAPPATTSRTCRHYSCLPSSVLLYPPPHLPLLFYLSLSLRPPVPLPLPHMVRGNQTAGTVMNSEFGVEGFVVSACQGGRHKGGGSGEALGACAPPGRAGVLWSRWRCGCNRVGLFQEGGYYTRTYTRWL

SEQ ID NO: 8875 - protein, 485 aa, Oryza sativa
MTSSSGQLKRLKPLYQLAVNNILAVVAVPLAAAVVLKAAELGHEEILARARALPPAHLFLAAFVPAAAAVVYLMLRPRAVYMVDYACFRTSPNCRVPFATFLEHSRVWPGFEERSVRFMTRLLERSGLGEETCLPYAQHYIPPSRDLESSRAEAELIIFSAIDDLLAKTGISPQDIDILVVNCSLFAPTPSFTDMIINRYKLRKDVRNVHLSGMGCSAGLISVGLARNLLQVAPKGAHALVVSTETITPNYYMGQERAMLLPNCLFRMGGAAVLLSTNGAKARFRLARVVRTLTGAQDGAYHCVYQEEDGRGNVGINLSKDLMSIAGDALKANITTMGPLVLPASEQLLFALSFMARKVLSGRIKPYIPDFRTAFEHFCIHAGGRAVIDELQRSLTLSDEQVEASRMTLHRFGNTSSSSLWYELAYVEAKGRMRKGDRVWMIGFGSGFKCNSAAWECIRPAANADGPWATCIHRYPVDIPDVLKH

SEQ ID NO: 8876 - protein, 489 aa, Brachypodium distachyon
MSSSAQLLRRLKPLYQLVVSNILAIVSVPLAALAALKAAELGPDEALARLRALRPAHMFLAAFVPAAAAALYLRLRPRAVYMVDYACFRTSPNCRVPFATFQEHARVWPGFDERSVRFMTRLLERSGLGEETCLPYAQHYIPPSRDLEPSRAEAELIVFSAIDDLLAKTGVSPADIDILVVNCSLFAPTPSFADMVVNRYRLRKDVRNVHLAGMGCSAGLIAVGLARNLLQVAPPGAKALVVSTETITPNYYMGKERAMLLPNCLFRMGGAAVLLSTSPRNARFRLSRVVRTLTGGAKDGAYRCVYQEEDDRGNVGINLSKDLMSIAGDALKANITAMGPLVLPASEQLLFALSFIARKVVSGRIKPYIPDFRTAFEHFCIHAGGRAVIDELQRSLTLSDEQVEASRMTLHRFGNTSSSSLWYELAYIEAKGRMRKGDRVWMIGFGSGFKCNSAAWECVRPPPPEAVRDGPWAASVHRYPVDIPDVVKH

SEQ ID NO: 8877 - protein, 482 aa, Triticum aestivum
MSSSVQLKRLYQLAVSNIVAIAAVPFAASALLKAAELGPEELLARLRALRPVHMFLAAFVPAAAAAVYLKLRPRAVYMVDYACFRTSPSCRVPFAAFQEHARVWPGFDERSVRFMSRLLERSGLGEETCLPYAQHYIPPSRDLESSRAEVELIVFSAIDDLLAKTKVAPEDIDILVVNCSLFAPTPSFADMIVNRYNLRKDVRNVHLAGMGCSAGLISVGLARNLLQVAPRGSNALVVSTETITPNYYMGKERAMLLPNCLFRMGGAAVLLSTNGANARFRLARVVRTLTGAQDGAYRCVYQEEDDRGNVGINLSKDLMSVAGEALKANITAMGPLVLPASEQLLFALSFIARKVVNRGIKPYIPDFRTAFEHFCIHAGGRAVIDELQRSLTLSDEQVEASRMTLHRFGNTSSSSLWYELAYVEAKGRMRKGDRVWMIGFGSGFKCNSAAWECIHPAPVAADGPWAACVHRYPVDIPDVLKH

SEQ ID NO: 8878 - protein, 277 aa, Saccharum officinarum
MAAPSGGGGGGAGEGSSSAAAAATIGAHGVDQEAMWQMNLGETMAPMELGPYPERVGEPDCSYYMRTGMCRFGMTCKFNHPADRKLAVAAARMKGEYPQRIGQPECQYYLKTGTCKFGATCKFHHPREKAAMATRVQLNELGYPLRPNEKECAYYLRTGQCKFGSTCKFHHPQPSTMMVAVRGSVYSPGQSATSPGQHAYQGAVTSWPLSRSASFIASPRWPGHSSYAQVMVPPGLVRSQDGVLILHRLVLHPRMTNNGHPELPNTILAHARVEQLA

SEQ ID NO: 8879 - protein, 443 aa, Zea mays
MAAPSGGGGGGAGEGSSSAAAAATIGVHGVDQVAEAMWQMNLEEAMELGPYPERVGEPDCSYYMRTGMCRFGMTCKFNHPADRKLAVAAARMKGEYPQRIGQPECQYYLKTGTCKFGATCKFHHPREKAAMATRVQLNELGYPLRPNEKECAYYLRTGQCKFGSTCKFHHSQPSTMMVAVRGSVYSPGQSATSPGQHAYQGAVTSWPLSRSASFIASPRWPGHSSYAQVIVPPGLVQVPGWSPYTAQIGSSSSEDQQRTPGAAQYYTGSRQSGTSIGDQGMFSSYQAGSVPVGLYAVQRENLFPERPDQPECQFYMKTGDCKFGAVCKFHHPRERIIPTPNCALSPLGLPLRPGEPICSFYNRYGMCKFGPNCKFDHPMGNAMYGQAPSPASEAPAPRRMLAHVPPSHPEASPDGGSGRSRRIAHSDSQQIPSGERSAEREAS

SEQ ID NO: 8880 - protein, 444 aa, Oryza sativa
MAAAPSAGGVGEGSSSSAAAAAAAAAATIGPHVVDEEAMWQMNLGEAMEAGPYPERIGEPDCSYYMRTGLCRFGMTCKFNHPADRKMAVAAARMKGEYPQRIGQPECQYYLKTGTCKFGATCKFHHPREKAAIATRVQLNALGYPLRPNEKECAYYLRTGQCKFGSTCKFHHPQPSNTMVAVRGSVYSPGQSVTSPSQHTYPGAVTNWPLSRSASFIASPRWPGHSSYAQVIVPPGLVQVPGWNPYAAQIGSSSSDDQQRTAGGAQYYTGSRHSETPNMGDQGMFSSYQAGSVPLGLYTVQRESIFPERPDQPECQFYMKTGDCKFGAVCKFHHPKERIIPTPNCALSSLGLPLRPGEPICTFYSRYGICKFGPNCKFDHPMGTVMYGLATSPTGDVSARRMLAPVPAHSEVSPDNVSGRSRRITHSDSQQIPSGERGTEREAS

SEQ ID NO: 8881 - protein, 450 aa, Setaria italica
MAAPSAGAGGGGGAAGEGSSSSAAAAAAAATIGAHGVDQVAEAMWQMNLGEAVELGPYPERVGEPDCSYYMRTGMCRFGMTCKFNHPADRKLAVAAARMKGEYPQRSGQPECQYYLKTGTCKFGATCKFHHPREKAAMATRVQLNELGYPFRPNEKECAYYLRTGQCKFGSTCKFHHPQPSTMMVAVRGSGYSPGQSATSPGQHAYQGAVTSWPLSRSASFIASPRWPGHSSYAQVIVPPGLVQVPGWSPYTAQIGSSSSDDQQQTPGAAQYYTGSRQSGTPGMGDQGMFSSYQAGSVPVGLYAVQRENVFPERPDQPECQFYMKTGDCKFGAVCKFHHPRERIIPTPNCALSSLGLPLRPGEPICSFYSRYGMCKFGPNCKFDHPLGTVMFGHASSPTGEVPTSRRMLAHVPSHPEVSPDSGSGRSRRISHSDSQQIPPGERSTEREAS

SEQ ID NO: 8882 - protein, 450 aa, Panicum virgatum
MAAPSAGAGGGGGGAGEGSSSSAAAAAAAATIGAHGVDQVAEAMWQMNLGEAVELGPYPERVGEPDCSYYMRTGMCRFGMTCKFNHPADRKLAVAAARMKGEYPQRNGQPECQYYLKTGTCKFGATCKFHHPREKAAMATRVQLNELGYPFRPSEKECAYYLRTGQCKFGSTCKFHHPQPSTMMVAVRGSGYSPGQSATSPGQHAYQGAVTSWPLSRSASFIASPRWPGHSSYAQVLVPPGLVQVPGWNPYTAQIGSSSSEDQQRTPGAAQYYTGSRQSGTPGIGDQGMFSSYQAGSVPVGLYAVQRENVFPERPDQPECQFYMKTGDCKFGAVCKFHHPRERIIPAPNCALSSLGLPLRPGEPICSFYSRYGMCKFGPNCKFDHPIGTVMYGHVSSPTSEVPTSRRMLAHVPSHPEVSPDNGSGRSRRITHSDSQQIPSGERSTEREAS

SEQ ID NO: 8883 - protein, 445 aa, Brachypodium distachyon
MAALSAGGPGGVVAGEGSTSSAAAAAATIGSHRVDGEAMWHMSLGESMEAGLYPERVGEPDCSYYMRTGLCRFGMTCKFNHPADRKMAVAAARMKGEYPQRIGQPECQYYLKTGMCKFGATCKFHHPREKAAMATRVQLNVLGYPLRPNEKECSYYLRTGQCKFGSTCKFNHPQPSNTMVALRGSVFSPGQSATSPSQHTYSGSVTNWPLSRSASFIASPRWPGHSSYAQVIVPPGLVQVPGWSPYAAQLGSSSSDDQGRSSGAAQYYTGSRQSETQGMSDHGMISSYQHGSVPAGLYAVQREYIFPDRPDQPECQFYMKTGDCKFGAVCKFHHPKERIIPSPSCALSPLGLPLRSGEPICTFYSRYGICKFGPNCKFDHPMGTVMYGLATSPTGEVPTGRHMLAPVPALSEVPPGNSSGRSRRMTHADTQQTPSTERSTEREAS

SEQ ID NO: 8884 - protein, 386 aa, Saccharum officinarum
FIQAPLTALLEYSGILRPDPGGGTQQPGTGAGPGEVSIRIVAPGEAGTSSERAEEAIVEEEEEDGHATRTRPEEPTPAAGGGEGGRESSSSYQRYDIQQVARWVEQILPFSLLLLVVFIRQHLQGFFVTIWIAAVMFKSNDILRKQTALKRERKIPVLVGITILFVVHVSGFYWCYKNGDLIRPLMMLPPKEIPPFWHAIFIILVNDTMVRQTAMVVKCLLLMYYKNSRGRSYRRQGQMLTIVEYFLLLYRALLPTPVWYRFFLNKEYGSLFSSLTTGLYLTFKLTSVVEKVQSFLTALRALSHKDFHYGSYATSEQVVAAGDLCAICQEKMHVPILLRCKHIFCEDCVSEWFERERTCPLCRALVKPADLRSFGDGSTSLFFQLF

SEQ ID NO: 8885 - protein, 423 aa, Zea mays
MDARAPPPPQPHPPRAPSPQPPPAPSRRYGLHFSASSFIQAPLTALLEYSGILRPDPGGGIQQPGTGARPGEVSIRIVAPGEAGTSSERAEEVIVEEEEEDGQATRTRPEDPSPAAGGGEGGRESSSSYQRYDIQQVARWVEQILPFSLLLLVVFIRQHLQGFFVTIWIAAVMFKSNDILCKQTALKRERKIPVLVGITILFVVHVSGFYWCYKNGDLIRPLMMLPPKEIPPFWHAIFIILVNDTMVRQTAMVVKCLLLMYYKNSRGRSYRRQGQMLTIVEYFLLLYRALLPTPVWYRFFLNKEYGSLFSSLTTGLYLTFKLTSVVEKVQSFLTALRALSHKDFHYGSYATSEQVVAAGDLCAICQEKMHVPILLRCKHIFCEDCVSEWFERERTCPLCRALVKPADLRSFSDGSTSLFFQLF

SEQ ID NO: 8886 - protein, 382 aa, Pennisetum glaucum
GQTGCLSIPDSEHNACSESGMDRILAGAGPDEVSIRIVAPGEAGTSSERAEEVIVEEEEEGHATRARAEEPAPAAGAGEGGRESSSSYQRYDIQQVARWVEQILPFSLLLLVVFIRQHLQGFFVTIWIAAVMFKSNDILRKQTALKRERKIPVLAGITVLFVVHVSGFYWYYKNGDLIRPLVMLPPKEIPPFWHAIFIILVNDTMVRQTAMIVKCLLLMYYKNSRGRSYRRQGQMLTIVEYFLLLYRALLPTPVWYRFFLNKEYGSLFSSLTTGLYLTFKLTSVVEKVQSFLTALRALSHKDFHYGSYATSEQVLAAGDMCAICQEKMHVPILLRCKHIFCEDCVSEWFERERTCPLCRALVKPADLRSFGDGSTSLFFQLF

SEQ ID NO: 8887 - protein, 423 aa, Panicum virgatum
MDAPPPQAQPPRAPSPPPPPQPPAPSRRYGVHFSASSFIQAPLTALLEYSGILRPDPGGGAHQAGAGAGPGEVSIRIVAPGEAGTSSERAEEVIVEEEEEEGHATRARPEEPVPAAGVGEGGRESSSSYQRYDIQQVARWVEQILPFSLLLLVVFIRQHLQGFFVTIWIAAVMFKSNDILRKQTALKRERKLPVLVGITVLFVVHVSGFYWCYKNGDLIRPLVMLPPKEIPPFWHAIFIILVNDTMVRQTAMIVKCLLLMYYKNSRGRSYRRQGQMLTIVEYFLLLYRALLPTPVWYRFFLNKEYGSLFSSLTTGLYLTFKLTSVVEKVQSFLTALRALSHKDFHYGSYATSEQVIAAGDMCAICQEKMHVPILLRCKHVFCEDCVSEWFERERTCPLCRALVKPADLRSFGDGSTSLFFQLF

SEQ ID NO: 8888 - protein, 428 aa, Setaria italica
MDAPPPPHQQQQAHPPRAPSPPPPPQPPAPSRRYGVHFSASSFIQAPLTALLEYSGILRPDPGGGAQQAGAGAGPGEVSIRIVAPGEAGTSSERAEEVIVEEEEEEGHATRARAEEPAPAAGAGEGGRESSSSYQRYDIQQVARWVEQILPFSLLLLVVFIRQHLQGFFVTIWIAAVMFKSNDILRKQTALKRERKIPVLVGITVLFVVHVSGFYWCYKNGDLIRPLLMLPPKEIPPFWHAIFIILVNDTMVRQTAMIVKCLLLMYYKNSRGRSYRRQGQMLTIVEYFLLLYRALLPTPVWYRFFLNKEYGSLFSSLTTGLYLTFKLTSVVEKVQSFLTALRALSHKDFHYGSYATSEQVLVAGDMCVICQEKMHVPILLRCKHIFCEDCVSEWFERERTCPLCRALVKPADLRSFGDGSTSLFFQLF

SEQ ID NO: 8889 - protein, 422 aa, Zea mays
MDALPPLQRATSPPPQPRPQPPVPSRRYGVHFSASSFIQAPLTTLLEYSGILRPDPGGGTQQDGAGAGPGEVSIRIVAPGEAGTSSERPEEVIVEEEEEDGHATRTRPEDPSPAAGGGEGGRESSSSYQRYDIQQVARWVEQILPFSLLLLVVFIRQHLQGFFVTIWIAAVMFKSNDILRKQTALKRERKIPVLVGITILFVVHVSGFYWCYKNGDLIRPLMMLPPKEIPPFWHAIFIILVNDTMVRQTAMVVKCLLLMYYKNSRGRSYRRQGQMLTIVEYFLLLYRALLPTPVWYRFFLNKEYGSLFSSLTTGLYLTFKLTSVVEKVQSFLTALRALSHKDFHCGSYATSEQVAVAGDLCAICQEKMHVPILLRCKHVFCEDCVSEWFERERTCPLCRALVKPADLRSFGDGSTSLFFQLF

SEQ ID NO: 8890 - protein, 420 aa, Brachypodium distachyon
MTESAPPRPTSPRPPLVLQPPQPPAAVASRRYGVHFSASSFIQAPLSALLEYSGILRVEPHHAGGEGGEVSIRIVGGGEAGESSERGEDGVVEEQEGDAGPTARAAHPSVPAPAGGEAGRESSSSYQRYDIQQVARCVEQILPFSLLLLVVFIRQHLQGFFVTIWIAAVMFKSNDILRKQTALKGERKMLVLVGITLLFVVHVFGVYWFYKNGDLIRPLVMLPPKEIPPFWHAIFIILVNDTLVRQTAMIVKCILLMYYKNTRGRSYRRQGQMLTIVEYFLLLYRALLPAPVWYRFFLNKEYGSLFSSLTTGLYLTFKLTSVVEKVQSFLTALRALSHKDFHYGSYATTEQIAAAGDMCAICQEKMHAPILLRCKHVFCEDCVSEWFERERTCPLCRALVKPADLRSFGDGSTSLFFQLF

SEQ ID NO: 8891 - protein, 528 aa, Brachypodium distachyon
MATLGLASCCTPGAVPPLRCVSAVAAPGRISTICCSPVPGCVVSMLPFGVGVNRLGSAPTFASFCTALRTSLRRFPTPVANSLVLLILWVIWKRRNRSSQPLSTVLLTNLRALVRLARGWLVINFLQPPQPPAAVASRRYGVHFSASSFIQAPLSALLEYSGILRVEPHHAGGEGGEVSIRIVGGGEAGESSERGEDGVVEEQEGDAGPTARAAHPSVPAPAGGEAGRESSSSYQRYDIQQVARCVEQILPFSLLLLVVFIRQHLQGFFVTIWIAAVMFKSNDILRKQTALKGERKMLVLVGITLLFVVHVFGVYWFYKNGDLIRPLVMLPPKEIPPFWHAIFIILVNDTLVRQTAMIVKCILLMYYKNTRGRSYRRQGQMLTIVEYFLLLYRALLPAPVWYRFFLNKEYGSLFSSLTTGLYLTFKLTSVVEKVQSFLTALRALSHKDFHYGSYATTEQIAAAGDMCAICQEKMHAPILLRCKHVFCEDCVSEWFERERTCPLCRALVKPADLRSFGDGSTSLFFQLF

SEQ ID NO: 8892 - protein, 175 aa, Panicum virgatum
QTAMIVKCLLLMYYKNSRGRSYRRQGQMLTIVEYFLLLYRALLPTPVWYRFFLNKEYGSLFSSLTTGLYLTFKLTSVVEKVQSFLTALRALSHKDFHYGSYPTSEQVFAAGDTCAICQEKMHVPILLRCKHIFCEDCVSEWFERERTCPLCRALVKPADLRSFGDGSTSLFFQLF

SEQ ID NO: 8893 - protein, 232 aa, Avena sativa
MLVLVGITILFVVHVFGVYWCYKNGDLIRPLVMLPPKEIPPFWHAIFIILVNDTMTRQTAMVVKCILLMYYKNTRGRSYRRQGQMLTVVEYLLLLYRALLPTPVWYRFFLNKEYGSLFSSLTTGLYLTFKLTSVVEKVQSFLTALRALSHKEFHYGSYATTEQVAAAGDMCAICQEKMHAPILLRCKHVFCEDCVSEWFERERTCPLCRALVKPADLRSFGDGSTSLFFQLF

SEQ ID NO: 8894 - protein, 402 aa, Hordeum vulgare
APTTTTPPASPRTQPQPQAPAAVPSRRYGVHFSASSFIQAPLSALLEYSGILRAEPGPHRPPAGAGEVSIRIVGPAPTDGDVQEEGDDAAGSSAPPAPADPSSSSSSYQRYDVQQVARWVEQILPFSLLLLVVFIRQHLQGFFVTIWIAAVMFKSNDILRKQTALKGERKMLILVGITILFIVHVSGVYWCYKNGDLIRPLVMLPPKEIPPFWHAIFVILVNDTMVRQTAMIVKCILLMYYRNTKGRSYRRQGQMLTLVEYFLLLYRALLPAPVWYRFFLNKEYGSLFSSLTTGLYLTFKLTSVVEKIQSFLTSLRALSHKDFHYGSYATSEQVAAAGDMCAICQEKMHVPILLRCKHVFCEDCVSEWFERERTCPLCRALVKPADLRSFGDGSTSLFFQLF

SEQ ID NO: 8895 - protein, 234 aa, Aristolochia fimbriata
RKISVLVGITLLFMLHVVGVYWWYRNDDLLYPLVMLPPKEIPPFWHAIFIIMVNDTMVRQAAMVLKCILLMYYKNSRGRNYRKQGQMLTLVEYLLLLYRALLPTPVWYRFFLNKEYGSLFSSLTTGLYLTFKLTSVVEKVQSFFTALKALSRKEVHYGSYATTEQVVAAGDLCAICQEKMHAPILLRCKHIFCEDCVSEWFERERTCPLCRALVKPADLRSFGDGSTSLFFQLF

SEQ ID NO: 8896 - protein, 414 aa, Triticum aestivum
MDAPPPRTTTTATPPPLPRPPPLQPQASAAVPSRRYGVHFSASSFIQAPLSALLEYSGVLRADPGPHHPPAGGGEVSIRIVGPPAADGAVQEEGDAAGGAQPSAPAPAAGAAGVDSSSSYQRYDIQQVARWVEQILPFTLLLLVVFIRQHLQGFFVTIWIAAVMFKSNDILRKQTALKGERKMLILVGITILFIVHVSGVYWCYKNGDLIRPLVMLPPKEIPPFWHAIFVILVNDTMVRQTAMIVKCILLMYYRNTKGRSYRRQGQMLTLVEYFLLLYRALLPAPVWYRFFLNKEYGSLFSSLTTGLYLTFKLTSVVEKIQSFFTSLRALSHKDFHYGSYATSEQVAAAGDMCAICQEKMHVPILLRCKHVFCEDCVSEWFERERTCPLCRALVKPADLRSFGDGSTSLFFQLF

SEQ ID NO: 8897 - protein, 413 aa, Triticum aestivum
MDAPPPRTTTTATPPPLPRPPPLQPQASAAVPSRRYGVHFSASSFIQAPLSALLEYSGVLRADPGPHHPPAGGGEVSIRIVGPPAADGAVQEEGDAAGGAQPSAPAPAAAAGADTSSSYQRYDIQQVARWVEQILPFTLLLLVVFIRQHLQGFFVTIWIAAVMFKSNDILRKQTALKGERKMLILVGITILFVVHVSGVYWCYKNGDLIRPLVMLPPKEIPPFWHAIFVILVNDTMVRQTAMIVKCILLMYYRNTKGRSYRRQGQMLTLVEYFLLLYRALLPAPVWYRFFLNKEYGSLFSSLTTGLYLTFKLTSVVEKIQSFFTSLRALSHKDFHYGSYATSEQVAAAGDMCAICQEKMHVPILLRCKHVFCEDCVSEWFERERTCPLCRALVKPADLRSFGDGSTSLFFQLF

SEQ ID NO: 8898 - protein, 409 aa, Secale cereale
MDAPPPTTAPTTPPASPRPQPQAPAAVPSRRYGVHFSASSFIQAPLSALLEYSGILRAEPGPHHPPAGGGEVSIRIVGPAPTDDVQEEGDAAGGAQPSAPAPAAAAGADPSSSSYQRYDIQQVARWVEQILPFTLLLLVVFIRQHLQGFFVTIWIAAVMFKSNDILRKQTALKGERKMLILVGITILFVVHVSGVYWCYKNGDLIRPLVMLPPKEIPPFWHAIFVILVNDTMVRQTAMIVKCILLMYYRNTKGRSYRRQGQMLTVVEYFLLLYRALLPAPVWYRFFLNKEYGSLFSSLTTGLYLTFKLTSVVEKIQSFFTSLRALSHKDFHYGSYATSEQVAVAGDMCAICQEKMHVPILLRCKHVFCEDCVSEWFERERTCPLCRALVKPADLRSFGDGSTSLFFQLF

SEQ ID NO: 8899 - protein, 486 aa, Sesamum indicum
MEASGGNSDAYRSSSSNTSTHSRRHGLHISASNILRSPLSTLLEYTGILRTRSNHSESDALLNNGSQISYRDHHLQPHLNDSPPPAPANRGGTAGEVSIRIIGAGEHEHDRVATVLHSVPVVGQLSAQSESFPQPISRSGSAVSVLSSLESQVELRSDREAGDGGAHTTDSGGDTDAAEGAAANNRDSSSSYQRYDIQQAARWIEQVLPFSLLLLVVFIRQHLQGFCVTIWIAAFMFKSNDVVRKQTALKGERRIFVLIGIVILFTLHVVGIYWWYRNDDLLYPLLMLPPRTIPPFWHAIFIIMVNDTLVRQAAMVFKCVLLMYYKNSRGRNYRRQGQLLTLVEYLLLLYRALLPAPVWYRFFLNKEYGSLFSSLMTGLYLTFKLTSVVEKVQSFITALRALSRKDIHYGAYATSEQVVAAGDLCAICQEKMHAPVLLRCKHIFCEDCVSEWFERERTCPLCRALVKPADLRSFGDGSTSLFFQLF

SEQ ID NO: 8900 - protein, 432 aa, Mimulus guttatus
MHISASNILRSPLSTLLEYTGVLRTRSNHSESDILLNSGANLGYRDHHLNDSAPSPVANSSVSAGEVSIRIIGSGEHENDRVATVLHPVPTVEQLSSQVDLRSDREAGEGVTHTVNPGSDTDAADGGGVTNRDSSSSYQRYDIQQAARWIEQVLPFSLLLLVVFIRQHLQGFCATIWIAAFMFKSNDIVRKQTALKGERRIFLLTGIAILFTLHVVGIYWWYRNDDLLYPLLMLPPRTIPPFWHAIFIIMVNDTLVRQAAMVFKCMLLMYYKNSRGQNYRRQGQMLTLVEYLLLLYRALLPAPVWYRFFLNKEYGSLFSSLMTGLYLTFKLTSVVEKVQSFITALRALSRKDIHYGCYATSEQVVAAGDLCAICQEKMHAPVLLRCKHIFCEDCVSEWFERERTCPLCRALVKPADLRSFGDGSTSLFFQLF

SEQ ID NO: 8901 - protein, 490 aa, Amorphophallus konjac
METSGGGADPYRSPSGGGAADGGNGGASSRRYGLQLSASNLLQAPISALLEYSGILRPRAGYPENESLIGGGGLPAGLRDHVPSRLDDAAVSSSGDGEVSIRIIGAGDQESIRVGTGPPQQLVVGPGRERNAGENGVQTEHVPTVSDRHSGDIGNEGGVAEAPSSSMSSPISSGSAAGTEGEAGSGVGGNNRDSPYQRYDIQQAARWIEQILPFSLLLLVVFIRQHLQGFFVTIWIAAVMFKSNDILRKQTALKGERKFSVLVGIALVFTLHVVAVYWWYRNDDVLYPLVMLPPKAIPPFWHAIFIIMVNDTMVRQAAMVFKCMLLMYYKNGRGRNYRRQGQMLTLVEYLLLLYRALLPTPVWYRFFLNKEYGSLFSSLTTGLYLTFKLTSVVEKVQSFFTALKALSRTEVHYGSYATTEQVIAAGDLCAICQEKMHAPILLRCKHIFCEDCVSEWFERERTCPLCRALVKPADLRSFGDGSTSLFFQLF

SEQ ID NO: 8902 - protein, 340 aa, Chelidonium majus
MGVMKVERVRGSSLSSSASIGTSNSSNESTDGETGNGAGGNRDSSYQRYDIQQVARWIEQVLPFSLLLLVVFIRQHLQGFFVTILIAAVMFKSNDILRKQTALKGERKISFLVGITILFMLHVVGVYWWYRNDDLLYPLVMLPPKAIPPFWHAIFIIMVNDTMVRQAAMVLKCILLMYYKNSRGRNYRKQGQMLTLIEYLLLLYRALLPTPVWYRFFLNKEYGSLFSSLTTGLYLTFKLTSVVEKVQSFFAALKALSRKEVHYGSYATSEQVNAAGDLCAICQEKMHAPILLRCKHIFCEDCVSEWFERERTCPLCRALVKPADLRSFGDGSTSLFFQLF

SEQ ID NO: 8903 - protein, 230 aa, Avena sativa
MLVGITLIFMIHVFGIYWWYRNDDLLRPLFMLPPKDIPPFWHAIFIIMINDTMVRQAAMTVKCILLMYYKNSRGRNYRRQGQMLTLVEYLLLLYRALLPTPVWYRFFLNKEYGSLFSSLTTGLYLTFKLTSVVEKVQSFLSAVKALSRKDVHYGSYATSEQAIAAGDMCAICQEKMHVPVLLRCKHIFCEDCVSEWFERERTCPLCRALVKPADIRSFGDGSTSLFFQLF

SEQ ID NO: 8904 - protein, 486 aa, Elaeis guineensis
MESSGGSSDPYRSQSGGGSGGSSRRYGVHFSASNFIQAPLSALLEYSGILRPRPSHQENESLISGAAGSALRDHVSGRLDDSAVAGTGGDGEVSIRIIGVGDQETLRMGSGQPQALAVGPGREGNSGGNGVGSETIPTVSERQGGDGGTDGGVGEVTSSSSSSLPSSISAVGPQSTEGEANVTGGNNRDSSYQRYDMQQIAKWIEQILPFSLLLLVVFIRQHLQGFFVTIWIAAVMFKSNDILRKQTALKGERKISVLVGITLVFMIHVFGVYWWYRNDDILYPLVMLPPKEIPPFWHAIFIIMLNDTMVRQAAMVVKCVLLIYYKNSRGRNYRKQGQMLTLVEYLLLLYRALLPTPVWYRFFLNKEYGSLFSSLTTGLYLTFKLTSVVEKVQSFFVALKALSRKEVHYGSYATTEQVVAAGDLCAICQEKMHAPILLRCKHIFCEDCVSEWFERERTCPLCRALVKPADLRSFGDGSTSLFFQLF

SEQ ID NO: 8905 - protein, 467 aa, Papaver somniferum
METSNSSTDSYRNSSSSSSNNSRRFGMQFSAANFIQAPLSALLEYSGVLRTRSSHQESESLINGSPTSVFRERNQNRLDDSIGPVSGDGEVSIRIIGEQDREGGEDALSADHITGSSSAVVLERQGGNVGNDGGGVGEGLASSASIAGSNSSNETTDGEAGAGVGGNNRDSSYQRYDIQQVARWIEQVLPFSLLLLVVFIRQHLQGFFVTILIAAVMFKSNDILRKQTALKGERKVTFLAGISVVFLLHVVGVYWWFRNDDLLHPLVMLPPKAIPPFWHAIFIIMVNDTMVRQAAMILKLALLIYYKNSRGRNYRRQGQMLTLVEYLLLLYRALLPTPVWYRFFLNKEYGSLFSSLTTGLYLTFKLTSVVEKVQSFFAALKALSRKEVHYGSYATSEQVNAAGDLCAICQEKMHAPILLRCKHIFCEDCVSEWFERERTCPLCRALVKPADLRSFGDGSTSLFFQLF

SEQ ID NO: 8906 - protein, 466 aa, Papaver somniferum
METSSSSTDSYRNSSSSGNNSRRFGMQFSAANFIQAPLSALLEYSGVLRTRSSHQESESLINGSPTSVFRERSQNRLDDSIGPVSGDGEVSIRIIGEQDREGGDDALAADQITGSSSAAVLERQGGNVGNDGGGVGEGLPSSASLAGSNSSNETTDGEAGTGVGGNNRDSSYQRYDIQQVARWIEQVLPFSLLLLVVFIRQHLQGFFVTILIAAVMFKSNDILRKQTALKGERKVTFLAGISVVFILHVVGVYWWFRNDDLLHPLVMLPPKAIPPFWHAIFIIMVNDTMVRQAAMILKLALLIYYKNSRGRNYRRQGQMLTLVEYLLLLYRALLPTPVWYRFFLNKEYGSLFSSLTTGLYLTFKLTSVVEKVQSFFAALKALSRKEVHYGSYATSEQVNAAGDLCAICQEKMHAPILLRCKHIFCEDCVSEWFERERTCPLCRALVKPADLRSFGDGSTSLFFQLF

SEQ ID NO: 8907 - protein, 451 aa, Brachypodium distachyon
MDPPAGGSTDRRGAVSGASAGAASSGLRRYGLNFSASSLLQAPLAALLEYSGVVPSGPPSQTVHQAVPSSSSEADGLLSAAAAGNGEVSIRIQGGPNDSDAAGAASTGASPGDSIEATAATDVDPASAAGRGAGADAEAGGGGSGGATGNGAGDRAYQRYDVHHVARWIEQILPFSLLLLVVFIRQHLQGFFVTIWIAAVMFKSNDILKKQTALKSERKAAALVGITLIFMIHVFGVYWWYRNDYLLRPLFMLPPKDIPPFWHAIFIIMVNDTMVRQAAMAAKCILLMYYKNSRGRNYRRQGQMLTLVEYLLLLYRALLPTPVWYRFFLNKEYGSLFSSLTTGLYLTFKLTSVVEKVQSFLSAVKALSRKDVHYGSYATAEQAIAAGDMCAICQEKMHVPVLLRCKHIFCEDCVSEWFERERTCPLCRALVKPADIRSFGDGSTSLFFQLF

SEQ ID NO: 8908 - protein, 453 aa, Triticum aestivum
METPAGGSADRRVTGSGASAGAAASGLSRYGLNFSASSLLQAPLAALLEYSGVVPSGPVPQTVQQAVPSSSSSSEADGLLSAAAAGDGEVSIRIQGGPGDPDTASATATGASPQDSIEVAASSNFDPASVAGRGGGADAEASGGGSGGATGNGAGDRPYQRYDVHHVARWIEQILPFSLLLLVVFIRQHLQGFFVTIWIAAVMFKSNDILKKQTALKGERKIAMLVGITIIFMVHVFGVYWWYRNDYLLRPLFMVPPKDIPPFWHAIFIIMVNDTMVRQAAMTVKCMLLMYYKNSRGRNYRRQGQMLTLVEYLLLLYRALLPTPVWYRFFLNKEYGSLFSSLTTGLYLTFKLTSVVEKVQSFLSAVKALSRKDVHYGSYATAEQAIAAGDMCAICQEKMHVPVLLRCKHIFCEDCVSEWFERERTCPLCRALVKPADIRSFGDGSTSLFFQLF

SEQ ID NO: 8909 - protein, 474 aa, Fagus grandifolia
MEAPGNNPEAYRSPSSGSGSSGIGISRRYGLLSASNIIQAPLSALLEYSGILRPNARSNHQESEALIHGGRLSSSASGFHHSQLDQPTTATTNDGEVSIRIIGAAEQEHEREPTAGLVVGQQLGEGTATRTDVSAQPTEAQGGDSRVDRGVAEGISQSANGNADGEAVDGNGANGRDSSYQRYDIQQAARWIEQVLPFSLLLLVVFIRQHLQGFFVTIWIAAVMFKSNDILRKQTALKGERKISVLVGISLAFTIHVVGVYWWYQNDDLLYPLVMLPPKAIPPFWHAIFIIMVNDTLVRQAAMICKCFLLMYYKNSRGRNYRRQGQMLTLVEYLLLLYRALLPTPVWYRFFLNKEYGSLFSSLMTGLYLTFKLTSVVEKVQSFFSALKALSRKEVHYGAYATSEQVSAAGDMCAICQEKMHAPILLRCKHIFCEDCVSEWFERERTCPLCRALVKPADLRSFGDGSTSLFFQLF

SEQ ID NO: 8910 - protein, 218 aa, Cynodon dactylon
MCFVYWWYRNDDLIRPLFMLPPKDIPPFWHAIFIIMVNDTMVRQAAMAIKCMLLMYYKNCRGRNYRRQGQMLTLVEYLLLLYRALLPTPVWYRFFLNKEYGSLFSSLTTGLYLTFKLTSVVEKVQSFLAAVKALSRKDVHYGSYATAEQVVVAGDMCAICQEKMHVPVLLRCKHIFCEDCVSEWFERERTCPLCRALVKPADIRSFGDGSTSLFFQLF

SEQ ID NO: 8911 - protein, 417 aa, Vitis vinifera
METSGSNSRYGIHIAASNFIQAPLAALLEYSGIFSTRSSSSQETDGLIAPSPASLDSFHSRSDDRDRDHDPSTPASTPEEAPAVSDASRNESGSGVAAVNSGGSTADGEPANGGSVNNRDSSYQRYDIQQFARWIEQILPFSLLLLVVFIRQHLQGFFVTIWIAAVMFKSNDILRKQTALKGERKLSVLTGITAVFMLHVICVYWWYRNNDLLYPLVLLPPKAIPPFWHAIFIIMVNDTMVRQAAMALKCILLMYYKNSRGRDYRKQGQMLTLVEYLLLLYRALLPTPVWYRFFLNKEYGSLFSSLTTGLYLTFKLTSVVEKVQSFFAALRALSRKEVHYGSYATSEQVNAAGDLCAICQEKMHAPILLRCKHIFCEDCVSEWFERERTCPLCRALVKPADIRSYGDGSTSLFFQIF

SEQ ID NO: 8912 - protein, 479 aa, Quercus alba
MEASGSSPEGFRSNSSGSGSGGIGNSRRYGLFSASNIIQAPLSALLEYSGILRTNASRSNHQETDSLIHGGRLSSSGSGFHLAQLDQPAAAATANDGEVSIRIIGAAEQEQDREPAAGLVVGHQLGSEVAAAARTDVSPRATEAQGGDSRIERGGVAEGISQSANGNTEGEAVDGGGANGRDSSYQRYDIQQAARWIEQVLPFSLLLLVVFIRQHLQGFFVTIWIAAVMFKSNDILRKQTALKGERKMSILIGITLAFTIHVVGVYWWYQNDDLLYPLVMLPPKAIPPFWHAIFIIMVNDTLVRQAAMICKCFLLMYYKNSRGRNYRRQGQMLTLVEYLLLLYRALLPTPVWYRFFLNKEYGSLFSSLMTGLYLTFKLTSVVEKVQSFFSALKALSRKEVHYGAYATSEQVSAAGDMCAICQEKMHAPILLRCKHIFCEDCVSEWFERERTCPLCRALVKPADLRSFGDGSTSLFFQLF

SEQ ID NO: 8913 - protein, 489 aa, Elaeis guineensis
MESSGGNSDSYRSQSAGSGGGSGGSSRRYGVHFSTSNFIQAPLSALLEYSGILRPRLSHQENESLISGAAGSGLRDHVSGRLDDSAVAGAGGDGEVTIRIIGVGDQENLRVGSGQPQALDVRSGREGSSSGNGLAAETIPAISERQGGDGGNDGGVGEVASSSSSSLPSSISAVGPQSTEGEANATGGNNRDSSYQRYDIQQVAKWIEQILPFSLLLLVVFIRQHLQGFFVTIWIAAVMFKSNDILRKQTALKGERKISVLIGITLVFMIHVFAVYWWYRNDDLLYPLVMLPPKEIPPFWHAVFIIMVNDTMVRQAAMVVKCVLLMYYKNGRGRNYRKQGQMLTLVEYLLLLYRALLPTPVWYRFFLNKEYGSLFSSLTTGLYLTFKLTSVVEKVQSFFAALKALSRKEVHYGSYATTEQVIAAGDLCAICQEKMHAPILLRCKHIFCEDCVSEWFERERTCPLCRALVKPADLRSFGDGSTSLFFQLF

SEQ ID NO: 8914 - protein, 463 aa, Oryza sativa
MEPPAGGSSDHRRGAGTGAGAGGAASPSGLRRYGFRFSASSLLQAPLAALLEYSGVVPSGPGAPQAGPPSALSSSPSSSSSSSEADGLLSAAAAGDGEVSIRIQGGPGEADAAGVAGAASSGEDSIEATAAGDVDPASAAAGRGGGADAEASGGGADGASGNGGGDRAYQRYDVHHVARWIEQILPFSLLLLVVFIRQHLQGFFVTIWIAAVMFKSNDILRKQTALKGERKIAVLVGITVIFMIHVFGVYWWYRNDDLLRPLFMLPPKEIPPFWHAIFIIMVNDTMVRQAAMAIKCMLLMYYKNSRGRNYRKQGQMLTLVEYLLLLYRALLPTPVWYRFFLNKEYGSLFSSLTTGLYLTFKLTSVVEKVQSFLAAVKALSRKDVHYGSYATAEQVIAAGDMCAICQEKMHVPVLLRCKHIFCEDCVSEWFERERTCPLCRALVKPADIRSFGDGSTSLFFQLF

SEQ ID NO: 8915 - protein, 343 aa, Panicum virgatum
GTSSEDSIEATTGSEVDQASAAGRGADAADAETNGGGGASGNGGGDRAYQRYNVHHVARWIEQILPFSLLLLVVFIRQHLQGFFVTIWIAAVMFKSNDILRKQTALKGERKISVLIGITVIFTIHVFGVYWWYRNDDILRPLFMLPPKDIPPFWHAIFIILVNDTMVRQAAMAVKCMLLMYYKNCRGRNYRRQGQMLTLVEYLLLLYRALLPTPVWYRFFLNKEYGSLFSSLTTGLYLTFKLTSVVEKVQSFLAAVKALSRKDVHYGSYATAEQVLAAGDMCAICQEKMHVPVLLRCKHIFCEDCVSEWFERERTCPLCRALVKPADIRSFGDGSTSLFFQLF

SEQ ID NO: 8916 - protein, 157 aa, Tabernaemontana elegans
MEASGSNSDAYRDTGFTNTNTSSHSRRHGIQLSASNILRSPISALLEYSGILRSRSAPHSDSDALLNSGVSHAYGNHLQSRLEESLGAAAAAPNASAGGGGEVSIRIITAAEQDLERVATPLPSSAVTLVREVNPQNQVFCAAYSQDWFCCFIGGSN

SEQ ID NO: 8917 - protein, 231 aa, Vinca minor
MEASGVVNSDAYRGANNSMGSISRRHGMQFSASNILRAPLSALLEYTGIFRSGRLSSSHSDSESLLNYGHDHHHRQSRLDDSFGGGGAATAVAEPNNASSGAGEVSIRIISAAEQDAGLLPSPTFRREVNSQNQAFAQQPISRSASAVSLDAQTDRGGLAADGVAQSTNGSVDAEAQDGVGTNNRDSSYQRYDIQQAARWIEQVLPFSLLLLVVFIRQHLQGFLLLYGLRL

SEQ ID NO: 8918 - protein, 453 aa, Triticum aestivum
METPAGGSADRRVTGSGASAGAAASGLSRYGLNFSASSLLQAPLAALLEYSGVVPSGPVPQTVQQAVPSSSSSSEADGLLSAAAAGDGEVSIRIQGGPGDPDTASATATGASPQDSIEVAASSNFDPASVAGRGGGADAEASGGGSGGATGNGAGDRPYQRYDVHHVARWIEQILPFSLLLLVVFIRQHLQGFFVTIWIAAVMFKSNDILKKQTALKGERKVAMLVGITIIFMVHVFGVYWWYRNDYLLRPLFMVPPKDIPPFWHAIFIIMVNDTMVRQAAMTVKCMLLMYYKNSRGRNYRRQGQMLTLVEYLLLLYRALLPTPVWYRFFLNKEYGSLFSSLTTGLYLTFKLTSVVEKVQSFLSAVKALSRKDVHYGSYATAEQAIAAGDMCAICQEKMHVPVLLRCKHIFCEDCVSEWFERERTCPLCRALVKPADIRSFGDGSTSLFFQLF

SEQ ID NO: 8919 - protein, 453 aa, Triticum aestivum
METPAGGSADRRVTGSGASAGAAASGLSRYGLNFSASSLLQAPLAALLEYSGVVPSGPVPQTVQQAVPSSSSSSEADGLLSAAAAGDGEVSIRIQGGPGDPDTASATATGASPQDSIEVAASSNFDPASVAGRGGGADAEASGGGSGGATGNGAGDRPYQRYDVHHVARWIEQILPFSLLLLVVFIRQHLQGFFVTIWIAAVMFKSNDILKKQTALKGERKVAMLVGITIIFMVHVFGVYWWYMNDYLLRPLFMVPPKDIPPFWHAIFIIMVNDTMVRQAAMTVKCMLLMYYKNSRGRNYRRQGQMLTLVEYLLLLYRALLPTPVWYRFFLNKEYGSLFSSLTTGLYLTFKLTSVVEKVQSFLSAVKALSRKDVHYGSYATVEQAIAAGDMCAICQEKMHVPVLLRCKHIFCEDCVSEWFERERTCPLCRALVKPADIRSFGDGSTSLFFQLF

SEQ ID NO: 8920 - protein, 368 aa, Allium cepa
IEREALISENSEDDLARENERDGGDGEVNILGGGSGNVINNNGSSNILEGDANNNGSGNGGGNNNSGSGGDSTSQRYDIQQVARWIEQILPFSLLLLVVFIRQHLQGFFVTIWIAAVMFKSNDVLRKQTALKGERKIPMLIGIALVFTIHVFGVYWWYKDDDLLYPLVLLPPKEIPPFWHAIFIIMVNDTMVRQATMVLKCILLMYYKNSRGRNYRKQGQMLTLVEYFLLLYRALLPAPVWYRFFLNKEYGSLFSSLTTGLYLTFKLTSVVEKVQSFFAALKALSRKEMHYGSYATTEQVIAAGDLCTICQEKMHAPILLRCKHIFCEDCVSEWFERERTCPLCRALVKPADLRSFGDGSTSLFFQLF

SEQ ID NO: 8921 - protein, 447 aa, Musa acuminata
METSGASSDPYRSQAGGGGGSSRRFRIRFSPSNLIRAPLSTLLEYSGILRTRAGHSEGEIMVGESMRDHGPGRIGESSLPGVGGSGSGEVAIRIIGLLGTLPERHGRDGGSDIGVGEIGPSSSSLPASILGGGGQSADGEVNNAGGNGRDSAYQRYDIQQVARWIEQVLPFSLLLLVVFIRQHLQGFFVTIWIAAVMFKSNDILRKQTALKGERKISLLVGITLVFMIHVFGVYWWYRNEGLLYPLVMLPPKEVPPFWHAIFIIMVNDTLVRQAAMVVKCVLLMYYKNSRGRKYRKQGQMLTLIEYFLLLYRALLPTPVWYRFFLNKEYGSLFSSLTTGLYLTFKLTSVVEKVQSFVAALKALSRKEVLYGSYATMEQVIAAGDLCAICQEKMHAPILLSCKHIFCEDCVSEWFERERTCPLCRALVKPADLRSFGDGSTSLFFQLF

SEQ ID NO: 8922 - protein, 479 aa, Musa acuminata
MEASGRSSNPYRSQSASSGSGSSRWYRVQLLASNFIRSRLSDVLDHFGVLRPRASHAEAEGLVGGESRVHASGRIGGSAASTGSGGEVSIRIIGVGDQESLRVGSTQPHPLVVGSGREGGSNVSGVSGEPIATFSERRGGDGGSDTMVGESASSSSSASASVPPVGSRSMDGDSNITGGNNRDSTYQRYDIQQIARWIEQILPFSLLLLVVFIRQHLQGFFVTIWIAAVMFKSNDILRKQTALKGERKISVLIAITLVFMIHVFGVYWWYRNDDLLYPLVMLPPKEILPFWHAIFIIMVNDTMVRQAAMVVKCFLLMYYKNSRGHNYRKQGQMLTLVEYFLLLYRALLPTPVWYRFFLNKEYGSLFSSLTTGLYLTFKLTSVVEKVQSFFSALKALSRKVHYGSYATTEQVIAAGDLCAICQEKMHAPILLHCKHIFCEDCVSEWFERERTCPLCRALVKPADLRSFGDGSTSLFFQMF

SEQ ID NO: 8923 - protein, 366 aa, Secale cereale
MERSRFGSRVAPATLTRRARRLQGPRRRTRLRWLLPTLTRPPVGGRGGGADAEASGGGSGGATGNGAGDRPYQRYDVHHVARWIEQILPFSLLLLVVFIRQHLQGFFVTIWIAAVMFKSNDILKKQTALKGERKVAMLVGITIIFMVHVFGVYWWYRNDYLLRPLFMVPPKDIPPFWHAIFIIMVNDTMVRQAAMTVKCMLLMYYMNSRGRNYRRQGQMLTLVEYLLLLYRALLPTPVWYRFFLNKEYGSLFSSLTTGLYLTFKLTSVVEKVQSFLSAVKALSRKDVHYGSYATAEQAIAAGDMCAICQEKMHVPVLLRCKHIFCEDCVSEWFERERTCPLCRALVKPADIRSFGDGSTSLFFQLF

SEQ ID NO: 8924 - protein, 452 aa, Sorghum bicolor
MDPPAGGSDRRGPSQSAGFAPSGLRRYGLNFSASSLLQAPLAVLLEYSGVVQSGPALAAHHPSAGPSSPLSASEVDGLLSAAAAVDGEVSIRIQGGPGDTEATGGPAAGTSSEDLIETTAGSEVDQASAAGRGAGATDAETNGGGAGTSGNGGGDRAYQRYDVHHVARWIEQILPFSLLLLVVFIRQHLQGFFVTIWIAAVMFKSNDILRKQTALKGERKISVLIGITVIFMIHVFGVYWWYRNDDLLRPLFMLPPKDIPPFWHAIFVIMVNDTTVRQAAMAVKCMLLLYYKNCRGRNYRRQGQMLTLVEYLLLLYRALLPTPVWYRFFLNKEYGSLFSSLTTGLYLTFKLTSVVEKVQSFLAAVKALSRKDVHYGSYATAEQVLAAGDMCAICQEKMHVPVLLRCKHIFCEDCVSEWFERERTCPLCRALVKPADIRSFGDGSTSLFFQLF

SEQ ID NO: 8925 - protein, 234 aa, Amaranthus tuberculatus
RKMPVLVGICTLFTLHVAGVYWWYRNDDLLYPLIMLPPKEIPPFWHAVFIIMVNDTLVRQAAMVVKCLLLMYYKNSRGRNYRRQGQMLTLVEYLLLLYRALLPTPVWYRFFLNKEYGSFFSSLMTGLYLTFKLTSVVEKVQSFFTAVKALSRKEIHYGAYATSEQVTAAGDMCAICQEKMHAPILLRCKHIFCEDCVSEWFERERTCPLCRALVKPADLKSFGDGSTSLFFQLF

SEQ ID NO: 8926 - protein, 474 aa, Malus domestica
MEGSGGNLDSFRASPGSSSNRRYGVLSASNIIRAPISTLLEYSGILRGRTNHQEGESLINGRSAAAFRDHRHSQLDQSPTTTSNDGEVSIRIIGAGEQEHDREGPGIVAGQLREVTAPPNDVSVPPMAGAASVALGTEEVGQTDGRTDRSSGEGIPQSLNGSAAGEGGDGTGANGRDSSYQRYDIQQAARGIEQVLPFSLLLLVVFIRQHLQGFFVTIWIAVVMFKSNDILKKQTALKGERKIAVLIGISLAFVLHVVGVYWWYQNDDLLHPLIMLPPKVIPPFWHAVFIIMVNDTLVRQAAMVLKCFLLMYYKNSRGRNYRKQGQMLTLVEYLLLLYRALLPTPVWYRFFLNKEYGSLFSSLMTGLYLTFKLTSVVEKVQSFFAALKALSRKEVHYGAYATSEQVNAAGDLCAICQEKMHAPILLRCKHIFCEDCVSEWFERERTCPLCRALVKPADIRSFGDGSTSLFFQLF

SEQ ID NO: 8927 - protein, 208 aa, Persea americana
DDLLYPLIILPPKAIPPFWHAVFIIMVNDTMVRQAGMVVKSILLMYYKNSRGRNYRKQGQMLTLVEYLLLLYRALLPTPVWYRFFLNKEYGSLFSSLTTGLYLTFKLTSLVEKIQCFFTALKALSRKDVHYGSYATPEQVIAAGDLCAICQEKMHAPILLRCKHIFCEDCVSEWFERERTCPLCRALVKPADLRSFGDGSTSLFFQLF

SEQ ID NO: 8928 - protein, 452 aa, Hordeum vulgare
METPSGGSADRRGTVSGASAGAAASGLSRYGLNFSASSLLQAPLAALLEYSGIVPSGPGPHTLQQAVPSSSSPSEADGLLSAAAAGDGEVSIRIQGGPGDPDASATATGASPQDSIEVAAASNFDPASVAGRGGGADAEASGGGSGGATGNGVGDRAYQRYDVHHVARWIEQILPFSLLLLVVFIRQHLQGFFVTIWIAAVMFKSNDILKKQTALKGERKVAMLVGITIIFMVHVFGFYWWYRNDDLFRPLFMVPPKDIPPFWHVIFIIMVNDTMVRQAAMTVKCMLLMYYKNSRGRNYRRQGQMLTLVEYLLLLYRALLPTPVWYRFFLNKEYGSLFSSLTTGLYLTFKLTSVVEKVQSFLSAVKALSRKDVHYGSYATAEQAIAAGDMCAICQEKMYVPVLLRCKHIFCEDCVSEWFERERTCPLCRALVKPADIRSFGDGSTSLFFQLF

SEQ ID NO: 8929 - protein, 471 aa, Cucumis sativus
MEGSGSDPDSHRAASTSGSSRRFGMLAASNIIQAPLSALLEYSGLLRGRQSHQESEALISARLPSGFRDHLRSHIEESSGATNDGEVSIRIIGAGEPEHGRDGAGLVVGQARDVSGQNAVSLQSVSGLASVTLGSELSQGESANERGAREGIPESINAGADGDASEAAGGNSRDSSYQRYDIQQAARGIEQILPFSFLLLVVFIRQHLQGFFVTIWIAAFMYKSNDILRKQTALKGERKISVLVCISLAFTIHVIGVYWWYQNDDLLYPLIMCPPRAIPPFWHAIFIIMVNDTLVRQAVMVVKCVLLMYYKNSRGRNYRKQGQMLTLVEYLLLLYRALLPTPVWYRFFLNKEYGSLFSSLLTGLYLTFKLTSVVEKVQSFFAALKALSRKEVHYGAYATSEQVSAAGDLCAICQEKMHAPILLRCKHIFCEDCVSEWFERERTCPLCRALVKPADLRSFGDGSTSLFFQVF

SEQ ID NO: 8930 - protein, 470 aa, Eschscholzia californica
MDTSNSNPDLYRSSSGSGSSNSRRFGMQFSAANFIQAPLSALLEYSGVLRTRSSHQETESLINGSTLSSIRDRIQNRVDDPGPASSGGEVSIRIIGAADQERDGEVVENAGSVEQITGPLSEAVLDRQSNMSNEGRNSEGSLLSSSSSSIGAGNSSNESNGGEAGDGTAGNRDSSSQRYDIQQVARWIEQILPFSLLLLVVFIRQHLQGFFVAIFIAAVMFKSNDILRKQTALKGERKMSFLVAITIAFMLHVVGVYYWYRNDDLLYPLVMLPPKEIPPFWHAIFIIMVNDTMVRQAAMILKCALLMYYKNSRGRDYRKQGQMLTLVEYMLLLYRALLPTPVWYRFFLNKEYGSLFSSLTTGLYLTFKLTSVVEKVQSFFTALKALSRKEILYGSHATSDQVNAAGDLCAICQEKMHAPILLRCKHIFCEDCVSEWFERERTCPLCRALVKPADLRSFSDGSTSLFFQLF

SEQ ID NO: 8931 - protein, 450 aa, Pennisetum glaucum
MDPPAVGSPDRRGSGPAAGAAPSGLRRYGLNFSASSLLQAPLAALLEYSGVVPSGAAPQAPHHPSAAPSSPSSASEVDGLLSAAAAGDGEVSIRIQGGPGDSEAAGGAATGTSSEDSIEATAGSEVDQASAAGRGASSADAEANGASGNGGGDRAYQRYDVHHVARWIEQILPFSLLLLVVFIRQHLQGFFVTIWIAAVMFKSNDILKKQTALKGERKVPVLIGITVIFIIHVFGVYWWYRNDDLLRPMFMLPPKDIPPFWHAIFIIMVNDTMVRQAAMAVKCMLLMYYKNCRGRNYRRQGQMLTLVEYLLLLYRALLPTPVWYRFFLNKEYGSLFSSLTTGLYLTFKLTSVVEKVQSFLAAVKALSRKDVHYGSFATAEQVLAAGDMCAICQEKMHVPVLLRCKHIFCEDCVSEWFERERTCPLCRALVKPADIRSFGDGSTSLFFQLF

SEQ ID NO: 8932 - protein, 368 aa, Allium cepa
  misc_feature (230)..(230): Xaa can be any naturally occurring amino acid
IEREALISENSEDDLARENERDGGDGEVNILGGGSGNVINNNGSSNILEGDANNNGSGNGGGNNNSGSGGDSTSQRYDIQQVARWIEQILPFSLLLLVVFIRQHLQGFFVTIWIAAVMFKSNDVLRKQTALKGERKIPMLIGIALVFTIHVFGVYWWYKDDDLLYPLVLLPPKEIPPFWHAIFIIMVNDTMVRQATMVLKCILLMYYKNSRGRNYRKQGQMLTLVEYFLXLYRALLPAPVWYRFFLNKEYGSLFSSLTTGLYLTFKLTSVVEKVQSFFAALKALSRKEMHYGSYATTEQVIAAGDLCTICQEKMHAPILLRCKHIFCEDCVSEWFERERTCPLCRALVKPADLRSFGDGSTSLFFQLF

SEQ ID NO: 8933 - protein, 424 aa, Cajanus cajan
MEGNNADLFRPSSSPSASPRRYSAILSPSTIIQAPLSLLLEYSGILPPRSNHHTHPTPDAVNNDAGEVSIRIIGSAEQEQQQQQHHHNHHQHHPREDETTPLAGGNDAVLASTSPRGDAEGDTAWRDSSYQRYDIQHAARWIEQVLPFSLLLLVVFIRQHLQGFFVTIWIAAVLFKSNDILRKQTALKGERKIPVLIGISVGFALHVVGVYWWYQNDDLMYPLIMLPPKDIPPFWHAIFIIMVNDTLVRQAAMVFKCILLMYYKNSRGRNYRKQGQMLTLVEYLLLLYRALLPTPVWYRFFLNKEYGSLFSSLMTGLYLTFKLTSVVEKVQSFFAAVKALSRKEMHYGAYATSEQVNAAGDLCAICQEKMHAPILLRCKHIFCEDCVSEWFERERTCPLCRALVKPADLRSFGDGSTSLFFQLF

SEQ ID NO: 8934 - protein, 440 aa, Glycine max
MEGNNNNNNNNADVFRPSVGPSSSPNSRRYSGILSASNLIQAPLSALLEYSGILPSRSSNQHSQPSSDAANNDGEVSIRIIGPAEQEQREEQQLQQTPPPGLVVGLSHSQNDTVLASGSPRGDAEGAAGTEGAAAGGDGAGRDSSYQRYDIQHAARWIEQVLPFSLLLLVVFIRQHLQGFFVTIWIAAVLFKSNDILRKQTALKGERKMLVLVGISVGFALHVVGVYWWYQNDDLMYPLIMLPPKDIPPFWHAIFIIMVNDTLVRQAAMVFKCILLMYYKNSRGRNYRKQGQMLTLVEYLLLLYRALLPTPVWYRFFLNKEYGSLFSSLMTGLYLTFKLTSVVEKVQSFFAAVKALSRKEMHYGAYATSEQVNAAGDLCAICQEKMHAPILLRCKHIFCEDCVSEWFERERTCPLCRALVKPADLRSFGDGSTSLFFQLF

SEQ ID NO: 8935 - protein, 470 aa, Fragaria vesca
MEAPGGNLDSYRAPVSGNSSSRRYGMLSASNFIQAPLSALLEYSGLLRGRSGHQEAESLIGGRSAAAFREQHHAQTEQASNDGEVSIRIIDAGEQENDREGGGLVVGQLRESGLLQNDVSGQHIARVGSVSLVSEEGQVDGRTDIGSGEGISQSVNGVADGEAGDGAGANGRDSSYQRYDIQQAARWIEQVLPFSLLLLVVFIRQHLQGFFVTIWIAAVMFKSNDILKKQTALKGERKISVLAGISIAFSVHVIGVYWWYQNDDLLYPLVMLPPKVIPPFWHAIFIIMVNDTLVRQAAMVIKFILLMYYKNSRGRNYRKQGQMLTLVEYLLLLYRALLPTPVWYRFFLNKEYGSLFSSLMTGLYLTFKLTSVVEKVQSFFAALKVLSRKEVHYGAYATSEQVVAAGDLCAICQEKMHAPILLRCKHIFCEDCVSEWFERERTCPLCRALVKPADLRSFGDGSTSLFFQLF

SEQ ID NO: 8936 - protein, 471 aa, Citrullus lanatus
MEGSGSDPDSHRAASTSSSSRRFGMLSASNIIQAPLSALLEYSGLLRGRPSHQESEALISARLPSGFRDHLRSQIEESSGATNDGEVSIRIIGAGEPEHGRDGAGLVVGQAREVSGQNAVSLQSVSGLASVTLGSDLSQGNSATERGAREGIPQSINGNADGDASEAAGGNSRDSSYQRYDIQQAARGIEQILPFSFLLLVVFIRQHLQGFFVTIWIAAFMYKSNDILRKQTALKGERKISVLVGISLAFTIHVIGVYWWYQNDDLLYPLIMLPPRAIPPFWHAIFIIMVNDTLVRQAVMVIKCVLLMYYKNSRGRNYRKQGQMLTLVEYLLLLYRALLPTPVWYRFFLNKEYGSLFSSLLTGLYLTFKLTSVVEKVQSFFAALKALSRKEVHYGAYATSEQVSAAGDLCAICQEKMHAPILLRCKHIFCEDCVSEWFERERTCPLCRALVKPADLRSFGDGSTSLFFQVF

SEQ ID NO: 8937 - protein, 517 aa, Aquilegia formosa
METSTASVNSSSSDPYNRNSSSSSSSSSFGGLGLGLGINHNHNSNNDSTRRYLTAANFFRYPLSALLEYSGLLRTTNNNPTTSTRSDTITTTDSTQTFINAFHHRDNFPPTTTTTAASASGGGEGGGGGGGGPGEVSIRIIGSTEQDHVRIGASTLTSSSSSSPLINHHHNHHHVDNASPSDPSVQGLSLSSQPSISTPNPAADDEEATNGALGANNTRDSSYQRYDIQQVARWIEQILPFSLLLLVVFIRQHLQGFFVTIWVAAVMFKSNDILRKQTALKGERKMSVLVGFSIGFIFHVVIIYWWYRNDDLLYPLVMLPPKTIPPFWHAIFTIMVNDTMVRQAAMVLKCILLMYFKNSRGRNYRKQGQMLTLVEYMLLLYRALLPAPVWYRFFLNKEYGSLFSSLTTGLYLTFKLTSVVEKVQSFFAALKALSRKEVHYGSYATSEQVNSAGDLCAICQEKMHAPILLRCKHIFCEDCVSEWFERERTCPLCRALVKPADLKSFGDGSTSLFFQLF

SEQ ID NO: 8938 - protein, 431 aa, Phaseolus coccineus
MEPNNADAFRPSSSPLSSPNSRRISGILSPSNIIQAPLSALLEYSGILPSRSSNNYTQPAPDVVNNDGEVSIRIIGPAEQEQQPREEQHSPPPAAGLAVGLAHSQNDAALTSASPRSDAAEESPVPGGDGVGRDSSYQRYDIQHAARWIEQVLPFSLLLLVVFIRQHLQGFFVTIWIAAVLFKSNDILRKQTALKGERKIPVLIGISVAFGLHVVGVYWWYQNDDLMYPLIMLPPKEIPPFWHAIFIIMVNDTLVRQAAMVFKCILLMYYKNSRGRNYRKQGQMLTLVEYLLLLYRALLPTPVWYRFFLNKEYGSLFSSLMTGLYLTFKLTSVVEKVQSFFAAVKALSRKEMHYGAYATLEQVNAAGDLCAICQEKMHAPILLRCKHIFCEDCVSEWFERERTCPLCRALVKPADLRSFGDGSTSLFFQLF

SEQ ID NO: 8939 - protein, 110 aa, Amorphophallus konjac
METPGGGSDSYRNGPGNAGAGGNGGGSSRRYGMQLSASNFIQTPISALLEYSGILRPRSVHPEHESLVDGGGPAAGLRDHASGRAGEASVSNAAGGEVSIRIIGRVIKMA

SEQ ID NO: 8940 - protein, 240 aa, Aquilegia formosa
TALKGERKMSVLVGFSIGFIFHVVIIYWWYRNDDLLYPLVMLPPKTIPPFWHAIFTIMVNDTMVRQAAMVLKCILLMYFKNSRGRNYRKQGQMLTLVEYMLLLYRALLPAPVWYRFFLNKEYGSLFSSLTTGLYLTFKLTSVVEKVQSFFAALKALSRKEVHYGSYATSEQVNSAGDLCAICQEKMHAPILLRCKHIFCEDCVSEWFERERTCPLCRALVKPADLKSFGDGSTSLFFQLF

SEQ ID NO: 8941 - protein, 440 aa, Cicer arietinum
MEGSGDIFRASPVAGASSPSSLSSNSRRYGFPSAASIIQAPLSVLLEYSGILPARSNQHQPSTDAVPNDSEVSIRIIGSTEQDNHREEQTPLVVGNDGASAGAAGMTSSPSQGDVEGVLRTGSGSIDAEAGGGGDGVGANGRDSSYQRYDIQHAARWIEQVLPFSLLLLVVFIRQHLQGFFVTIWIAAVLFKSNDVLRKQTALKGERKMPVLIGISVAFALHVAGVYWWYQNDDLMNPLVMLPPKEIPPFWHAIFVIMVNDTLARQAAMIFKCILLMYYKNSRGRNYRKQGQLLTLVEYFLLLYRALLPTPVWYRFFLNKEYGSLFSSLMTGLYLTFKLTSVVEKVQSFFAAVKALSRKEVHYGAYATSEQVIAAGDLCAICQEKMHAPVLLRCKHIFCEDCVSEWFERERTCPLCRALVKPADLRSFGDGSTSLFFQLF

SEQ ID NO: 8942 - protein, 367 aa, Fagopyrum esculentum
LLSNLGKLSALLVLVLDPLSSSFRPLLNWMSKMNQEVIAYQLMWALNLVLMLPVLTMRLLIVLGPIALTGIPLTRDMIYSRLLVGLSRSSLFLLLLVVFIRQHLQGFFATIWIAVVMFKSNDILKKHTALKGERKIFVLVGYCIIFALHIIGVYWWYRKDDLLYPLIMLPPKAIPPFWHTVFIIIVNDTLARQTSMVVKCFLLMYYKNSRGRNYRRQGQMLTLVEYFVLLYRALLPTPVWYRFFLNKEYGSLFSSLMTGLYLTFKLTSVVEKVQAFFTAVKALSRKEVHYGAYATSEQVNAAGDLCAICQEKMHTPILLRCKHIFCEDCVSEWFERERTCPLCRALVKPADLKSFADGSTSLFFQLF

SEQ ID NO: 8943 - protein, 454 aa, Setaria italica
MDPPAGGSPDRRGSGPGAGAAPSGLRRYGLNFSASSLLQAPLAALLEYSGVVPSVPAPQAPHHPSAAPSSPSSASEVDGLLSAAAAGDGEVSIRIQGGPGDSEAAGGAAAGTSSEDSIEATAGSEVDQASAAGRGAGGADAEANGAGSGASGNGGGDRAYQRYDVHHVARWIEQILPFSLLLLVVFIRQHLQGFFVTIWIAAVMFKSNDILRKQTALKGERKISVLIGITVIFMIHVFGVYWWYRNDDLLRPLFMLPPKDIPPFWHAIFIIMVNDTMVRQAAMAVKCMLLMYYKNCRGRNYRRQGQMLTLVEYLLLLYRALLPTPVWYRFFLNKEYGSLFSSLTTGLYLTFKLTSVVEKVQSFLAAVKALSRKDVHYGSYATAEQVLVAGDMCAICQEKMHVPVLLCCKHIFCEDCVSEWFERERTCPLCRALVKPADIRSFGDGSTSLFFQLF

SEQ ID NO: 8944 - protein, 452 aa, Zea mays
MDPPPVSPDRWGPSQGAGVGPSGLRRYGLNFSASSLLQAPIAALLEYSGVVQSGPALAAHHPSAGPSSPLSASEVDGLLSAAAAGDGEVSIRIQGGPGDTEATGGPDAGTSSEDLIEATAGSEVDQASAAGRGAGATDAEANGGGAGTSGNGGGDRAYQRYDVHHVARWFEQILPFSLLLLVVFIRQHLQGFFVTIWIAAVMFKSNDILRKQTALKGERKISVLIGITVIFMIHVFGVYWWYRNDDLLRPLFMLPPKDIPPFWHAIFVIMVNDTMVRQAAMAVKCMLLLYYKNCRGRNYRRQGQMLTLVEYLLLLYRALLPTSVWYRFFLNKEYGSLFSSLTTGLYLTFKLTSVVEKVQSFLAAVKALSRKDVHYGSYATAEQVLAAGDMCAICQEKMHVPVLLRCKHIFCEDCVSEWFERERTCPLCRALVKPADIRSFGDGSTSLFFQLF

SEQ ID NO: 8945 - protein, 235 aa, Cucumis melo
ERKISVLVCISLAFTIHVIGVYWWYQNDDLLYPLIMCPPRAIPPFWHAIFIIMVNDTLVRQAVMVVKCVLLMYYKNSRGLNYRKQGQMLTLVEYLLLLYRALLPTPVWYRFFLNKEYGSLFSSLLTGLYLTFKLTSVVEKVQSFFAALKALSRKEVHYGAYATSEQVSAAGDLCAICQEKMHAPILLRCKHIFCEDCVSEWFERERTCPLCRALVKPADLRSFGDGSTSLFFQVF

SEQ ID NO: 8946 - protein, 412 aa, Arachis hypogaea
PGGVLRNNNNTTTTRSNFNNQEPNPNPNSEPSVNDGELSIRIISPSEHDNHDNHRHREEQPSSSGGGGLVVGLPHDEGGSVMPNSSTGDTGIGNGNGIGNGDARTGGEGGGNGRDSSYQRYDIQHAARWVEQVLPFSLLLLVVFIRQHLQGFFVTIWIAAVLFKSNDILRKQTALKGERKIPILIGISVAFSLHVISIYWWYQNDDLMYPLVMLPPREIPPFWHAIFIIMVNDTLVRQAAMVFKCILLIYYKNSRGRNYRRQGQMLTLVEYLLLLYRALLPTPVWYRFFLNKEYGSLFSSLMTGLYLTFKLTSVVEKVQAFFASVKALSRKEVHYGSYATSEQVIAAGDLCAICQEKMHAPILLRCKHIFCEDCVSEWFERERTCPLCRALVKPADLRSFGDGSTSLFFQLF

SEQ ID NO: 8947 - protein, 133 aa, Platanus occidentalis
MAAFFSSLTTGLYLTFKLTSVVEKVQSFFAALKALSRKEVHYGSYATSEQVNAAGDLCAICQEKMHAPILLRCKHIFCEDCVSEWFERERTCPLCRAWLNLQALDPLGMVPPACSSSYSEVSYILEMREYFLF

SEQ ID NO: 8948 - protein, 472 aa, Prunus persica
MEVPGGNLDSFRAASGNSSSRRYGMLSASNIIQAPLSALLEYSGLLRGRSNHQEAESLINGRSAAAFRDHHHSQLDQSPTTSNDGEVSIRIIGAGEQEHDREGAGLVVGQLREVTVPPNEVSAPPMAGVASVSLTTEEGQTDGRTDRSSGEGMPQSLNGSADGEGVDGAGSNGRDSSYQRYDIQQAARWIEQVLPFSLLLLVVFIRQHLQGFFVTIWIAAVMFKSNDILRKQTALKGERKVAVLIGISLAFALHVVGVYWWYQNDDLLYPLIMLPPKLIPPFWHAVFIIMVNDTLVRQAAMVLKCILLIYYKNSRGRNYRKQGQMLTLLEYLLLLYRALLPTPVWYRFFLNKEYGSLFSSLMTGLYLTFKLTSVVEKVQSFFAALKALSRKEVHYGAYATSEQVNAAGDLCAICQEKMHAPILLRCKHIFCEDCVSEWFERERTCPLCRALVKPADLRSFGDGSTSLFFQLF

SEQ ID NO: 8949 - protein, 475 aa, Solanum phureja
MEASGANSDAQRGISSTSNNIGSNSRRHGVQLSAANLFRSPLSTLLEYSGILRTRSSHTESDSLINSQFQPRVDDAGTSPASPGGSGEVSIRIIGAGEQEHDRVGNVVPSPAVGGTLREGDGENEVFGRTVSRSGSAASVGALESQSSDRGAGDGVTQQMNGNTETGTTDGAGVNNRESSYQRYDIQQAARWIEQIIPFSLLLLIVFIRQHLQGFFVTILIAAVMFKSNDIVKKQTALKGERKISILIGICILFSSYLFGFYWWYRNDDLLSPLLMLPPKAIPPFWHAIFMIMVNDTLVRQAAMVCKCFLLMYYKNSRGRNYRRQGQLLTLVEYLLLLYRALLPAPVWYRFFLNKEYGSLFSSLMTGLYLTFKLTSVVEKVQSFFTALKALSRKEIHYGVYATSEQVNAAGDLCAICQEKMHTPILLRCKHIFCEDCVSEWFERERTCPLCRSLVKPADLKSFGDGSTSLFFQLF

SEQ ID NO: 8950 - protein, 475 aa, Solanum lycopersicum
MEASGANSDAQRGISSTSNNIGSNSRRHGVQLSAANLFRSPLSTLLEYSGILRTRSSHTETDSLINSQFQPRLDDAGTSPASPGGSGEVSIRIIGAGEQEHDRVGNVVPSPAVGGTLREGDGENEVFGRTISRSASAASVGALESQSSDRGAGDGVTQQVNGNTETGTTDGAGVNNRESSYQRYDIQQAARWIEQIIPFSLLLLIVFIRQHLQGFFVTILIAAVMFKSNDIVKKQTALKGERKISILIGICILFSSYLFGFYWWYRNDDLLSPLLMLPPKAIPPFWHAIFMIMVNDTLVRQAAMVFKCFLLMYYKNSRGRNYRRQGQLLTLVEYLLLLYRALLPAPVWYRFFLNKEYGSLFSSLMTGLYLTFKLTSVVEKVQSFFTALKALSRKEIHYGVYATSEQVNAAGDLCAICQEKMHTPILLRCKHIFCEDCVSEWFERERTCPLCRSLVKPADLKSFGDGSTSLFFQLF

SEQ ID NO: 8951 - protein, 488 aa, Triphysaria pusilla
MEASGGNSDAYRSSSSSSSTSAHSRRYGNGMHISASNILRSPFSTLLEYTGILGTTRSSHSDSDGLLSGGGGAHSGYRYHHLQTHSGNSASPSPASNNADGGAAEVSIRIIGPSEHEHDRVSTVLHSAPTVGQLGIQNESFSRPISRSGSAASELSSLESQVDREAGDGGSRSASGADAAAEGVGNNRDSSSSYQRYDIQQAARWIEQVLPFSLLLLIVFIRQHLEGFCVTIWIAAFMFKSNDIVRKQTALKCERRIFVLIVIAVLSTLHVFGFYWWYRNDDVLYPLLMLPPRTVPPFWNAIFIIMVNDTLVRQAAMIFKCALLIYYKNSRGRNYRRQGQILTLVEYLLLLYRALLPAPVWYRFFLNKEYGSLFSSLMTGLYLTFKLTSVVEKVQSFITALKALSKKDIHYGAYATSEQVVAAGDLCAICQEKMHTPVLLRCKHIFCEDCVSEWFERERTCPLCRALVKPADLKSFADGSTSLFFQLF

SEQ ID NO: 8952 - protein, 370 aa, Beta vulgaris
EVSIRIIGAAEHDHDPTSTTPSQLHPCPTVHPLPLPTTATDAQPATAGDPHFSTSTTDAESGDASAAPNNNRDSTYQRYDIQQAARWIEQILPFSLLLLVVFIRQHLQGFFVTIWIAVFMFKSNDILRKQTALKGERKIPLLVGICTLFTLHVAGVYWWYRNDDLLYPLIMLPPKEIPPFWHAVFIIMVNDTLVRQAAMIVKCILLMYYKNSRGRNYRRQGQILTLVEYLLLLYRALLPTPVWYRFFLNKEYGSLFSSLMTGLYLTFKLTSVVEKVQSFFAAIKALSRKEIHYGAYATSEQVTAAGDMCAICQEKMHAPILLRCKHIFCEDCVSEWFERERTCPLCRALVKPADLKSFGDGSTSLFFQLF

SEQ ID NO: 8953 - protein, 426 aa, Medicago truncatula
MEGNGASSSSSRRYGFPSAASIIQAPLSALLEYSGILPARSNQQHQPIPDSAPNDGEVSIRIIGSNEQDNHRDEQGSPLVVNDGGGAAAMTNSSEHGDVEGVLRTGSGNVDAESGGGGGGGDVGANGRDSSYQRYDIQHAARWIEQVLPFSLLLLVVFIRQHLQGFFVTIWIAAVLFKSNDILRKQTALKGERKMPVLIGISVAFTLHVVSVYWWYQNDDLMYPLVMLPPKEIPPFWHAIFIIMVNDTLARQAAMVVKCILLMYYKNSRGRNYRKQGQMLTLVEYLLLLYRALLPAPVWYRFFLNKEYGSLFSSLMTGLYLTFKLTSVVEKVQSFFAAVKALSRKEVHYGAHATSEQVIAAGDLCAICQEKMHAPILLRCKHIFCEDCVSEWFERERTCPLCRALVKPADLRSFGDGSTSLFFQLF

SEQ ID NO: 8954 - protein, 467 aa, Eucalyptus grandis
MEASGGGNSDPYRGSAVTGSSGSSSSSNSRRYSLLSASNLIQAPISTLLEYSGLLRTRPNHLETEPLFHGGVSGGLHGRAEDSTVTSNDGEVSIRIIGAGEQEHHRERAGLVVGQQVREAGGTNEASTRSPAAIAAADGQGDARSGAGEGASQPGNGGSDSEGGETNGRESSYQRYDIQQAARWIEQILPFSLLLLVVFIRQHLQGFFVTIWIAAFLFKSNDILRKQTALKGERKISYLIGISLLFTLHIVGVYWWYRKDDLLYPLIMFPPKGIPPFWHAMFVIVVNDTLVRQAAMVIKCLLLIYFKNSRGRNYRKQGQLLTLVEYLLLLYRALLPTPVWYRFFLNKEYGSLFSSLMTGLYLTFKLTSVVEKVQSFFTALKALSRKDIHYGAYATAEQVNAAGDLCAICQEKMHAPILLRCKHIFCEDCVSEWFERERTCPLCRALVKSADLRSFGDGSTSLFFQIF

SEQ ID NO: 8955 - protein, 465 aa, Euphorbia peplus
MEASGTNSDAYRGSSGGSSSPNSSNSRRYGTLSASSIIQAPISALLEYSGLLRTARSTHHESDPLIGSGGIGIHNNNRLDDSTAVTSSNNGEVAIRIIGAGEHEHESDGSGLVVGQSEVSVQQPIAGTTSDVPGDSRSDPGTPQGTPQHPSSGEGEASDGSGAANGRDSSYQRYDIQQAARWIEQVLPFSLLLLVVFIRQHLQGFFATIWIAVVMFKSNDILRKQTALKGERKISVLIGISLAFTLHVVCVYWWYQNDDLLYPLVMLPPKSIPPFWHAIFIIMVNDTLVRQAAMVLKCLLLMYYKNSRGRNYRKQGQLLTLVEYLMLLYRALLPTPVWYRFFLNKEYGSLFSSLMTGLYLTFKLTSVVEKVQSFFSALKALSRKEVHYGAYATSEQVNAAGDLCAICQEKMHAPILLRCKHIFCEDCVSEWFERERTCPLCRALVKPADLRSFGDGSTTLFFQIF

SEQ ID NO: 8956 - protein, 464 aa, Euphorbia peplus
MEASGTNSDVYRGSSGGSSSPNSSNSRRYGTLSASSIIQAPISALLEYSGLLRRSTHHESDPLIVGSGGIGVHNNNNRLDDSAAVTASNSGEVAIRIIGAGEHDHERDGAGLVVGQSEVSVQQPVVGTTGDVPGDSRSEPGTPLGTPQHPSSADGEGSDGSGANGRDSSYQRYDIQQAARWIEQVLPFSLLLLVVFIRQHLQGFFVTIWIAVVMFKSNDILRKQTALKGERKISVLVGISLAFTLHVVCVYWWYQNDDLLYPLVMLPPKSIPPFWHAIFIIMVNDTLVRQAAMVLKCLLLMYYKNSRGRNYRKQGQLLTLVEYLMLLYRALLPTPVWYRFFLNKEYGSLFSSLMTGLYLTFKLTSVVEKVQSFFSALKALSRKEVHYGAYATSEQVNAAGDLCAICQEKMHAPILLRCKHIFCEDCVSEWFERERTCPLCRALVKPADLRSFGDGSTTLFFQIF

SEQ ID NO: 8957 - protein, 462 aa, Vitis vinifera
MEAPGGNYRGSSEIGNGNSRRYGMQLSASNIIQAPLSALLEYSGLLRGRSSHQETESLIYGSGFRDRVEESAPVSNGGEVSIRIIGAGEQENERVGAGLASLAVGPVRDNEASVQQIAGQGSGTVTLEGHGQGQGESRAGEGISQSGNGNGDGEAADGAGANGRDSSYQRYDIQQAARWIEQVLPFTLLLLVVFIRQHLQGFFVTIWISAVMFKSNEILRKQTALKGERKISVLVGISLVFTLHVAGVYWWYHNGDLLYPLIMLPPKAIPPFWHAIFIIMVNDTLVRQAAMVFKCILLMYYKNSRGRNYRKQGQLLTLVEYTLLLYRALLPAPVWYRFFLNKEYGSLFSSLMTGLYLTFKLTSVVEKVQSFFAALKALSRKEVHYGAYATSEQVNAAGDLCAICQEKMHAPILLRCKHIFCEDCVSEWFERERTCPLCRALVKPADLRSYGDGSTSLFFQLF

SEQ ID NO: 8958 - protein, 454 aa, Silene vulgaris
MEGGSANSEGNRDRNSASSRRYRVPLSASNFIRSPISALLEYSGLLRPRSNNFESEPLTAGSSLSPPQYTPQVQDSTPVNDGEVSIRIIGSSEGDSSNLGQNCGSGGSVGEGTGVAAVAQEEVRGERGTGVAVAVGDGVSSSNGDAEADTSGAGNRDSAYQRYDIQQAARWIEQVLPFSLLLLVVFIRQHLQGFFVTIWIAVFMFKSNDILRKQTALKDERKVPILVGISILFTLHIAGVYWWYRNDDLLYPLIMLPPKDIPPFWHAVFIIMVNDTLVRQAAMVIKCLLLMYYKNSRGRNYRRQGQMLTLVEYLLLLYRALLPTPVWYRFFLNKEYGSLFSSLMTGLYLTFKLTSVVEKVQSFFASIKALSRKEVHYGAHATSEQVTAAGDMCAICQEKMHAPILLRCKHIFCEDCVSEWFERERTCPLCRALVKPADLKSFGDGSTSLFFQLF

SEQ ID NO: 8959 - protein, 466 aa, Gossypium raimondii
MDASGTDSDAYGGASSNSRRHRILSASNIIQAPLSALLEYSGLLRTSRSIHQESDPLIPNPNLENSTSALANNGHVAIRIIGTGDNHESERDASGMVAGQLREVTPQNEVFLGLGTSDGQGGNSRSSELGVAAGEGEGVSHSSSNGSVSADAEAGDGGGGGSGVNNSRDSSYQRYDIQQAARWIEQVLPFSLLLLVVFIRQHLQGFFVTIWIAAVMFKSNDILRKQTALKGERKISVLTGICVAFTLHVIAVYWWYWNDDLLYPLVMLPPKYIPPFWHAIFIIMVNDTLVRQEAMVLKCFLLMYYKNSRGRNYRKQGQMLTLVEYMMLLYRALLPTPVWYRFFLNKDYGSLFSSLMTGLYLTFKLTSVVEKVQSFFAALKALSRKEVHYGAYATSEQVNAAGDLCAICQEKMHAPILLRCKHIFCEDCVSEWFERERTCPLCRALVKPADLRSYGDGSTSLFFQIF

SEQ ID NO: 8960 - protein, 458 aa, Abies balsamea
METSSTTSPDGLRNNGSRRYGMRFSAANVIQAPLSALLEYTGILRGRPHYHEIEGTVGGSVRERADDGGRAEVSIRIIGAGEQIGAVQLQTNGVETGSASVSSNGHLQVSSAGLESAQTARGADIGDDGTGSSATMAPLTISAGANGETDANSNTNANGRDTAYQRYDIQQLARWIEQILPFSLLLLVVFIRQHLQGFFVTFWIAAVMIKSNDVLRKQTALKGERKVSVLIGIILVFVVHVVGVYWWYRKDDLLYPLVMLPPKTIPPFWHALFIIVVNDTMVRQAAMVFKCGLLIYFKNSRGRNYRKQGQMLTLVEYILLLYRALLPTPVWYRFFLNKEYGSLFSSLTTGLYLTFKLTSIVEKVQSFFAALKALSRKEVQYGSYATTEEVVAAGDLCAICQEKMHAPILLRCKHIFCEECVSEWFERERTCPLCRALVKPADLRSFGDGSTSLFFQLF

SEQ ID NO: 8961 - protein, 111 aa, Amsonia hubrichtii
MTGLYLTFKLTSVVEKVQCFLTASKALSRKEIHYGVYATSEQVNAAGGLCAICQEKMHAPILLRCKHIFCEDCVSEWFERERTCPLCRALVKPADLRSFGDGSTSLFFQLF

SEQ ID NO: 8962 - protein, 472 aa, Manihot esculenta
MEASGSNSDGYRGSSGGSSTSSGNSRRYGMLSASSIIQAPISALLEYSGLLRTSRSTHQETDTLMNASGGVHDHRLDDSTAVAAGIAAAANNGEVAIRIIGAGEHEHDRESSGLAVGQLGSQREVSVQQPMAGMESDVQGDSRNDRGSGEGPPQQPSGASGDGEVADGSGTNGRDSSYQRYDIQQAARWIEQVLPFSLLLLVVFIRQHLQGFFVTIWIAVVMFKSNDILRKQTALKGERKIYVLIGISLAFTLHVVGVYWWYQNDDLLYPLIMLPPKTIPPFWHAIFIIMLNDTLVRQAAMVFKCILLMYYKNSRGRNYRKQGQMLTLVEYLMLLYRALLPTPVWYRFFLNKEYGSLFSSLMTGLYLTFKLTSVFEKVQSFFAALKALSRKEVHYGAYATSEQVNAAGDLCAICQEKMHAPILLRCKHIFCEDCVSEWFERERTCPLCRALVKPADLRSFGDGSTTLFFQIF

SEQ ID NO: 8963 - protein, 475 aa, Ricinus communis
MEASGDAYRGSSSSSSSSSSSSSSSNNNNNLRRYGMLSASSIIQAPISALLEYSGLLRTTSSTLSSRSTHHQETDPLVNDSTAASALVNSGEVSIRIIGAGEHESDHDRDGGLVIGQNEVVSVQQQPIAGLASDGESRNDHSNGGRGTGEGGGATQQASNVSGDGEAAADGSGGNGRDSSYQRYDIQQAARWIEQVLPFSLLLLVVFIRQHLQGFFVTIWIAVVMFKSNDILRKQTALKGERKISILIGISLAFTLHVVGVYWWYQNDDLLNPLIMLPPKSIPPFWQAIFIIMVNDTLVRQAAMVLKCILLMYYKNSRGRNYRKQGQMLTLVEYLMLLYRALLPTPVWYRFFLNKEYGSLFSSLMTGLYLTFKLTSVVEKVQSFFSALKALSRKEVHYGAYATTEQVNAAGDLCAICQEKMHAPILLRCKHIFCEDCVSEWFERERTCPLCRALVKPADLRSFGDGSTTLFFQIF

SEQ ID NO: 8964 - protein, 116 aa, Cedrus atlantica
QILPFSLLLLVVFIRQHLQGFFVTFWIAAVMIKSNDVLREQTALKGERKVSVLIGIILVFVFHVVGVYWWYRKDDLLYPLVMLPPKTIPPFWHALFIIVVNDTMVRQAAMVFKCGF

SEQ ID NO: 8965 - protein, 483 aa, Coffea canephora
METSNSNSDNAHASPSASNSTPSSPRDSNSAPSRRYGVQFPPPLRFFHSPVSSLLEYSGSIRLRPDHSEAEHLIIDHHDTSNSNGSISANGPVPVSSTTALRSGSNASIATSSNGEVSIRIIGPGDGDRVGLVADADGDEESLGLGSTSASVDGSSQDRSLGAGAGAAAVDAGGEGNSTNGSSRGESSYQRYDIQQFGRWIEQILPFSLLLLVVFIRQHLQGFFVTIWITAFMFKSNDILRKQTALKAERKMFVLVTYFVVFILHAFGIYWWYRNDDLYYPLFMVPPKSIPPFWHAIFIILVNDTMVRQIAMALKLVLLMYYKNGRGHNFRRQGQMLTLVEYTLLLYRALLPTPVWYRFFLNKEYGSLFSSLTTGLYLTFKLTSIVEKVQSFLAALKALSKKEIHYGSYATSEQVNAAGDLCAICQEKMHAPILLRCKHIFCEDCVSEWFERERTCPLCRALVRPADLRSFGDGSTSLFIQMF

SEQ ID NO: 8966 - protein, 466 aa, Gossypium hirsutum
MDASGTDSDAYGGASSNSRRHRILSASNIIQAPLSALLEYSGLLRTSRSIHQESDPLIPNPNLENSTSALANNGHVAIRIIGTGDNHESERDASGMVAGQLREVTSQNEVFLGLGTSDGQGGNSRSSELGVAAGEGEGVSHSSSNGSVSADAEAGDGGGGGSGVNNSRDSSYQRYDIQQAARWIEQVLPFSLLLLVVFIRQHLQGFFVTIWIAAVMFKSNDILRKQTALKGERKISVLTGICVAFTLHVIAVYWWYWNDDLLYPLVMLPPKYIPPFWHAIFIIMVNDTLVRQEAMVLKCFLLMYYKNSRGRNYRKQGQMLTLVEYMMLLYRALLPTPVWYRFFLNKDYGSLFSSLMTGLYLTFKLTSVVEKVQSFFAALKALSRKEVHYGAYATSEQVNAAGDLCAICQEKMHAPILLRCKHIFCEDCVSEWFERERTCPLCRALVKPADLRSYGDGSTSLFFQIF

SEQ ID NO: 8967 - protein, 466 aa, Gossypium hirsutum
MDASGTDSDAYGGASSNSRRHRILSASNIIQAPLSALLEYSGLLRTSRSIHQESDPLITNPNLENSTSALANNGHVAIRIIGTGDNHESERDASGMVAGQLREVTPQNEVFLGLGTSDGQGGNSRSSDLGVAAGEGEGVSHSSSNGSVSADAEAGDGGGGGSGVNNSRDSSYQRYDIQQAARWIEQVLPFSLLLLVVFIRQHLQGFFVTIWIAAVMFKSNGILRKQTALKGERKISVLTGICLAFTLHVIAVYWWYWNDDLLYPLVMLPPKYIPPFWHAIFIIMVNDTLVRQEAMVLKCFLLMYYKNSRGRNYRKQGQMLTLVEYMMLLYRALLPTPVWYRFFLNKDYGSLFSSLMTGLYLTFKLTSVVEKVQSFFAALKALSRKEVHYGAYATSEQVNAAGDLCAICQEKMHAPILLRCKHIFCEDCVSEWFERERTCPLCRALVKPADLRSYGDGSTSLFFQIF

SEQ ID NO: 8968 - protein, 435 aa, Lotus japonicus
GSPTSSSSSSSLNLSSNSRRFGLLSASNIIQAPLSLLLEYSGILPPRSNQHQPNSDVAAAPSDGEVSIRIIGSAEHDHQRREEQTLSDGDLAVGNDAVDPSQGGDADGGVGVSRTGNGGGNAEAGGGRGEGAGPNGRDSSYQRYDIQHAARWIEQVLPFSLLLLVVFIRQHLQGFFVTIWIAVVLFKSNDILRKQTALKGERKVPVLIGFSVAFALHVVGVYWWYQNDDLMYPLVMLPPKEIPPFWHAIFIIMVNDTLVRQAAMVFKCILLIYYKNSRGRNYRKQGQMLTLVEYLLLLYRALLPAPVWYRFFLNKEYGSLFSSLMTGLYLTFKLTSVVEKVQSFFAAVKALSRKEVHYGAHATSEQVNAAGDLCAICQEKMHAPILLRCKHIFCEDCVSEWFERERTCPLCRALVKPADLRSFGDGSTSLFFQLF

SEQ ID NO: 8969 - protein, 251 aa, Pinus pinaster
MIKSNDVLRKQTALKGERKVSVLIGIILVFVLHVVGVYWWYRRDDLLYPLVMLPPKTIPPFWHALFIIVVNDTMVRQAAIGFKCGLLIYYKNSRGRNYRKQGQMLTLVEYILLLYRALLPTPVWYRFFLNKEYGSLFSSLTTGLYLTFKLTSIVEKVQSFFAALKALSRKEVQYGSYATTEEVLAAGDLCAICQEKMHAPILLRCKHIFCEECVSEWFERERTCPLCRALVKPADLRSFGDGSTSLFFQLF

SEQ ID NO: 8970 - protein, 458 aa, Pinus taeda
METSSTSTEGFRNNGSRRYGMRFSAANIIQAPLSALLEYTGILRGRPHYHEIEGAGGGSIRERADDGSGAEVSIRIIGAGEQIGAVQLQTNGVETGSANVNSNGHLQVSSAGLESAQIAGDIDVGAEGTGSSTTITPLTINAGGNGETDTGNSNNNPNGRDTAYQRYDIQQLARWIEQILPFSLLLLVVFVRQHLQGFFVTFWIAAVMIKSNDVLRKQTALKGERKVSVLIGIILVFVLHVVGVYWWYRRDDLLYPLVMLPPKTIPPFWHALFIIVVNDTMVRQAAMVFKCGLLIYYKNSRGRNYRKQGQMLTLVEYILLLYRALLPTPVWYRFFLNKEYGSLFSSLTTGLYLTFKLTSIVEKVQSFFAALKALSRKEVQYGSYATTEEVLAAGDLCAICQEKMHAPILLRCKHIFCEECVSEWFERERTCPLCRALVKPADLRSFGDGSTSLFFQLF

SEQ ID NO: 8971 - protein, 458 aa, Pseudotsuga menziesii
METSSTSTEGFRNNGSRRYGMRFSAANVIQAPLSALLEYTGILRGRPHYHEIEGTGGGSVRERADDGGGAEVSIRIIGAGEQIGAVQLQTNGVETGSANVSSNGHLQASSVGLESAQTAGGADISADGTGSSATMTPLTISAGVNGETDAGNSNNTANGRDTAYQRYDIQQLARWIEQILPFSLLLLVVFIRQHLQGFFVTFWIAAVMIKSNDVLRKQTALKGERKVSVLIGIILVFVVHVVGVYWWYRKDDLLYPLVMLPPKTIPPFWHALFIIVVNDTMVRQAAMVFKCGLLIYYKNSRGRNYRKQGQMLTLVEYILLLYRALLPTPVWYRFFLNKEYGSLFSSLTTGLYLTFKLTSIVEKVQSFFAALKALSRKEVQYGSYATTEEVLAAGDLCAICQEKMHAPILLRCKHIFCEECVSEWFERERTCPLCRALVKPADLRSFGDGSTSLFFQLF

SEQ ID NO: 8972 - protein, 458 aa, Picea glauca
METSSTSTEGFRNNGSRRYGMRFSAANIIQAPLSALLEYTGILRGRPHYHEIEGTGGGSVRERADDGGGAEVSIRIIGAGEQIGAVQLQTNGVETGSANVNSNGHLQASSAGLESAQIAGDVDIGADGTGSSATMNPLTISAGGNGETDAGNSNNNANGRDTAYQRYDIQQLARWIEQILPFSLLLLVVFVRQHLQGFFVTFWIAAVMIKSNDVLRKQTALKGERKVSVLIGIILVFVVHVVGVYWWYRKDDLLYPLVMLPPKTIPPFWHALFIIVVNDTMVRQAAMVFKCGLLIYYKNSRGRNYRKQGQMLTLVEYILLLYRALLPTPVWYRFFLNKEYGSLFSSLTTGLYLTFKLTSIVEKVQSFFAALKALSRKEVQYGSYATTEEVLAAGDLCAICQEKMHAPILLRCKHIFCEECVSEWFERERTCPLCRALVKPADLRSFGDGSTSLFFQLF

SEQ ID NO: 8973 - protein, 167 aa, Zostera marina
AVITEHNTVIADRADVDGENVAREGISPSSSYTSSDASVGAEGDAGNTTGANSRDGAYQRYDIQQVARWIEQILPFSLLLLVVFIRQHLQGFFVTIWIAAVMFKSNDILRKQTALKGERKICVLVAFAFAFTLHVAGVYWWYRNDDLVYPLFMLPPKVIPHFGMPYL

SEQ ID NO: 8974 - protein, 426 aa, Arabidopsis thaliana
METPGASHDSFRGSPRRNSILSASNIIQAPISTLLEYSGLFRARPSPSHEAETLVSDDSSGLSNGEVAIRIIGNTEQDAETDTNALREPGHSELLGSSATQVDPMGGASEGASQAAPGDPAAGDAASRDSPYQRYDIQQAARWIEQILPFSLLLLVVFIRQHLQGFFVAIWIAAVMFKSNDILKKQTALKGERHISALIGISVAFTAHVVGVYWWFRKDDLLYPLIMLPPKSIPPFWHAIFIIVVNDTLVRQASMIFKCFLLMYYKNSRGRNYRKQGQLLTLVEYFMLLYRSLLPTPVWYRFFLNKDYGSLFSSLMTGLYLTFKLTSVVEKVQSFFTALKALSRKEVHYGSYATTEQVNAAGDLCAICQEKMHTPILLRCKHMFCEDCVSEWFERERTCPLCRALVKPADLKSFGDGSTSLFFQIF

SEQ ID NO: 8975 - protein, 462 aa, Theobroma cacao
MEASSTNLDAYRGGSTNSRRYGMLSASNIIQAPISALLEYSGLLRTSRSIHQEPDPLIPNQNLENSTPTLANNGEVAIRIIGAGDHESERDASGMVVGQLREVTSQSEVSLGLGTSDGQGGDTRSSDRGVATGEGVSQSSPNGSAGAADAEAGDGGGAGVNNSRDSSYQRYDIQQAARWIEQVLPFSLLLLVVFIRQHLQGFFVTIWIAAVMFKSNDILRKQTALKGERKISVLIGIALAFTLHVIAVYWWYWNDDLLYPLVMLPPKSIPPFWHAIFIIMVNDTLVRQEAMVLKCFLLMYYKNSRGRNYRKQGQMLTLVEYMMLLYRALLPTPVWYRFFLNKDYGSLFSSLMTGLYLTFKLTSVVEKVQSFFAALKALSRKEVHYGAYATLEQVNAAGDLCAICQEKMHAPILLRCKHIFCEDCVSEWFERERTCPLCRALVKPADLRSYGDGSTSLFFQIF

SEQ ID NO: 8976 - protein, 471 aa, Manihot esculenta
MEASGSNSDVYRGSSGVSNPTNSNSRRNGILSASSIIQAPITALLEYSGLLRTTSSTHQETDPLINNSAGIHAHRLDDSTATPAAAATANNGEVAIRIIGAGEHEHDREGSGLVVGQLGAQSEVSVQQPLAGMESDVQGDSRNDRVSGEGASQQSSSASGDGEVADGSGANGRDSSYQRYDIQQAARWIEQVLPFSLLLLVVFIRQHLQGFFVTIWIAVVMFKSNDIVRKQTALKGERKMSVLIGISLAFTLHVVGVYWWYQNDDLLYPLIMLPPKSIPPFWHAIFIIMVNDTLVRQAAMVFKCILLMYYKNTRGRNYRKQGQMLTLVEYLMLLYRALLPTPVWYRFFLNKEYGSLFSSLMTGLYLTFKLTSVVEKVQSFFAALKALSRKEVHYGAYATSEQVNAAGDLCAICQEKMHAPILLRCKHIFCEDCVSEWFERERTCPLCRALVKPADLRSYGDGSTTLFFQIF

SEQ ID NO: 8977 - protein, 340 aa, Catharanthus roseus
MRLGLNSVEEGAQERNLGTTSASVDSVGEGSVGGGSSSNGRGESSYQRYDIQQFARWIEQILPFFLLLLVVFIRQHLQGFFVTIWISAFMFKSNDILRKQTALKGERKIFVLAGYFVVFMLHVLGIYWWYRNDDLYYPLFMVPPKSIPPFWHAVFIILVNDTMVRQAAMSLKLLLLMYYKNGRGHNFRRQGQMLTLVEYTLLLYRALLPTPVWYRFFLNKEYGSLFSSLTTGLYLTFKLTSIVEKVQSFLAALKALSRTEIHYGSYATAEQVNAAGDLCAICQEKMHAPILLRCKHIFCEDCVSEWFERERTCPLCRALVRPADLRSFGDGSTSLFIQVF

SEQ ID NO: 8978 - protein, 326 aa, Cephalotaxus harringtonia
TPLTINSGPNSAETDASENNNNTNGNGRDTAYQRYDIQQLARWIEQILPFSLLLLVVFIRQHLQGFFVTFWIAAVMIKSNDILRKQTALKGERKISVLIGIILVFVVHVVGIYWWYRNVDLLYPLVMLPPKIIPPFWHAMFIIVVNDTMVRQAAMVVKCGLLIYYKNSRGRNYRKQGQMLTLVEYILLLYRALLPTPVWYRFFLNKDYGSLFSSLTTGLYLTFKLTSIVEKVQSFFAALKALSRKEVQYGSYATTEEVLAAGDLCAICQEKMHAPILLRCKHIFCEECVSEWFERERTCPLCRALVKPADLRSFGDGSTSLFFQLF

SEQ ID NO: 8979 - protein, 462 aa, Unknown
  Sequence found in Organisms: Citrus sinensis, Citrus clementina
MEASVTNPDAYRGPSGTSSNSRRYGMLSASNIIQAPLSTLLEYSGLLRTRSSHQESEPLINSTVSAHLSNHNRLDDPTVNNGEVAIRIIGAGEHEHERDGSGGLVIGQVREGTGQSDVASVALAGDNQGDGRTDRGVGAGEGVLQSSNGNGDAEAGDGAAVNGRDSSYQRYDIQQAARWIEQVLPFSLLLLVVFIRQHLQGFFVTIWIAAVMFKSNDVLRKQTALKGERKVSVLIGISIAFMLHVAGVYWWYRNDDLLYPLVMLPPKSIPPFWHAIFIIMVNDTLVRQASMVLKCFLLMYYKNSRGRNYRKQGQLLTLVEYLMLLYRALLPTPVWYRFFLNKEYGSLFSSLMTGLYLTFKLTSVVEKVQSFFSALKALSRKEVHYGAYATTEQVNAAGDLCAICQEKMHAPILLRCKHIFCEDCVSEWFERERTCPLCRALVKAADLRSFGDGSTSLFFQIF

SEQ ID NO: 8980 - protein, 190 aa, Actinidia deliciosa
WHAIFIILVNDTLVRQAAMALKCMLLMYYKNGRGNNFRRQGQILTLIEYTLLLYRALLPTPVWYRFFLNKEYGGLFSSLTTGLYLTFKLTSVVEKVQSFFASLKALSQKDIHYGSYATLEQVNAAGDLCAICQEKMHAPILLRCKHIFCEDCVSEWFERERTCPLCRALVKAADLRSFGDGSTSLFFQLF

SEQ ID NO: 8981 - protein, 432 aa, Carica papaya
ISTLLEYSGLLRTRSGTHQETESLISGGIHNHLHNQGRLDDSAPTASNGEVSIRIIGAGEQETERESPGLVVGQVRDPSGQSEVSVQPMAGLVSDVQGDSVGDRSLGMGEGVSQPSSNSAADAEAGDGAGPNTRDSSYQRYDIQQAARWIEQVLPFSLLLLVVFIRQHLQGFFVTIWIAAVMFKSNDILRKQTALKGERKISILIGISLAFTIHVIGIYWWYRNDDLLYPLVMLPPKSIPPFWHAVFIIMVNDTLVRQTAMVLKCFLLMYYKNSRGRNYRKQGQMLTLVEYLMLLYRALLPTPVWYRFFLNKEYGSLFSSLMTGLYLTFKVTSIVEKVQSFFAALKALSRKEVHYGAYATSEQVNAAGDLCAICQEKMHAPILLRCKHIFCEDCVSEWFERERTCPLCRALVKPADLRSFGDGSTSLFLQMF

SEQ ID NO: 8982 - protein, 378 aa, Taxus baccata
HVRVGAVASNVEETETGNGGNNNHIQGSSTPLQSTGNVDISGGGSVGSSSSITPLTINSGPNSAETDASDNSNNTNGNGRDTAYQRYDIQQLARWIEQILPFSLLLLVVFIRQHLQGFFVTFWIAAVMIKSNDVLRKQTALKGERKISVLIGIILVFVVHVVGIYWWYRNVDLLYPLVMLPPKNIPPFWHAMFIIVVNDTMVRQAAMVAKCGLLIYYKNSRGRNYRKQGQMLTLVEYILLLYRALLPTPVWYRFFLNKDYGSLFSSLTTGLYLTFKLTSIVEKVQSFFAALKALSRKEVQYGSYATTEEVLAAGDLCAICQEKMHAPILLRCKHIFCEECVSEWFERERTCPLCRALVKPADLRSFGDGSTSLFFQLF

SEQ ID NO: 8983 - protein, 307 aa, Trigonella foenum-graecum
MEGNGDMFRSSPVSGASSSSRRYGFPSAASIIQAPLSALLEYSGILPARSNQQHQPIPDSVPNDGEVSIRIIGSNEQDNHREEEGSSVVANDGGGVAAMTSNGDVEGASRTGSGNVDAEAGGGGGDVAANGRDSSYQRYDIQHAARWIEQVLPFSLLLLVVFIRQHLQGFFVTIWIAAVLFKSNDILRKQTALKGERKMPVLIGISVAFALHVIGVYWWYQNDDLMYPLVMLPPKEIPPFWHAIFIIMVNDTLARQAAMVVKCILLMYYKNSRGRNYRKQGQMLTLVEYLLLLYRALLPAPVWYRFS

SEQ ID NO: 8984 - protein, 482 aa, Musa acuminata
MDTPSGGSDPYRTPSSGSAGGGSSRRYVIPYSASNLIQAPLSALLEYSGILRPEASQSESERLIGGGLPLPEVGPARVDESSTSPTGGGGEVSIRIVGAGDQESLRVASSQLHRSTLGPGGEVNSGVVVPGELIAASSERQGGDGVSDNGVGEGASPSSSVPTSDSAFGGHSADGDVNMTGNNRDSSYQRYDIQRIAKWIEQILPFSLLLLVVFIRQHLQGFLVTIWISAVMFKSNAVLRKQTALKGERKISVIVGIILVCMVHVFGIYWWYRNDDLLYPLIMLPPKEIPRFWHAVFIILVNDVVMRQAAMVVKCILLIYYKNFKGRSYRKQGQMLTLVEYFLLLYRSLLPTAVWYRFFLNKEYGSLFSSLTTGLYLTFKLTSVVEQVQSFFAALKALSRKEVHYGSYATSEQVIAAGDLCAICQEKMNVPILLRCKHIFCEDCVSEWFERERTCPLCRVLVKPAGLRSFSDGSTTLFFQLF

SEQ ID NO: 8985 - protein, 412 aa, Amsonia hubrichtii
EAESLIVENNNNNSDGGNSTSNVAMSTSRSSSSHNSSSNNNGSSNGEVSIRIIGAGEGDRLGSDDEDDEEEAMGLGLGTVDEGGRERSMGTTSVSLDSSAEGSVGGGSNSNGRGDSSYQRYDIQQFARWIEQILPFSLLLLIVFIRQHLQGFFVTIWISAFMFKSNDILRKQTALKGERKIFVLVGYFVVFMLHVLGIYWWYQNDDLYYPLFMVPPKSIPPFWHAIFIILVNDTMVRQVAMSLKLLLLMYYKNGRGHNFRRQGQLLTLIEYTLLLYRALLPTPVWYRFFLNKEYGSLFSSLTTGLYLTFKLTSVVEKIQSFLAALKALSRREIHYGSYATSEQVNAAGDLCAICQEKMHAPILLRCKHIFCEDCVSEWFERERTCPLCRALVRPADLRSFGDGSTSLFIQVF

SEQ ID NO: 8986 - protein, 429 aa, Arabidopsis lyrata
METPGANHDSFRGSPRRNSILSASNIIQAPISTLLEYSGLFRTRPNPSQEAETLVTDDSSGISNGEVAIRIIGNGEQDAETDSNGLREPGGLGHTELLGSATQVDPIGGAPSEGASQAAPGESVAGDAATRDSPYQRYDIQQAARWIEQILPFSLLLLVVFIRQHLQGFFVAIWIAAVMFKSNDILKKQTALKGERHISALIGISVAFTAHVVGVYWWFRKDDLLYPLIMLPPKSIPPFWHAIFIIVVNDTLVRQASMIFKCFLLMYYKNSRGRNYRKQGQLLTLVEYLMLLYRSLLPTPVWYRFFLNKDYGSLFSSLMTGLYLTFKLTSVVEKVQSFFTALKALSRKEVHYGSYATTEQVNAAGDLCAICQEKMHTPILLRCKHMFCEDCVSEWFERERTCPLCRALVKPADLKSFGDGSTSLFFQIF

SEQ ID NO: 8987 - protein, 90 aa, Tropaeolum majus
MTGLYLTFKLTSVVEKVQSFFTALRALSRKEVHYGAYATSEQVNAAGDLCAICQEKMHAPILLRCKHIFCEDCVSEWFEREGHVHCAGLW

SEQ ID NO: 8988 - protein, 498 aa, Tropaeolum majus
MEASGTNPDAYRGSSSSSNSRRYGLLSASNIIQAPISTLLEYSGFLRPRSDSHHERESLIGAGIRDHFHNQSRVEDSATAATNGEVAIRIIGAGENEGEREGGGLVVGQVREVSGQSEVSVQPITGFTNDGQGDSRSDRGVATAGEPASHPSSSSGVDTEAGDAGGANSRDSSYQRYDIQQAARWIEQILPFSLLLLVVFIRQHLQGFFVTIWIGAVMFKSNDILRKQTALKGERKISILIAISLAFTLHVVGIYWWYRNDDLLYPLVMLPPKSIPPFWHAIFIIMVNDTLVRQTSMVLKCLLLMYFKNSRGRNYRKQGQLLTLVEYLMLLYRALLPTPVWYRFFLNKEYGSLFSSLMTGLYLTFKLTSVVEKVQSFFTALRALSRKEVHYGAYATSEQVIAAGDLCAICQEKTHAPVLLRCKHIFCEDCVSEWFERERTCPLCRALVKPADLKSFGDGSTSLFSKCFKMDIVNTQILNYIPSNFLMNDCQLMKWSGI

SEQ ID NO: 8989 - protein, 466 aa, Phalaenopsis aphrodite
METSGGNSDAYWTSRAAGTGGGTRSYSTQFSASSIIQAPLTALLEYSGFLRPRSSNHAESAGLLAGEANGGRAVHGSAQPEGSLSSSSGGEGEVLIRIIPSGDHENQTHPSTGENGVSEDAIPRVSGDVGVGDDGGREYRVREVGGSPASANTQSLDDDVNLADANNRESSYQRYDIQQLARWVEQILPFSLLLLVVFIRQHLQGFFVTIWIAAVMFKSNDILRKQTALKGERRMSVLVGITVVFMFHVFGVYWWYRNDDLMNPLVLLPPKEIPPFWHAIFFILVNDTMVRQAAMVIKCILLIYFKNSRGRSYRKQGQMLTLVEYFLLLYRALLPTPVWYRFFLNKEYGSFFSSLITGLYLTFKLTSVVEKVRSFFAALKDLSCKEVHYGSNATAEQVIAAGDLCAICQEKMHVPILLRCKHIFCEDCVSEWFDRERTCPLCRALVKPTGLRSFGDGSTSLFFQLF

SEQ ID NO: 8990 - protein, 476 aa, Populus trichocarpa
MEGSGSISDPHRGGGGNSNSSSSLTSSSRWYGMLSASSIIQAPISSLLEYSGLLRTTRSNHQENESLIPGGLGGGGHGSSRLDDSSASVVPNNGEVSIRIIGAGEHERDGSGGLVVGQVGGAQNEVLGQQQMMGADALQGDLRSDRGGGDAADGAGGQQSSSVSGDGEAADEAGGNGRDSTYQRYDIQQVARWIEQVLPFSLLLLVVFIRQHLQGFFVTIGIAVVMFKSNDILRKQTALKGERKISVLVGISLAFMVHVVAVYWWYQNDDLLYPLIMLPPKSIPPFWHAIFIIMVNDTLVRQAAMAFKCVLLIYYKNSRGRNYRRQGQMLTLVEYLILLYRALLPAPVWYRFFLNKEYGSLFSSLMTGLYLTFKLTSFVEKVQSFFSALKALSRKEVHYGAHATSEQVNAAGDLCAICQEKMHAPILLRCKHIFCEDCVSEWFERERTCPLCRALVKPADLRSFGDGSTSLLFQIF

SEQ ID NO: 8991 - protein, 125 aa, Sarracenia psittacina
RFYDSSDWCLLVAPEDDLLYPLFLVPPKAVPPFWHAVFSILVNDTTVRQAAMALKCMLLMYYKNGRGLTSVARGNTDSDRVYFIVVPCIVSDSCLVSIFLEQRVWKPLFITDYRIVLNFQAHFCG

SEQ ID NO: 8992 - protein, 327 aa, Fragaria vesca
MDERVPLVPPSAPENEAGEGGNAVEENSRDSAYQRYDIQQVARWIEQVLPFSLLLLVVFIRQHLQGFFVTIWISAVMYRSNDIVRKQTALKGDRKISFLVAIAGAFMLHVVGVYWWYRNDDLLYPLAMLPPKAIPPFWHAIFIILVNDTLVRQATMAFKCLLLVYYKNGRGHNYRRQGQMLTVVEYSLLLYRALLPAPVWYRFFLNKEYGSLFSSLITGLYLTFKLTSVVEKVQSFFASIRALSRKDIHYGSHATLEQVNAAGDLCAICQEKMHAPILLRCKHIFCEDCVSEWFERERTCPLCRAVVKPADLRTFGDGSTSLFFQFF

SEQ ID NO: 8993 - protein, 221 aa, Tabernaemontana elegans
MLHVLGTYWWYQNDDTLLSIVHGSSKISPTIWHAIFIILVNDTMVRQVAMSLKLLLLMYYKNGRGHNFRRQGQMLTLVEYTLLLYRALLPAPVWYRFFLNKDYGSLFSSLTTGLYLTFKLTSIVEKVQSFLAALKALSRREIHYGSYATSEQVNAAGDLCAICQEKMHAPILLRCKHIFCEDCVSEWFERERTCPLCRALVRPADLRSFGDGSTSLFIQVF

SEQ ID NO: 8994 - protein, 429 aa, Eutrema halophilum
METSGTNHDAFRGSPRRNSILSASNIIQAPISTLLEYSGLFRTRTSPSPEAETLVSDASAGISNGEVAIRIIGNGEQDAETDNSGLREAAAHAQPEVLASGTQVDPLGAGDGASQSQAAPVDSVAGDAASRDSPYQRYDIQQAARWIEQILPFSLLLLVVFIRQHLQGFFVAIWIAAVMFKSNDILKKQTALKGERHISALIGISVAFTAHVVGVYWWFRKDDLLCPLIMLPPKSIPPFWHAIFIIVVNDTLVRQASMIFKCFLLMYYKNSRGRNYRKQGQLLTLVEYLMLLYRSLLPTPVWYRFFLNKDYGSLFSSLMTGLYLTFKLTSVVEKVQSFFTALKALSRKEVHYGSYATSEQVNAAGDLCAICQEKMHTPILLRCKHMFCEDCVSEWFERERTCPLCRALVKSADLKSFGDGSTSLFFQIF

SEQ ID NO: 8995 - protein, 427 aa, Eutrema parvulum
METSGTNHDAFRGSPRRNPILSASNLIQAPISTLLEYSGLFRTRTSPTQEAETLVSDDSAGISNGEVAIRIIGNGEQDAATDINGLREAASHGQTEVLGPGTQVDPTGTGEGASQAAPGDSAAADAASRDSPYQRYDIQQAARWIEQILPFSLLLLVVFIRQHLQGFFVAIWIAAVMFKSNDILKKQTALKGERHISALIGISLAFTTHVVGVYWWFRKDDLLYPLIMLPPKSIPPFWHAIFIIVVNDTLVRQASMIFKCFLLMYYKNSRGRNYRKQGQLLTLVEYLMLLYRALLPTPVWYRFFLNKDYGSLFSSLMTGLYLTFKLTSVVEKVQSFFTASKALSRKEVHYGSYATTEQVNAAGDLCAICQEKMHTPILLRCKHMFCEDCVSEWFERERTCPLCRALVKPADLKSFGDGSTSLFFQIF

SEQ ID NO: 8996 - protein, 384 aa, Tripterygium wilfordii
MEASGSNSEAYRSSSPVNSGHSRRYGILSASNIIQAPISTLLEYSGLLRTARSSHQESESLINQIHNNRADDSGTSSPVAANNGEVAIRIIGADENENDREGSGLVVEQVREGVNGQAEVSIQPIASNIQLEGVGDDRGDREAGDGVSQPGSASGDGEAGEGVGANGRDSSYQRYDIQQAARCIEQILPFSLLLLVVFIRQHLQGFFVTIWIAAVLFKSNDILRKQTALKGERKSSVLIGIALAFNVHVVCVYWWYRDDDLLYPLVMLPPRSIPPFWHAIFVIMVNDTLVRQAAMILKCILLIYYKNSRGRNYRKQGQMLTLVEYLMLLYRALLPTPVWYRFFLNKDYGSPFLISNDWVIFDFQADFCGREGAIFLYCFESTFP

SEQ ID NO: 8997 - protein, 427 aa, Brassica juncea
METSSTNNDTFRGSPRRNSSILSASNLIQAPISTLLEYSGLFRPRPTSPTHEASETATLVSTGSDDSPGINSNGGEVAIRIIGNAEQDDVESDITGAAQTEGLGSSSAGTGEGASTGESVGGDAAAASRDSPYQRYDIQQAARWIEQILPFSLLLLVVFIRQHLQGFFVAIWIAAVMFKSNDILKKQTALKGERQISALIGISVAFATHVVGVYWWFRKDDLLYPLIMFPPKSIPPFWHAIFIIVVNDTLVRQASMILKCFLLMYYKNSRGRNYRKQGQLLTLVEYLMLLYRSLLPTPVWYRFFLNKDYGSLFSSLMTGLYLTFKLTSVVEKVQSFFTALKSLSRKEVHYGSYATTEQVNAAGDLCAICQEKMHTPILLRCKHMFCEDCVSEWFERERTCPLCRALVKPADLKSFGDGSTSLFFQIF

SEQ ID NO: 8998 - protein, 468 aa, Malus domestica
MEASSGNGSPASGGASGGATGDSSNTSSFGSMQFPALRLFQSPLSFVLDYSGILSPSSSRRDSDAPVVNAVVVADSQPHSPTACTSGSSNTGEVSIRIIGASEHEDRGNGGATVPVQGEENGGSPGRVQSLDDLAGTVNGVGSDERVPLVASSSPTHAGDTGNGAEDSSRDSAYQRYDIQQIARWIEQILPFSLLLLVVFIRQHLQGFFVTIWVSAVMYRSNDVVKKQTALKRDRKISVLVSIAGAFMLHVVVVYLWYRSDDLLYPLAMLPPKTIPPFWHAIFIILVNDTMVRQAAMAFKCLLLIYYKNGRGHNYRRQGQMLTVIEYTLLLYRALLPAPVWYRFFLNKDNGSLFSSLTTGLYLTFKLTSVVEKVQSFFASIRALSRKDIHYGSHATLEQVNAAGDLCAICQEKMHAPILLRCKHIFCEDCVSEWFERERTCPLCRALVKPADLRTYGDGSTSLFFQLF

SEQ ID NO: 8999 - protein, 427 aa, Brassica rapa
METSSTNNDTFRGSPRRNSSILSASNLIQAPISTLLEYSGLFRPRPTSPTHEASETATLVSTGSDDSPGINSNGGEVAIRIIGNAEQDDVESDITGAAQTEGLGSSSAGTGEGASTGESVGGDAAAASRDSPYQRYDIQQAARWIEQILPFSLLLLVVFIRQHLQGFFVAIWIAAVMFKSNDIMKKQTALKGERQISALIGISVAFATHVVGVYWWFRKDDLLYPLIMFPPKSIPPFWHAIFIIVVNDTLVRQASMILKCFLLMYYKNSRGRNYRKQGQLLTLVEYLMLLYRSLLPTPVWYRFFLNKDYGSLFSSLMTGLYLTFKLTSVVEKVQSFFTALKSLSRKEVHYGSYATTEQVNAAGDLCAICQEKMHTPILLRCKHMFCEDCVSEWFERERTCPLCRALVKPADLKSFGDGSTSLFFQIF

SEQ ID NO: 9000 - protein, 107 aa, Fagus grandifolia
MMIFCTHWSCFLQKAILPFWHAVFIILVNDTMVRQAAMAFKCLLLMYYKNGRGHNFRRQGQMLTLVEYMLLLYRALLPTPVWYRFFLNKDYGSLFSSLITGLYLTSS

SEQ ID NO: 9001 - protein, 428 aa, Brassica napus
METSSTNNDTFRGSPRRNSSILSASNLIQAPISTLLEYSGLLRPRTTSPTHEAETLVSSDDSPGINSNGGGGEVAIRIIGNSEQDEVAESDITGAAQTTEVPGSSSASPVGGGTGEGGESVGGDAAAASRDSPYQRYDIQQAARWIEQILPFSLLLLVVFIRQHLQGFFVAIWIAAVMFKSNDIMKKQTALKGERQISALIGISVAFAAHVVGVYWWFRKDDLLYPLIMFPPKSIPPFWHAIFIIVVNDTLVRQASMILKCFLLMYYKNSRGRNYRKQGQLLTLVEYLMLLYRSLLPTPVWYRFFLNKDYGSLFSSLMTGLYLTFKLTSVVEKVQSFFTALKSLSRKEVHYGSYATTEQVNAAGDLCAICQEKMHTPILLRCKHMFCEDCVSEWFERERTCPLCRALVKPADLKSFGDGSTSLFFQIF

SEQ ID NO: 9002 - protein, 425 aa, Brassica napus
METSSTNNDTFRGSPRRNSSILSASNLIQAPISTLLEYSGLFRPRPTSPTHEASETATLVSTGSDDSPNGGGGEVAIRIIGNAEQDDVESDITGAAQTEGLGSSSAGTGEGASTGESVGGDAAAASRDSPYQRYDIQQAARWIEQILPFSLLLLVVFIRQHLQGFFVAIWIAAVMFKSNDIMKKQTALKGERQISALIGISVAFATHVVGVYWWFRKDDLLYPLIMFPPKSIPPFWHAIFIIVVNDTLVRQASMILKCFLLMYYKNSRGRNYRKQGQLLTLVEYLMLLYRSLLPTPVWYRFFLNKDYGSLFSSLMTGLYLTFKLTSVVEKVQSFFTALKSLSRKEVHYGSYATTEQVNAAGDLCAICQEKMHTPILLRCKHMFCEDCVSEWFERERTCPLCRALVKPADLKSFGDGSTSLFFQIF

SEQ ID NO: 9003 - protein, 446 aa, Eucalyptus grandis
METPGDIDVYPVSSSSTSGSGSSASRFGVQFPSLSLFQSPLSVILEYSGIIPSAPTVPESESPVLGASAGHIQTESPYSEVRNGGSSEEVSIRIIGSSEAGSGVNMGDGGGQIGCDDLMDIAAESDDLLLEAASTSSANVMDSADSSRDSGYQRYDLQRVGRWIEQILPFSLLLLVVFIRQHLQGFFVTIWIAAVMFKSNDILRKQTALKGERKNSVLVSISVVFIVYVVGVYWWYRNDGALYPLLMLPPKAIPPFWHAIFMIMLNDIMARQAAMSVKCLLLIYYKNSRGHNFRRQGQMLTLVEYTMLLYRALLPAPVWYRFFLNKDYGSLFSSLTTGLYLTFKLTSVVEKVRSFLAAVKALSHKEVHYGSYATKEQVNAAGDLCAICQEKMHSPILLQCKHIFCEECVSEWFERERTCPLCRALVRPADLQSFGDGSTSLFFQLF

SEQ ID NO: 9004 - protein, 385 aa, Podocarpus macrophillus
IRIFGAGEPENLRVGTAQGNFDVGGFERATSDSSSLQGNGADAVTSMPSLAISAVGNVESAADVAARDGTEDGSGRSGNGNGDGSNNSSGSWRYEIQHVARGIEQVLPFSLLLFVIFVRQHLQGFLVTFWITAAMIKLNDLVRKQTALKGERKISVLIGIILVLLLHLAGVYWWYKDADLWYPLLMLPPKTIPPFWNAIFVIIVNDTMVRLAAMILKCVLLIYYKHSRSCNYRKQGQMLTVVEYTLLLYRALLPTPVWYRFFLNKEYGSLFSSLTTGLYLTFKLTSIVEKVQASFTALKALSHKELQYGSYATTEEVVAAGDLCAICQEKMHAPILLRCKHIFCEDCVSEWFERERTCPLCRAVVKPAELRSFGDGSTSLFFQLF

SEQ ID NO: 9005 - protein, 525 aa, Podocarpus macrophillus
MENSGGSAEGFRSNGSYRRNGLHFSAANIIQAPLSALLEYSGLLRDRSQQQHHEREAAAGLTGGSDDVSGAEVSIRIIGSGEQENVRVGSVEETEIVNNNINNSISHLQVSSSLPTLQAADGVDGGGVGSSSVMAPLTISAGTNVENNVGDNSNSSNNSNNVNGRDAAYQRYDIQQLARWIEQILPFSLLLLVVFIRQHLQGFFVTFWIAAVMVKSNDVLRKQTALKGERKSSVLMCIILVFIVHVVGIYWWYRNADLLYPLVMLPPKNIPPFWHAMFIIVVNDTMVRQAAMVLKCGLLIYYKNSRGRNYRKQGQMLTLVEYILLLYRALLPTPVWYRFFLNKEYGSLFSSLTTGLYLTFKLTSIVEKVQSFFAALKHCLARSSIRVICNYRGGSCSWRLVCNCQEKMHAPILLRCKHIFCEECVSEWFERERTCPLCRALVKQADLRSFADGSTSLSFSYFDCCTESKTNLVDLWIIIRTIGHLQRNGFTSLCQQLRNLLRFVASQTSENFAKKYCYAEFWIGF

SEQ ID NO: 9006 - protein, 443 aa, Populus trichocarpa
MEGSGNISDPYRGRGGGNSNSSNNSSPSSSRRYGMLSASSILQAPISLLLEYSGLLRTTRSSHQETESLIPGGGGLGSTRLDGSSAAVVSNNGEVAIRIIGSGEHEHDRDSSGGLVVGQVGGGQNESSSVGGDGEAADGAGGNGRDSTYQRYDIQQAARWIEQVLPFSLLLLVVFIRQHLQGFFVTIWIAVVMFKSNDILRKQTALKGERKVSMLVGISLAFAIHVVGVYWWYQNDDLLYPLIMLPPKSIPPFWHAIFIIMVNDTLVRQAAMVFKCILLISYKNSRGRNYRKQGQMLTLVEYLMLLYRALLPTPVWYRFFLNKEYGSLFSSLMTGLYLTFKLTSVVEKVQSFCAALKALSRKEVHYGAYATSEQVNAAGDLCAICQEKMHAPILLRCKHIFCEDCVSEWFEREGTCPLCRALVKPADLRSFSDGSTSLLFQIF

SEQ ID NO: 9007 - protein, 254 aa, Silene vulgaris
MEGAGANTEGHRDRNSTGGNSASSRRYRLHFSASNFLRSPVSSLLEYSGLLRPRSSNNETEPLISGSSSGLTPAGAYDSTSSSLNEGEVSIRIIGGAEGENERVETSSLGQSCGGNESGGVVVGEEELRTEAGVGTGTGEGVSSQFSSSSGDAEAADASGGSNREGTYQRYDIQQAARWIEQVLPFSLLLLVVFIRQHLQGFFITIWVSVFMFKSNDILRKHTALKGERKNFCSNWLLHLVHPSCCWCVLVVPE

SEQ ID NO: 9008 - protein, 437 aa, Solanum phureja
MDTSENANVSPSSPTSSNLSTFGIQFTPLRFFQSPVSTLLEYSGLFTVRPDNPETDPLVADDTVTNDAESSSDVGGGNSSSGEVSIRIIGAGENQGIGDEYEDDGSVMDGEEGGSVEERGSGVEASSTVPDDDAGNASRDSSYQRFDIQQVARWIEQILPFSLLLLFVFIRQHLQGFFVTIWITAVMFKSNDILRKQTALKGERKTDVLVGYFVVFVIHVIGIYWWYHNDDLFYPLLMVPPKVIPPFWHAIFIILVNDTMVRQAAMALKLVLLMYYKNGRGHNFRRQGQILTLVEYMLLLYRALLPTPVWYRFFLNKEYGSLFSSLTTGLYLTFKLTSIVEKVKSFYTALKALSKKEVHYGSHATPEQVNAAGDLCAICQEKMHAPILLRCKHLFCEDCVSEWFERERTCPLCRALVRPADLRSFGDGSTSLFFQLF

SEQ ID NO: 9009 - protein, 438 aa, Solanum lycopersicum
MDTSENNANGSLSSPTSSNLTAFGVQFTPLRFFQSPVSTLLEYSGLFTVRPDNPEMDPLVVDDTVTNEAESSSNVGGGNSSSGEVSIRIIGAGENQGIGGEDEDDGSVMDGEEGGAVEERGSGVDASSMVADDDAGNASRDSSYQRFDIQQVARWIEQILPFSLLLLFVFIRQHLQGFFVTIWITAVMFKSNDILRKQTALKGERKIDVLVGYFVVFVIHVTGIYWWYHNDELFYPLLMVPPKVIPPFWHAIFIILVNDTMVRQAAMALKLVLLMYYKNGRGHNFRRQGQILTLVEYMLLLYRALLPTPVWYRFFLNKEYGSLFSSLTTGLYLTFKLTSIVEKVKSFYTALKALSKKEVHYGSHATPEQVNAAGDLCAICQEKMHAPILLRCKHLFCEDCVSEWFERERTCPLCRALVRPADLRSFGDGSTSLFFQLF

SEQ ID NO: 9010 - protein, 354 aa, Zostera marina
MDTNGENFDGYGNRRYGGVHFSPYAFMQAPISVLLEYAGDLRNPFLSSRIIHSENDDEIFVRSSGDDGSAIPYEYGSGRTDDSVPEGSGGSGGEISIRIIEPGDRDVLGAVDGGLPLPVLEIDSVSESSTVLTEHLDANTPSSSSFTSDDSTREEPDAAENTASANSRDGLLQSFDLQQMARWAEKFLPFSLLLLVVFIRQHLQGFFLTLWIAAVMFKSNDILRKQTALKGERKVSVLVSFTIIFALHVVEVYWWYRNDGLINPLFMVPPKVIPPFWHAVFIVTVNDTMVRQAAMVVKCMLLLLYRDSRGRSYRRQGQMLTLVEYLLLLYRALLPAPVWYRFFLNKEYGSLFLP

SEQ ID NO: 9011 - protein, 201 aa, Brassica juncea
IMFPPKSIPPFWHAIFIIVVNDTLVRQASMILKSFLLMYYKNSRGRNYRKQGQLLTLVEYLMLLYRSLLPTPVWYRFFLNKDYGSLFSSLMTGLYLTFKLTSVVEKVQSFFTALKSLSRKEVHYGSYATTEQVNAAGDLCAICQEKMHTPILLRCKHMFCEDCVSEWFERERTCPLCRALVKPADLKSFGDGSTSLFFQIF

SEQ ID NO: 9012 - protein, 111 aa, Brassica napus
MTGLYLTFKLTSVVEKVQSFFTALKSLSRKEVHYGSYATTEQVNAAGDLCAICQEKMHTPILLRCKHMFCEDCVSEWFERERTCPLCRALVKPADLKSFGDGSTSLFFQIF

SEQ ID NO: 9013 - protein, 467 aa, Manihot esculenta
METCSAASSDDIFRNSSSSSSSSSSSSPSFSGSASGGGGGGSRNISSRRYGINIAASNLIHAPLTTLLEYAGILRGGGNVSSAAHEREQLILPPPAAAVRSSTGAHHHQEVTIRIIGAADSNVDPTVEAMPASLPLSDDQPGRAVPSETPTVDGVSGITADPSSSSPPPPPSYQRYDIQNFARWIEQIVPFSLLLLLVFIRQHLQGFCVALWIAAILFKSNDILKKQTALKGERKNSITIAITLGFMLHVMSIYWWYRNDDLLYALVLLPVSTIPPFWHALFIIVVNDAMVRQVAMAFKCILLMYYKNGRGHSYRKQGQMLTLVEYFLLLYRALLPAPVWYKFFLNKEYGSFFSSLITGLYLTFKLTSVLGKVRSFFTALRALSSKEIHYGSKATSEQVNAAGDLCAICQEKMSAPILLRCKHIFCEECVSQWFERERTCPLCRALVKPADIRSYGDGSTSLFFQLF

SEQ ID NO: 9014 - protein, 466 aa, Euonymus alatus
MEASGSNSEAYRSSSPVNGGHSRRYGLLSASNIIQAPISALLEYSGLLRTARSSHQESESLINQIHNNSADHSGTASPVAANNDEVAIRIIGAGENENDREGSGLVVGQVREGVNGQTEMSLQRIASNIQLEGLGDNRSNREAGDGVSQPGSASGHGEASEGAGANGRDSSYQRYDIQQAARCIEQVLPFSLLLLVVFIRQHLQGFFVTIWIAAVLFKSNDILRKQTALKGERKISVLIGISLAFMVHIVCVYWWYRNDDLLYPLVMLPPRSVPPFWHAIFIIMVNDTLARQAAMILKCILLIYYKNSKGRNYRKQGQMLTLIEYLMLLYRALLPTPVWYRFFLNKDYGSLFSSLMTGLYLTFKLTSVVEKVQSFFTALKALSRKEVHYGAYATTEQVNAAGDLCAICQEKMHAPVLLLCKHIFCEDCVSEWFERERTCPLCRALVKPADLRSFSDGSTSLFFQIF

SEQ ID NO: 9015 - protein, 222 aa, Euonymus alatus
FAVHVVCVYWWYQNEDLLYPLVMLPPKSIPPFWHAIFIIVVNDTLVRQAAMMLKCILLIYYKNSRVRNYRRQGQMLTLVEYLMLLYRDLLPTPVWYRFFLNKDYGSLFSSLMTGLYLIFKLTSVVEKVQSFFTALKALSRKEVHYGSYATKEQVNAAGDLCAICQEKMLAPVLLRCKHVFCEDCVSEWFERERTCPLCRALVKPADLRSFSDGSTSLFFQIF

SEQ ID NO: 9016 - protein, 466 aa, Euonymus alatus
MEASGSNSEAYRSSSPVNSGHSRRYGILSASNIIQAPISALLEYSGLLRTARSSHQESESLINQIHNNRADDSGSASPVAANNGEVTIRIIGAGENENDREGSGLVVGQVREGVNGLTEVSLQPIASNIHLEGVGDNRSDRGAGDGVSQPGSVSGDGEAGEGVGANGRDSSSQRYDIQQAARCIEQVLPFSLLLLVVFIRQHLQGFFVTIWIAAVVFKSNDILRKQTALKGERKISVLIGIALAFMVHVVCIYWWYRNDDLLYPLVMLPPRSIPPFWHAIFIIMVNDTLVRQAAMMLKCMLLIYYKNSKGRNYRKQGQLLTLVEYLMLLYRALLPTPVWYRFFLNKDYGSLFSSLMTGLYLTFKLTSVVEKVQSFFTALKALSRKEVHYGAYATTEQVSAAGDLCAICQEKRHAPVLLRCKHIFCEDCVSEWFERERTCPLCRALVKPADLRSFSDGSTSLFFQIF

SEQ ID NO: 9017 - protein, 148 aa, Arachis hypogaea
MLTLVEYTLLLYRALLPTPVWYRFFLNRAYGSLFSSLTTGLYLTFKLTSVVEKVQCFLSALKALSRKEVHYGVNATMEQVNAAGDLCAICQEKMHAPILLRCKHIFCEECVSEWFERERTCPLCRALVKPADLRTFGDGSTSLFFQLF

SEQ ID NO: 9018 - protein, 151 aa, Hordeum vulgare
QGQMLTLVEYFLLLYRALLPAPVWYRFFLNKEYGSLFSSLTTGLYLTFKLTSVVEKIQSFLTSLRALSHKDFHYGSYATSEQVAAAGDMCAICQEKMHVPILLRCKHVFCEDCVSEWFERERTCPLCRALVKPADLRSFGDGSTSLFFQLF

SEQ ID NO: 9019 - protein, 94 aa, Sarracenia psittacina
GIVRSSISTDHASPKRYTPFWHAIFIIMVNDTSVRQAAMALKCSLLMYYKNSRGRNYRKQGQMLTLVEYSLPALYRALAASTSLASFLFEQRIW

SEQ ID NO: 9020 - protein, 451 aa, Cannabis sativa
MESSLGNSEMYGRINNSTRRFGIQIPESNFIRAPLTAFLEHTGIFGGGGSSVSQATRGLVGSRHSLIRNSLQEEDEEDDEYDVVPGDGEDEEDEVSIRIIGATENQHELPTVDGANVVLRSGNDNAGPSSGSEDSEGNAESGAGAGATSNSRDSSPYQRYDIQHFARWFEQILPFTLLLLLVFIRQHYQGFSITIWIAAVMFKSNDIVRKQTALKGERKIPILVCISSVFMLHVICFYWWYRKDDLLYPLALIPPKVVPPFWHAVFIIMINDIMVRQAAMALKCMLLVFFRDSRGRDYRKQGQMLTLVEYLLLLYRALLPTPVWYRFFLNKEYGSFFSSLTTGLYLTFKLTSVVEKVQCFFVALRALSRKEVHYGSYATSEQVSAAGDLCAICQEKMHAPILLRCKHIFCEDCVSEWFERERTCPLCRALVKPAGIKSYGDGATSLYFQLF

SEQ ID NO: 9021 - protein, 481 aa, Medicago truncatula
METLGGNSSPSPSLSSASSSSSFGGINTDDNNGSVSWYGMRLPVNPFLSPISFLLDYSGILRSGNDSEGMIVNNGVSGSELRPQVDAGGAVAGSSAGEVAIRIIGAGENIHNQVGEVGYDDCGEELIAERSGMPGLGENDAEGRGGIEASEGVPLVSSSSSSSLAGSGQVDGEAAGNGTENNRDSSSYQRYDIQLVAKWIEQILPFSLLLLVVFIRQHLQGFFVTIWIAAVMFKSNEIVKKQTALKGDRKVSLLAGIAFAFILHVICIYWWYRNDDILYPLAMLPPNPTPFWHAIFTILVNDILMRQVAMAFKCILLIYYKKGKGHNFRRQAQMLTLVEYTLLLYRALLPTPVWYRFFLNREYGSLFSSLTTGLYLTFKLTSVVEKVQCFISALKALSRKEVHYGVYATAEQVTAAGDLCAICQEKMHSPILLRCKHIFCEDCVSEWFERERTCPLCRALVKAADLRTFGDGSTSLFFQLF

SEQ ID NO: 9022 - protein, 462 aa, Brachypodium distachyon
MDPPAGGSTDRRGAVSGASAGAASSGLRRYGLNFSASSLLQAPLAALLEYSGVVPSGPPSQTVHQAVPSSSSEADGLLSAAAAGNGEVSIRIQGGPNDSDAAGAASTGASPGDSIEATAATDVDPASAAGRGAGADAEAGGGGSGGATGNGAGDRAYQRYDVHHVARWIEQILPFSLLLLVVFIRQHLQGFFVTIWIAAVMFKSNDILKKQTALKSERKAAALVGITLIFMIHVFGVYWWYRNDYLLRPLFMLPPKDIPPFWHAIFIIMVNDTMVRQAAMAAKCILLMYYKNSRGRNYRRQGQMLTLVEYLLLLYRALLPTPVWYRFFLNKEYGSLFSSLTTGLYLTFKLTSVVEKVQSFLSAVKALSRKDVHYGSYATAEQAIAAGDMCAICQEKMHVPVLLRCKHIFCEDCVSEWFERERTCPLCRALVKPADIRSFGGKRLEILPYHVAPLSPYVPRSM

SEQ ID NO: 9023 - protein, 453 aa, Ricinus communis
METSSSSSSSSSFSSSSIGLGSSNYGGVSSVSGSNNSNSRRYGINIAASSLIHAPLTTLLEYSGFLGGGGGSASSSQEREQLISPPPSSRGSNRGGGGGGEHHQDQEVTIRIIGGAESSSASSLPLSDDQDQPPGGPLISQALPSSHGTTTEPSSSTSYQRYDIQNFARWIEHVLPFSLLLLLVFIRQHLQGFCMALWIAAVLFKSNDILRKQTALKGERKKFFLVAMTVLFMLHVVSFYWWYRNDDLLYPLALLPPTKLPPFWHAVFIIVVNDAMVRQLAMAFKCILLMYYKNSSGQNYRKQGQMLTLVEYLLLFYRALLPAPVWYRFFLNKEYGSLFSSLVTGLYLTFKLTSVLRKIQLFVTALRALSRKEMHYGSYATSEQVNAAGDLCAICQEKMHAPILLCCKHIFCEDCVSEWFERERTCPLCRALVKPADIRSYSDGSTSLYFQLF

SEQ ID NO: 9024 - protein, 199 aa, Cephalotaxus harringtonia
PLSSLLEFSRTSETSTNLGAGGPLFRGLGRANDVAGRGHSTRADEAGAAEVSIRIFSAGEGEEHVTVNSYGSSGEQGFEPATSSLHSNGVESALTSMPSLTISADGAAEVASRRDRNDDDDANNTSRNNNNSGSQRYEIQQVARWIEQVLPFSLLLFVIFVRQHLQGFLISFWITAVMVKMNDLLRKQTSLKGERKYQF

SEQ ID NO: 9025 - protein, 431 aa, Unknown
  Sequence found in Organisms: Citrus clementina, Citrus sinensis
METSVPGHSSSPLPDDDRTSTSASASDNSRSYEVQLPAALNLFRSPLSLLLEYSRVMSTSQESEQDRLTVNADSEARGQTQLPNSALSTGEVSIQIIRQENGEATGAGEDNEGNAIGEGETVPLAASEGSTSREGSYQSYDIHQFARWVEQVLPFSLLLLVVFVRQHLQGFFVTVWITAVIFKSNDILRKQTALKGERKNYILFMIFIGFMFQVIGIYWWFRSDDILYPLLMIPPSTIPPFWHAVFIILVNDTMVRQAAMAMKCLLLIYYKNGRGHNFRRQGQILTLVEYALLLYRALLPTPVWYRFFLNKDYGSLFSSLTTGLYLTFKLTTVVDKVQSLFAAIRALSRKEVHYGSYATTEQVNAAGDLCAICQEKMHAPILLQCKHLFCEDCVSEWLERERTCPLCRALVKPADLRSFGDGSTSLLFQLF

SEQ ID NO: 9026 - protein, 218 aa, Cleome spinosa
VVGIYWWFHNENMLHPLILLPPKSIPPFWHAVFIIMVNDTLVRQAGMVLKCLLLIYYKNSRGRSYRKQGQLLTAVEYLMLLYRALLPTPVWYRFFLNKEYGSLFSSLMTGLYLTFKLTSVVEKVQSFFAALKVLSCRDVHYGAYATSEQVHAAGDICAICQEKMHTPVLLSCKHIFCEDCVSEWFERERTCPLCRALVKPADIKSFSDGSTSLFSQIF

SEQ ID NO: 9027 - protein, 86 aa, Cucurbita pepo
MGQPAYSSSCFRRKPSITRHNNTITSTKKDIVYQMETGRSRRTKKKGELDIEVSLKILSNSKCFIIIESCLYELLVISVICKIYSL

SEQ ID NO: 9028 - protein, 230 aa, Cucumis melo
VLAGTSITFLVHVIGIYWWCHSDDLLYPLVMLPPKTVPPFWHALFIILVNDTMVRQFAMALKCFLLIYYKNGRGHNFRRQGQILTLVEYTLLLYRALLPTPVWYRFFLNKDQGSLFSSLTTGLYLTFKLTSVVEKIQSFVAAFKALSRKEVHYGSYATSEQVNAAGDLCAICQEKMNAPILLRCKHIFCEDCVSEWFERERTCPLCRALVKPAELRTFGDGSTSLLFQLF

SEQ ID NO: 9029 - protein, 457 aa, Mimulus guttatus
METPNRDALDSASQGSNGVGTSRIFRSRAIRFLRSPISSLLEYSGVLRDRPDYPFSEAYPLIPESTGANFNQNPRRSEPLNRNDAVDGGGTSNSGGSNNCAEVSIRIIGEQESVGGANNSDSGVNGVGLGAGESTVGAGDVNRNGNGNGNSNDDNNNREASSSERYDIQQAARWIEQILPFSLLLLVVFIRQHLQGFVVTIYSTAILFKSNDILRNQTALKGERKITILVGSSVFFMIHIFGTYWWHRRDDLFYPLIMIPPKSIPPFWHAIFIILINDTMARQTAMVFKLVLLMYYKNGRGQSFRRQGQMLTLVEYTLLLYRALLPAPVWYRFFMNKDYGSLFSSLITGLYLTFKLTSIVEKVQSFVTALKALSKKEVHYGSHATSEQVSAAGDMCAICQEKMHVPIFLRCKHIFCEDCVSEWFERERTCPLCRALVRPADLQSYGDGSTNLFFQLF

SEQ ID NO: 9030 - protein, 490 aa, Phalaenopsis aphrodite
MSASGGNSNFFRSPAGSTVGGNGAGGGSRRYGLPFSVSDLIQAPLSALLEYSGILRPRSVHLESESLSGRRIIASTGERAPGQVEESFVTDSSDGEVSIRIFDIGDQENPRTSAGIQQPLSVGPLREGSLGDHGVSMEQMQMDSERQRGEGGSSDAGVGVSTFAGATQSPSVLGVGGQSVEGEGSVAEGNARDSAYQRYDIQQAARCIEQVLPFSLLLLVVFIRQHLQGFFITIWLSAVMFKSNDLLCKQTALKGERKISVLVGIGVIFTIHVIGVYWWYCNEELLYPLVLLPPSEVPPFWHAIFIIMVNDTMVRQAAMAVKCVLLVCYKNSRGCNYRKQGQLLTIVEYLVLLYRALLPTPVWYRFFLNKEYGSLFSSLTTGLYLTFKLTSVVEKVQSFMAAVKALSRKEMHYGSHATVDQVIAAGDICAICQERMHAPILLRCKHIFCEDCVSEWFERERTCPLCRALVKPADLRSFSDGSTSLFFQIF

SEQ ID NO: 9031 - protein, 465 aa, Cajanus cajan
MESSPSSSSSSSSSGSETGGGAVTWFGMSFPFRSPLSLVMDYCAREDSAEPVIIIPRTRPRFQAQPESASASASASASASASASDSDENACSGAEEVAIRIIGAGEQESGSPSSSRGREAGCEEEVIGRSAMLSSEARRRMAEERVPLVSLDDGIGGGRDSSSSSSSSSTYQRYDIQQVAKWIEQILPFSLLLLIVFIRQHLQGFFVTICISAVMFKSNEIVKKQTALKGDRKVSILIGISFAFMLHVICIYWWYRNDDLLYPLAMLPPKSTPPFWHTIFIILVNDTLVRQAAMASKCVLLIYYKNGRGHNFRRQGQMLTLVEYTLLLYRALLPTPVWYRFFLNKEYGSLFSSLTTGLYLTFKLTSVVEKVQCFVSALKALSKKEVHYGVYATTEQVNAAGDMCAICQEKMQAPILLSCKHMFCEECVSEWFERERTCPLCRALVKPADLRTFGDGSTSLFFQLF

SEQ ID NO: 9032 - protein, 346 aa, Sciadopitys verticillata
MESSRRYGLPFSLAGAIQAPFSTLLDFSGLSRGRPSQSGEASTNLASGRPLFRGLGGSRADDLAGRGQGSDRADEAVTGAAEVAIRIFSTGEPEHVRVGSVNNLASGFEPATSSVQSNGAENGANALTSMPSLTISAESAADVAGHGDDDVNSNNNSSNNGSGSHRYDIQQLARWIEQVLPFSLLLLVIFVRQHLQGFLVSFWITAVMIKLNDLLRKQTALKGERKISVLTGIMSVLLLHVVGVYWWYKDDDLWYPLLMLPPKTIPPFWHAIFVIIVNDTMVRQAAMILKCGLLMYYKSNRGCNYRKQGQLLTLVEYILLLYRALLPTPVWYRFFLNKEYGSIFLH

SEQ ID NO: 9033 - protein, 473 aa, Glycine max
MESSPSSSSSSMSSSSGSDTSGGGGGGAVTWFGMSFPFRSPLSLVMDYCAREDSAEPVIIIPRTRPRFQAHAESASASSSDSDENACNGAAEEVAIRIIGAGEQESGSSPSSSSRGRGGEPGCEEAVVGRSGMLSSEARRRMAEERVPLVSLDDGIGGVRESSSSSSSSSSSSSSSSTYQRYDIQQVAKWIEQILPFSLLLLIVFIRQHLQGFFVTICISAVMFKSNEIVKKQTALKGDRKVSVLLGISFAFVLHVISIYWWYQNDDLLYPLAMLPPKTPPPFWHTIFIILVNDTLVRQAAMAFKCLLLIYYKNGRGHNFRRQGQMLTLIEYTLLLYRALLPTPVWYRFFLNKDYGSLFSSLTTGLYLTFKLTSVVEKVQCFVSALKALSKKEVHYGVYATTEQVNAAGDLCAICQEKMQAPILLSCKHMFCEECVSEWFERERTCPLCRALVKPADLRTFGDGSTSLFFQLF

SEQ ID NO: 9034 - protein, 199 aa, Trigonella foenum-graecum
MLPPNPTPFWHAIFTILVNDILMRQVAMAFKCILLIYYKKGKGHNFRRQAQMLTLVEYTLLLYRALLPTPVWYRFFLNREYGSLFSSLTTGLYLTFKLTSVVEKVQCFISALKALSRKEVHYGVYATAEQVTAAGDLCAICQEKMHSPILLRCKHIFCEDCVSEWFERERTCPLCRALVKAADLRTFGDGSTSLFFQLF

SEQ ID NO: 9035 - protein, 204 aa, Vinca minor
GGQERATSVSVDEEGQGSAGSGNNGNGRGESSYQRYDIQQFARWIEQFLPFFLLLLVVFIRQHLQGFFVTIWITAFMFKSNDILRKQTALKGERKMFVLVGYFVVFMLHVLGIYWWYRNDDLYYPLFMVPPKSIPPFWHAIFIILVNDTMARQAAMSLKLLLLMYYKNGRGHNFRRQGQMLTLVNTLCCSTVHYYQLLYGIDSS

SEQ ID NO: 9036 - protein, 483 aa, Citrullus lanatus
METSPSNSDPYSNSSSPTTARTSSRFGLSLPSLNFFRSPLSVILDYSGILPTRAVRHESDPVINAAATPDLRVYSQNQNHLITTSSSSSSSSSSSATTSSGNTIPSGEVSIRIIGSGEQDPSPSGLLPNQAGYEQNGRLPVSGDQPESPDEERVPLVSTASSSIQSGSTRVDGESGNGMEESVNRDSSYQRYDIQQVARWIEQILPFSLLLLIVFIRQHLEGFFITIWISAVMYKSNDIVKKQTALKGERKISVLAGTSIAFLVHVIGIYWWCHSDDLLYPLVMLPPKTVPPFWHALFIILVNDTMVRQFAMALKCFLLIYYKNGRGHNFRRQGQILTLVEYTLLLYRALLPTPVWYRFFLNKDQGSLFSSLTTGLYLTFKLTSVVEKIQSFVAAFKALSRKEVHYGSYATSEQVNAAGDLCAICQEKMNAPILLRCKHIFCEDCVSEWFERERTCPLCRALVKPAELRTFGDGSTSLLFQLF

SEQ ID NO: 9037 - protein, 459 aa, Phaseolus coccineus
MESSPSSSSSLSSSSGSDASGGAALTWLGMSFPFRSPLSLVMDYCTREDSAEPVIIIPRTRPRFQAPAESVASASASDSGDNACSGAEEVAIRIIGSGEQDSGSSPSSSRSRGGEPGCEEAAVVGRGGMLSSEARRRMAEERVPLVSLDDGIGGGRDSSSSSSTYQRYDIQQVAKWIEQILPFSLLLLIVFIRQHLQGFFVTICISAVMFKSNEIVKKQTALKGDRKVSVLLSISFAFMLHVICIYWWYRNDDLLYPLAMLPPKTTPPFWHTIFIILVNDTLVRQAAMALKCLLLIYYKNGRGHNFRRQGQMLTLIEYTLLLYRALLPTPVWYRFFLNKDYGSLFSSLTTGLYLTFKLTSVVEKVQCFVSALKALSKKEVHYGVYATTEQVSAAGDMCAICQEKMQAPILLSCKHMFCEECVSEWFERERTCPLCRALVKPADLRTFGDGSTSLFFQLF

SEQ ID NO: 9038 - protein, 307 aa, Secale cereale
GAGGGSGRGDSPYQGYDVQRLARWVEHALPFSLLLLGVFIRQHLQGFFVMIWIAAVMFKSNDILRKQTALKGERKMPMLIGIVIVFTIHVFGVYWWYRNDDLVRPLVMLPPKEIPPFWHAIFFIAVNDTMVRQAAMVVKCLLLMYYKNSKGRHYRRQGQMLTVVEYSLLLYRALLPAPVWYRFFLNKEYGSLFSSLTTGLYLTFKVASMVEKVRSLLASVNALSHKDLHYGSHATTEQVLAAGDLCAICQEKMHTPILLQCKHIFCEDCASEWLERERTCPLCRALVKPGDIRSFSDGSTTLFFQLF

SEQ ID NO: 9039 - protein, 443 aa, Cicer arietinum
MRLPSINPLRSPLSFLLDYSGILRSTNDSEAVILNNEVSGHGSRSRVDDSAGSVAGSSAGEVAIRIIGAGENIQTQVGEVGYDDCGDDVIGERSGMPALDDDDDTEGRSGIAASEGVPLVSSSSSSSLAGSGQVDGDAAENGTENSSRDSSSYQRYDIQLVAKWIEQILPFSLLLLVVFIRQHLQGFFVTIWIAAVMFKSNEIVKKQTALKGDRKVSLLAGISFAFILHVIGIYWWYRNDDVLYPLIMLPPKPTPFWHAIFTILVNDMLMRQVAMAFKCILLIYYKKGKGHNFRRQAQMLTLVEYTLLLYRALLPTPVWYRFFLNREYGSLFSSLTTGLYLTFKLTSVVEKVQYFISALKALSRKDVHYGVYATTEQVTAAGDLCAICQEKMHSPILLRCKHIFCEDCVSEWFERERTCPLCRALVKAADLRTFGDGSTSLFS

SEQ ID NO: 9040 - protein, 461 aa, Cichorium intybus
METTGVNVDSTSSDNHATNNPNSSNPTSPTIRRTSSSSSSPRAVSSSPFPIIRFLQAPVTTIIEYSGVLRPRSNNDYHESESLISNHHHRDHNSSSPGTASNRSSTGDNSNGEVSIRILGGAEQEEEHGESATVNRGDGGEEREVADSGDASGGNGGSNNNVDSAYQQRYDLQQVSRWIEQILPFSLLLLIVFIRQHLQGLFVTIYITAFMYKSNDILRKQTALKGERKLSVLAGYCIVFMLHVIGVYWWYQNDDLCYPLFMFPPKEIPPFWNAIFTIIVNDTMVRQAAMAFKLVLLMYYKNGRGHSFRRQGQMLTLVEYTLLLYRAFLPAPVWYRFFLNKEYGSLFSSLTTGLYLTLKLTSVVEKVGSFYAALKALSRKEVNYGSYATPEQVSEAGDLCAICQEKMQSPILLRCKHIFCEDCVSEWFERERTCPLCRALVRPADMRSFGDGSTSLFFQFF

SEQ ID NO: 9041 - protein, 253 aa, Vigna unguiculata
AVMFKSNEIVKKQTALKGDRKVSVLLGISFAFMLHVICIYWWYRNDDLLYPLAMLPPKTTPPFWHTIFIILVNDTLVRQAAMALKCLLLIYYKNGRGHNFRRQGQMLTLIEYTLLLYRALLPTPVWYRFFLNKDYGSLFSSLTTGLYLTFKLTSVVEKVQCFVSALKALSKKEVHYGVYATTEQVSAAGDMCAICQEKMQAPILLSCKHMFCEECVSEWFERERTCPLCRALVKPADLRTFGDGSTSLFFQLF

SEQ ID NO: 9042 - protein, 460 aa, Euphorbia peplus
MESCSTTSSSSPPSPASSGGFSNPTTARRYGINIAASNLIHSPLTTLLEYSGILGGRGGVGGGASSIEREQLIPSRPSSSSSSTRSNSGDRHEEVTIRIIGAAESNSTAAATTSGEASTPSSPVSDDQSSSSAGVVPETLDVDGASGITTDPSTLPTPPPSSSSSYQRYDIQNFARWIEQILPFSLLLLLVFIRQHIQGFCLALWVGAVLFKSNDILRKQTSLKGQRKNSILVAMTMVFILHVASIYWWYRNDDLLHPFILIPPATIPHFWQAIFIIVVNDSMIRQVAMASKCILLMYYKNSRGCNYRKQGQILTIIEYFMLLYRALLPAPVWYRFFLNKEYGNFFSSLITGLYLTFKLTSVLGKVQLFFTALRALSHKEMHYGSYATSEQVNAIGDMCAICQEKMHTPILLRCKHIFCEDCVSEWFERERTCPLCRALVKPADIRTYSDGSTSLSFQLF

SEQ ID NO: 9043 - protein, 457 aa, Glycine max
MESSPSSSSSGSDTSGGGGGGGAVTWFGMSFPFRSPLSLVMDYCVREDSAEPVIIIPRTRPRFQAHAESDAASASDSDENACNGAAEEVAIRIIGVGEQESGSSPSSSRGRGGELGGEEAVVGRSGMLSSRRRMAEERVPLVSLDDGIVGARDSSSSSSSSTYQRYDIQQVAKWIEQILPFSLLLLIVFIRQHLQGFFVTICISAVMFKSNEIVKKQTALKGDRKVSVLLGISFAFMLHVISIYWWYRNDDLLYPLAMLPPKTPPPFWHTIFIILVNDTLVRQAAMAFKCLLLIYYKNGRGHNFRRQGQMLTLVEYTLLLYRALLPTPVWYRFFLNKDYGSLFSSLTTGLYLTFKLTSVVEKVQCFVSALKALSKKEVHYGVHATTEQVNAAGDMCAICQEKMQAPILLSCKHMFCEECVSEWFERERTCPLCRALVKPADLRTFGDGSTSLFFQLF

SEQ ID NO: 9044 - protein, 434 aa, Solanum lycopersicum
METTTSSSVSDFDRNPNSNSNSSSSPHTSNSTAFGVNLSPLRVFRYPLSTFLEYSGLLRVRPENPETDLLLPDNPTPNSSGSTTSSNGEVSIRIIGSGENDRVRTDDGSVMDGGEREEERGSNVEGSTSSGSGNNRDSSYQRYDIQQIARWIEQFLPFSLLLLVVFIRQHLQGFFVIIWITAFMFRSNDILRKQTALKGERKITVLLGYFLVFMLHISGIYWWNHKDDIFYPLLMVPPKGIPPFWHAIFIILVNDTMVRQAAMTLKLVLLMVYKNGRGHNFRRQGQLLTLVEYMLLLYRALLPTPVWYRFFLNKDYGSLFSSLITGLYLTFKLTSIVEKVRSFLTALKALSIKEIHYGSHATPEQVNAAGDLCAICQEKMNTPILLCCKHIFCEDCVSEWFERERTCPLCRALVRPADLRSFGDGSTSLLFQLF

SEQ ID NO: 9045 - protein, 163 aa, Brassica oleracea
  misc_feature (60)..(60): Xaa can be any naturally occurring amino acid
YYKNSRGRNYRKQGQLLTLVEYLMLLYRSLLPTPVWYRFFLNKDYGSLFSSLMTGLYLTXKLTSVVEKVQSFFTALKSLSRKEVHYGSYATTEQVNAAGDLCAICQEKMHTPILLRCKHMFCEDCVSEWFERERTCPLCRALVKPADLKSFGDGSTSLFFQLF

SEQ ID NO: 9046 - protein, 302 aa, Hordeum vulgare
AGGGTSPYQGYDVQRLARWVEHALPFSLLLLGVFIRQHLQGFFVMIWIAAVMFKSNDILRKQTALKGERKMPMLIGIVIVFTIHVFGVYWWYRNDDLVRPLVMLPPKEIPPFWHAIFFIAVNDTMVRQAAMVVKCVLLMYYKNSKGRHYRRQGQMLTVVEYSLLLYRALLPAPVWYRFFLNKEYGSLFSSLTTGLYLTFKVASMVEKVRSLLASVNALSHKDLHYGSHATTEQVLAAGDLCAICQEKMHTPILLQCKHIFCEDCASEWLERERTCPLCRALVKPGDIRSFSDGSTTLFFQLF

SEQ ID NO: 9047 - protein, 262 aa, Hordeum vulgare
GFFVMIWIAAVMFKSNDILRKQTALKGERKMPMLIGIVIVFTIHVFGVYWWYRNDDLVRPLVMLPPKEIPPFWHAIFFIAVNDTMVRQAAMVVKCVLLMYYKNSKGRHYRRQGQMLTVVEYSLLLYRALLPAPVWYRFFLNKEYGSLFSSLTTGLYLTFKVASMVEKVRSLLASVNALSHKDLHYGSHATTEQVLAAGDLCAICQEKMHTPILLQCKHIFCEDCASEWLERERTCPLCRALVKPGDIRSFSDGSTTLFFQLF

SEQ ID NO: 9048 - protein, 432 aa, Theobroma cacao
METSPPISGPPSPSPTSSSSVTSSSGGDTSDSSRSFAIQVPALNLFRSPLSLLLEYSGIFSNPTLNQPRGVLVNTDLQPPANAASGAGEVSIQIIGPARAEEDNAQTSLDHDGVEEDDPLTGSSTSNEERSSNSSYQMQSYDVQRIARWFEHILPFSLLLLLVFIREHLQGFVVMIWVTIVMFKSNVILQKQTALKGERKNAVLITYSVLFMLHVIGVYWWYRDNDLLYPLVMLPPKTIPPFWHAIFIILVNDAMVRQAVMAFKCVLLIYYKNGRGHNFRRQGQVLTLVEYTLLLYRALLPTPVWYRFFLNKDYGSLFSSLTTGLYLTFKLTAVIEKVQSFFAALKALSQKEVHYGSYATLEQVNEAGDLCAICQEKMQAPILLRCKHIFCEDCVSEWFERERTCPLCRAVIKAPDLRSFGDGSTSLFFQLF

SEQ ID NO: 9049 - protein, 251 aa, Centaurea maculosa
  misc_feature (14)..(14): Xaa can be any naturally occurring amino acid
  misc_feature (16)..(16): Xaa can be any naturally occurring amino acid
  misc_feature (26)..(26): Xaa can be any naturally occurring amino acid
  misc_feature (30)..(31): Xaa can be any naturally occurring amino acid
  misc_feature (35)..(36): Xaa can be any naturally occurring amino acid
  misc_feature (60)..(60): Xaa can be any naturally occurring amino acid
  misc_feature (64)..(64): Xaa can be any naturally occurring amino acid
  misc_feature (77)..(77): Xaa can be any naturally occurring amino acid
  misc_feature (235)..(235): Xaa can be any naturally occurring amino acid
MYKSNDILRKQTAXKXERRLSVLAGXFIVXXLHVXXVYWWYQNEDLCYPLFMVPPTAIPXFWHXIFTIIVNDTMVQXAAMAFKLVLLMYYRNGKGHNFRRQGQMLTLVEYGMLLYRAFLPAPVWYRFFLNKEYGSLFSSLITGLYLTFKLTSIVEKVGSFWTALKALSRKDVHYGSYATPEQVTEAGDLCAICQEKMQAPVLLRCKHIFCEDCVSEWFERERTCPLCRALVKPAXLRSFGDGSTSLFFQLF

SEQ ID NO: 9050 - protein, 251 aa, Flaveria ramosissima
MYKSNDILRKQTALKAERKLSVLVGYCILFMLHVIGVYWWYRNDNLCNPLFMVPPKAIPPFWNAIFTIIVNDTMVRQAAMAFKLVLLMYYKNGRGHSFRRQGQMLTLVEYTLLLYRAFLPAPVWYRFFLNKEYGSLFSSLTTGLYLTLKLTSVVEKFGSFYAALKALSRKEVNYGSHATAEQVSEAGDLCAICQEKMQAPILLRCKHIFCEDCVSEWFERERTCPLCRALVRPADIRSFGDGSTSLFFQLF

SEQ ID NO: 9051 - protein, 295 aa, Raphanus sativus
  misc_feature (246)..(247): Xaa can be any naturally occurring amino acid
DQRYDIQQAARWIEQILPFSLLLLVVFIRQHLQGFFVAIWIAAVMFKSNDILKKQTALKGERQISALIGISVAFAAHVVGVYWWFRKDDLLYPLIMFPPKSIPPFWHAIFIIVVNDTLARQASMILKCFLLIYYKNSRGRNYRKQGQLLTLVEYMMLLYRSLLPTPVWYRFFLNKDYGSLFSSLMTGLYLTFKLTSVVEKVQSFFTSLKSLSRKEVHYGSYATTEQVNAAGDLCAICQEKMHTPVXXRCKHMFCEDCVSEWFERERTCPLCRALVKPADLKSFGDGSTSLFFQIF

SEQ ID NO: 9052 - protein, 434 aa, Solanum phureja
METTTSSSVSDFDTNPNSNSNSSSSPHTSNSTAFGVNLSPLRVFRYPLSTFLEYSGLLRVRPENPETDLLLPDNPTPNSSESTTSSNGEVSIRIIGSGENDRVRSDDGSVMDGGEREEERGSNVEGSTSSGSGNNRDSSYQRYDIQQVARWIEQFLPFSLLLLVVFIRQHLQGFFVIIWITAFMFRSNDILRKQTALKGERKITVLLGYFLVFMLHISGIYWWNRKDDIFYPLLMVPPKVIPPFWHAIFIILVNDTMVRQAAMTLKLVLLMVYKNGRGHNFRRQGQLLTLVEYMLLLYRALLPTAVWYRFFLNKDYGSLFSSLITGLYLTFKLTSIVEKVRSFLTALKALSIKEIHYGSHATPEQVNAAGDLCAICQEKMNTPILLCCKHIFCEDCVSEWFERERTCPLCRALVRPADLRSFGDGSTSLLFQLF

SEQ ID NO: 9053 - protein, 460 aa, Euphorbia esula
  misc_feature (6)..(6): Xaa can be any naturally occurring amino acid
  misc_feature (26)..(26): Xaa can be any naturally occurring amino acid
  misc_feature (57)..(58): Xaa can be any naturally occurring amino acid
  misc_feature (90)..(90): Xaa can be any naturally occurring amino acid
  misc_feature (113)..(113): Xaa can be any naturally occurring amino acid
  misc_feature (244)..(244): Xaa can be any naturally occurring amino acid
  misc_feature (399)..(399): Xaa can be any naturally occurring amino acid
MESCSXTSSSSPPSPASSGGFSNPTXARRYGINIAASNLIHSPLTTLLEYSGILGGXXGVGGGASSIEREQLIPSRPSSSSSSTRSNSGXRHEEVTIRIIGAAESNSTAAATXSGEASTPSSPVSDDQSSSSAGVVPETLDVDGASGITTDPSTLPTPPPSSSSSYQRYDIQNFARWIEQILPFSLLLLLVFIRQHIQGFCLALWVGAVLFKSNDILRKQTSLKGQRKNSILVAMTMVFILHVXSIYWWYRNDDLLHPFILIPPATIPHFWQAIFIIVVNDSMIRQVAMASKCILLMYYKNSRGCNYRKQGQILTIIEYFMLLYRALLPAPVWYRFFLNKEYGNFFSSLITGLYLTFKLTSVLGKVQLFFTALRALSHKEMHYGSYATSEQVNAIGDMXAICQEKMHTPILLRCKHIFCEDCVSEWFERERTCPLCRALVKPADIRTYSDGSTSLSFQLF

SEQ ID NO: 9054 - protein, 219 aa, Triticum aestivum
HVFGVYWWYRNDDLVRPLVMLPPKEIPPFWHAIFFIAVNDTMVRQAAMVVKCVLLMYYKNSKGRHYRRQGQMLTVVEYSLLLYRALLPAPVWYRFFLNKEYGSLFSSLTTGLYLTFKVASMVEKVRSLLASVNALSHKDLHYGSHATTEQVLAAGDLCAICQEKMHTPILLQCKHIFCEDCASEWLERERTCPLCRALVKPGDIRSFSDGSTTLFFQLF

SEQ ID NO: 9055 - protein, 312 aa, Triticum aestivum
RGDEAGAGGGSGRGDSPYQGYDVQRLARWVEHALPFSLLLLGVFIRQHLQGFFVMIWIAAVMFKSNDILRKQTALKGERKMPMLIGIVIVFTIHVFGVYWWYRNDDLVRPLVMLPPKEIPPFWHAIFFIAVNDTMVRQAAMVVKCVLLMYYKNSKGRHYRRQGQMLTVVEYSLLLYRALLPAPVWYRFFLNKEYGSLFSSLTTGLYLTFKVASMVEKVRSLLASVNALSHKDLHYGSHATTEQVLAAGDLCAICQEKMHTPILLQCKHIFCEDCASEWLERERTCPLCRALVKPGDIRSFSDGSTTLFFQLF

SEQ ID NO: 9056 - protein, 404 aa, Brachypodium distachyon
MDQPPHPPQPAVSEAAGGYATRFSPAGLIHAPLSALLEYSSGLLRAQATAGAHRGEAADREVSIRIVGPGGDAGPRAPGAGEVPPAADEEAPAVRGDEAGAGSGRAESPYQGYDVQRVARWLDHALPFSLLLLGVFIRQHLQGFFVMIWIAAVMFKSNDILRKQTALKGERKMPMLIGIVVVFIVHVFGVYWWYRNDDLVRPLMMLPPKEIPPFWHAIFFIAVNDTMVRQAAMVVKCVLLMYYKNSKGRHYRRQGQMLTVVEYSLLLYRALLPAPVWYRFFLNKEYGGLFSSLTTGLYLTFKVASLVEKVRWLLASLRALSHKDLHYGAHATTEQVLAAGDLCAICQEKMHSPILLQCKHIFCEDCASEWLERERTCPLCRALVKPGDIRSFSDGSTTLFFQLF

SEQ ID NO: 9057 - protein, 252 aa, Rosa hybrid cultivar
ISCHVVGTNDIWLRKQDGYVKGDEGKFFFFLVGLLLVVFMLHVVGVYWWYRNDDLLYPLAMLPPKAIPPFWHAIFIILVNDTLVRQATMAFKCLLLVYYKNGRGHNYRRQGQMLTVVEYSLLLYRALLPAPVWYRFFLNKEYGSLFSSLITGLYLTFKLTSVVEKVQSFFASIRALSRKDIHYGSHATLEQVNAAGDLCAICQEKMHAPILLRCKHIFCEDCVSEWFERERTCPLCRAVVKPADLRTFGDGS

SEQ ID NO: 9058 - protein, 179 aa, Fagus grandifolia
MVRQAAISFKCMLLIHYKNSRGRDYRKQGQMLTLVEYILLLYRALLPAPVWYRFLFKIKDMEVVFSSLTTGLYLTFKLTSIVEKVQSFIAALKALTRKEIHYGSYATAEQVNAAGDLCAICQEKMHAPILLRCKHIFCEECVSEWFERERTCPLCRVLIKTADIKSYGDGSTSLFFQLF

SEQ ID NO: 9059 - protein, 333 aa, Lotus japonicus
RVRVAMSAEDRRAFAADNVPLVALPNAISGIPRDSSSPYGRLDVQQIAKWGEQILPFALLLLIVFVRQHWQGFFVTICASAVMFKSNEIVKKQTALKGDRKVSVLLSIAFAFMFYVMCIYWWHCNDDLLSPLAMVPSKATPPFWHTIFIVLVNDTLVRQATMAFKCLLLIYYKDSRGHNFRRQAQMLTLVEYTLLLYRALLPTPVWYRFFLNKEYGSLFSSLTTGLYLTFKLTSVVEKVRCFFSALKALSKHEVHYGAYATMEQVNAAGNLCAICQEKMHSPILLCCKHMFCEECVSEWFERERTCPLCRASVKPADLQTFGDGSTSLFFQLF

SEQ ID NO: 9060 - protein, 449 aa, Mimulus guttatus
MEASSSDATNMESSPPSSTSNGGSSSRILHNLPYMRFLQSPVSSLLEYSGILRVRPDYPYSETRPLIPENVAPTLNSQNPSNSQSIDAVDGGGSGNGEVSIRIIGEREQDNRIGDNGENDVSRAGLGAEEDSTVGGEDVNGSSDGDSSNREGSTYQRYDIQQAARWIEQILPFSLLLLVVFIRQHLQGFVVAIYITAILFKSNDILRKQTSLKGERKISVLIGYSVLFMFHILGIYWWHKKNAFFNSLLMIPPNAIPPFWHALFIILVNDTMVRQASMVLKLAVMMYYKNGRGHNFRRQGQMLTLVEYTTLLYRALLPTPVWYRFFLNKEYGSLFSSLTTGLYLTFKLTSIVDKVQSFVASLRALSRKEIHYGSYATPEQVSAAGDLCAICQEKMHTPILLRCKHVFCEDCVSEWFERERTCPLCRALVRAADLRSYGDGSTNLLFQLF

SEQ ID NO: 9061 - protein, 448 aa, Populus trichocarpa
MEICGEGNSGEIYRNSSLGSSSVGGGGDGYSNNPRRYGINIAASNLIHAPLTTLLEYSGILGGSTSSYSQEREQLISSPSTATGGGGGHQEVTIRIIGSAENDHDDEPNASPNVEALPYGQRGGVVEGNANTESSISDGSSGIATDSSSSSSSYQRYDIQNLARWIEHVLPFSLLLLLVFVRQHLQGFCAALWIAAVLFKSNDILRRQTALKGERKKSVLLGMTVVLILHVMSIYWWYRNADLLYPLVLLPPSTIPPFWHVLFIIIVNDALVRQVAMVFKCMLLLFYKNSRGHNYRKQGQMLTLVEYFLLLYRALLPTPVWYRFFLNREYGSFFSSLVTGLYLTFKLTTVLRKVQLFFTALRTLSHKEMYYGSYATSEQVNAVGDLCAICQEKMHAPILLRCKHIFCEDCVSEWFDRERTCPLCRALVKSADIKSYSDGSTSLFFQLF

SEQ ID NO: 9062 - protein, 121 aa, Primula obconica
SNNSRSRNYRRQGQMLTLVEYFLLLYRALLPAPVWYRFFLNEEYGSLFSSLMTGLYFTFKLTSVVEKVQFFFAALKALSRKDIHYGSHATSEQVIAAGDLCAICQEKMHTPILLRCKHIFL

SEQ ID NO: 9063 - protein, 183 aa, Vigna unguiculata
MVNDTLVRQAAMVVKCMLLMYYKNSRGRNYRKQGQMLTLVEYLLLLYRALLPTPVWYRFFLNKEYGSLFSSLMTGLYLTFKLTSVVEKVQSFFAAVKALSRKEMHYGAYATSEQVNAAGDLCAICQEKMHAPILLRCKHIFCEDCVSEWFERERTCPLCRALVKPADLRSFGDGSTSLFFQLF

SEQ ID NO: 9064 - protein, 324 aa, Brassica juncea
SQTTEGLGSSSAGTGEGASTGESVGGDAAASRDSPYQRYDIQQAARWIEQILPFSLLLLVVFIRQHLQGFFVAIWIAAVMFKSNDIMKKQTALKGERQISALIGISVAFAAHVVGVYWWFRKDDLLYPLIMFPPKSIPPFWHAIFIIVVNDTLVRQASMIFKCFLLIYYKNSRGRNYRKQGQLLTLVEYLMLLYRSLLPTPVWYRFFLNKDYGSLFSSLMTGLYLTFKLTSVVEKVQSFFTALKSLSRKEVHYGSYATTEQVNAAGDLCAICQEKMHTPVLLRCKHMFCEDCVSEWFERERTCPLCRALVKPADLKSFGDGSTS

SEQ ID NO: 9065 - protein, 145 aa, Helianthus annuus
GNGNGNGDGNSEVSIRIMSGGDHEEERGEAETVDRGDGGGEREVSGSGDVSGVNGNDSNGNGRGNVDSVYQQRYDLQQVSRWIEQILPFSLLLLVVFVRQHLQGIFVTLYITAFMYKSNDILRKQTALKNFCRGRESYLFLLDIA

SEQ ID NO: 9066 - protein, 437 aa, Helianthus annuus
METTGVNINTTTSDASVSNNNSIPPSSNPLSPRITSSTISPRRTTSSESFPVIRFLQAPVTTVLEYSGVLRPRSNPEYHESESLNHDHHDHDHGSGDLGTGVGSSGEVSIRIIGEEGRGESVAVNGGDGGTGEREMADSSDVDGSGSRGDSSSQQRYDMQQVSRWIEQILPFSLLLLIVFIRQHLQGFFVTIYVTAFMYKSNDILQKQTALKGERKLSVLGGYFVVFVLHVIGVYWWYQNDDLCYPLFMVPPRAIPPFWHAIFTIIVNDTMVRQAAMAIKLVLLMYYRNGKGHNFRRQGQMLTLVEYALLLYRAFLPAPVWYRFFLNKEYGSLFSSLTTGLYLTFKLTSIVEKVGSVWTALKALSRKEVHYGSYATPEQVIEAGDLCAICQEKMQAPVLLRCKHIFCEDCVSEWFEKRKDVPVMQICGEASRVTFIR

SEQ ID NO: 9067 - protein, 465 aa, Lactuca sativa
MRRLMETTGVSVDPTSSDNHATNSPNSSNPTSPTMRRISSSSSSPRAMSSSPFPIIRFLQAPVTTIIEYSGVLRPRSNTDYHESESLISNHHHRDHNSSGSGTASNRSSNDENSNGEVSIRIMGGADQEEEHGEPVAVNREDGGGEREVADSGDGSGGNGGSNNNVDSAYQQRYDLQQVSRWIEQILPFSLLLLIVFIRQHLQGLFVTIYITAFMYKSNDILRKQTALKGERKLSVLAGYCIVFMLHVIGVYWWYQNDDLCHPLFMVPPKEIPPFWNAIFTIIVNDTMVRQAAMGFKLVLLMYYKNGRGHSFRRQGQMLTLVEYTLLLYRAFLPAPVWYRFFLNKEYRSLFSSLTTGLYLTLKLTSVVEKIGSFYAALKALSRKEVNYGSYATAEQVSEAGDLCAICQEKMQAPILLRCKHIFCEDCVSGWFERERTCPLCRALVRPADIRSFGDGSTSLFFQFF

SEQ ID NO: 9068 - protein, 195 aa, Helianthus annuus
TIPPFWHAIFIIIVNDTMVRQAAMTLKLVLLMYYKNGRGHNFRRQGQMLTLVEYALLLYRAFLPAPVWYRFFLNKEYGSLFSSLITGLYLTFKLTSVVEKVGSFYAALKALSRKEMHYGSYATSEQVSEAGDMCAICQEKMQAPVLLCCNHIFCEDCVSEWFERERTCPLCRALVRPADIRSFGDGSTSLFFRLF

SEQ ID NO: 9069 - protein, 448 aa, Helianthus annuus
METTGVSVDTTTSDASVSNNNSIPPSSNPLSPRITSSTISPRRTTSSESFPVIRFLQAPVTTVLEYSGVLRPRSNPEYHESESLNHDHRDHDHGSGDLGTGVGSSGEVSIRIIGEEGRGESVAVNGGDGGTGEREMADSSDVDGSGSRGDSSSQQRYDMQQVSRWIEQILPFSLLLLIVFIRQHLQGFFVTIYVTAFMYKSNDILQKQTALKGERKLSVLGGYFVVFVLHVIGVYWWYQNDDLCYPLFMVPPRAIPPFWHAIFTIIVNDTMVRQAAMAIKLVLLMYYRNGKGHNFRRQGQMLTLVEYALLLYRAFLPAPVWYRFFLNKEYGSLFSSLTTGLYLTFKLTSIVEKVGSVWTALKALSRKEVHYGSYATPEQVIEAGDLCAICQEKMQAPVLLRCKHIFCEDCVSEWFERERTCPLCRSVVKPAELRSFGDGSTSLFFQLF

SEQ ID NO: 9070 - protein, 50 aa, Nicotiana tabacum
MNAPILLRCKHIFCEDCVSEWFDRERTCPLCRALVRPADLKSFGDGSTSL

SEQ ID NO: 9071 - protein, 153 aa, Vaccinium corymbosum
VRQGQMLTLVEYTLLLYRALLPTAVWYRFFLNKEYGSLFSSLTTGLYLTFKLTSVVEKVQSFFAALKALSRKDINYGSYATLEQVNAAGDLCAICQEKMHAPILLRCKHIFCEDCVSEWFERERTCPLCRALVRPADLRSFGDGSTSLFFQLF

SEQ ID NO: 9072 - protein, 493 aa, Cucumis sativus
METSPSNSDPYSNSSSPTTARSSSRFALSLPSLNFFRSPLSVILDYSGILPTRAVRHESDPVINAAATPDLRVFSQNQNHLIHTSSPSSSPSSVTTSSVTTSSANTIPSGEVSIRIIGSGEQDPSPRALLPNQVVYEQNGRLPVSGDQPESPDEERVPLVSTTSSSIQPGGTRVDGESGNGMEESVNRDSSYQRYDIQQVARWIEQILPFSLLLLIVFIRQHLEGFFITIWISAVMYKSNDIVKKQTALKGERRISVLAGTSITFLVHVIGIYWWCHSDDLLYPLVMLPPKTVPPFWHALFIILVNDTMVRQFAMALKCFLLIYYKNGRGHNFRRQGQILTLVEYTLLLYRALLPTPVWYRFFLNKDQGSLFSSLTTGLYLTFKLTSVVEKIQSFVTAFKALSQKEVHYGSYATSEQASTLILSVNAAGDLCAICQEKMNAPILLRCKHIFCEDCVSEWFERERTCPLCRALVKPAELRTFGDGSTSLLFQLF

SEQ ID NO: 9073 - protein, 444 aa, Helianthus annuus
MEPVGVGAATTNSDTSVANTTSNSSQTTSFQILRFLQAPVTTLFEYSGFLRPRLSNSNEYYESERLISRRSSSSLNDLGGAGSGSGSVGRNSENNDGEVSIRIIGDGEEEEGGDGGDNSDLDGRIGGGGDGSSGNNNNASDSSNQNQNQQRYDLQQVSRWIEQILPFSLLLIVVFIRQHLQGFFVTIYVTAFMYKSNDILRKQTALKGERKLSVLVGYSIIFMLHVVGVYWWYQNDDLSYPLFMVPPKTIPPFWHAIFIIIVNDTMVRQAAMTLKLVLLMYYKNGRGHNFRRQGQMLTLVEYALLLYRAFLPAPVWYRFFLNKEYGSLFSSLITGLYLTFKLTSVVEKVGSFYAALKALSRKEMHYGSYATSEQQVSEAGDMCAICQEKMQAPVLLCCNHIFCEDCVSEWFERERTCPLCRALVRPADIRSFGDGSTSLFFRLF

SEQ ID NO: 9074 - protein, 180 aa, Tripterygium wilfordii
DTLVRQAAMMLKCILLIYYKNRRGRNYRRQGQMLTLVEYLMLLYRALLPTPVWYRFFLNKDYGSLFSSLMTGLYLTFKLTSVVEKVQSFFTALKALSHKEVHYGAYATTEQVNAAGDLCAICQEKMLVPVLLRCKHIFCEDCVSEWFERERTCPLCRALVKPADLRSFSDGSTSLFFQIF

SEQ ID NO: 9075 - protein, 486 aa, Musa acuminata
METPGGDSDPYGSRFPSSSAGGGISGGPSRRYRVPFSANLIHAPLSALLEYSGILRPGASQSETESLIPLPELNLAQVDESSVSAVADRGEVSIRIIGSGDQESLRMASTQPQPSTAWSGGQGNSGGRGVSGESNPAFSERHRGGDGGSNSGVGEAASSSASSVSASIAAVDGPSTDAEASMTGGRNRDSSYQRYDIQQVARWIEQILPFSLLLLVVFIRQHLQGFFVTIWISAVMFKSNDILKKQTALKGERKLTVLVGTAFFSMLHIFGIYWWYRNDDILYPLIMFSPKAIPQFWHAIFIILVNDIMVRQAAMVVKCILLVYYKDRKGRNYRQQCQMLTLVEYLLLLYRSFLPTPVWYRFFLNKEYGSFFSSLTTGLYLTLKLTSAVEKVQSFISAFKALSCKDVSYGSYATAEQVITAGDMCAICQEKMHAPILLRCKHIFCEDCVSEWFERERTCPLCRAVVKPAGLRSFGDGSTSLFYQLF

SEQ ID NO: 9076 - protein, 466 aa, Lactuca sativa
METVGVGVATTNSDSYTGNISNSVSSDSSSPTTRGAGGGISSSRRSTSSSAFPIVRFLQAPVTTLFEYSGFLRPRSSNDNHESESLIPHHHNHSSSDSSTASSSDGSNNEGEVSIRIMGDGEQEEGHGDDGGESAVIGGDGGGREREMADSSDVDVRSGANGSNNNSDSSNQQRYDLQQVSRWIEQILPFSLLLIVVFIRQHLQGFFVTIYVTAFMYKSNDILRKQTALKGERKLSVLIGYGIIFTLHVIGVYWWYQNDDLSSPLLMVPPKSIPPFWHAIFIIIVNDTMVRQAAMTLKLVLLMYYKNGRGHNFRRQGQMLTLVEYALLLYRAFLPAPVWYRFFLNKEYGSLFSSLITGLYLTFKLTSIVEKVGSFYAAMKALSRKEMHYGSYATSEQVSEAGDMCAICQEKMQAPILLCCNHIFCEDCVSEWFERERTCPLCRALVRPADIRSFGDGSTSLFFRLF

SEQ ID NO: 9077 - protein, 251 aa, Ambrosia trifida
MYKSNDILRKQTALKGERKLSVLAGYCVLFMLQVAGVYWWYQNDDICNPLFMMPPKAIPSFWNAVFTIVVNDTMVRQAAMAFKLVLLMYYKNGRGHSFRRQGQILTLVEYTLLVYRAFLPAPVWYRFFLNKEYGSLFSSLTTGLYLTLKLTSVVEKIGSFYAALKALSRKEVNYGSHATAEQVSEAGDVCAICQEKMQAPILLRCKHIFCEDCVSEWFERERTCPLCRALVRPADIRSFGDGSTSLFFQLF

SEQ ID NO: 9078 - protein, 434 aa, Ambrosia trifida
METSAAGVVGVASTDNSNSVSSQTTSSQIIRFLQSPVTSLFEYSGFLRPRLINSNTNSNEYHRSVSLSDLSGVVGDSVARNNDNNDGQVSIRIIGEGDEERGDADGAGSNSGLDINNNNNNNDNNNNDNDNNGGDSSNQQQRYDLQQVSRWIEQILPFSLLLIVVFIRQHLQGFFVTIYVTAFMYKSNDILRKQTALKGERKLSVLVGYSVIFMLHVVGVYWWYQNDDLSYPLFMVPPKTIPPFWHAIFIIIVNDTMVRQAAMTLKLVLLMYYKNGRGHNFRRQGQMLTLVEYALLLYRAFLPAPVWYRFFLNKEYGSLFSSLITGLYLTFKLTSVVEKVGSFYAALKALSRKEMHYGSYATPEQVSEAGDMCAICQEKMQAPILLCCNHIFCEDCVSEWFERERTCPLCRAMVRPADIRSFGDGSTSLFFRLF

SEQ ID NO: 9079 - protein, 166 aa, Centaurea maculosa
WWDASSSIRGVTDSVSGNADAEAAEGVGVNNGRESPYQRYDIQQAARWAEQVLPFSLLLLVVFIRQHLQGFFVTIWITAFMFKSNDMLRRQTALKGERRILSLASISLLFMLHVAGVYWWYRKDDLLYPLVMLPPKTIPPFWHAIFIVMVNDTLVRQAAMVLNAFC

SEQ ID NO: 9080 - protein, 461 aa, Flaveria ramosissima
METSGVSVDSTSSDNHVNNNPNSSNPPSPTVRRSSSPRTTTMTTSSSPFPIIRFLQAPVTTLIEYSGVLRPRSNSDGQESESLISNHRRRDHSSSGSSAASNRSSTGDDGNGEVSIRISSGGGQEEGRVEPTPVNTVDGGGEREAADSGGESGENGGSNNNVDSAYQQRYDLQQVSRLIEQILPFSLLLLIVFVRQHLQGIFVTIYITAFLYKSNDILRKQTALKGERKLSVLAGYCILFILQVIGVYWWYQNDDLCNPLFMLPPKAIPPFWNAIFTIIVNDTMVRQAAMAFKLVLLMYYKNGRGHSFRRQGQILTLVEYALLLYRAFLPAPVWYRFFLNKEYGSLFSSLTTGLYLTLKLTSVVEKIGSFYAALKALSRKEVNYGTHATAEQVSEAGDVCAICQEKMQAPILLRCKHIFCEDCVSEWFERERTCPLCRALVRPADIRSFGDGSTSLFFQLF

SEQ ID NO: 9081 - protein, 174 aa, Triphysaria pusilla
SAMFSKLFLLMYYKNGKGHNFRRQGQLLTLMEYTLLLYRALLPTPVWYRFFLNKEYGSLFSSLTTGLYLTFKLTSIVEKVQSFVMSLKALSRKEIHYGFCATSEQVNAAGDLCAICQEKMHAPILLRCKHIFCEDCVSEWFERERTCPLCRALVRPAELRSYADGSTNLSIQLF

SEQ ID NO: 9082 - protein, 460 aa, Cirsium arvense
METVGGVGVSTANSDAYATNSSSVSSNPPSPTARASSSSRRVSSSSSFPIVRFLQAPVTTIFEYSGFLRPRSSSSEYHESEGLIPHSRGSVDSGDVSSSGGNEGEVSIRIIGDGEQEGEHGGESGGVDGDGGGREMDDSSDVDGRSGGGNGSSNNNSNGGDSSNQQRYDLQQVSRWIEQILPFSLLLIVVFIRQHLQGFFVTIYVTAFMYKSNDILRKQTALKGERKLSVLVGYSIIFMLHVIGVYWWYQNDDLSYPLFMVPPKAIPPFWHAIFIIIINDTMVRQAAMTIKLVLLMYYKNGRGHNFRRQGQMLTLVEYGLLLYRAFLPAPVWYRFFLNKEYGSLFSSLITGLYLTFKLTSVVEKVGSFYAALKALSRKEMHYGSYATSEQVSEAGDMCAICQRKRCNAPILLCCNHIFCEDCVSEWFERERTCPLCRALVRPADIRSFGDGSTSLFFRLF

SEQ ID NO: 9083 - protein, 172 aa, Helianthus annuus
MAFKLVLLMYYKNGRGHSFRRQGQILPLVEYTLLLYRAFLPAPVWYRFFLNKEYGSLFSSLTTGLYLTLKLTSAVEKIGSFYAALKALSKKEVNYGSHATAEQVSEAGDVCAICQEKMQAPILLRCKHIFCEDCVSEWFERERTCPLCRALVRPADIRSFGDGSTSLFFQLF

SEQ ID NO: 9084 - protein, 206 aa, Ambrosia trifida
METSGVSVVDSTTSDNNNNINNNNNHESNNQNSSNPSSPTIRRSSLQTTSFPVIRFLQAPVTTLIEYSGVLRPRSTNDYQESESLIANHHSPSDVNSSNGDNGNDEVSIRISSGGGQGEEHSEPNSVNRVDNGGGGDREGSDSGDVSGGNGGGTSIIIIIMWIRRINNGMICSKFRGGLNKFFRFRCCCWSFSFVSTYMVSLLQYI

SEQ ID NO: 9085 - protein, 251 aa, Ambrosia trifida
MYKSNDILRKQTALKGERRLSVLIGYSMIFMFHVVGVYWWYQNDDLSYPLLMVPPKTIPPFWHAIFIIIVNDTMVRQAAMTLKLVLLMYYRNGRGHNFRRQGQMLTLVEYTLLLYRAFLPAPVWYRFFLNKEYGSLFSSLITGLYLTFKLTSVVGKVGSFYAALKALSRKEMHYGSYATPEQVNEAGDMCAICQEKMQAPILLCCNHIFCEDCVSEWFERERTCPLCRALVRPADIRSFGDGSTSLFFRLF

SEQ ID NO: 9086 - protein, 455 aa, Ceratodon purpureus
MESSGSIPEVHRSSSSSRRYGMQLTSANFLPAPLSALLEFTGLMRGRAHQSESEQEVAMSTGSVGQNSDGERAGDGGAEVSIRIFGVGEPEQVRVASSPAVLNARSSTDLSSQSLPTLLPMRIAGNESSPNTAISPHSSSAEERGEASDTEAAGNGREAASQRYDFQQLARWIEQALPFTILLLMVFIRQHLQGFFVAFWITAVMFKANDVLRKQTALKNERKPPVLIALGWVLVVHIIGVYWWYSGDALWRPLILFPPRTIPPFWDAIFIIVVNDTVARQAAMVFKCGVLIYYKNSRGRNYRRQAQLLTLVEYVLLLYRALIPGPVWYRFFLNKNYGNLFSSLTTGLYLTFKLTSNLEKVQTFLAALRALSRREVQYGSYATSEEVLAAGDMCAICQEKMHAPISLRCKHIFCEDCVSEWFERERTCPLCRAVVKSAGLRSYGDGSTSLFIQLF

SEQ ID NO: 9087 - protein, 314 aa, Flaveria ramosissima
MADTSDVDGRSNGNSDSSNQQRYDLQQVSRWIEQILPFSLLLIVVFIRQHLQGFFVTIYVTAFMYKSNDILRKQTALKGERRLSVLIGYSMIFMLHVVGVYWWYQNDDLSYPLFMIPPKTIPPFWHAIFIIIVNDTMVRQAAMTLKLVLLMYYKNGRGHNFRRQGQMLTLVEYALLLYRAFLPAPVWYRFFLNKEYGSLFSSLITGLYLTFKLTSVVGKVRSFYAALKALSRKEMHYGSHATSEQVSEAGDMCAICQEKMQAPILLCCNHIFCEDCVSEWFERERTCPLCRALVRPADIRSFGDGSTSLFFRVF

SEQ ID NO: 9088 - protein, 430 aa, Flaveria ramosissima
METVATTNSDAYVSNSLNTSSTTASSSSFPVVRFLQAPVTTIFEYSGFLRPRSSNDYHESESLISPNNIHNPSDSGGNEGDVSIRIMGDGEQEEEHGGDGGESVVLGGDGGGGEREMADSSHVEGRSNGNSESSNQQRYDLQQVSRWIEQILPFSLLLIVVFIRQHLQGFFVTIYVTAFMYKSNDILRKQTALKGERRLSVLIGYSMIFMLHVVGVYWWYQNDDLSYPLFMIPPKTIPPFWHAIFIIIVNDTMVRQAAMTLKLVLLMYYKNGRGHNFRRQGQMLTLVEYALLLYRAFLPAPVWYRFFLNKEYGSLFSSLITGLYLTFKLTSVVGKVRSFYAALKALSRKEMHYGSHATSEQVSEAGDMCAICQEKMQAPILLCCNHIFCEDCVSEWFERERTCPLCRALVRPADIRSFGDGSTSLFFRVF

SEQ ID NO: 9089 - protein, 485 aa, Lotus japonicus
METLDGNSDQYATVSSNSPSSSSGGFNSSDDHNNGSVSWYGMRLPSVNPLRSPLSLLLDYSGILTQTHDSGSVIVNNGVPASEIRSQVQMQPFDDAVGGSAGEVAIRIIGAGEHDQNQIGEVGFDGCDNLMGERRGAGMSPLDDDPEGRGGAAVNETVPLVSSSASLAGSVQGDGDAAGNGAESDSRGSSSYQRYDIQQVAKWIEQILPFSLLLLIVFIRQHLQGFFVTIWISAVMFKSNEIVKKQTALKGDRKVSVLVGISFAFILQVTCIYWWYRNDDLLYPLIMLPPRPTPFWHSVFIILVNDVLVRQAAMVFKCFLLIYYKNGKGHNFRRQAQMLTLVEYMLLLYRALLPTLVWYRFFLNRDYGSLFSSLTTGLYLTFKLTSIIEKVRGFISAFKALSRKDVHYGVYATMEQVNAAGDLCAICQEKMHSPVLLRCKHIFCEECVSEWFERERTCPLCRALVKPADLQTFGDGSTSLFFQLF

SEQ ID NO: 9090 - protein, 189 aa, Utricularia gibba
MRYFIILVNDTMVRQAAMVLKLVILMYYRNGRGHSFRKQGQMLTLVEYALMLYRALLPTPIWYRFFLNKEYGNLFSSLITGLYLTFKLTSVVEKVRSFFISLKALSRKEIHYGSYATLEQVNAAGDMCAICQEKMHSPILLRCKHIFCEDCVSEWFERERTCPLCRALVRPADIRSYGDGSTTLFFQFF

SEQ ID NO: 9091 - protein, 148 aa, Malus domestica
MLTLVEYLLLLYRALLPTPVWYRFFLNKEYGSLFSSLMTGLYLTFKLTSVVEKVQSFFAALKALSRKEVHYGAYATSEQVNAAGDLCAICQEKMHAPILLRCKHIFCEDCVSEWFERERTCPLCRALVKPADLRSFGDGSTSLFFQLF

SEQ ID NO: 9092 - protein, 179 aa, Eschscholzia californica
TMVRQAAMVLKCAVLIYFKNSRGHNYRKQGQMLTLVEYMLLLYRALLPAPVWYRFFLNKEYGSLFSSLTTGLYLTFKLTSVVEKVQSFFAALKALSRKEVHYGSYATTEQVIAAGDLCAICQEKMQAPVLLRCRHIFCEDCVSEWFERERTCPLCRALVKPADIRSFGDGSTSLFFQLF

SEQ ID NO: 9093 - protein, 210 aa, Cannabis sativa
MDLYVILCTCLCFGFHYCLLIPTLAVALSLDTLVRQVAMAFKCLLLIYYKNGRGYNFRRQGQLLTLLEYALLLYRAFLPTPVWYRFFLNKENGSLFSSLTTGLYLTFKLTSIVEKVQFFFAAAKALTRKELQFGSHATPEQVNAAGDLCAICQEKMHAPILLRCKHIFCEDCVSEWFERERTCPLCRAMVKPPDLRTFGDGSTNLLFQLF

SEQ ID NO: 9094 - protein, 473 aa, Cannabis sativa
MEVSGNASEPYENSGSPRRGGVGGGMLNHLPPLSLFHSPLSFLLEYSGILPVRSTHRDSEEEAVNSVGAVTPDSPPTSPAPCAAGGTSGGDSAEVSIRIIGGGEQEDRSISSPRRSGEGGVDGDGSLRMHELDDQPGSARVGSGAGVAEASGRAPLVSPSSSVPVSRSGVSSLQDESSSQSYDIQQIAKWIEQILPFSILLLVVFIRQHLLGFFVTIWISAVMFKSNDIVRRQTALKGERKTYVLLGIFSAFMLHVVGIYWWFQNDDLLYPLVMLPPKAIPPFWHAIFIVLVNDTLVRQVAMAFKCLLLIYYKNGRGYNFRRQGQLLTLLEYALLLYRAFLPTPVWYRFFLNKENGSLFSSLTTGLYLTFKLTSIVEKVQFFFAAAKALTRKELQFGSHATPEQVNAAGDLCAICQEKMHAPILLRCKHIFCEDCVSEWFERERTCPLCRAMVKPPDLRTFGDGSTNLLFQLF

SEQ ID NO: 9095 - protein, 295 aa, Helianthus annuus
QQRYDLQQVSRWIEQVLPFSLLLIVVFIRQHLQGFFVTIYVTAFMYKSNDILRKQTALKGERRLSVLIGYSMIFMFHVVGVYWWYQNDDLSYPLFMIPPKTIPPFWHAIFIIIVNDTMVRQAAMTLKLVLLMYYRNSRGHNFRRQGQMLTLVEYALLLYRAFLPAPVWYRFFLNKEYGSLFSSLITGLYLTFKLTSVVGKVGSFYAALKVLSRKEMHYGSYATPEKVSEAGDMCAICQEKMQAPILLCCNHIFCEDCVSEWFERERTCPLCRALVRPADIRSFGDGSTSLFFRLF

SEQ ID NO: 9096 - protein, 249 aa, Ambrosia trifida
KSNDILQKQTALKGERKLSVLAGYFVVFVLHVIGVYWWYQNEDLCYPLFMVPPRAIPPFWHAIFTIIVNDTMVRQAAMAIKLVMLMYYRNGKGHNFRRQGQMLTLVEYAFLLYRAFLPAPVWYRFFLNKEYGSLFSSLTTGLYLTFKLTSIVEKVGSLWTALKALSRKEVHYGSYATPEQVIEAGDLCAICQEKMQAPVLLRCKHIFCEDCVSEWFERERTCPLCRSVVKPAELRSFGDGSTSLFFQMF

SEQ ID NO: 9097 - protein, 192 aa, Flaveria ramosissima
NTTILACYIYHHVNDTMVRQAAMAIKLVLLMYYRNGKGHNFRRQGQMLTLVEYASLLYRAFLPAPVWYRFFLNKEYGSLFSSLTTGLYLTFKLTSIVEKVGSLWTAMKALSRKDVHYGSYATPEQVIEAGDLCAICQEKMQAPVLLRCKHIFCEDCVSEWFERERTCPLCRSVVKPADIRSFGDGSTSLFFQ

SEQ ID NO: 9098 - protein, 251 aa, Helianthus annuus
MYKSNDILRKQTALKGERRLSVLIGYSMIFMFHVVGVYWWYQNDDLSYPLFMIPPKTIPPFWHAIFIIIVNDTMVRQAAMTLKLVLLMYYRNSRGHNFRRQGQMLTLVEYALLLYRAFLPAPVWYRFFLNKEYGSLFSSLITGLYLTFKLTSVVGKVGSFYAALKVLSRKEMHYGSYATPEKVSEAGDMCAICQEKMQAPILLCCNHIFCEDCVSEWFERERTCPLCRALVRPADIRSFGDGSTSLFFRLF

SEQ ID NO: 9099 - protein, 187 aa, Phaseolus coccineus
IFIIMVNDTLVRQAAMVFKCILLMYYKNSRGRNYRKQGQMLTLVEYLLLLYRALLPTPVWYRFFLNKEYGSLFSSLMTGLYLTFKLTSVVEKVQSFFAAVKALSRKEMHYGAYATLEQVNAAGDLCAICQEKMHAPILLRCKHIFCEDCVSEWFERERTCPLCRALVKPADLRSFGDGSTSLFFQLF

SEQ ID NO: 9100 - protein, 462 aa, Lactuca sativa
METTGLSVDTTNSDAYETDNLASSNSLTPRITSRSSSSRRMTPSSSFSVIRFLQAPVTTVLEYSGVLRPRSNNDYHESESLIHDHHHHHDARSSSDSDTATSSNGDNGEVSIRIIGAVDPEEQHGGEGGEPVALNGGDNDGGEREMADSTDVDGENGRSGSHSDSSYQQRYDMQQVSRWIEQILPFSLLLLIVFIRQHLQGFFVTVYVTAFMYKSNDILRKQTALKGERRLSVLGGYFIVFILHVIGVYWWYQNDDLCYPLFMVPPRAIPPFWHAIFTILVNDTMVRQTAMAFKLVLLMYYKNGKGHNFRRQGQMLTVIEYALLLYRAFLPAPVWYRFFLNKEYGSLFSSLTTGLYLTFKLTSIVEKVGSFWTALKALSRKEVHYGSYATPDQVIEAGDMCAICQEKMQAPVLLRCKHIFCEDCVSEWFDRERTCPLCRAVVKPAEIRSYGDGSTTLFFQLF

SEQ ID NO: 9101 - protein, 160 aa, Ambrosia trifida
MAGGHSFRRQGQLFTLVEYTLLLYRAFLPTPIWYRFFLNKEYGSLFSSLITGLYLTLKLTSVVEKIGSFYAALKALSRKEVNYGSHATAEQVSEAGDLCAICQEKMQAPILLRCKHIFCEDCVSEWFERERTCPLCRALVRPADIRTFGDGSTSLFFQVF

SEQ ID NO: 9102 - protein, 464 aa, Arnica chamissonis
MERIGVSVDTTSSDAFVSDNLASLNPLSQSSGITSRTNSSRRTTSSSSFPLIRFLQAPVTTVLEYSGVLRPRSTNDYHESESLIHDRHHNHDTRSSSDSDTATSSNGDNGEVSIRIIGAADREQEHGADGGEPVAVNAGDGGRGGGETADSSDADGGNGESGSHSDSSYQQRYDMQQVSRWIEQILPFSLLLLIVFIRQHLQGFFVTIYVTAFLYKSNDILRKQTALKGERRLYVLAGYFVVFVLHVIGVYWWYQNDDLCYPLFMVPPRSIPPFWHAIFTIIVNDTMVRQTAMAFKLVLLMYYRNGKGRNFRRQGQMLTLVEYALLLYRAFLPAPVWYRFFLNKEYGSLFSSLITGLYLTFKLTSIVEKVRSLWTAFKALSRKEVHYGSYATPEQVTEAGDMCAICQEKMQTPVLLRCKHIFCEDCVSEWFERERTCPLCRSVVKPADIRSFADGSTSLFFQWF

SEQ ID NO: 9103 - protein, 172 aa, Arnica chamissonis
MTLKLVLLMYYKNGRGHNFRRQGQMLTLVEYALLLYRAFLPAPVWYRFFLNKEYGSLFSSLITGLYLTFKLTSVVEKVGSFYAALKALSRREMHYGSYATSEQVSGTGDMCSICQEKMRAPILLHCNHIFCEDCVSEWFERERTCPLCRALVRPADIRSFADGSTSLFLRLF

SEQ ID NO: 9104 - protein, 386 aa, Cicer arietinum
MFPSTRPRFRASSDSDSEEVLLRNGVVRGNSSSPRNRVGELNCNDVIGGGRGMLLSEEARRAIAEERVPLASLASVVGGGGGGGDRDSSSTRPRFDFQQIAKWVEQILPFSLLLLVVLIRQHLQGFFVTISVSAVMFKSNEIVKKQTALKGDQKVSALLGVSFVFMLYVICIYWWYRNDDLLYPLALFPPKATPPFWHTIFIILVNDILVRQAAMAFKCLLLIYYKNSRGHNFRQQGQMLTLVEYTLLLYRAFLPTPVWYQFFFNKDYGSLFSSLITGLYLTFKLTSAVEKVQCFICALKALSKKEIHYGVYATTEQVNAAGDLCAICQGKMHDPILLCCKHMFCDECVSEWFEREWTCPLCRKSVKPADLRTFGDGSTSLFFQLF

SEQ ID NO: 9105 - protein, 227 aa, Citrus sinensis
MIFIGFMFQVIGIYWWFRSDDILYPLLMIPPSTIPPFWHAVFIILVNDTMVRQAAMAMKCLLLIYYKNGRGHNFRRQGQILTLVEYALLLYRALLPTPVWYRFFLNKDYGSLFSSLTTGLYLTFKLTTVVDKVQSLFAAIRALSRKEVHYGSYATTEQVNAAGDLCAICQEKMHAPILLQCKHLFCEDCVSEWLEKKRTAHYAKLWLTLLDLRFFGDGLTSLVFPLF

SEQ ID NO: 9106 - protein, 484 aa, Phalaenopsis aphrodite
METSGRESDPYRTSGAVANGGRSRSYAMQLSTSSFIQALTAFLEYSGVLRSQSSNHRGSESFLSGEANGGPVEHASGRRELFSSSSAGGDGEVLIRIIVPGDHDGVRAGGQGPAPPSARVRATGENSAPVEEIPTASDDSGLGDDGGSEYGAREVDGSPPSQLPSVLPANTQRSDGEGTLGGANSSESSYQRFDIQQLAKWVEQILPFSLLLLVVFIRQHLQGFFVTIWIAAVMFKSNDILRKQTALKGERKMLVLVVITVVFMLHVFGVYWWYRNDDLLNPLVLLPPKEIPPFWHAIFIILVNDTMVRQAAMVLKCVVLMCYRNNRGRSYRKQGQMLTLLEYFLFLYRALLPAPVWYRFFLNKEYGSFFSSLITGLYLTIKLTTIVDKIHSFLAAVKSLSCKDVHYGSHATAEQVIIAGDLCAICQEKMQTPILLRCKHIFCEDCVSEWFDRERTCPLCRALVKPAGLRSFGDGSTTLFFQLF

SEQ ID NO: 9107 - protein, 193 aa, Utricularia gibba
PLSWHAVFVIVVNDALVRQAAMVIKLLILMYYKNSRGQSFRKQGQMLTLVEYGLLLYRTLLPAPIWYRFFLNKEYGSLFSSLITGLYLTFKLTAVVEKVRSLVISVKVLSRKEVHYGAYATSEQVNAAGDMCAICQEKMRTPVLLRCKHIFCDDCVSEWFERERTCPLCRALVRPADLRSYGDGSTTLFFQLF

SEQ ID NO: 9108 - protein, 182 aa, Zea mays
MCDLVARTGRHQQRYEDGRRLVAGCIPFRYRANNDETSGDKTKKLVEVLMINSQSGPGLLFPKGGWENDETVEEAAAREAIEEAGVRGDIVHFLGLYDFKSKTHQDACCPEGMCRAAVFALHVKEELASWPEQSTRQRTWLTVPEAASSCRYQWMQEALLTGFSDWHDKWSRGGGGTNCDPA

SEQ ID NO: 9109 - protein, 182 aa, Setaria italica
MCDLVARTGRHQQRYEDGRRLVAGCIPFRYRANNDETSDDKHKKLVEVLMINSQSGPGLLFPKGGWENDETVEEAAAREAIEEAGVRGDIVHLLGFYDFKSKTHQDACCPEGMCRAAVFALHVKEELTSWPEQSTRQRTWLTVPEAASQCRYQWMQEALLTGFSEWHDKWSRSGGGTNCDPA

SEQ ID NO: 9110 - protein, 188 aa, Zea mays
MCDLVARTGRHQQRYEDGRRLVAGCIPFRYRANNDETSGDKTKKVVEVLMINSQSGPGLLFPKGGWENDETVEEAAAREAIEEAGVRGDIVHFLGSYDFKSKTHQDACCPEGMCRAAVFALHVKEELNSWPEQSTRQRTWLTVPEAASRCRYQWMEEALLTGFSDWHDKWSIGDGGGGGANCVTRPNC

SEQ ID NO: 9111 - protein, 183 aa, Oryza sativa
MCDLVARTGRHQQRYEDGRRLVAGCIPFRYRTSNDETSDDEPKKIVEVLMINSQSGPGLLFPKGGWENDETVEQAAAREAVEEAGVRGDIVQFLGFYDFKSKTHQDACCPEGMCRAAVFALHVKEELDSWPEQSTRRRTWLTVPEATSQCRYQWMQEALLTGFSDWHDNWSKGGGGDTNYDSL

SEQ ID NO: 9112 - protein, 68 aa, Secale cereale
GRRDGAQEERAGGGGGGGQGSMCDLVARTGRHQQRYEDGRRLVAGCIPFRYRADETSGDEQKKLLKFS

SEQ ID NO: 9113 - protein, 179 aa, Triticum aestivum
MCDLVARTGRHQQRYEDGRRLVAGCIPFRYRADETSGDEQKKVVEVLMINSQSGPGLLFPKGGWENDETVEQAAAREAIEEAGVRGDIVQFLGFYDFKSKTHQDACCPEGMCRAAVFALHVKEELASWPEQSTRRRTWLTVPEATSQCRYQWMQEALLTGFSEWHDNWSKGGSAGGDPI

SEQ ID NO: 9114 - protein, 180 aa, Hordeum vulgare
MCDLVARTGRHQQRYEDGRRLVAGCIPFRYRVDETSGDEQKKAVEVLMINSQSGPGLLFPKGGWENDETVEQAAAREAIEEAGVRGDIVQFLGFYDFKSKTHQDACCPEGMCRAAVFALHVKEELASWPEQSTRRRTWLTVPEATSQCRYQWMQEALLTGFSEWHDNWSKSDGGGGGNPV

SEQ ID NO: 9115 - protein, 179 aa, Leymus cinereus x Leymus triticoides
MCDLVARTGRHQQRYEDGRRLVAGCIPFRYKVDETSGDEQKKVVEVLMINSQSGPGLLFPKGGWENDETVEQAAAREAIEEAGVRGDIVQFLGFYDFKSKTHQDACCPEGMCRAAVFALHMKEELASWPEQSTRRRTWLTVPEATSQCRYQWMQEALLTGFSEWHDNWSKSGGGGGDPI

SEQ ID NO: 9116 - protein, 163 aa, Panicum virgatum
SLVAGCIPFRYRTNNDETSDDEHKKLVEVLMINSQSGPGLLFPKGGWENDETVEEAAAREAIEEAGVRGDIVHLLGFYDFKSKTHQDACCPEGMCRAAVFALHVKEELTSWPEQSTRQRTWLTVPEAASQCRYQWMQEALLTGFSDWHDKWSRGGGGTNCDPA

SEQ ID NO: 9117 - protein, 158 aa, Pennisetum glaucum
CIPFRYRANNDETSDDKHDKLVEVLMINSQSGPGLLFPKGGWENDETVEEAAAREAIEEAGVRGDIVHLLGFYDFKSKTHQDACCPEGMCRAAVFALHVKEELTSWPEQSTRQRTWLTVPEAASQCRYQWMQEALLTGFSEWHDKWSRGGGGTNCDPA

SEQ ID NO: 9118 - protein, 152 aa, Saccharum officinarum
  misc_feature (126)..(126): Xaa can be any naturally occurring amino acid
MCDLVARTGRHQQRYEDGRRLVAGCIPFRYRANSDETSGDKTKKLVEVLMINSQSGPGLLFPKGGWENDETVEEAAAREAIEEAGVRGDIVETPRPRHTQGHQAYGGQAQHGAGDGCPTNCIFWGXMTSKARHIKMRAALRVCAELQCLRCM

SEQ ID NO: 9119 - protein, 182 aa, Oryza sativa
MCDLVARTGRHQQRYEHGRRLVAGCIPFRYKDNNDETSDDGHKKLVEVLMINSQSGSGLLFPKGGWENDETVEEAAAREAIEEAGVRGDLVQLLGFYDFKSKTHQDKFCPEGMCRAAVFALRVKEELASWPEQSTRKRTWLTLSEAVERSRYPWVREALTTGFTTWHENWSNGDDHVDPSSR

SEQ ID NO: 9120 - protein, 180 aa, Zea mays
MAGGGAPSAWGPSPALVTALVALLGLGLAAYIVGPQLYWHAAEVLTAAAACPACDCNCDARPLLDLPEDCAKHFKGVKSRASGEETEKSFTELLVEELKQREEEATQAQQEADVKLLEAKKLASQYQKEADKCSSGMDTCEETRENSAEALVQQKKLTSLWERRARELGWRPENAKARLK

SEQ ID NO: 9121 - protein, 178 aa, Setaria italica
MAGAGASSAWGPSPALVTALVALLGLGLAAYIVGPQLYWHAAEALTAAGACPACDCNCDARPLLDLPEDCAKQFKGVKSRATGEETEKSFTELLIEELRQREEEATQAQQEADVKLLEAKKLASQYQKEADKCSSGMDTCEEAREKSAEALVEQKKLTSLWEQRARELGWKPENTRHT

SEQ ID NO: 9122 - protein, 178 aa, Panicum virgatum
MAGAGAPSAWGPRPALVTALVALLGLGLAAYIVGPQLYWHAAEALTAAGACPACDCNCDARPLLDLPEDCAKQFKGVKSRASGEETEKSFTELLIEELRQREEEATQAQQEADVKLLEAKKLASQYQKEADKCSSGMDTCEEAREKSAEALVEQRKLTSLWEQRARELGWKPDNTRHT

SEQ ID NO: 9123 - protein, 183 aa, Oryza sativa
MAGGSTSSSSSWGPSPALVTAVVALLGLGLAAYIVGPQLYWHASEALGRSTGACPACDCDCDARPLLALPEDCSKQFKDVKSRASGEETEKSFTELLIEELKQREEEATQAQQQADVKLLEAKKLASQYQKEADKCSSGMDTCEEAREKSSEALVEQRKLTALWEERARELGWKPGNIKPHQT

SEQ ID NO: 9124 - protein, 180 aa, Brachypodium distachyon
MAGGPSSWGPSPAAVTALVALVGLGLAGYIVGPPLYWHVAEALGRSPGACPACACDCDALPLLSLPEDCGKQFKEVSSRASGEETEKSFTELLIEELKQREEEATQAQQQADVKLLEAKKLASQYQKEADKCSSGMDTCEEAREKSADSLLDQKKLTALWEERARELGWKPGNGKSHGNQ

SEQ ID NO: 9125 - protein, 340 aa, Zea mays
MTPTPTTTATRPASRPGSPTSAPPPPSAEDLDPNLKLLTGYMNTLASTLEEAGYEEGRDLFGAPYDFRYGLAGPGHPSQVGSAYLQRLRLLVESACAASGGRPAILVAHSLGGLFALQLLARSPPQWRAAHVRRLVTLSTPWGGSVQEMLTFASGNTLGVPFVDPSLIRDEQRTAESNLWLLPTPSVFGNTTLVLSRAHNRSYSAKNMTQFLRDIGFEEGVEPYRARIRPLVEALPEPGVPLTCLVGTGVDTVESLVYGDRGFDEAPEKVVYGDGDGTVNLASLIGPIKAWSDSPAQVVEVVELPKVSHSGMLSDKSALEQIIRIIDSINLNATSYHHSS

SEQ ID NO: 9126 - protein, 452 aa, Setaria italica
MEGRPSLAPAPAAVTVMVVMLSTLSCSCCGASSAARAVAAGRRPVILIPGAGGNQLEARLTEEYRPASLACRVWPPVRGRGGWFRLWFDPSVLLPPLTRCFADRMTLYYDAGADDYRNAPGVETRVSDFGSTSTLRYLDPNLKLLTGYMNTLASTLEKAGYEEGRDLFGAPYDFRYGLAGPGHPSTVGTAYLQRLRLLVESACAANGGRPAILMAHSLGGLFALQLLARSPLPWRAAHVARLVTLSAPWGGSVQEMLTFASGNTLGVPFVDASLIRDEQRSAESNLWLLPAPRVFGNTTLVVSRGHGDGGGGNRSYSAKNMTQFLRDIGFEQGVEPYRARIRPLVEALPEPGVPVTCLVGTGVDTVESLVYGDGGFDEPPEEVVYGDGDGTVNLASLVGPIKAWSDSPAQVVEVVELPKVSHSGILNDRSALEQIIRIVDSINLNATSYQPS

SEQ ID NO: 9127 - protein, 455 aa, Setaria italica
KHGGAPFTGPRASSGDGDGRYAVDAELLVLRRVVGGEGGRGRAAAGDTDPGRGRQPAGGAPDGGVQAGEPGVPGVAARARPRRLVPPLVRPLRPPPAAHQVLRRPHDALLRRRRRRLPQRARRRDQGLRLRLHLHPPLPRSKRVRRLLTGYMNTLASTLEKAGYEEGRDLFGAPYDFRYGLAGPGHPSTVGTAYLQRLRLLVESACAANGGRPAILMAHSLGGLFALQLLARSPLPWRAAHVARLVTLSAPWGGSVQEMLTFASGNTLGVPFVDASLIRDEQRSAESNLWLLPAPRVFGNTTLVVSRGHGDGGGGNRSYSAKNMTQFLRDIGFEQGVEPYRARIRPLVEALPEPGVPVTCLVGTGVDTVESLVYGDGGFDEPPEEVVYGDGDGTVNLASLVGPIKAWSDSPAQVVEVVELPKVSHSGILNDRSALEQIIRIVDSINLNATSYQPS

SEQ ID NO: 9128 - protein, 443 aa, Brachypodium distachyon
MERRPSLVAMVVVAMLSLSSCCCCASSSAGGGQQLHPVILIPGSGGNQLEAKLTEEYSPSSLACRVWPLVRGRGGWFRLWFDPSVLVAPLTRCFAERMMLYYDIAADDYRNAPGVETRVSDFGSTSSLRYLDPNLKLLTGYMDALASTLEKAAGYEEGRDLFGAPYDFRYGLAAPGHPSQAGSAYLERLRLLVESACAANGGKPAILLAHSLGGLYALQLLARSPAPWRAAHVKRLVTLSAPWGGSVQEMLTFASGNTLGVPFVDASIIRDEQRSSESNLWLLPTPKVFGNTTLVVSEFHNRSYSAKNVTQFLRDIGFEGGVEPYRARIRPLGEALPEPGVPVTCLVGTGVDTVESLVFGKEGFEAGPVKVAYGDGDGTVNLASLVGPIKAWADSPAQVLEVVELPGVSHSGILKDKSALQQIVRIVDAINLNTTGSNYLRSF

SEQ ID NO: 9129 - protein, 2468 aa, Sorghum bicolor
MGAQEAAVEEVLRAAAVEVSTSSAKRRLRLFRHTLPPLIAKATESPSDIALLVDLIFQTLPIYDDRASRKAVDDMVIQALGEPTFMKPFAAVLVQSMEKNLKVSNPLTSFKLLRWSHYLLKWSQFATLSKGAFTRLANAQAVLCQALMDGSFRRCRTCKQLFVHLFSEPSGIYKMYIEELRDLRISMRDSPAFLNLILDFTITSPSLSTEYKSVFLDLYVKTILSSKDRPPKAATEAFKPLFLEIGHEDFKNTVIPSCIKMLKRNPEIVLQSIGYLLKTVRLDLSKYSMEFMPVVLHQARHSDEERRVNALSIIGTLSEKSSDPDALPSMVNAIKAVLGGSEGKLSLPYQRIGTINALEQLSRSPPKQIGRLAPSVSSFLLTCYRDDGIEEVKLAILSAIGSWALVSAEAVQPDVVSFIAAGLKEKDTLRKGHLKFLRVICKNSDSLTKVASLLDHLIQLSKTGFSKATQRLDGVYALFAVSRLAAVDTKADGAILKEKLWTLIAQNEPSLISLQLLPKLADDDCLAVLDLLQSLLVEHFFRVREYFSIQSLLQLQIYLLCHPSWEVRKVASDVTKKIFSSSSGLAEDILFLFTDWLSLVGERLSILKQGDMDSSSDSQIPFVPSTEVLVKCLFLIAPYAVVHSPRSYSRIILCSHHPCLSSSSSPAGVYKRLQKRLRQEQIFFVDLITPNISVICKHFIGLQERTLHDSFSESDIKIFYTPEGQLSTEQGVYIAEAVASKNTKLAKGRFRAYDDQDAHTARSVVPAKNEKRESSSTGKRETGKSTKKTAPIDKAKTAKEEARELLLKEEASVRMKVGQVQKILSLMLDALGELAIANPIFTHGQLPSLVNYVEPLLSSAIVSDAAFCTMLRLARCTAPPLCNWAPEIAAAIRVISVGDFEMVLDLTPVIMEDDSKKKPSSGLFEQIVNGLTIACKAGPLPADSFTFVFPVLYHVLSTVPAYHPSVGPMLNELCLGLRSHELAQALVGVYAKEVHVRLACLTAIKCVPVHSVQRDLQVSTSLWIAAHDPEKVVAELAEELWDRFGFDVITDYSGIFDALSHKNYNVRAASAEALAAALDENQDKMQDALSTLFSLYIRDLGPGVEFGDAHWLGRQGIALALHSIADVLASKDLPVVMTFLISRALADPNVDVRGRMINAGILIIDRHGKENVPLLFPIFESYLNKRASTTFLLIIVLASDEETYDLVREGVVIFTGALAKHLSKDDPKVHSVIEKLLDVLNTPSEAVQRAVSDCLSPLMVSKQEEGQALVSRLLDRMMKCDKYGERRGAAFGLAGVVKGFGISSLKKYGIAATLQQNLEDRISAKSREGALLGFECLCEKLGKLFEPYVIQMLPFLLVSFSDQVLAVREAAECAARAMMSQLTGPGVKLVLPSLLKGLEDKAWRTKQSSVQLLGAMAYCAPQQLSQCLPKIVPKLTEVLTDTHPKVQAAGQTALQEVGSVIKNPEISALVPILLSALMDPNAHTKHSLDILLQTTFINSIDAPSLALLVPIVHRGLRERGVETKKKAAQIVGNMSSLVTEPKDMIPYIGLLLPEVKKVLVDPIPEVRAVAARALGSLISGMGEEIFPDLVPWLLDTLKSDNSNVERSGAAQGLSEVLAALGQDYFDHILPDIIRNCSHQKASVRDGHLTLFRYLPRSLGGVFQNYLQAVLPAILDGLADENESVRDAALSAGHVFVEHYATTSLPLLLPAIEDGIFSDNWRIRQSSVELLGDLLFKVAGTSGKAILEGGSDDEGASTEAQGRAIIEVLGREKRNEVLAAIYMVRSDVSLTVRQAALHVWKTIVANTPRTLKEIMPVLMDTLISSLASSSSERRQVAGRSLGELVRKLGERVLPSIIPILSQGLKDPSASRRQGVCIGLSEVMGSAGKHQLLSFMDLLIPTIRTALCDSHIYCNSTQEVRESAGLAFSTLYKSAGLQAIDEIVPTLLRALEDDDTSATALDGLKQILSSFNAHALGALAEVAGPGLNSHIGTVLPALILAMDDEDVDVQNSARKAAETVLLVIDEEGVETLIPELLRGINDSQASMRRGSAYLIGFLFKNTKLYLADEASDMMSTLIILLSDTDKATVSAALEAFSRVATSVPKEQLPTYIKLVRDAVSTARDKERRRRKGVPILVPGLCLPKALQPFLPIFQQGLISGSAETKEQAAEGLGELIDVTSEKTLKEVVVPITGPLIRILGDRFPWQVKSAILSTLTIIIMKGGIALKPFLPQLQTTFMKCLQDNNRSLRTRAAAALGKLSALSTRVDSLVGELLSMLQSGDESVEESVLSALKGVIKHAGKSVSSAIRSRGCALLEDLLQAQVDDVRSCAAKVIGTLSQYMEETEISDLVQTLLNVSTSSDWCTRHGALLAFSSISMHSPSKLCHLASFPSLVDLLKDSLKDDKFPVREVATRTLGRILCFELQSEASTLQLVQLLVLALRDDSSEVRRRSLSCIKAAAKVYHWSLFISI

SEQ ID NO: 9130 - protein, 1974 aa, Sorghum bicolor
MDSSSDSQIPFVPSTEVLVKCLFLIAPYAVVHSPRSYSRIILCSHHPCLSSSSSPAGVYKRLQKRLRQEQIFFVDLITPNISVICKHFIGLQERTLHDSFSESDIKIFYTPEGQLSTEQGVYIAEAVASKNTKLAKGRFRAYDDQDAHTARSVVPAKNEKRESSSTGKRETGKSTKKTAPIDKAKTAKEEARELLLKEEASVRMKVGQVQKILSLMLDALGELAIANPIFTHGQLPSLVNYVEPLLSSAIVSDAAFCTMLRLARCTAPPLCNWAPEIAAAIRVISVGDFEMVLDLTPVIMEDDSKKKPSSGLFEQIVNGLTIACKAGPLPADSFTFVFPIMERILLSSKKTCLHDDVVHILSLHMDPILPLPRPRMLSVLYHVLSTVPAYHPSVGPMLNELCLGLRSHELAQALVGVYAKEVHVRLACLTAIKCVPVHSVQRDLQVSTSLWIAAHDPEKVVAELAEELWDRFGFDVITDYSGIFDALSHKNYNVRAASAEALAAALDENQDKMQDALSTLFSLYIRDLGPGVEFGDAHWLGRQGIALALHSIADVLASKDLPVVMTFLISRALADPNVDVRGRMINAGILIIDRHGKENVPLLFPIFESYLNKRASDEETYDLVREGVVIFTGALAKHLSKDDPKVHSVIEKLLDVLNTPSEAVQRAVSDCLSPLMVSKQEEGQALVSRLLDRMMKCDKYGERRGAAFGLAGVVKGFGISSLKKYGIAATLQQNLEDRISAKSREGALLGFECLCEKLGKLFEPYVIQMLPFLLVSFSDQVLAVREAAECAARAMMSQLTGPGVKLVLPSLLKGLEDKAWRTKQSSVQLLGAMAYCAPQQLSQCLPKIVPKLTEVLTDTHPKVQAAGQTALQEVGSVIKNPEISALVPILLSALMDPNAHTKHSLDILLQTTFINSIDAPSLALLVPIVHRGLRERGVETKKKAAQIVGNMSSLVTEPKDMIPYIGLLLPEVKKVLVDPIPEVRAVAARALGSLISGMGEEIFPDLVPWLLDTLKSDNSNVERSGAAQGLSEVLAALGQDYFDHILPDIIRNCSHQKASVRDGHLTLFRYLPRSLGGVFQNYLQAVLPAILDGLADENESVRDAALSAGHVFVEHYATTSLPLLLPAIEDGIFSDNWRIRQSSVELLGDLLFKVAGTSGKAILEGGSDDEGASTEAQGRAIIEVLGREKRNEVLAAIYMVRSDVSLTVRQAALHVWKTIVANTPRTLKEIMPVLMDTLISSLASSSSERRQVAGRSLGELVRKLGERVLPSIIPILSQGLKDPSASRRQGVCIGLSEVMGSAGKHQLLSFMDLLIPTIRTALCDSTQEVRESAGLAFSTLYKSAGLQAIDEIVPTLLRALEDDDTSATALDGLKQILSVRTAAVLPHILPKLVQPPLSSFNAHALGALAEVAGPGLNSHIGTVLPALILAMDDEDVDVQNSARKAAETVLLVIDEEGVETLIPELLRGINDSQASMRRGSAYLIGFLFKNTKLYLADEASDMMSTLIILLSDTDKATVSAALEAFSRVATSVPKEQLPTYIKLVRDAVSTARDKERRRRKGVPILVPGLCLPKALQPFLPIFQQGLISGSAETKEQAAEGLGELIDVTSEKTLKEVVVPITGPLIRILGDRFPWQVKSAILSTLTIIIMKGGIALKPFLPQLQTTFMKCLQDNNRSLRTRAAAALGKLSALSTRVDSLVGELLSMLQSGDESVEESVLSALKGVIKHAGKSVSSAIRSRGCALLEDLLQAQVDDVRSCAAKVIGTLSQYMEETEISDLVQTLLNVSTSSDWCTRHGALLAFSSISMHSPSKLCHLASFPSLVDLLKDSLKDDKFPVREVATRTLGRILCFELQSEASTLQLVQLLVLALRDDSSEVRRRSLSCIKAAAKINHSALATHHSVLGPAIADALKDSSMPVRLAAERCALHVFQLTKGPDNVTSAQKYLGMTGLEVKKIAKLNEESDGSESSDDDKRT

SEQ ID NO: 9131 - protein, 579 aa, Zea mays
MRRRWDSCFSGSDVRVGGRVPPEEPEPEVFSFAEPLPSWPTGGGFARGRIRIGGGELELAAATAFQKICTLSSRRRGGGGSATFYRPVGVPEGFSLLGYYCQPNCRPLHGHVLVARAGERPSGASPQPPPPPLCKPLDYTLIWEFQASGDTGYGYGRSDAYFWIPVPPERYRALGCLVTTEPRRPPLEEVVCVREDLTDECEPHGSLLCLEQPRPSSFFTVRGVRPVRRGIREKGVCVGTFCCAADGLPPREHGMACLGNVELDLSAMPTLEQAHAVIRHYGPTLFFHPKEVYLPSSVSWFFKNGAALYRRGGDTAGEEIDGEGSNLPGGGCNDGEFWIDVPSGERGRAVCRGSIDSAELYAHVKPAMGGTCTDVAMWVFCPFNGPARLKLGPISLPLGKTGRHVGDWEHFTFRVSNLTGELMGVYYSQHSGGHWVDASALEYIDGNRPVVYSSRNGHASYAYPGVYLQGSAALGVGIRNDAARSSLFVDSSARYRIVAAGYLGEGAVVEPQWLQFMREWGPTVVYKWRKRMEWVIGRLPPWLRCRAESMLNKMPNELSREEGPTGPKEKNNWEGDERW

SEQ ID NO: 9132 - protein, 592 aa, Setaria italica
MRQRWGSCFSGGDVRVGAPALEEPEPEVFSFAEPLPPWPPGGGFARGRMSIGGGELELAAATSFQKICTLSPRRWGGGGSSVTFYRPVGVPEGFSLLGHYCQPNCRPLHGHLLVARAGARPPGAPPQPLPPLRAPRDYSLVWEFRAGGVANGSRGNAGNCYGLRDAYFWVPVPPEGYKALGCLVTTELQKPPLDEVACVRADLTDECEPHGSLLHLQLARPSASESCAAAAFAVRGVRPVHRGMWGKGVGAGTFCCAADGSSPREQGMACLSNVELDLSAMPTLEQAHAVIRHYGPTLFFHPKEVYLPSSVSWFFKNGAALYKRGGDAVGEEIDGEGSNLPGGGCNDGECWIDVPSGERGRAVCRGDIDSAELYAHVKPAMGGACTDVAMWVFCPFNGPARLKLGPVSLPLGKTGRHVGDWEHFTLRVSNLTGELMGVYYSQHSGGHWVDASALEYTDGNRPVVYSSRNGHASYAYPGVYLQGSAALGIGIRNDAARSRLFVDSSAKYRIVAAEYLGEGAVAEPQWLHFMREWGPTVVYKSRKRMEWMTGKLPLRLKCRAEKMLNKMPNELSREEGPTGPKEKNNWEGDERW

SEQ ID NO: 9133 - protein, 2011 aa, Setaria italica
MKKVLSSSSGLAEDTLFLFTDWLSLVGERLSMLKQGDMDNSSDSQLPFTPSIEVLVKCLFLIAPYAVVHSLRSYSRLILCSHHPCLSSSASPAGVYKRLQRRLRQQQIVFVDLITPNISVICKHFIGLEERTLHDSFSENDIKIFYTPEGQLSTEQGVYVAEAVASKNTKLAKGRFRAYDDQDADTARSVVPAKTEKRESSGTGKRETGKSTKKTAPVDKAKTAKEEARELLLKEEASVRMKVGQVQKNLSLMLDALGELAIANPIFTHGQLPSLVNYVDPLLSSAIVSDAAFRTMLRLARCTAPPLCNWAPEIAAAIRVISIGDFEMVLDLMPVIVEEDSKKKPSSGLFEQIVNGLTIACKAGPLPADSFTFIFPIMERILLSSKKTCLHDDVLHILSMHLDPILPLPRPRMLSVLYHVLSTVPAYHPSVGPMLNELCLGLRSHELAQALGGVYAKEVHVRLACLNAIKCVPIHSVQRDLQVSTSLWIAAHDPEKVVAELAEELWDRFGFDVITDYSGIFNALSHKNYNVRAASAEALAAALDENPDKMQDALSTLFSLYIRDLGPGVEFGDTHWLGRQGIALALHSIADVLASKDLPVVMTFLISRALADPNVDVRGRMINAGILIIDRHGKENVPLLFPIFESYLNKKASDEETYDLVREGVVIFTGALAKHLSKDDPKVHSVIEKLLDVLNTPSEAVQRAVSDCLSPLMVSKQEEGQALVSRLLDRMMKCEKYGERRGAAFGLAGVVKGFGISSLKKYGIATTLRQSLEDRMSAKSREGALLGFECLCEKLGRLFEPYVIQMLPLLLVAFSDQVLAVREAAECAARAMMSQLTGPGVKLVLPSLLKGLEDKAWRTKQSSVQLLGAMAYCAPQQLSQCLPKIVPKLTEVLTDTHPKVQAAGQTALQEVGSVIKNPEISALVPILLSALMDPNDHTKHSLDILLQTTFINSIDAPSLALLVPIVHRGLRERGVETKKKAAQIVGNMSSLVTEPKDMIPYIGLLLPEVKKVLVDPIPEVRAVASRALGSLISGMGEEIFPDLVPWLLDTLKSDSSNVERSGAAQGLSEVLAALGQDYFDRILPDIIRNCSHQKASVRDGHLTLFRYLPRSLGGVFQNYLQAVLPAILDGLADENESVRDAALSAGHVFVEHYAASSLPLLLPAIEDGIFSDNWRIRQSSVELLGDLLFKVAGTSGKAILEGGSDDEGASTEAQGHAIIEVLGREKRNEVLAAIYMVRSDVSLTVRQAALHVWKTIVANTPRTLKEIMPVLMDTLISSLASSSSERRQVAGRSLGELVRKLGERVLPSIIPILSQGLKDPNASRRQGVCIGLSEVMGSAGKHQLLSFMDELIPTIRTALCDSTQEVRESAGLAFSTLYKSAGLQAIDEIVPTLLRALEDDDTSATALDGLKQILSVRTAAVLPHILPKLVQPPLSSFNAHALGALAEVAGPGLNSHIGTVLPALILAMDDEDADVQNSARKAAETVLLVIDEEGVETLIPELLRGINDSQASMRRGSAYLIGFLFKNTKLYLADEASDMMSTLIILLSDTDKATVSAALEAFSRVVGSIPKEQLPTHIKLVRDAVSTARDKERRRRKGAPVLVPGLCLPKALQPFLPIFQQGLISGTAETKEQAAEGLGELIDVTSEKTLKEVVVPITGPLIRILGDRFPWQVKSAILSTLTIIITKGGIALKPFLPQLQTTFVKCLHDTNRSVRTRAAAALGKLSALSTRVDPLVSDLLSMLQSGDESVKESVLSALKGVIKHAGKSVSAAIRSRGCDLLKDLLQADADDVRSCAAKVIGTLSLYMEETEISDLVQILLNMSTSPDWCTRHGALLGFSSISMHSPSKLCHLASFPSLVDLLKDSLKDDKFPVREVATRTLGRILCFQLQLEAGTLQLVQLLVLALRDDSSEVRRRSLSCIKAAAKINHSALATHHSILGSAIADALKDSSMPVRLAAERCALHVFQLTKGPDNVTAAQKYLGMTGLEVKKIAKLNEESDGSESSDDDKRA

SEQ ID NO: 9134 - protein, 517 aa, Zea mays
MYRLFRRSFSMAAEGSAAAASSSPPPSTSMSSTPRQHLPDELYRRIMNVGRPSIPLSPVLEQWNQEGHTAKKFVIQAIVKKLVGLRRFAHALELSFWMTDRRHLHLSVGDVAYRLDLISKVHGLEKAVEYFGMVPKQLRKPQCYGSLLKCYVEAKAVDKAEEHFAKMQEMGMTSSYAYTWMMKLYLQTGQLERVHAMFQDMEEKGVKPDTFSVEAMLAAYIAAEDVQGVGKVLDKANPHEKLVTWHGHASAASLFMKSGMQVGAVMALVEAERRISPKSSRIAYAFLLKTYTELGMHAEAGRIWSVYKSKVPPCNTMYMSRLSALLRTNDIDGAEATLKEWETVPLRYHDFRLINVMVDAYCREGLVEKAVALVDGAIKKGRTPYANTWYKLAGGFFKTGQVPEAVDMTRKALDSATPPWRPDLANVLMSLNHFVDQKDVGAAEEMVSTLQKLVPLTRDVYHCLLKTYVRAGKPPSDLLERMKEDGLEADEETERILAGECERVDMHPLSITNHLIG

SEQ ID NO: 9135 - protein, 496 aa, Sorghum bicolor
MASLFAAGRRLLSLGRRGVLLPVPRSRAVATSSRSNSEEERPPQSLQSTLWPLGHPCTLLVPEIELWAARPRNRLRAVELQRIVRELRKRHRHRQALEVSEWMNLKGHVKFLPKDHAIHLDLIGQVHGVGAAETYFNNLSDKDKTEKPYGALLNCYTRELLVDKALAHFQNMKELGFVFSALSYNNLMGLYTNIGQHERVPMVMAEMKRDGIVPDNFSYRICINSYGIRADFFGLENTLEEMECEPQIVVDWNTYAVVASNYIKGYLREKAYSALRKAEAKMDKKDGDAYGHLISLYGHLGDKLEVKRLWALHMLNCKRYINKDYTNMLAVLVKLDEITEAEDLLKEWESSKNAFDFQVPNVLLTGYRQKGLLDKAETLLDGFLKKGKTPTSTSWWIVAIGYAEKGDVAKAYELTKNALSVFAPNSGWIPRPSIIEMILKYLGNEGEVKDVEAFVNLLKVAVPMNSDMTEALSRARAREERKAEEATEAPREDIIA

SEQ ID NO: 9136 - protein, 442 aa, Saccharum officinarum
MGKSKRNKGGRGGGGADDQLDGGSDADSVTSMSTGLSDLQLAQATENVSSQEFVLDKYIDALYEKRGSTREEALGALTDAFESFVLLGLVENKYVTLLSQFTNSIKKGSTKEVCLACRCIGLLAITLGAGSSSHEIMDESHPQLLRVLQTWPDAPKMISALDCLAVVTFVGATDLAETQLSLKAIWDVIHPKSGSNVGIVRKPKPPLLAAAVSAWAFLLTTVGSSRRNTDSWKEPITFLCSLLEAEDRAVRIAAGEALALCFELKLVDGSSNDEADVDSDTRETSGSKHQLFLNMQALKAKISGLVYSLSMEAGGRGADKKNLNDQRDLFQRISDFIKNGECPEESLRISGKNGILRVTSWRELIQLNYMRRFLGRGFLKHSQDNDLLHDIFDIKIDRTENMSTTKKKMFRSEEEKGRALKLNKERRLAQERKQNILSEQYG

SEQ ID NO: 9137 - protein, 444 aa, Setaria italica
MGKSKRNKGGRGGGGGGGDDQLEGGSDADSVASMSTALSDLQVAQATEHVSSQEFVLDKYIDDLYEKRGSTREKALGALVDAFESFMLLGLVENKYVTLLSQFTNSIKKGSAKEVCLACRAIGLLAITLGAGSSSHEIMDESHPQLLRILQTWPDAPKMISALDCLAVVTFVSANDLAETQLSLKAIWDVIHPKSGSKVGIVRKPNPPLLAAAVSAWAFLLTTVGSSRRNSDSWKEPITFLSSLLEAEDRAVRIAAGEALALCFELKLLDVSSSEEADVDSDTRETSGSKNQLFLNMQALKAKISGLVCNLSMEAGGRGADKKNLNDQRDLFQRISDFIKSGECPEESLRISGKNGILRVTSWRESIQLNYLRRFLGRGFLKHAQDNDLLHDIFDIKIDQVKNMSTTKKKIFRSEEEKGRALKLNKERRLAQERKQNILNEQYG

SEQ ID NO: 9138 - protein, 443 aa, Zea mays
MGKSKRNKGGRGGGGADDKLDGGGDADSVTSMSSGLSDLQFAQATEHISSQEFVLDKYVDALYEKRGSTREEALGSLTDAFESFVLLGLVENKYVTLLSQFINSIKRGSVKEVCLACRCIGLLAITLGAGSSSHEIMDESHPHLLRVLQTWPDAQKMISALDCLAVVTFVGATDLAETQLSLKAIWDVIHPKSGSNVGVVRKPKPPLLAAAVSAWAFLLTTIGSSRRNTDSWKEPITFLCSLLEAEDRAVRIAAGEALALCFELRMFDVSSSDEADVDSYTGEAGGSKHQLFLNMQALKAKLSGLVYSLSMEAGGRGADKKNLNDQRDLFQRISDFIKSGECPEESLRISGKNGILRVTSWRESIQLNYMRRFLGRGFLKHSQDNDLLHEVFDIKIDRTENMSATEKKMFRSGEEKGRALKLNKERRLAQERKQQNILNEQYG

SEQ ID NO: 9139 - protein, 440 aa, Oryza sativa
MGKSKKNKGGRGGGGGGGEDQFDGGSDVDSVSSVSTALSDLQLAQATEQVSSQDFVLDKYIDDLYEKRGSTREAALGALVDAFESFVLLDLVENKYATLLSQFINSIKKGSIKEVCLACHTTGLLAITLGAGSSSHEIMDESRLQLLRVLQTWPDASKMISALDCLAVVTFVGATDLSETQLSMKAIWDVIHPKSGSNVGIVRKPKPPLLAAAVSAWALLLTTIVSSKRNVDSWKESITFLSALLEAEDRAVRMAAGEALALCFELKLLDVFSNEEVEVDTAEASGSKNQLFLNMQALKAKISGLVYNLSMEAGGRGADKKNLNDQRDLFQRISDFIKTGECLEESLRIAGKHGILRVTSWRESIQLNYLRRFLGRGFLKHAQDNGLLHDIFDIKMDKTENMSTTEKKIYRSGEEKGRALKLNKERRLAQMRKQNILNEQ

SEQ ID NO: 9140 - protein, 573 aa, Setaria italica
MAATGFRVHPAAFFSAHPREAGAKQLPFHHCSPHRILVARRTWLLRARSSNGRPQIGASFSNSNEVLDGKPAGDGPPKQGGGTVSITVVGASGDLAKKKIFPALFALFYEDCLPEHFTVFGYARSKMSDEELRNMISMTLTCRIDKRENCGDKMEEFLQRCFYQSGQYNSEEGFAELDRKLKEKEEGKVPNRLFYLSIPPNIFVDVVRSASRTASSSTGWTRFIVEKPFGRDSESSGELTRSLKKYLAEEQIFRIDHYLGKELVENLSVLRFSNLVFEPLWSRNYIRNVQLIFSEDFGTEGRGGYFDNYGIIRDIMQNHLLQILALFAMETPVSLDAEDIRNEKVKVLRSMRPLKVEDVVVGQYKGHTRGGRSFPGYADDPTVPKGSVTPTFAAAALFIDNARWDGVPFLMKAGKALHTRRAEIRVQFRSVPGNLYRRSVGTDPDTATNELVLRVQPDEAIYLKINNKVPGLGMRLDRSNLNLLYSERYRREIPDAYERLLLDAIEGERRLFIRSDELDAAWAIFTPVLRELEDRRVAPELYPYGSRGPVGAHYLAANYNVRWGDVTSDDGSF

SEQ ID NO: 9141 - protein, 574 aa, Triticum aestivum
MAAIDLRFHLHPAAFSSVHPSNSSAKPHRHCPPQRIHAAGRRCLLRAKSSNGHPQIGASFSDGVLDAKPSGAGGPAPEQGEHTVSITVVGASGDLAKKKIFPALFALFYEDWLPEHFTIFGYARSKMSDEELRNMISMTLTCRIDQRANCSEKMDKFLKRCFYQSGQYNSEEGFCELDRKLTEKEAGKLPNRLFYLSIPPNIFVDVVRSASRTASLPSGSGWTRFIVEKPFGRDSESSGELTRSLKMYLEEEQIFRIDHYLGKELVENLSVLRFSNLVFQPLWSRDYIRNVQLIFSEDFGTEGRGGYFDNYGIIRDIMQNHLLQILALFAMETPVSLAAEDIRNEKVKVLRSMRKLKLEDVVVGQYKGHTRGGKSFPAYVDDPTVPNDSVTPTFAAAALFIDNARWDGVPFLMKAGKALHTRRAEIRVQFRRVPGNLYRGNVGTDLDMATNELVLRVQPDEAIYLKINNKVPGLGMRLDSSNLNLFYSERYQREIPDAYERLLLDAMEGERRLFIRSDELDAAWAIFTPVLRELEEKRVAPELYPYGSRGPVGAHYLAANYNVRWGDISSDGSF

SEQ ID NO: 9142 - protein, 574 aa, Triticum aestivum
MAAIDLRFHLHPAAFSSVHPSNSSAKPHRHCPPQRIHAAGRRCLLRAKSSNGHPQIGASFSDGVLDAKPSGAGGPAPEQGEHTVSITVVGASGDLAKKKIFPALFALFYEDWLPEHFTIFGYARSKMSDEELRNMISMTLTCRIDQRANCSEKMDKFLKRCFYQSGQYNSEEGFRELDRKLTEKEAGKLPNRLFYLSIPPNIFVDVVRSASRTASLPSGSGWTRFIVEKPFGRDSESSGELTRSLKMYLEEEQIFRIDHYLGKELVENLSVLRFSNLVFQPLWSRDYIRNVQLIFSEDFGTEGRGGYFDNYGIIRDIMQNHLLQILALFAMETPVSLAAEDIRNEKVKVLRSMRKLKLEDVVVGQYKGHTRGGKSFPAYVDDPTVPNDSVTPTFAAAALFIDNARWDGVPFLMKAGKALHTRRAEIRVQFRRVPGNLYRGNVGTDLDMATNELVLRVQPDEAIYLKINNKVPGLGMRLDSSNLNLFYSERYQREIPDAYERLLLDAMEGERRLFIRSDELDAAWAIFTPVLRELEEKRVAPELYPYGSRGPVGAHYLAANYNVRWGDISSDGSF

SEQ ID NO: 9143 - protein, 570 aa, Brachypodium distachyon
MATTGLLFHLHPTAFSSARPQNATSRLHSHCPPQGIHAAGRRCLLRAKSSNGHPQIGASFSDGVLDGKVPGGGPPEQEGNTVSITVVGASGDLAKKKIFPALFALFYEDWLPKHFTVFGYARSKMSDEELRNMISMTLTCRIDQRENCSDKMEQFLQRCFYQSGHYNSEEGFSELDRKLTEKEAGKLPNRLFYLSIPPNIFVDVVRSASRTASSPSGWTRFIVEKPFGRDYESSGELTRSLKMYLAEEQIFRIDHYLGKELVENLSVLRFSNLVFQPLWSRDYIRNVQLIFSEDFGTEGRGGYFDNYGIIRDIMQNHLLQILALFAMETPVSLAAEDIRNEKVKVLRSMRRLKLEDVVVGQYKGHTRGGKSFPAYVDDPTVPSGSVTPTFAAAALFIDNARWDGVPFLMKAGKALHTRRAEIRVQFRRVPGNLYRGNVGTDLDMATNELVLRVQPDEAIYLKINNKVPGLGMRLDSSNLNLFYSERYQREIPDAYERLLLDAIEGERRLFIRSDELDAAWAIFTPVLKELEDKRVAPELYPYGSRGPVGAHYLAANYNVRWGDISSDGSF

SEQ ID NO: 9144 - protein, 574 aa, Hordeum vulgare
MAAIDLRFHLHPAAFSSVHPSNPSTKPHRHCPPQRIHAAGRRCLLTAKSSNGHPQIGASFNDGVLDAKPSGAGGPATEQGGNTVSITVVGASGDLAKKKIFPALFALFYEDWLPEHFTVFGYARSKMSDEELRNMISMTLTCRIDQRANCSEKMDKFLKRCFYQSGQYNSEEGFRELDRKLTEKEAGKLPNRLFYLSIPPNIFVDVVRSASRTASLPGGSGWTRFIVEKPFGRDSESSGELTRSLKMYLEEEQIFRIDHYLGKELVENLSVLRFSNLVFQPLWSRDYIRNVQLIFSEDFGTEGRGGYFDNYGIIRDIMQNHLLQILALFAMETPVSLAAEDIRNEKVKVLRSMRQLKLEDVVVGQYKGHTRGGKSFPAYVDDPMVPNDSVTPTFAAAALFIDNARWDGVPFLMKAGKALHTRRAEIRVQFRRVPGNLYRGNVGTDLDMATNELVLRVQPDEAIYLKINNKVPGLGMRLDSSNLNLFYSERYQREIPDAYERLLLDAMEGERRLFIRSDELDAAWAIFTPVLRELEDKRVAPELYPYGSRGPVGAHYLAANYNVRWGDISSDGSL

SEQ ID NO: 9145 - protein, 618 aa, Secale cereale
MAAIDLRFHLHPAAFSSVHPSNSSTKPHRHCPPQRIHAAGRRCLPRAKSSNGHPQIGASFSDGVLDAKPSGAGGPAPEQGEHTVSITVVGASGDLAKKKIFPALFALFYEDWLPEHFTIFGYARSKMSDEELRNMISMTLTCRIDQRANCSEKMDKFLKRCFYQSGQYNSEEGFLELDRKLTEKEAGKLPNRLFYLSIPPNIFVDVIRSASRTASLPSGSGWTRFIVEKPFGRDSESSAELTRSLKMYLEEEQIFRIDHYLGKELVENLSVLRFSNLVFQPLWSRDYIRNVQLIFSEDFGTEGRGGYFDNYGIIRDIMQNHLLQILALFAMETPVSLAAEDIRNEKVKVLRSMRKLKLEDVVVGQYKGHTRGGKSFPAYVDDPMVPNDSVTPTFAAAALFIDNARWDGVPFLMKAGKALHTRRAEIRVQFRRVPGNLYRGNVGTDLDMATNELVLRVQPDEAIYLKINNKVPGLGMRLDSGNLNLFYSERYQREIPDAYERLLLDAMEGERRLFIRSDELDAAWAIFTPVLRELEEKRVAPELYPYGSGAPSARTTSPPTTTSVGGHQQRRILLASSVSVCLLRPMHSLSLLKAPVGLITSLRLPSSDSQFYSDSIKL

SEQ ID NO: 9146 - protein, 577 aa, Oryza sativa
MAGTGLRFRQGAIFFSGAHAAAHPRTRTPHHHCSPQRTHDARGRCRLTAKSANGRPQISASFRDVAIDGAQSEDGAPEQGGSTVSITVVGASGDLAKKKIFPALFALYYEDCLPEHFTVFGYARSKMSDEELRNMISLTLTCRIDQRENCSDKMEQFLKRCFYQSGQYNSEEGFSELDRKLKEKEAGKVPNRLFYLSIPPNIFVDVVRSASRTASSQDGWTRFIVEKPFGRDSESSGELTRNLKKYLAEEQIFRIDHYLGKELVENLSVLRFSNLVFEPLWSRNYIRNVQLIFSEDFGTEGRGGYFDNYGIIRDIMQNHLLQILALFAMETPVSLDAEDIRNEKVKVLRSMRQLRLEDVVVGQYKGHSKGGKTYPAYVDDPTVPSGSITPTFAAAALFIDNARWDGVPFLMKAGKALHTRRAEIRVQFRRVPGNLYGRRSRSVGGGGTTATRELEKATNELVLRVQPDEAIYLKINSKVPGLGMRLDSSDLNLLYSERYPAEIPDAYERLLLDAIEGERRLFIRSDELDAAWAIFTPVLADLEANKVAPELYPYGSRGPVGAHYLAANHNVRWGDIS

SEQ ID NO: 9147 - protein, 575 aa, Avena sativa
MASISLRFHLQPAAAFSAQPFNASTKPHRHCPPQKIHAAARRRCLLRVKSSNGHPQIGASFSDVVAGVLDGMSSGAGAVLPEQEENTVSITVVGASGDLAKKKIFPALFALFYEDWLPKHFTVFGYARSKMSDQELRNMISMTLTCRIDQRENCSDKMEQFLKRCFYQSGQYNSEEGFCELDRKLTEKEAGKQPNRLFYLSIPPNIFVDVVRSASRTASSPGGWTRFIVEKPFGRDYESSGELTRSLKMYLEEEQIFRIDHYLGKELVENLSVLRFSNLVFQPLWSRDYIRNVQLIFSEDFGTEGRGGYFDNYGIIRDIMQNHLLQILALFAMETPVSLAAEDIRNEKVKVLRSMRKLKLEDVVVGQYKGHTRGGKSFPAYVDDPTVPNGSVTPTFAAAALFIDNARWDGVPFLMKAGKALHTRRAEIRVQFRRVPGNLYSRGNNVGGGTHLDMATNELVLRVQPDEAIYLKINNKVPGLGMRLDSSNLNLFYSERYHREIPDAYERLLLDAIEGERRLFIRSDELDAAWAIFTPVLRELEENRVAPELYPYGSRGPVGAHYLASKYNVRWGDIS

SEQ ID NO: 9148 - protein, 93 aa, Unknown
  Sequence found in Organisms: Pennisetum glaucum, Setaria italica, Saccharum officinarum
MDKSMLGDLDGLPEEDKMRMAAMIDQLQIRDSLRMYNSLVERCFTDCVDTFRRKTLDKQEESCVRRCAEKFLKHSMRVGMRFAELNQGVATPD

SEQ ID NO: 9149 - protein, 93 aa, Unknown
  Sequence found in Organisms: Oryza sativa, Eragrostis curvula
MDKSMLGDLDGLPEEDKMRMAAMVDQLQIRDSLRMYNSLVERCFTDCVDTFRRKTLDKQEESCVRRCAEKFLKHSMRVGMRFAELNQGVATPD

SEQ ID NO: 9150 - protein, 93 aa, Zea mays
MDKSMLGDLDGLPEEDKMRMAAMIDQLQIRDSLRMYNSLVERCFTDCVDTFRRKNLDKQEESCVRRCAEKFLKHSMRVGMRFAELNQGVATPD

SEQ ID NO: 9151 - protein, 93 aa, Panicum virgatum
MDKSMLGDLDGLPEEDKMRMASMIEQLQIRDSLRMYNSLVERCFTDCVDTFRRKTLDKQEESCVRRCAEKFLKHSMRVGMRFAELNQGVATPD

SEQ ID NO: 9152 - protein, 93 aa, Sorghum bicolor
MDKSMLGDLDGLPEEDKMRMAAMVEQLQIRDSLRMYNSLVERCFTDCVDTFRRKTLDKQEESCVRRCAEKFLKHSMRVGMRFAELNQGVATPD

SEQ ID NO: 9153 - protein, 93 aa, Saccharum officinarum
MDKSMLGDLDSLPEEDKMRMAAMVDQLQIRDSLRMYNSLVERCFTDCVDTFRRKTLDKQEESCVRRCAEKFLKHSMRVGMRFAELNQGVATPD

SEQ ID NO: 9154 - protein, 93 aa, Panicum virgatum
MDKSMLGDLDGLPEEDKMRMAAMIEQLQIRDSLRMYNNLVERCFTDCVDTFRRKTLDKQEESCVRRCAEKFLKHSMRVGMRFAELNQGVATPD

SEQ ID NO: 9155 - protein, 53 aa, Cynodon dactylon
SFPSAPDPSFLPPAAAVAAATMDKSMLGDLDGLPEEDKMRMAAMVDQLQIRDS

SEQ ID NO: 9156 - protein, 93 aa, Setaria italica
MDKSLLGDLDGLPEEDKMRMAAMVDQLQIRDSLRMYNSLVERCFTDCVDTFRRKTLDKQEESCVHRCAEKFLKHSMRVGMRFAELNQGVATPD

SEQ ID NO: 9157 - protein, 93 aa, Lolium multiflorum
MDKSMLGDLDNLPEEDKMRMAVMVDQLQVRDSLRMYNNLVERCFTDCVETFRRKTLDKQEESCVRRCAEKFLKHSMRVGMRFAELNQGVATPD

SEQ ID NO: 9158 - protein, 93 aa, Tabernaemontana elegans
MDKSMLGDLDSLPEEDKVRMSAMIDQLQIRDSLRMYNSLVERCFTDCVDTFRRKTLDKQEETCVRRCAEKFLKHSMRVGMRFAELNQGAATPD

SEQ ID NO: 9159 - protein, 93 aa, Unknown
  Sequence found in Organisms: Valeriana officinalis, Vinca minor
MDKSMLGDLDNLPEEDKIRMSTMIDQLQIRDSLRMYNSLVERCFTDCVDTFRRKTLDKQEETCVRRCAEKFLKHSMRVGMRFAELNQGAATPD

SEQ ID NO: 9160 - protein, 95 aa, Brachypodium distachyon
MDKGMGMLGDLDNLPDEDKMRMASMVDQLQIRDSLRMYNSLVERCFTDCVDTFRRKTLDKQEESCVRRCAEKFLKHSMRVGMRFAELNQGVATPD

SEQ ID NO: 9161 - protein, 93 aa, Antirrhinum majus
MDKSMLGDLDALPEEDKQRMAAMIDQLQVRDSLRMYNSLVERCFTDCVDTFRRKTLDKQEETCVRRCAEKFLKHSMRVGMRFAELNQGAPTPD

SEQ ID NO: 9162 - protein, 93 aa, Fraxinus spp
MDKSMLGDLDSLPEEDKLRMSSMIDQLQIRDSLRMYNSLVERCFTDCVDTFRRKSLDKQEETCVRRCAEKFLKHSMRVGMRFAELNQGAATPD

SEQ ID NO: 9163 - protein, 93 aa, Fraxinus spp
MDKSMLGDLDPLPEEDKLRMSSMIDQLQIRDSLRMYNSLVERCFTDCVDTFRRKSLDKQEETCVRRCAEKFLKHSMRVGMRFAELNQGAATPD

SEQ ID NO: 9164 - protein, 93 aa, Avena sativa
MDKSMLGDLDNLPEEDKMRMAVMVDQLQVRDSLRMYNNLVERCFTDCVETFRRKTLDKQEESCVKRCAEKFLKHSMRVGMRFAELNQGVATPD

SEQ ID NO: 9165 - protein, 93 aa, Lippia dulcis
MDKSMLGDLDALPEEDKLRMASMIDQLQIRDSLRMYNTLVERCFTDCVDTFRRKTLDKQEETCVRRCAEKFLKHSMRVGMRFAELNQGAATQD

SEQ ID NO: 9166 - protein, 93 aa, Salvia sclarea
MDKSMLGDLDALPEEDKLRMSSMIDQLQIRDSLRMYNTLVERCFTDCVDTFRRKTLDKQEETCVRRCAEKFLKHSMRVGMRFAELNQGAATPD

SEQ ID NO: 9167 - protein, 93 aa, Triphysaria pusilla
MDKSMLGDLDALPEEDKQRMSAMIDQLQIRDSLRMYNSLVERCFTDCVDTFRRKTLDKQEETCVRRCAEKFLKHSMRVGMRFAELNQGAPTPD

SEQ ID NO: 9168 - protein, 93 aa, Vaccinium corymbosum
MDKSMLGDLDSLPEADKQKMAAMIDQLQIRDSLRMYNSLVERCFTDCVDTFRRKSLDKQEETCVRRCAEKFLKHSMRVGMRFAELNQGAATPD

SEQ ID NO: 9169 - protein, 93 aa, Actinidia deliciosa
MDKSMLGDLDSLPEEDKLRMSTMIDQLQIRDSLRMYNSLVERCFNDCVDTFRRKSLDKQEETCVRRCAEKFLKHSMRVGMRFAELNQGAATPD

SEQ ID NO: 9170 - protein, 108 aa, Olea europaea
MDKSMLGDLDSLPEEDKLRMSSMIDQLQIRDSLRMYNSLVERCFTDCVDTFRRKSLDKQEETCVRRCAEKFLKALNACWHEICRAQPRCWYTRLRKPLIALAIMFWHI

SEQ ID NO: 9171 - protein, 93 aa, Lippia dulcis
MDKSMLGDLDALPDEDKLRMSSMIDQLQIRDSLRMYNTLVERCFTDCVDTFRRKTLDKQEETCVRRCAEKFLKHSMRVGMRFAELNQGAATPD

SEQ ID NO: 9172 - protein, 93 aa, Sarracenia psittacina
MDKNMLGDLDSLPEEDKLRMSSMIDQLQIRDSLRMYNSLVERCFTDCVDTFRRKSLDKQEETCVRRCAEKFLKHSMRVGMRFAELNQGAATPD

SEQ ID NO: 9173 - protein, 93 aa, Scabiosa columbaria
MDKSMLGDLDSLAEEDKIRMSTMIDQLQIRDSLRMYNSLVERCFTDCVDTFRRKTLDKQEETCVRRCAEKFLKHSMRVGMRFAELNQGSATQD

SEQ ID NO: 9174 - protein, 79 aa, Vinca minor
MDKSMLGDLDSLPEEDKIRMSTLIDQLQIRDSLRMYNSLVERCFTDCVDTFRRKTLDKQEETCVRRCAEKFLKHSMRVE

SEQ ID NO: 9175 - protein, 120 aa, Utricularia gibba
MDKSMLGDVDALPEEDKQRMTAMIDQLQIRDSLRMYNSLVERCFTDCVDSFRRKTLDKQEETCIRRCAEKFLKHSMRVGDEICRAESGRRHTGRCRFHPVMQRPRVSKNQEQTPIDSMPC

SEQ ID NO: 9176 - protein, 93 aa, Unknown
  Sequence found in Organisms: Secale cereale, Triticum aestivum
MDKSMLGDLDNLPDEDKMRMSAMIEQLQMRDSLRMYNALVETCFKDCVDTFRRKTLDKQEESCVRRCAEKFLKHSMRVGMRFAELNQGVATPD

SEQ ID NO: 9177 - protein, 93 aa, Persea americana
MDKSMLGDLESLPEEDKLKMASMIDQLQIRDSLRMYNSLVERCFSDCVDTFRRKSLDKQEETCVRRCAEKFLKHSMRVGMRFAELNQGTATPD

SEQ ID NO: 9178 - protein, 93 aa, Mimulus guttatus
MDKSMLGDLDALPEEDKLRMSAMIDQLQVRDSLRMYNSLVERCFTDCVDSFRRKSLDKQEETCVRRCAEKFLKHSMRVGMRFAELNQGAATPD

SEQ ID NO: 9179 - protein, 93 aa, Elaeis guineensis
MDKSMLGDLDSLPEEDKIRMSAMIDQLQIRDSLRMYNSLVERCFSDCVDTFRRKSLDKQEETCVRRCAEKFLKHSMRVGMRFAELNQGAATQD

SEQ ID NO: 9180 - protein, 93 aa, Orobanche aegyptiaca
MDKNMLGDLDALPEEDKQRMSAMIEQLQIRDSLRMYNSLVERCFTDCVDTFRRKTLDKQEETCVRRCAEKFLKHSMRVGLRFAELNQGAATPD

SEQ ID NO: 9181 - protein, 93 aa, Phalaenopsis aphrodite
MDKSMLGDLDNLPEEDKARMSTMIDQLQIRDSLRMYNSLVERCFNDCVDSFRRKTLDKQEETCVRRCAEKFLKHSMRVGMRFAELNQGAATQD

SEQ ID NO: 9182 - protein, 93 aa, Platanus occidentalis
MDKSMLGDLDSLPEEDKLKMAAMIDQLQIRDSLRMYNSLVERCFTDCVDSFRRKSLDKQEETCVSRCAEKFLKHSMRVGMRFAELNQGTATPD

SEQ ID NO: 9183 - protein, 156 aa, Lippia dulcis
AAKACSPHVIRAMAAQKPTPAATKTVASKKGTTSGQSVKLLTRVEQLRLLTKAEKAGLLSAAEKAGFSLSTIERLGLLSKAEELGVLSAATDPGTASGLLSLSLALLALGPVCVYLVPEDYPWEIGLQVVVALLAVVGGSAAFAASNLVSTLQKSN

SEQ ID NO: 9184 - protein, 93 aa, Musa acuminata
MDKSMLGDLDSLPEEDKIRMSAMIDQLQIRDSLRMYNTLVERCFSDCVDTFRRKSLDKQEETCVRRCAEKFLKHSMRVGMRFAELNQGAPTPD

SEQ ID NO: 9185 - protein, 93 aa, Vaccinium corymbosum
MDKSMLGDLDSLPEADKLKMAAMIEQLQIRDSLRMYNSLVERCFTDCVDTFRRKSLDKQEETCVQRCAEKFLKHSMRVGMRFAELNQGAATPD

SEQ ID NO: 9186 - protein, 93 aa, Hordeum vulgare
MDKSMLGDIDNLPDEDKMRMSAMIEQLQMRDSLRMYNALVETCFKDCVDTFRRKTLDKQEESCVRRCAEKFLKHSMRVGMRFAELNQGVATPD

SEQ ID NO: 9187 - protein, 93 aa, Beta vulgaris
MDKNMLGDLDNLPEEDKMKMAAMIDQLQIRDSLRMYNSLVERCFTDCVDSFRRKTLDKQEETCVKRCAEKFLKHSMRVGLRFAELNQGAPTPD

SEQ ID NO: 9188 - protein, 93 aa, Catharanthus roseus
MDKSMLGDLDSLPEEDKVRLSVMVDQLQVRDSLRMYNSLVERCFTDCVDTFRRKTLDKQEETCVRRCAEKFLKHSMRVGMRFQELNQGAATPD

SEQ ID NO: 9189 - protein, 93 aa, Unknown
  Sequence found in Organisms: Cichorium intybus, Lactuca sativa
MDKSMLGDLGNLPAEDQARMATMIDQLQIRDSLRMYNTLVERCFTDCVDTFRRKTLDKQEETCVRRCAEKFLKHSMRVGLRFAELNQGAATPD

SEQ ID NO: 9190 - protein, 93 aa, Taraxacum officinale
MDKSMLGDLGSLPPEDQARMATMIDQLQIRDSLRMYNTLVERCFTDCVDTFRRKTLDKQEETCVRRCAEKFLKHSMRVGLRFAELNQGAATPD

SEQ ID NO: 9191 - protein, 93 aa, Vitis vinifera
MDKSMLGDLDSLPEEDKLRMSVMIDQLQIRDSLRMYNSLVERCFSDCVESFRRKSLDKQEETCVRRCAEKFLKHSMRVGMRFAELNQGTATPD

SEQ ID NO: 9192 - protein, 93 aa, Liriodendron tulipifera
MDKSMLGDLESLPEEDKIRMSVMIDQLQIRDSLRMYNSLVERCFNDCVDSFRRKSLDKQEETCVRRCAEKFLKHSMRVGMRFAELNQGTATPD

SEQ ID NO: 9193 - protein, 93 aa, Mimulus guttatus
MDKSMLGDLDSLPEEDKLRMSAMIDQLQVRDSLRMYNSLVERCFTDCVESFRRKTLDKQEETCVRRCAEKFLKHSMRVGMRFAELNQGAPTPD

SEQ ID NO: 9194 - protein, 93 aa, Lippia dulcis
MDKSMLGDLDALPEEDKLRMSSMIEQLQIRDSLRMYNTLVERCFTDCVDTFRRKTLDKQEETCIRRCAEKFLKHSMRVGMRFAELNQGAATQD

SEQ ID NO: 9195 - protein, 93 aa, Beta vulgaris
MDKNMLGDLDNLPEEDKMKMAAMIDQLQIRDSLRMYNSLVERCFTDCVESFRRKTLDKQEETCVKRCAEKFLKHSMRVGLRFAELNQGAPTPD

SEQ ID NO: 9196 - protein, 93 aa, Malus domestica
MDKSMIGDLDSLPEEDKMRMATMIDQLQIRDSLRMYNSLVERCFNDCVDTFKHKSLQKQEETCVRRCAEKFLKHSMRVGMRFAELNQGAATQD

SEQ ID NO: 9197 - protein, 93 aa, Cirsium arvense
MDKSMLGDLGTLPPEDQARMSTMIDQLQIRDSLRMYNTLVERCFTDCVDTFRRKTLDKQEETCVRRCAEKFLKHSMRVGLRFAELNQGAATPD

SEQ ID NO: 9198 - protein, 93 aa, Taraxacum officinale
MDKSMLGDLGSLPPEDQARMATMIDQLQIRDSLRMYNTPVERCFTDCVDTFRRKTLDKQEETCVRRCAEKFLKHSMRVGLRFAELNQGAATPD

SEQ ID NO: 9199 - protein, 93 aa, Solanum melongena
MDKSMIGDLDSLPEADKLRMAAMIDQLQVRDSLRMYNSLVERCFTDCVDTFKRKTLDKQEETCVRRCAEKFLKHSMRVGLRFAELNQGAPTPD

SEQ ID NO: 9200 - protein, 93 aa, Vitis vinifera
MDKSMLGDLDSLPEEAKLRMSAMIDQLQIRDSLRMYNSLVERCFTDCVDSFPRKSLDKQEETCVRRCAEKFLKHSMRVGMRFAELNQGTATQD

SEQ ID NO: 9201 - protein, 93 aa, Prunus persica
MDKSMIGDLDSLPEEDKLRMATMIDQLQIRDSLRMYNSLVERCFTDCVDTFKHKSLQKQEETCVRRCAEKFLKHSMRVGMRFAELNQGAATQD

SEQ ID NO: 9202 - protein, 93 aa, Helianthus annuus
MDKSMLGDLGSLPPEDQARMATMIDQLQIRDSLRMYNTLVERCFTDCVDTFRRKTLDKQEETCVRRCADKFLKHSMRVGLRFAELNQGAATPD

SEQ ID NO: 9203 - protein, 93 aa, Tragopogon dubius
MDKSMLGDLGNLPAEDQARMATMIDQLQIRDSLRMYNTLVERCFTDCVDTFRRKTLDKQEETCVRRCAEKFLKHSMRVGLRFAELNQGAATQD

SEQ ID NO: 9204 - protein, 93 aa, Zostera marina
MDKSLLGDLDSLPEGDKIRMSQMIDQLQIRDSLRMYNSLVERCFTDCVDTFRRKTLDKQEDTCVRRCAEKFLKHSMRVGLRFAELNQGAPTPD

SEQ ID NO: 9205 - protein, 94 aa, Flaveria ramosissima
MDKSMLGDLASLPPEDQARMSTMIDQLQIRDSLRMYNTLVERCFTDCVDTFRRKTLDKQEETCVKRCAEKFLKHSMRVGMRFAELNQGAATPDE

SEQ ID NO: 9206 - protein, 93 aa, Musa acuminata
MDKSMLGDLESLPEEDKIRMSAMIDQLQIRDSLRMYNTLVERCFSECVDTFRRKSLDKQEETCVRRCAEKFLKHSMRVGMRFAELNQGAPTPD

SEQ ID NO: 9207 - protein, 93 aa, Bupleurum chinense
MDKNMLGDLASLPQEDQAKMASMIDQLQIRDSLRMYNSLVERCFTDCVDTFRRKTLDKQEDTCVRRCAEKFLKHSMRVGMRFAELNQGAATSD

SEQ ID NO: 9208 - protein, 93 aa, Allium cepa
MDKSMLGDMGNLPEEDQMRMASMIEQLQIRDSLRMYNSLVERCFADCVDSFKRKTLDKQEETCVRRCAEKFLKHSMRVGMRFAELNQGAATSD

SEQ ID NO: 9209 - protein, 93 aa, Rosa hybrid cultivar
MDKSMIGDLDSLPEEDKLRMATMIDQLQIRDSLRMYNSLVERCFNDCVDTFKHKSLQKQEETCVRRCAEKFLKHSMRVGMRFAELNQGAATQD

SEQ ID NO: 9210 - protein, 93 aa, Fagopyrum esculentum
MDKSMLGDLDNLPEEDKLRMASMVDQQQMRDSLRMYNSLVERCFNDCVDNFRRKTLDKQEETCVRRCAEKFLKHSMRVGLRFAELNQGAATTD

SEQ ID NO: 9211 - protein, 93 aa, Gerbera hybrid cultivar
MDKSMLGDLGTLPPEDQARMSTMIDQLQIRDSLRMYNTLVERCFTDCVDSFRRKTLDKQEETCVRRCAEKFLKHSMRVGLRFAELNQGAATPD

SEQ ID NO: 9212 - protein, 93 aa, Carpinus betulus
MDKTMLADLDSLPEEDKARMSTMIDQLQIRDSLRMYNSLVERCFTDCVDTFQRKSLTKQEETCVRRCAEKFLKHSMRVGMRFAELNQGAATSD

SEQ ID NO: 9213 - protein, 93 aa, Carpinus betulus
MDKSMLGDLDNLPEEDKLRMSSMIDQLQIRDSLRMYNSLVERCFNDCVDTFKHKSLQKQEETCVRRCAEKFLKHSMRVGMRFAELNQGAATQD

SEQ ID NO: 9214 - protein, 93 aa, Nicotiana benthamiana
MDKSMLGDLDNLPEADKLKMASMIDQLQIRDSLRMYNSLVERCFTGCVDTFKRKTLDKQEETCITRCAEKFLKHSMRVGMRFAELNQGAATQD

SEQ ID NO: 9215 - protein, 93 aa, Carthamus tinctorius
MDKNMLGDLGNLPPEDQARMATMIDQLQIRDSLRMYNTLVERCFTDCVDTFRRKTLDKREETCVRRCAEKFLKHSMRVGLRFAELNQGAATPD

SEQ ID NO: 9216 - protein, 94 aa, Helianthus annuus
MDKSMLGDLGTLPPEDQARMSTMIDQLQIRDSLRMYNTLVERCFTDCVDTFRRKTLDKQEETCVKRCAEKFLKHSMRVGMRFAELNQGAATQDE

SEQ ID NO: 9217 - protein, 94 aa, Flaveria ramosissima
MDKSMLGDLGTLPPEDQARMSTMIDQLQIRDSLRMYNTLVERCFTDCVDTFRRKTLDKQEETCVKRCAEKFLKHSMRVGLRFAELNQGAATPDP

SEQ ID NO: 9218 - protein, 94 aa, Guizotia abyssinica
MDKSMLGDLGTLPPEDQARMSTMIDQLQIRDSLRMYNTLVERCFTDCVDTFRRKTLDKQEETCVRRCAEKFLKHSMRVGLRFAELNQGAATQDE

SEQ ID NO: 9219 - protein, 94 aa, Prunus persica
MDKGMLAADLEGLPEEDKHRMATLIDQLQIRDSLRMYNSLVERCFTDCVDTFQRKALTKQEDSCVRRCAEKFLKHSMRVGMRFAELNQGAATQD

SEQ ID NO: 9220 - protein, 93 aa, Unknown
  Sequence found in Organisms: Cucumis sativus, Cucumis melo
MDKNMLADLDGLPEEDKIKMATMIDQLQIRDSLRMYNSLVERCFTDCIDNFQRKSLTKQEETCVRRCAEKFLKHSMRVGMRFAELNQGAATSD

SEQ ID NO: 9221 - protein, 93 aa, Cynara scolymus
  misc_feature (6)..(6): Xaa can be any naturally occurring amino acid
  misc_feature (19)..(19): Xaa can be any naturally occurring amino acid
MDKSMXGDLGTLPPEDQAXMSTMIDQLQIRDSLRMYNTLVERCFTDCVDTFRRKTLDKQEETCVRRCAEKFLKHSMRVGLRFAELNQGAATPD

SEQ ID NO: 9222 - protein, 93 aa, Fagopyrum esculentum
MDKSMLGDLENIPEEDKLRMAAMVDQQQIRDSLRMYNSLVERCFGDCVDNFRRKTLDKQEETCVRRCAEKFLKHSMRVGLRFAELNQGAATTD

SEQ ID NO: 9223 - protein, 93 aa, Fagopyrum esculentum
MDKSMLGDLENLPEEDKLRMASMVDQQQMRDSLRMYNSLVERCFNDCVDNFRRKTLDKQEETCVRRCAEKFLKHSMRVGLRFAELNQGAATTD

SEQ ID NO: 9224 - protein, 93 aa, Mesembryanthemum crystallinum
MDKNMLGDLDNLPEEDKLKMASMIEQLQIRDSLRMYNNLVERCFTDCVDSFRRKTLDKQEETCVKRCAEKFLKHSMRVGLRFAELNQGAATTD

SEQ ID NO: 9225 - protein, 93 aa, Unknown
  Sequence found in Organisms: Capsicum annuum, Solanum tuberosum, Solanum phureja
MDKSMIGDLDSLPEADKLRMAAMIEQLQVRDSLRMYNSLVERCFTDCVDSFKRKTLDKQEETCVRRCAEKFLKHSMRVGLRFAELNQGAPTPD

SEQ ID NO: 9226 - protein, 93 aa, Petunia hybrida
MDKNMIGDLDSLPEADKLKMAAMIDQLQVRDSLRMYNSLVERCFTDCVDNFRRKTLDKQEETCIRRCAEKFLKHSMRVGMRFAELNQGAPTPD

SEQ ID NO: 9227 - protein, 93 aa, Solanum lycopersicum
MDKSMIGDLDSLPEADKIRMAAMIEQLQVRDSLRMYNSLVERCFTDCVDSFKRKTLDKQEETCVRRCAEKFLKHSMRVGLRFAELNQGAPTPD

SEQ ID NO: 9228 - protein, 96 aa, Utricularia gibba
MDKSMLADVDALPEEDKLRMTAMIDQLQIRDSLRMYNSLVERCFTDCIDSFRRKTLDKQEETCIRRCAEKFLKHSMRVGMRFAELNQGAATPDSAL

SEQ ID NO: 9229 - protein, 94 aa, Primula obconica
MNNGPMGDLSSLPEEDQVRMATMIDQLQIRDSLRMYNSLVERCFTDCVDNFRRKTLDKQEETCVRRCAEKFLKHSMRVGMRFAELNQGAATPDE

SEQ ID NO: 9230 - protein, 74 aa, Musa acuminata
MSAMIEQLQIRDSLRMYNTLVERCFSECVDTFRRKSLDKQEETCVRRCAEKFLKHSMRVGMRFAELNQGAPTPD

SEQ ID NO: 9231 - protein, 89 aa, Epimedium sagittatum
MLGNLDSLPEADKVRMANMIDQLQIRDSLRMYNSLVERCFTDCVDSFRRKSLDKQEETCVRRCAEKFLKHSMRVGMRFAELNQGAATSD

SEQ ID NO: 9232 - protein, 93 aa, Acacia harpophylla
MDKSMLGDLDNLPEEDKLKMAAMIDQLQIRDSLRMYNALVERCFNDCVDTFKHKSLQKQGESCVRRCAERFLKHSMRVGMRFAELNQGAATQD

SEQ ID NO: 9233 - protein, 93 aa, Artemisia annua
MDKSMMGDLGSLPAEDQARMATMIDQLQVRDSLRMYNNLVERCFTDCVDSFRRKTLDKQEESCVKRCAEKFLKHSMRVGLRFAELNQGAATQD

SEQ ID NO: 9234 - protein, 93 aa, Centaurea maculosa
MDKNMLGDLGNLPAEDQARMATMIDQLQVRDSLRMYNTLVERCFTDCVDTFRRKTLDKQEETCVRRCAEKFLKHSMRVGLRFAELNQNAATSD

SEQ ID NO: 9235 - protein, 93 aa, Eschscholzia californica
MDKNMLQELGSLPEEDQMRMSQMIEQLQLRDSLRMYNSLVERCFTDCVDKFTRKSLDKQEESCVRRCAEKFLKHSMRVGMRFAELNQGAATPD

SEQ ID NO: 9236 - protein, 93 aa, Gerbera hybrid cultivar
MDKSMLGDLGSLPPEDQARMSSMIDQLQIRDSLRMYNALVERCFTDCVESFRRKTLDKQEETCVRRCAEKFLKHSMRVGLRFAELNAGAATPD

SEQ ID NO: 9237 - protein, 93 aa, Lotus japonicus
MDKSMLADMDSLGEADKQRMSTMIDQLQIRDSLRMYNSLVERCFTDCVDTFKHKSLQKQEESCVRRCAEKFLKHSMRVGMRFAELNQGAATQD

SEQ ID NO: 9238 - protein, 93 aa, Quercus alba
MDKSMLADLDTLPEEDKIRMSTMIDQLQIRDSLRMYNSLVERCFNDCVDTFKHKSLQKQEETCVRRCAEKFLKHSMRVGLRFAELNQGAATQD

SEQ ID NO: 9239 - protein, 93 aa, Cajanus cajan
MDKSMLADLDSLPEADKQRMSAMIDQLQIRDSLRMYNSLVERCFNDCVDTFKHKSLQKQEETCVRRCAEKFLKHSMRVGMRFAELNQGAATQD

SEQ ID NO: 9240 - protein, 93 aa, Glycine max
MDKSMLADLDSLPEADKQRMTVMIDQLQIRDSLRMYNSLVERCFSDCVDTFKHKSLQKQEETCVRRCAEKFLKHSMRVGMRFAELNQGAATQD

SEQ ID NO: 9241 - protein, 93 aa, Glycine max
MDKSMLADLDSLPEADKQRMTVMIDQLQIRDSLRMYNSLVERCFNDCVDTFKHKSLQKQEETCVRRCAEKFLKHSMRVGMRFAELNQGAATQD

SEQ ID NO: 9242 - protein, 93 aa, Juglans hindsii x Juglans regia
MDKSMLGDLDNLPEEDKIRMSSMIDQLQIRDSLRMYNSLVERCFNDCVDNFKHKSLQKQEETCVQRCAEKFLKHSMRVGMRFAELNQGAATQD

SEQ ID NO: 9243 - protein, 93 aa, Citrullus lanatus
MDKNMLADLEGLPEEDKLKMATMIDQLQIRDSLRMYNSLVERCFTDCIDNFQRKSLTKQEETCVRRCAEKFLKHSMRVGMRFAELNQGAATSD

SEQ ID NO: 9244 - protein, 94 aa, Linum usitatissimum
MDKNMLAGLEGMPEEDKLRMASMIDQLQIRDSLRMYNSLVERCFTDCVDDFSRKSLKKQEETCVQRCAEKFLKHSMRVGMRFAELNQGAATPDN

SEQ ID NO: 9245 - protein, 94 aa, Humulus lupulus
MDKSMLGGDMPQLSEEDNVRMSTMIDQLQIRDSLRMYNSLVERCFTDCVDTFKHKSLQKQEESCVRRCAEKFLKHSMRVGMRFAELNQGAATQD

SEQ ID NO: 9246 - protein, 93 aa, Amorphophallus konjac
MDKSMQGDLENLPEEDKIKMAQMIDRLQVSDSLRMYNSLVERCFIECVDTFRRKSLDKQEETCVRRCAEKFLKHSMRVGMRFAELNQGAPTPD

SEQ ID NO: 9247 - protein, 93 aa, Artemisia annua
MDKSMMGDLGSLPAEDQARMATMIDQLQVRDSLRMYNNLVERCFTDCVDSFRRKTLDKQEETCVKRCAEKFLKHSMRVGLRFAELNQGAATQD

SEQ ID NO: 9248 - protein, 93 aa, Fagus grandifolia
MDKSMLADLDSLPEADKLRMSTMIDQLQIRDSLRMYNSLVERCFNDCVDTFKHKSLQKQEETCVRRCAEKFLKHSMRVGMRFAELTQGAATQD

SEQ ID NO: 9249 - protein, 93 aa, Cucurbita pepo
MDKNMLADLEGLPEEDKLKMATMIDQLQIRDSLRMYNSLVERCFADCIDNFQRKSLTKQEETCVRRCAEKFLKHSMRVGMRFAELNQGAATSD

SEQ ID NO: 9250 - protein, 93 aa, Eucalyptus grandis
MDKSMMGDLDNLPEEDKLRMSSMIDQLQIRDSLRMYNSLVERCFNDCVDSFKHKNLQKQEETCVNRCAEKFLKHSMRVGMRFAELNQGAATQD

SEQ ID NO: 9251 - protein, 421 aa, Cirsium arvense
MSKLMVQPQSQPHFLLLTFPAQGHINPALQFAKRLLRLGVKVTLATCISADGPTTKASEHIPESLNFAVFSDGFDDGYDVNDYTSFMSQLKTRRSHSVKETILSFAKDGTPVTCLVYTLLLPWVAKVAGGLNLPSALLWIQPASVFRIYYYYFKGYDKLIGEGCDEPSWTIELPGVPLLKSRDLPSFCLPSNVNNFALPLFKGQLQALDAEDKPKILVNTFDALEEEALKEIDDKMKLIAVGPLIPSAFLDEKDSSDTSFGGDLIESSKDYIEWMNTKPKRSIVYISFGSIIMSSKKQKEAMAHALLASRRPFLWLLKNKDEAEEEEEKRKNMLGDLGNLPAEDQARMATMIDQLQVRDSLRMYNNLVERCFTDCVDTFRRKTLDKQEETCVRRCAEKFLKHSMRVGLRFAELNQGAATQD

SEQ ID NO: 9252 - protein, 90 aa, Flaveria ramosissima
MLGDLASLPLEDQARMSTMIDQLQIRDSLRMYNTLVERCFTDCVDTFRRKTLDKQEETCVKRCAEKFLKHSMRVGMRFAELNQGAATPDE

SEQ ID NO: 9253 - protein, 94 aa, Fragaria vesca
MDKSMLGDLNSLPAEDQQRMASMIDQLQIRDSLRMYNSLVERCFNDCVDTFKHKSLQKQEETCVKRCAEKFLKHSMRVGMRFAELNQGAATQDE

SEQ ID NO: 9254 - protein, 71 aa, Tropaeolum majus
MIDQLQLRDSLKMYNSLVERCFTDCVDTFTRKSLQKQEESCVMRCAEKFLKNSMRVGMRFAELNQQAPTQD

SEQ ID NO: 9255 - protein, 89 aa, Senecio madagascariensis
MLGDLGSLPPEDQARMATMIDQLQIRDSLRMYNTLVERCFTDCVDSFRRKTLDKQEETCVRRCAEKFLKHSMRVGLRFAELNQGAATQD

SEQ ID NO: 9256 - protein, 93 aa, Sequoia sempervirens
MDKSMLGDLANMPEEDQQRMSNMIDQLQIRDSLRMYNSLVERCFNNCVDSFRRKTLDKQEETCVQRCAEKYLKHSMRVSMRFAELNQGSPTPD

SEQ ID NO: 9257 - protein, 93 aa, Silene vulgaris
MDKSMLENLENLPEQDKMKMGAMIEQLQIRDSLRMYNSLVERCFTDCVDTFKRKTLDKHEETCVKRCAEKFLKHSMRVGLRFAELNQGAATQD

SEQ ID NO: 9258 - protein, 85 aa, Camellia sinensis
LDSLPEEDKLRMSSMIDQLQIRDSLRMYNPLVERCFTDCVDTFRRKSLDKQEETCVRRCAEKFLKHSMRVGMRFAELNQGAATPD

SEQ ID NO: 9259 - protein, 90 aa, Ambrosia trifida
MLGDLGTLPPEDQARMSTMIDQLQIRDSLRMYNTLVERCFTDCVDTFRRKTLDKQEETCVKRCAEKFLKHSMRVGMRFAELNQGAATQDE

SEQ ID NO: 9260 - protein, 79 aa, Triticum aestivum
MDKSMLGDLDGLPEEDKMRMAAMIDQLQIRDSLRMYNSLVERCFTDCVDTFRRKNLDKQEERASAGARRIPEALHEGRH

SEQ ID NO: 9261 - protein, 93 aa, Medicago truncatula
MDKSMIADMENLPEADKQRMATMIDQLQIRDSLRMYNNLVERCFHDCVDTFKHKSLQKQEETCVRRCAEKFLKHSMRVGMRFAELNQGAATQD

SEQ ID NO: 9262 - protein, 93 aa, Cicer arietinum
MDKSMIADMESLPEADKLRMAGMIEQLQIRDSLRMYNSLVEKCFNDCVDTFKHKSLQKQEETCVRRCAEKFLKHSMRVGMRFAELNQGAATQD

SEQ ID NO: 9263 - protein, 93 aa, Vigna unguiculata
MDKSMLADLESLPEADRQRMSAMMEQLQIRDSLRMYNSLVERCFTDCVDTFKHKSLQKQEETCVRRCAEKFLKHSMRVGMRFAELNQGAATQD

SEQ ID NO: 9264 - protein, 93 aa, Cryptomeria japonica
MDKSMLGDLANMPEEDQQRMSNMIDQLQIRDSLRMYNSLVERCFNNCVDSFRRKTLDKQEETCVQRCAEKYLKHSMRVSLRFAELNQGSPTPD

SEQ ID NO: 9265 - protein, 93 aa, Euonymus alatus
MDKNVLAGLEGLPEEDKVRMAAMIDQLQMRDSLRMYNSVVERCFNDCIDNFSRKTLQKQEESCVMRCAEKFLKHSMRVGMRFAELNQGAATQD

SEQ ID NO: 9266 - protein, 93 aa, Glycyrrhiza uralensis
MDKSMLADMESLGEADKQRMSVMIDQLQIRDSLRMYNSLVERCFNDCVDTFKHKSLQKQEETCVRRCAEKFLKHSMRVGMRFAELNQGAATQD

SEQ ID NO: 9267 - protein, 93 aa, Taxus baccata
MDKNMLGDLGNMPEEDQQRMSNMIDQLQIRDSLRMYNSLVERCFNHCVDSFRRKTLDKQEETCVQRCAEKYLKHSMRVSMRFAELNQGSPTPD

SEQ ID NO: 9268 - protein, 93 aa, Tripterygium wilfordii
MDKNVLAGLDGLPEEDKVRMATMIDQLQMRDSLRMYNSVVERCFNDCVDNFSRKSLQKQEETCVMRCAEKFLKHSMRVGMRFAELNQGAATQD

SEQ ID NO: 9269 - protein, 82 aa, Sesamum indicum
LPEADKQRMSAMIDQLQIRDSLRMYNSLVERCFTDCVDTFRRKTLDKQEETCVRRCAEKFLKHSMRVGMRFAELNQGAATQD

SEQ ID NO: 9270 - protein, 93 aa, Cleome gynandra
MDANMLAGLDGLPEEDKARMGSMIDQLQLRDSLRMYNSLVERCFVDCVDNFTRKTLQKQEETCVMRCAEKFLKHTMRVGMRFAELNQNQATQD

SEQ ID NO: 9271 - protein, 93 aa, Cleome spinosa
MDANMLAGLDGLPEEDKARMGSMIDQLQLRDSLRMYNSLVERCFNDCVDNFTRKTLQKQEETCVMRCAEKFLKHTMRVGMRFAELNQNQATQD

SEQ ID NO: 9272 - protein, 93 aa, Humulus lupulus
MDKNMMADMDSLPEEDKLRMSATIDQLQIRDSLRMYNALVERCFTDCVDTFQRKSLTKQEDTCVRRCAEKFLKHSMRVGMRFAELNQGAATSE

SEQ ID NO: 9273 - protein, 93 aa, Tropaeolum majus
MDKNMLAGLDGLPEEDKARMGAMIDQLQLRDSLKMYNSLVERCFTDCVDNFTRKSLQKQEESCVMRCAEKFLKNSMRVGMRFAELNQQAPTQD

SEQ ID NO: 9274 - protein, 93 aa, Quercus alba
MDKNMIADLESLPESDKARMSTLIEQLQIRDSLRMYNSLVERCFTDCVDTFQRKSLTKQEETCVRRCAEKFLKHSMRVGMRFAELNQGAPTTD

SEQ ID NO: 9275 - protein, 93 aa, Carica papaya
MDKGILAGLDGLPEEDKARMSAMIDHLQLRDSLRMYNSLVERCFTDCVDNFTRKTLQKQEETCVMRCAEKFLKHSMRVGMRFAELNSQAATQD

SEQ ID NO: 9276 - protein, 93 aa, Podocarpus macrophillus
MDKNMLGDLSNMPVEDQQRMTNMIDQLQIRDSLRMYNSLVERCFSHCVDSFRRKTLDKQEETCVQRCAEKYLKHSMRVSMRFAELNQGSPTPD

SEQ ID NO: 9277 - protein, 93 aa, Eutrema parvulum
MDASMMAGLDGLPEEDKAKMASMIDQLQLRDSLRMYNSLVERCFVDCVDTFTRKTLQKQEETCVMRCAEKFLKHTMRVGMRFAELNQNAPTQD

SEQ ID NO: 9278 - protein, 102 aa, Papaver somniferum
MDKSMMGDIDAMPEEDKMRMSTMIDQLQVRDSLRMYNSLVERCFVDCVDTFRRKSLDKQEESCIRRCAEKFLKHSMRVGMRFAELNQGTATPDTQLISTTQN

SEQ ID NO: 9279 - protein, 251 aa, Zea mays
MPCCPPSLLGVGPRLRSFLRDYDALQSLALVLIYLQIGCALIGSLGALFNGVLVINLVIGLFAVVAIESSSQRLGRTYAVLLFFAVVLDVAWFILFSHAIWTINPDDKYGQLFVFSLRLALWMQIIGFSVRFLSSFLWIQMYRLGPSFTTPTYFETNHEARTSFLSPRSDSVRRNSMADDILGGSIYDPSYYSSLFEDVRNNACNHQGDKQSGSNDSGSTSAGQSPRLKSFACRSLLANDVESGLRRPLNS

SEQ ID NO: 9280 - protein, 251 aa, Setaria italica
MPCCPPLLLGVGPRLRSFLRDYDALQSLALALIYLQIGCALIGSLGALFNGVLVINLVIGLFAVVAIESSSQRLGRTYAVLLFFAVVLDVAWFILFSHAIWTITPDEKYGELFVFSLRLALWMQIIGFSVRFLSSFIWIQMYRLGASSSTPTYFDANHEVRNSFLSPRSDSVRRSSMADDILGGSIYDPSYYSSLFEDGRNNACNHQGDKQSGSNDSGSTSAGQSPRLKSFSCRSLLTNDVESGLRRPLNP

SEQ ID NO: 9281 - protein, 245 aa, Zea mays
MPCCSPSLLGVGPRVRSFLRDYDALQSLALALIYLQIGCALIGSLGALFNGVLVINLVIGLFAVVAIESSSQRLGRTYAVLLFFAVVLDVAWFILFSHAIWTINPDEKYGELFVFSLRLALWMQIIGFSVRFLSSFLWIQMYRLGASSSTPTYFETNHEARISFLSPRSDSVRRSPTADDILGGSIYDPSYYSSLFEDVRNNACNHQGDKQSGSNDSGSTSAGQTPRLKSFANDVEGGLKRPLNS

SEQ ID NO: 9282 - protein, 252 aa, Brachypodium distachyon
MPWCPGFGPRVRSFLRDYDALQSLALALIYLQIGCALIGSLGALFNGVLVINLVIGLFAVVAIESSSQRLGRTYAVLLFFAIVLDVAWFILFSHAIWNTTPDENYGELFVFSLRLALWMQIIGFSVRFLSSFVWIQMYRLGVSSSTPTYYEANDARNSFLSPRSNSVRRSSMADDILGGSIYDPSYYSSLFEDVRNSACNHQGDKQSGSNDSGSTSAGQSPRLKTFGTRSFLSNDVEAGLRKPLNSCTVETS

SEQ ID NO: 9283 - protein, 252 aa, Triticum aestivum
MHWCPGIGPRVRSFLRDYDALQSLALALIYLQIGCALIGSLGALFNGVLVINLVIGLFAVVAIESSSQRLGRTYAVLLFFAIVLDVAWFILFSHAIWNSTPDEKYGQLFVFSLRLALWMQTIGFSVRFLSSFIWIQMYRLGVSSSTPTYYEANDARNSFLSPRSNSVRRGSMADDILGGSIYDPSYYSSLFEDVRNNACNHQGDKQSGSNDSGSTSAGQSPRLKSFGSRSFLSNDVEAGLRKPLNSCSVETS

SEQ ID NO: 9284 - protein, 258 aa, Oryza sativa
MRSCCCCCPCPAALGIGIGPRLRSFLRDYDALQSLALALIYLQIGCALIGSLGALFNGVLVINLVIGLFAVVAIESSSQTLGRTYAVLLFFAIVLDVAWFILFSHAIWNITPEEKYGQLFVLSLKLALWMQIIGFSVRFLSSFIWIQMYRLGVSSSTPTYHEVNYDGRNSFLSPRSSSVRRNSMADDILGGSIYDPAYYSSLFADVRNNTCTHQGDKQSGSNDSGSTSAGQSPRLKSFASRSFVANDVEAGLRRPLNS

SEQ ID NO: 9285 - protein, 246 aa, Hordeum vulgare
MHWCPGIGPRVRSFLRDYDALQSLALALIYLQIGCALIGSLAALFNGVLVINLVIGLFAVVAIESSSQRLGRTYALLLFFAIVLDVAWFILFSHAIWNSTPDEKYGQLFVFSLRLALWMQTIGFSVRFLSSFIWIQMYRLGVSSSTPTYYEANDARNSFLSPRSNSVRRGSVADDILGGSIYDPSYYSSLFEDVRNNACNHQGDKQSGSNDSGSTSAGQSPRLKSFGSRSFLSNDVSHVQLFEIRI

SEQ ID NO: 9286 - protein, 227 aa, Panicum virgatum
  misc_feature (146)..(146): Xaa can be any naturally occurring amino acid
  misc_feature (184)..(184): Xaa can be any naturally occurring amino acid
  misc_feature (207)..(207): Xaa can be any naturally occurring amino acid
MPCCPPPLLGVGPRLRSFLRDYDALQSLALALIYLQIGCALIGSLGALFNGVLVINLVIGLFAVVAIESSSQRLGRTYAVLLFFAVVLDVAWFILFSHAIWTITPDEKYGQLFVFSLRLALWMQIVGFSVRFLSSFIWIQMYRLGXSSSSPTYFDANHEVRNSFLSPRSDSVRRSSMADDILAXSIYDPSYYSSLFEDFRNNPCNHXGDKQSGSNDSGSTSAANLHD

SEQ ID NO: 9287 - protein, 327 aa, Zea mays
MAGTWVKMEQKGAGPGARSSHAITLLGGTAYSFGGELTPRVPVDSTMYAFDLNTQTWSALDATGDVPPPRVGVTMAAAGGTVFTFGGRDLEHKELNELYAFDAATRAWTLLSSGADGPPHRSYHSMAADAGAGRVYVFGGCGDAGRLNDLWAYDVAAGQWEQLPPPGEACQPRGGPGLVVAGGKVWVVYGFSGEELDDVHCYDPATREWAAVQTTGDRPSPRSVFCAAGFGRHVVLFGGEVDPSDLGHLGAGKFSAEAFALDTETGAWTRLDDRAEAEHHPGPRGWCAFTAGEKDGQRGLLVYGGNSPTNDRLGDIYFFTPVLEAAS

SEQ ID NO: 9288 - protein, 332 aa, Panicum virgatum
MAAGTWVKLEQKGTGPGARSSHAITLVGDTAYAFGGELTPRVPVDNTMYAFDLQTQTWSPVAATGDVPPPRVGVTMAAVGGTVYMFGGRDQDHKELNELYSFDTAAGAWALLSSGADGPPHRSYHSMAADAAAGRVYVFGGCGAAGRLNDLWGYDVAAGRWEQLPPPGEAACRPRGGAGLAVAGGKLWVVYGFGGEELDDVHCYDPATGRWSAVETAGDKPSPRSVFCAVGIGARVVVFGGEVDPSDLGHLGAGKFSAEAFALDTGTGAWTRLDDGAAGAGAEHHPGPRGWCAFAAGEKDGRRGLLVYGGNSPTNDRLDDIYFFAPALEAAS

SEQ ID NO: 9289 - protein, 337 aa, Setaria italica
SQLSKNSRSHLIITQLEQKGAGPGARSSHAITLVGDMAYAFGGEFTPRVPVDKTMYAFDLKSHTWSAVGATGDVPPPRVGVTMAAVGGTVYMFGGRDQEHKELNELYSFDTSTGTWALLSSGADGPPHRSYHSMVADAVGGRVYVFGGCGDAGRLNDLWGYDVAAGRWERLPSPGEACRPRGGPGLAVAGGKLWVVYGFGGEELDDVHCYDPATGRWSAVETSGDKPSPRSVFCVTGIGRHVLVFGGEVDPSDLGHLGAGKFSAEAFALDTETGAWTRLDDDAEAEPEHHPGPRGWCAFAAGEKEGRRGLLVYGGNSPTNDRLDDIYFFAPVLEAAR

SEQ ID NO: 9290 - protein, 242 aa, Zea mays
MSLSVGGARTSLLPSSFTASSSRPRFLALPLHRRSHGSLTSLPAACRRRLRVRMARTESTGVTIGFRAPDFELPEPLTGKLWTLDDFEGNSALLVMFICNHCPFVKHLKKDISKLASFYVEKGLGAVAISSNSVRTHPQDGPDRMAEEAELFKYPFPYLYDESQEVAKAFGAVCTPEFYLFKKDGRRPFELFYHGQFDDSRPSNNVPVTGRDLSRAIDCALSGQELPFVQKPSVGCSIKWHP

SEQ ID NO: 9291 - protein, 243 aa, Setaria italica
MSLAVAGARASLLPSPLAASSSRARLLALPPRHRRPHGSLASPPAAGRRRLRVRMARTETTGVAVGFRAPEFELPEPLTGKLWTLDDFEGNPALLVMFICNHCPFVKHLKKDIAKLTSFYMEKGLGAVAISSNSIRTHPQDGPERMAEEAKLFKYPFPYLYDESQEVAKAFGAVCTPEFYLFKKDGRRPFELFYHGQFDDSRPSNNVPVTGRDLSRAIDCALSGQELPFVEKPSVGCSIKWHP

SEQ ID NO: 9292 - protein, 244 aa, Setaria italica
MSLAAAGARASLLPSPLAASSSLPRLLALPPRHRRPHGSLASPPAAGRRRRLRVRMARTESTGVAVGFRAPEFELPEPLTGKLWTLDDFEGNPALLVMFICNHCPFVKHLKKDIAKLTSFYMEKGLGAVAISSNSIRTHPQDGPECMAEEAKLFKYPFPYLYDESQEVAKAFRAVCTPEFYLFKKDGRRFFELFYHGQFDDSRPSNNVPVTGRDLSRAIDCALSGQELPFVEKPCVGCSIKWHP

SEQ ID NO: 9293 - protein, 252 aa, Oryza sativa
MSLATAAAGAQPFVRSSSSAAAASSSRPLLAVAAARHRRPHGSLAAAAAAARRRRRRPLLQVRAARTESTGVSVGFRAPQFELPEPLTGKLWTLDDFEGNPALLVMFVCNHCPFVKHLKKDIAKLTSFYMEKGLAAVAISSNSIVTHPQDGPDYIAEEAKLYKYSFPYLYDESQEVAKAFRAVCTPEFYLFKKDGRRPFELFYHGQFDDSRPSNNVPVTGRDLSRAIDCALSGQELPFVPKPSVGCSIKWHP

SEQ ID NO: 9294 - protein, 247 aa, Triticum aestivum
MSLVAACAAGARASLLSSSPSSSSRPCPALAHHSRAYRSLVSPAASRGGRRSTRLRVRAARLESTGVSVGFRAPQFELPEPLTGKIWTLDDFEGSPALLVMFICNHCPFVKHLKKDIAKLTSFYMEKGLASVAISSNSIVTHPQDGPEYMAEEAKLFKYPFPYLYDESQEVAKGFRAVCTPEFYLFKKDGRRPFELFYHGQFDDSRPSNNVPVTGRDLSRAIDCALSGQELPFDQKPSVGCSIKWHK

SEQ ID NO: 9295 - protein, 138 aa, Saccharum officinarum
MVVRIRLARFGCRNRPFYRVMAADSRSPRDGKHLEVLGYYNPLPGKDGGKRMGLKFDRVKYWLSVGAQPSDPVQSILFRAGLLPPPPMLAMSRKGGPRDRRPVHPMTGRPLDLEGVTIVDDSNAPEGDAEDPTDEVAS

SEQ ID NO: 9296 - protein, 138 aa, Panicum virgatum
MVVRIRLARFGCRNRPFYRVMAADSRSPRDGKHLEVLGYYNPLPGQDGGKRMGLKFDRVKYWLSVGAQPSDPVQRILFRAGLLPPPPMLAMARKGGPRDRRPIHPMTGKPLDLEGVTIVDDSNAPGGDAEEPKDEVAS

SEQ ID NO: 9297 - protein, 137 aa, Cenchrus ciliaris
MVVRIRLARFGCRNRPFYRVMAADSRSPRDGKHLEVLGYYNPLPGQDGGKRMGLKFDRVKYWLSVGAQPSDPVQRILFRAGLLPPPPMLAMARKGGPRDRRPIHPMTGKPLDLEGVTIVDSDAPEGDDEEPKDEVAS

SEQ ID NO: 9298 - protein, 138 aa, Zea mays
MVVRIRLARFGCRNRPFYRVMAADSRSPRDGKHLEVLGYYNPLPGKDGGKRMGLKFDRVKYWLSVGAQPSDPVQSILFRAGLLPPPPLLAMARKGGPRDRRPIHPMTGRPLDLEGVAIIDNSNAPEGDTEVPTDEVAQ

SEQ ID NO: 9299 - protein, 137 aa, Pennisetum glaucum
MVVRIRLARFGCRNRPFYRVMAADSRSPRDGKHLEVLGYYNPLPGKDGGKRMGLKFDRVKYWLSVGAQPSDPVQRILFRAGLLPPPPMLAMARKGGPRDRRPIHPMTGKPLDFENVTIVNSDAPEGDGEEPKDEVAS

SEQ ID NO: 9300 - protein, 136 aa, Oryza sativa
MVVRIRLARFGCRNRPFYRVMAADSRSPRDGKHLEVLGYYNPLPGKDGGKRMGLKFDRVKYWLSVGAQPSDPVQRILFRAGLLPPPPMLAMARKGGPRDRRPIHPMTGRPLDLEGVTVVDDSNVPEGGAEEPVSEE

SEQ ID NO: 9301 - protein, 137 aa, Setaria italica
MVVRIRLARFGCRNRPFYRVMAADSRSPRDGKHLEVLGYYNPLPGQDGGKRMGLKFDRVKYWLSVGAQPSDPVQRILFRAGLLPPPPMLAMTPKGGPRDRRPIHPMTGKPLDLEGITIVDSDAPEGDAEEHKDEVAS

SEQ ID NO: 9302 - protein, 136 aa, Pseudoroegneria spicata
MVVRIRLARFGCRNRPFYRVMAADSRSPRDGKHLEVLGYYNPLPGKDGGKRMGLKFDRVKYWLSVGAQPSDPVQRILFRAGVLPPPPLLAMGRKGGPRDRNPIHPMTGRPLDLEGVTIVDDPSAAEGDAEEPSLEA

SEQ ID NO: 9303 - protein, 139 aa, Brachypodium distachyon
MVVRIRLARFGCRNRPFYRVMAADSRSPRDGKHLEVLGYYNPLPGKDGGKRMGLKFDRVKYWLSVGAQPSDPVQRILFRAGVLPPPPLLAMGRKGGPRDRNPIHPMTGRPLNLEGVTIVDDPNATEGDAEESTEPTLEA

SEQ ID NO: 9304 - protein, 139 aa, Triticum aestivum
MVVRIRLARFGCRNRPFYRVMAADSRSPRDGKHLEVLGYYNPLPGKDGGKRMGLKFDRVKYWLSVGAQPSDPVQRILFRAGVLPPPPLLAMGRKGGHRDRNPIHPMTGRPLDLEGVTIVDDPNAAEGDAEAPTEPSLEA

SEQ ID NO: 9305 - protein, 139 aa, Hordeum vulgare
MVVRIRLARFGCRNRPFYRVMAADSRSPRDGKHLEVLGYYNPLPGKDGGKRMGLKFDRVKYWLSVGAQPSDPVQRILFRAGVLPPPPLLAMGRKGGHRDRNPIHPMTGRPLDLEGVTIVDDPNAAEGDAEASTEPSLEA

SEQ ID NO: 9306 - protein, 139 aa, Hordeum vulgare
MVVRIRLARFGCRNRPFYRVMAADSRSPRDGKHLEVLGYYNPLPGKDGGKRMGLKFDRVKYWLSVGAQPSDPVQRILFRAGVLPPPPLLAMGRKGGHRDRNPIHPMTGRPLDLEGVTIVDDPNAADGDAEASTEPSLEA

SEQ ID NO: 9307 - protein, 429 aa, Secale cereale
SDSSDVEDRSVDKGYPGNDTTSPNVEAGTDVRETQSILLERIASEMNRLKFYISHAQNLPFIENMEKRVQGATKLLDGSLERCFVVGLEHRDAKVIYNCLRAYAAIDNTSSAEELFRTTVVSPLIQKIVPQNYAKAVSGVSSDDLEDDYEQIMQCVEKDCKFILEISSSANSGLHIFDFLANSILKEVHSAIMKGKPGACSPGKPKDFLRNYKASLKFLDFLEGYCPSKSAVTKFRSEPAYTDFMRLWHVNVYFSLRFQEIAGGLDGALTATISPVGVNENQMKQKTLLLKQSIKLLESLQSCWSDDVLVFSHSDKFLRLSLQLISRYTTWLSSGLAARNASDGSSSSPADSEWALSVPVEDFIYVIHDVNAVIGELSESSDFVGRVNQLLASCPIEVLALVKQSILQAVEPLKELLPSVMDVIIGVDS

SEQ ID NO: 9308 - protein, 137 aa, Oryza sativa
MVVRIRLARFGCRNRPFYRLMAADSRSPRDGKHLEVLGYYDPLPGKDGGKRMGLKFDRVKYWLSVGAQPSDPVERILYRAGILPPPPMLAMAHKGGPRDRRPIDPMTGRPLDLEGVTVVDDSHTPKSGDGAPNEETA

SEQ ID NO: 9309 - protein, 88 aa, Triticum aestivum
MVVRIRLARFGCRNRPFYRVMAADSRSPRDGKHLEVLGYYNPLPGKDGGKRMGLKFDRVKYWLSVGAQPSDPVQSISFVPDFCHHLHC

SEQ ID NO: 9310 - protein, 137 aa, Cenchrus ciliaris
  misc_feature (46)..(46): Xaa can be any naturally occurring amino acid
  misc_feature (75)..(76): Xaa can be any naturally occurring amino acid
MVVRIRLARFGCRNRPFYRLMAADSRSPRDGKHLEVLGYYNPLPGXDGGKRMGLKFDRVKYWLSVGAQPSDPVEXXLFRAGILPPPPMLAMAHKGGPRDRRPIDPMTGRPLDIEGLTIVDDPNIQDGENGVSVEETA

SEQ ID NO: 9311 - protein, 137 aa, Setaria italica
MVVRIRLARFGCRNRPFYRLMAADSRYPRDGKHLEVLGYYNPLPGKDGGKRMGLKFDRVKYWLSVGAQPSDPVERMLFRAGILPPPPMLAMEHKGGPRDRRPIDPMTGCPLDIEGLTIVDDPNTLDGENGASVEETA

SEQ ID NO: 9312 - protein, 137 aa, Panicum virgatum
MVVRIRLARFGCRNRPFYRLMAADSRSPRDGKHLEVLGYYNPLPGKDGGKRMGLKFDRVKYWLSVGAQPTDPVERILFRAGILPPPPMLAMAHKGGPRDRQLIDPMTGHPLDIDGLAIVDDPNAPDGENGASIEKTA

SEQ ID NO: 9313 - protein, 137 aa, Panicum virgatum
MVVRIRLARFGCRNRPFYRLMAADSRSRRDGKHLEVLGYYDPLPGKDGGKRMGLKFDRLKYWLSVGAQPSDPVERILFRAGILPPPPMLAMAHKGGPRDRQLIDPMTGHPLDIEGLSIVDDPNAPDGENGASIEKTA

SEQ ID NO: 9314 - protein, 837 aa, Zea mays
MFFSRLDDSPMFRKQMQSLEEGAELLRERCLKFHKGCRKYTEGLGEAYDGDIAFASSLETFGGGHNDPISVTFGGPVMTKFTIALREIGTYKEVLRSQVEHMLNDKLLQFVDIDLHEMKDARKRFDKATLLYDQAREKYLSLKKGTRTDVATAVEDELHSARSLFEQARFNLVTALSNIEAKKRFEFLEAVSGTMDAHLRYFKQGYELLHQMEPYINQVLAFAQQSRERSNYEQAALLERMQEFKRQIDRESRWSPNGMNDSPNGDGIQTIGRSSHKMIEEAMQSASKGKVQTIRQGYLSKRSSNLRGDWKRRFFVLDSRGMLYYYRKQNSRPSSGYSNQRTSIPSEHGSGLLSRWFSSHYHGGVHDEKSVARHTVNLLTSTIKVDADQSDLRFCFRIISPTKNYTLQAESAMDQMDWIEKITGVIASLLSSQSPERHLISSPKGSSHHRTASSSSSFSSSTELEHSISEDCMLEKNSGSGYFEHSARVAQHHRTSMMKPDKPIDLLRKVAGNNCCADCGASEPDWASLNLGILLCIECSGVHRNMGVHISKVRSLTLDVRVWEQSVINLFQSIGNTFANSVWEEMLPSSSCVDHGDISRADGLENMSHGFAPKKPKQSDSIAVKEKFIHAKYAEKDFVRKHNMDGIQLAEQMWDNVSSNNKKGVYSLIVGSNADVNFSYGHTSFNSALTLGKALLLQEQSASPSNGSSRCFDRNPLEKGCTGDSVSPASTSARIDGPDDYVEGLSLLHLACRAADLGMVELLLQYGANVNSTDSRGRTPLHHSIMKGRHVYAKLLLSRGADSQAADRDGRTALQYAIDSGTIEDEEILVLLEDPSR

SEQ ID NO: 9315 - protein, 837 aa, Panicum virgatum
MFFSRLDDSPMFRKQMQSLEDGAELLRERCLKFHKGCRKYTEGLGEAYDGDIAFASSLETFGGGHNDPISVAFGGPVMTKFTIALREIGTYKEVLRSQVEHMLNDKLLQFVDIDLHEMKDARKRFDKATLLYDQAREKYLSLKKGTRTDVATAVEDELHSARSSFEQARFNLVTALSNIEAKKRFEFLEAVSGTMDAHLRYFKQGYELLHQMEPYINQVLAYAQQSRERSNYEQAALVERMQEFKRQIDRKSRWSPNGMNDSPNGDGIQAIGRSSHKMIEAAMQSASKGKVQTIRQGYLSKRSSNLRGDWKRRFFVLDSRGMLYYYRKQNSRPSSGYSNQRTSTPSEHGSGLLSRWFSSHYHGGVHDEKSVARHTVNLLTSTIKVDADQSDLRFCFRIISPTKNYTLQAESAMDQMDWIEKITGVIASLLSSQSPERRLLLSPKGSSHHRTASESSSFSSSTELEHSISEDRMLEKNSGSGYFEHSARATQHHRTSMMKPDKPIDLLRKVAGNGNCADCGASEPDWASLNLGVLLCIECSGVHRNMGVHISKVRSLTLDVRVWEPSVINLFQSLGNAFANTVWEEMLPSLSCADHGDISRADRLENTSHCFALSKPKQSDPIAVKEKFIHAKYAEKDFVRKHNMDEIQLAQQMWDNVSSNNKKGLYSLIVGSNADVNFSYGHTPFNSALTLGKALLLQEQPGSPSNGSSRCFDRNPLEKGSPGDSISPASTSARIDELDDYVEGLSLLHLACRVADLGMVELLLQYGANVNSTDSRGRTPLHHCIMKGRHFYAKLLLSRGADSQVTDRDGRTALQYAIDSGTIDDEEILVLLEDPSR

SEQ ID NO: 9316 - protein, 837 aa, Setaria italica
MFFSRLDDSPMFRKQMQSLEEGAELLRERCFKFHKGCRKYTEGLGEAYDGDIAFASSLETFGGGHNDPISVAFGGPVMTKFTIALREIGTYKEVLRSQVEHMLNDKLLQFVDIDLHEMKDARKRFDKASLLYDQAREKYLSLKKGTRTDVATAVEDELHSARSSFEQARFNLVTSLSNIEAKKRFEFLEAVSGTMDAHLRYFKQGYELLHQMEPYINQVLAYAQQSRERSNYEQAALVERMQEFKRQIDRESRWSPNGMNDSPNGDGIQAIGRSSHKMIEAVMQSASKGKVQTIRQGYLSKRSSNLRGDWKRRFFVLDSRGMLYYYRKQNSRPSSGYSNQRTSTPSEHGSGLLSRWFSSHYHGGVHDEKSVARHTVNLLTSTIKVDADQSDLRFCFRIISPTKNYTLQAESAMDQMDWIEKITGVIASLLSSQSPERRLLLSPKGSSHHRTASESSSFSSSTELEHSISEDCMLEKNSGSGYFDHSARGTQHHRTSMMKPDKPIDLLRKVAGNGNCADCGAAEPDWASLNLGILLCIECSGVHRNMGVHISKVRSLTLDVRVWELSVINLFQSLGNTFANTVWEGMLPSSSCADHGDISRADELENTLHGFTLSKPKQSDPITVKEKFIHAKYAEKDFVRKHNVDEIQLAQLMWDNVSSNNKKGVYSLIVGSNADVNFSYGHTSFNSALTLGKALLLQEQPASPSNGSSRCFDRNPLEKDSSGDSISPASTSARIDELDDYVEGLSLLHLACRVADLGMVELLLQYGANVNSTDSRGRTPLHHCIMKGRPMYARLLLSRGADSQATDRDDRTALQYAMDGGAIDDEEILVLLEDPSR

SEQ ID NO: 9317 - protein, 836 aa, Oryza sativa
MFFTRLDDSPMFRKQIQSLEEGSELLRERCLRFHKGCRKYTEGLGEAYDGDIAFASSLEAFGGGHNDPISVAFGGPVMTKFTIALREIGTYKEVLRSQVENMLNDKLLQFVDIDLHDVKDARKRFDKASLLYDQARERYLSLKKGTRTDVATAVEDELHSARSSFEQARFNLVTALSNIEAKKRFEFLEAVSGTMDAHLRYFKQGYELLHQMEPYINQVLAYAQQSRERSNYEQAALVERMQEFKRQIDRESRWSPNGINDSPNGDGIQAIGRSSHKMIEAVMQSASKGKVQTIRQGYLSKRSSNLRGDWKRRFFVLDSRGMLYYYRKQNSRPSSGYTNQRSSAPSEHGSGLLSRWFSSHYHGGVHDEKSVARHTVNLLTSTIKADADQSDLRFCFRIISPTKNYTLQAESAMDQMDWIEKITGVIASLLSSQSPERRLLSSPKGSGHNRTASESSSFSSSTELDHSISEDCMLERNSGSGYFDHSGRAIQHHRTSMKPDKPIDLLRKVVGNNICADCGAAEPDWASLNLGILLCIECSGVHRNLGVHISKVRSLTLDVRVWEPSVINLFQSLGNTFANTIWEDMLPSSSSVDHGDNSRADGLENTSHNLIFSKPKHSDHIAVKEKFIHAKYAERDYVRKLNMDDSLVAQQMWENVSSNNKKGVYSLIVGSNADVNLTYGQTSFNSALTLGKALLLQEQPTSPSDGSSRCFDRSSLERISPRDSLSLASTSARIDELDDCVEGLSLLHLACRVADVGMVELLLQYGANVNSADSRGRTPLHHSILKGRHMFAKLLLSRGADSQATDRDGRTALQYAIDSGTIDDEEILVLLEDPSR

SEQ ID NO: 9318 - protein, 836 aa, Brachypodium distachyon
MYFSRLDDSPMFRKQMQSLEEGAELLRERCLKYHKGCRKYTEGLGEAYDGDIAFASSLEAFGGGHNDPISVAFGGPVMTKFTIALREIGTYKEVLRSQVEHMLNDKLLQFVDMDLHDVKDARKRFDKASLLYDQARERYLSLKKGTRSDIATAVEDELHSARSSFEQARFNLVTALSNIEAKKRFEFLEAVSGTMDAHLRYFKQGYELLHQMEPYINQVLAYAQQSRERSNYEQAALVERMQEFKRQIDRESRWSPTGMTDSPNGDGIQAIGRSSHKMIEAVMQSASKGKVQTIRQGYLSKRSSNLRGDWKRRFFVLDNRGMLYYYRKQNSRPSSGYPNQRSSTPSEHGSGLLSRWFSSHYHGGVHDEKSVARHTVNLLTSTIKVDADQSDLRFCFRIISPTKNYTLQAESAMDQMDWIEKITGVIANLLSSQSPERRLLLSPKGSGHHRTTSESSSFSSSTELDHSISEDCMMEKNPGSGYFEHSSRVTQHHRTSMKPDRPIELLRKVVGNDICADCGAAEPDWASLNLGVLLCIECSGVHRNLGVHISKVRSLTLDVRVWEPSVINLFQSLGNTFANTIWEEMLPLSSSVDHGDTPRADGIENTSPNLAVSKPKHSDPIALKEKFIHAKYADKDFVRKRNMDETQLAQQMWDNVSSNNKMGVYSLIVGSHADVNLTYGQTSFNSALTLGKALLLQEQPASPSNGSSRCFDRGSLEKISPTDSLSPASTSERIDELDVGVEGLSLLHLACRVADVGMVELLLQYGANVNSTDSRGRTPLHHSILKGRRVYAKLLLSRGADSRATDRDGRTALQYAIDSGTINDEEILVLLEDPSR

SEQ ID NO: 9319 - protein, 834 aa, Triticum aestivum
MYFTRLDDSPMFRKQMQSLEEGADLLRERCLKYHKGCRKYTEGLGEAYDGDIAFASSLEAFGGGHNDPISVAFGGPVMTKFTIALREIGTYKEVLRSQVEHMLNDKLLQFVDMDLHDVKDARKRFDKASLLYDQARERYLSLKKGTRTDIATAVEDELHSARSSFEQARFNLVTALSNIEAKKRFEFLEAVSGTMDAHLRYFKQGYELLHQMEPYINQVLAYAQQSRERSNYEQAALVERMQEFKRQIDRESRWSPNGMTDSPNGDGIQAIGRSSHKMIEAVMQSASKGKVQTIRQGYLSKRSSNLRGDWKRRFFVLDNRGMLYYYRKQNSRPSSGYSNQRSSTPNEHGSGLLSRWFSSHYHGGVHDEKSVARHTVNLLTSTIKVDADQSDLRFCFRIISPTKNYTLQAESAMDQMDWIEKITGVIASLLSSQSPERRLLLSPKGSGHHRTNSESSSFSSSTELDHSMSEDFMMEKNSGSGYFEHSRVTQHHRTSMRPDKPIELLRKVVGNDVCADCGAAEPDWASLNLGVLVCIECSGVHRNLGVHISKVRSLTLDVRVWEPSVINLFQSLGNTFANTIWEEMLTSSSSFDHGDTSRADGIENTPDNLAVRKPKQSDPISLKEKFIHAKYAEKDFVRKHSMDETQLAQQMWDHVSSNNKMEVYSLIVRSNADVNLTYGQTSFNSALTLGKALLLQEQPSSPSNGSSRCFDRGASEKISPRGSLSPASTSARTDELDGCAEGLSLLHLACRVADIGMVELLLQYGASVNSTDPRGRTPLHHSILKGRRVHAKLLLSRGADSQATDREGRTALQYAIDSGTIEDEEILVLLEDPR

SEQ ID NO: 9320 - protein, 834 aa, Secale cereale
MYFTRLDDSPMFRKQMQSLEEGAELLRERCLKYHKGCRKYTEGLGEAYDGDIAFASSLEAFGGGHNDPISVAFGGPVMTKFTIALREIGTYKEVLRSQVEHMLNDKLLQFVDMDLHDVKDARKRFDKASLLYDQARERYLSLKKGTRTDIATAVEDELHSARSSFEQARFNLVTALSNIEAKKRFEFLEAVSGTMDAHLRYFKQGYELLHQMEPYINQVLAYAQQSRERSNYEQAALVERMQEFKRQIDRESRWSPNGMTDSPNGDGIQAIGRSSHKMIEAVMQSASKGKVQTIRQGYLSKRSSNLRGDWKRRFFVLDNRGMLYYYRKQNSRPSSGYSNQRSSTPTEHGSGLLSRWFSSHYHGGVHDEKSVARHTVNLLTSTIKVDADQSDLRFCFRIISPTKNYTLQAESAMDQMDWIEKITGVIASLLSSQSPERRLLLSPKGSGHHRTNSESSSFSSSTELDHSMSEDFMMEKNSGSGYFEHSRLTQHHRTSMRPDKPIELLRKVVGNDVCADCGAAEPDWASLNLGVLVCIECSGVHRNLGVHISKVRSLTLDVRVWEPSVINLFQSLGNTFANTIWEEMLTSSSRFDHGDTSRADGIENTPDNLAVRKPKQSDPISLKEKFIHAKYAEKDFVRKHSMDETQLAQQMWDHVSSNNKMEVYSLIVRSNADVNLTYGQTSFNSALTLGKALLLQEQPSSPSNGSSRCFDRGTVEKVSPRSSLSPASTSARTDELDGCAEGLSLLHLACRVADIGMVELLLQYGASVNSTDSRGRTPLHHSILKGRRVHAKLLLSRGADSQATDREGRTALQYAIDSGTIEDEEILVLLEDPR

SEQ ID NO: 9321 - protein, 834 aa, Triticum aestivum
MYFTRLDDSPMFRKQMQSLEEGADMLRERCLKYHKGCRKYTEGLGEAYDGDIAFASSLEAFGGGHNDPISVAFGGPVMTKFTIALREIGTYKEVLRSQVEHMLNDKLLQFVDMDLHDVKDARKRFDKASLLYDQARERYLSLKKGTRTDIATAVEDELHSARSSFEQARFNLVTALSNIEAKKRFEFLEAVSGTMDAHLRYFKQGYELLHQMEPYINQVLAYAQQSRERSNYEQAALVERMQEFKRQIDRESRWSPNGMTDSPNGDGIQAIGRSSHKMIEAVMQSASKGKVQTIRQGYLSKRSSNLRGDWKRRFFVLDNRGMLYYYRKQNSRPSSGYSNQRSSTPNEHGSGLLSRWFSSHYHGGVHDEKSVARHTVNLLTSTIKVDADQSDLRFCFRIISPTKNYTLQAESAMDQMDWIEKITGVIASLLSSQSPERRLLLSPKGSGHHRTNSESSSFSSSTELDHSMSEDFMMEKNSGSGYFEHSRVTQHHRTSMRPDKPIELLRKVVGNDVCADCGAAEPDWASLNLGVLVCIECSGVHRNLGVHISKVRSLTLDVRVWEPSVINLFQSLGNTFANTIWEEMLTSSSSFDHGDTSRADGIENTPDNLAVRKPKQSDPISLKEKFIHAKYAEKDFVRKHSMDETQLAQQMWDHVSSNNKMEVYSLIVRSNADVNLTYGQTSFNSALTLGKALLLQEQPSSPSNGSSRCFDRGTSEKISPRGSLSPASTSARTDELDGCAEGLSLLHLACRVADIGMVELLLQYGASVNSTDSRGRTPLHHSILKGRRVHAKLLLSRGADSQATDCEGRTALQYAIDSGTIDDEEILVLLEDPR

SEQ ID NO: 9322 - protein, 835 aa, Hordeum vulgare
MYFTRLDDSPMFRKQMQSLEEGAELLRERCLKYHKGCRKYTEGLGEAYDGDIAFASSLEAFGGGHNDPISVAFGGPVMTKFTIALREIGTYKEVLRSQVEHMLNDKLLQFVDMDLHDVKDARKRFDKASLLYDQARERYLSLKKGTRTDIATAVEDELHSARSSFEQARFNLVTALSNIEAKKRFEFLEAVSGTMDAHLRYFKQGYELLHQMEPYINQVLAYAQQSRERSNYEQAALVERMQEFKRQIDRESRWSPNGMTDSPNGDGIQAIGRSSHKMIEAVMQSASKGKVQTIRQGYLSKRSSNLRGDWKRRFFVLDNRGMLYYYRKQNSRPSSGYSNQRSSTPTEHGSGLLSRWFSSHYHGGVHDEKSVARHTVNLLTSTIKVDADQSDLRFCFRIISPTKNYTLQAESAMDQMDWIEKITGVIASLLSSQSPERRLLLSPKGSGHHRTNSESSSFSSSTELDHSMSEDFMMEKNSGSGYFEHSSRVTQHHRTSMRPDKPIELLRKVVGNDVCADCGAAEPDWASLNLGVLVCIECSGVHRNLGVHISKVRSLTLDVRVWEASVINLFQSLGNTFANTIWEEMLTSSSSVDHGDAVRTDGIENTPDNLAVRKPKQSDPISLKEKFIHAKYAEKDFVRKHSMDETQLAQQMWDHVSSNNKMEVYSLIVRSNADVNLTYGQTSFSSALTLGKALLLQEQPSSPSNGSSRCFDRGTVEKISPRSSLSPASTSARTDELDGCAEGLSLLHLACRVADIGMVELLLQYGASVNCTDSRGRTPLHHSILKGRRVHAKLLLSRGADSQATDREGRTSLQYAIDSGTIDDEEILVLLEDPR

SEQ ID NO: 9323 - protein, 785 aa, Pennisetum glaucum
FASSLEAFGGGHNDPISVAFGGPVMTKFTIALREIGTYKEVLRSQVEHMLNDRLLNFVDIDLHDVKDAHKRFDKASLAYDQIREKYLSLKKGTRPDITTAIEDELHSARSSFEQARFNLVTSLSHIEAKKRFEFLEAVSATMDSHLRYFKQGYELLHQMEPYINQVLAYAQQSRERSNYEQAALIERMQEFKRQIDRESRWSPNGMNDSPNGDGIQAIGRSSHKMIEAVMQSASKGKVQTIRQGYLSKRSSNLRGDWKRRFFVLDSRGMLYYYRKQNSRPSSGYPNQRTSTPSSEHGSGLLSRWFSSHYHGGVHDEKSVARHTVNLLTSTIKVDADQSDLRFCFRIISPTKNYTLQAESAMDQMDWIEKITGVIASLLSSQSPERRLLLSPKGSSHHRTASESSSFSSSTELEHSISEDCMLEKNSGSGYFDHSSRGTQHHRTSMMKPDKPIDLLRKVAGNGNCADCGAAEPDWASLNLGILLCIECSGVHRNMGVHISKVRSLTLDVRVWEPSVINLFQSLGNTFANTVWEGMLPSSCCTDHGDISRADELENTLHDLTLSKPKQSDPIAVKEKFIHAKYAEKDFVRKHNVDEVQLAQQMWDNVSSNNKKGVYSLIVGSNGDVNFSYGHTSFNSALTLGKALLLQEQPASPSNGSSRCFDRNPLEKDSPGDSISPASTSARIDEFDDYVEGLSLLHLACRVADLGMVELLLQYGANVNSTDSRGRTPLHHCIMKGRPMYARLLLSRGADSQATDRDGRTALQYAIDGGTIEDEEILVLLEDPSR

SEQ ID NO: 9324 - protein, 672 aa, Zea mays
MFTCRCAVVVVVALAVLLLPAAATQLVYCDDSTYADNSTFQANLNLLSAALPANASASPAGFATGAVGTAPEQVNGMALCRGDTNASSCSSCVAAAFRYAQAQQGCPLTKGATVYLDDCTLRFAGIRFLDFLREDQWLVPELVPAIEPASGSVNATDAWFGAAVAGIFTALVDRAAAASNATRKYFATAEMDFDPKLYGLAQCAPDLTPAQCQGCLGDLQSRVTAQFLSGRPLGNNAFMVWCSLRYSVSPFYAGRAMLQLPAPPAPPPTSTPTLHSSGRKVNAAGISAGIACVVVLMLILSVFFFIRFRLRIKVKKNDHSLKKIGRAQCTIFDLLTLEEATEHFAEKNKLGKGGFGIVYKGILSDGQEIAVKKLLGRAGSGLDQLQNEVQVLAELQHKNLVGLQGFCSHHNDTLLVYEYIKNGSLDTILFDDREGNALNWEQQYNIIFGIAKGILYLHEDSSMRIIHRDLKANNILLDDNMEPKIADFGLARLLGEGHTHTQTGRVVGTFGYMAPEYASHGSVSPKIDIFSFGVLILEIVTRRSNCSSDDHSTVNLLSDVWDHWKKGTMPQMLHRSLDEFARSQALRCIHIGLLCVQPEPDDRPDISAVVFMLTRDSIELQPPGQPAFFFGRESPSALRLDGQSSYVYHRDGFKLGQGVSVNGVTLSELYPR

SEQ ID NO: 9325 - protein, 216 aa, Saccharum officinarum
MAQAMASMTGLSQGVLPSRRAASRARTAVVVRASAEGEAAAQAGRRAVLGLVATGIVGGALSQAVHAATVNPIKIGAPPPPSGGLPGTENSDQARDFGLPLKDRFYLQPLPPAEAAARVKTSAQDIINLKPLIDKKAWPYVQNDLRLRASYLRYDLKTVIASKPKEEKKSLKELTGKLFSTIDDLDHAAKIKSTPEAEKYFAATKDVLGDVLAKIG

SEQ ID NO: 9326 - protein, 216 aa, Zea mays
MAQAMASMTGLSQGVLPSRRAANRARTAAVVRASAEAQAQAQAGRRAVLGLVATGIVGGALSQAVHAETVKTIKIGAPPPPSGGLPGTLNSDQARDFDLPLKERFYLQPLPPAEAVARVKTSAQDIINLKPLIDKKAWPYVQNDLRLRASYLRYDLKTVIASKPKEEKQSLKELTGKLFSTIDDLDHAAKIKSTPEAEKYFAATKDALGDVLAKLA

SEQ ID NO: 9327 - protein, 217 aa, Zea mays
MAQAMASMTGLSQGVLPSRRADSRTRTAVVIVRASAEGDAVAQAGRRAVIGLVATGIVGGALSQAARAETVKTIKIGAPPPPSGGLPGTLNSDQARDFDLPLKERFYLQPLPPAEAAARVKTSAQDIINLKPLIDKKAWPYVQNDLRLRASYLRYDLKTVIASKPKEEKKSLKELTGKLFSTIDDLDHAAKIKSTPEAEKYFAATKDALGDVLAKLG

SEQ ID NO: 9328 - protein, 216 aa, Panicum virgatum
MAQAMASMTGLSQGVLPSRRAASRARAAVVRASAEGEAAAQAGRRAVLGLVATGIVGGVFTQAVRADEAVKTIKIGPPPPPSGGLPGTLNSDQARDFDLALKERFYLQPLPPAEAAARAKSSAQDILNLKPLIDKKAWPYVMNDLRLRASYLRYDLNTVIASKPREEKKSLKELTGKLFSTIDDLDHAAKIKSTPEAEKYYAATKSALDDVFAKLG

SEQ ID NO: 9329 - protein, 218 aa, Panicum virgatum
MAQAMASMTGLSQGVLPSRRAASRARTAVVRASAEGEGEAAAQAGRRAVLGLVATGIVGSVFTQAVRADEAVKTIKIGPPPPPSGGLPGTLNSDQARDFDLALKERFYLQPLPPAQAAARAKSSAQDILNLKPLIDKKAWPYVMNDLRLRASYLRYDLNTVIASKPKEEKKSLKELTGKLFSTIDDLDHAAKIKSTPEAEKYYAATKSALDDVLAKLG

SEQ ID NO: 9330 - protein, 211 aa, Setaria italica
MAQAMASMTGLSQGVLPSRRAASRARTAVVRASADGEAGRRAVLGLVATGIVGSVFSQAAHAEAVKTIKIGPPPPPSGGLPGTLNSDQARDFDLALKERFYLQPLPPAEAAARAKSSAQDILNLKPLIDKKAWPYVMNDLRLRASYLRYDLNTVIASKPKDEKKSLKELTGKLFSTIDDLDHAAKIKSTPEAEKSFAATKSALDDVFAKLG

SEQ ID NO: 9331 - protein, 211 aa, Eragrostis curvula
  misc_feature (58)..(58): Xaa can be any naturally occurring amino acid
  misc_feature (61)..(61): Xaa can be any naturally occurring amino acid
  misc_feature (64)..(64): Xaa can be any naturally occurring amino acid
MAQAMASMTGLSQGVLPGRRVGRARTAIRASAAAEGETSRRAVLGLVATGIVGGALSXAAXAEXVKTIKIGGAPPPSGGLPGTENSDQARDFGLPLKERFYLQPLPPAEAAARAKQSAQDIINLKPLIDKKAWPYVMNDLRLRASYLRYDLKTVIASKPKDEKKSLKELTGKLFNTIDDLDHAAKIKSTPEAEKYYAETKTVLSDVLAKLG

SEQ ID NO: 9332 - protein, 294 aa, Pennisetum glaucum
MGMDRSLRLFQSSFPDRFFDLGIAEQHAVTFSAGLACGGLKPFCIIPSTFLQRAYDQIVEDVDMQKIPVRFAITNAGLVGSEGPTNSGPFDITFMSCLPNMIVMSPSNEDELVDMVATAAMVEDRPICFRYPRGAIVGTSGTLTYGNPLQIGKGEILVEGKEIAFLGYGEVVQRCLIARSLLSNFGIQATVANARFCKPLDIDLIRTLCQQHSFLITVEEGTVGGFGSHVSQFISLDGLLDGRIKWRPIVLPDRYIEHASLAEQLDLAGLTAHHIAATALTLLGRHRDALLLMK

SEQ ID NO: 9333 - protein, 334 aa, Zea mays
MSAAAALRPIEPLPLPTGLSLSPRLKLLLTFFRADLTVRPLDEWQLKSALLAFLRDPPLPLPLLPDSDLSVSRLPDLQKRRREEPVASGVLHVRDLSFLRPRKGDGEAEEMTGEQEKYFEWRSTLVQKLEGIELNLEGVKFRMTVEIPSSDDFRTMKKSWEDFYSSELLNTRNPVRKIAKRPDTIVVRGVPSRWFAETRVSSKPSTLVTHTVFSALGKIRNLNISNDDEIEAKGHGVNKGLISGLNCKVQVQFESYNDFQDAMKALCGRSLEKEGSRLKVDYDVTWDCEGFFRISQYEPVRNNLEERDSLASVNSQRKHHTSRIESDYRKRFRE

SEQ ID NO: 9334 - protein, 336 aa, Setaria italica
MPAAAALRPTEPLPLPSGLSLTPRLKLILTFFRADLTVRPLDEWQLKSALLTFLRDPPLSLPLLPDSDLSVRRLPNLQKRRREEPVASGALHVRDLSLLRPRKGDSEAEEMTPEQEEEKYFEWRSSLVEKLEGIELNLEGVKFRMTIEIPPSEDFRTMKKSWEDFYSSELLNSRNPVRKIARRPDTIIVRGVPSRWFAETRVSSKPSTLVTHTIFSALGKIRTLNIANDDELEAKEDGANKELISGLNCKVWVQFESYDDFHDAMKALCGRSLEKEGSRLRVDYDVTWDREGFFRIAQYEPARSNVGEKDASASVHGRKKHYTSRIESDHRKRFRD

SEQ ID NO: 9335 - protein, 340 aa, Oryza sativa
MSAAAAALRPTEPLPLPSGLSLAPRLKLLLTFFRADLSVRPVDEWQLKTALLAFLRDPPLSLPVLPDSDLSVRTLPDLHKRRRDEPVASGVLHVRDLSFLRPRRRNGDDEEEEAEEMTREQEEEKYFQWRSSLVEKLAGIELNLEGVKFRMSVEIPPSDDFRAMKKSWENFYASELLSSRNPVRKIAKRPDTILVRGVPSRWFAETRISSKASTLVTHTIFSALGKIRNLNISSDDEWGAKQDGTNKEIISGLNCKVWVQFENYDDFNSAMQALCGRSLEKEGSRLKVDYEVTWDHEGFFRNAQYEPVRSNLEERNSSAHGRKKHYTSRIESDHRKRFRD

SEQ ID NO: 9336 - protein, 162 aa, Zea mays
MGAVEPPAWMSAAARRWLENAGATAEDTPGRAFNALPLSGVRVSLAERGRALCSLRVPPHLTDAEGNWHAGAIAAAADDVCAAAIMSVEGIIKVSVHYDISYFTPAKLHDEVEMDGRVVEHKGRMTAVVVEIRKKKSGELVAIGRQWMTASRPKGAAAHSKI

SEQ ID NO: 9337 - protein, 162 aa, Zea mays
MGAVEPPAWMSAAARRWLENAGATVEDAPGRGFNALPLSGVRVSLAERGRALCSLHVPPHLTDAEGNWHAGAIAAAADDVCAAAIMSVEGIIKVSIHYDISYFTTAKLHDEVEMDGRVVEQKVRMTAVAVEIRKKESGELVAIGRQWMTASRPKVAAAHSKI

SEQ ID NO: 9338 - protein, 162 aa, Setaria italica
MGAPTEGPPAWMAAAARRWLEDAGAKVEGGQDRAFNALPLAGVRVSLAERGRAVCSLRVPAHLTDAEGNWHTGAIAAAADDVCAAAIMSVEGIIKVSVHYDISYFAPAKLHDEVEMDGRVVERKGRMTAVAVEIRRKESGELVAIGRQWMTASRPSGSRSKI

SEQ ID NO: 9339 - protein, 156 aa, Panicum virgatum
MREPPAWMADGARRWLEDAGATVEGGPDRAFNALPLSGVRVSLAERGRAVCSLRVPAHLTDAEGNWHTGAIAAAADDVCAAAIMSVEGIIKVSVHYDISYFAPAKLHEEVELDGKVVEHKGRMTAVTVEIRKKESGELVAIGRQWMTASRPRGSKI

SEQ ID NO: 9340 - protein, 162 aa, Zea mays
MGAVEPSAWMSAAARRWLENAGATAEDAPGRGFNALPLSGMRVSLAERGRALCSLRVPPHLTDVEGNWHAGAIVAAADDVCAAAIMSVEGIIKVSIHYDISYFTTAKLHDEVEMDGRVVEQKVRMTAVAVEIRKKESGELVAIGRQWMMASRPKVVAAHSKI

SEQ ID NO: 9341 - protein, 162 aa, Zea mays
MGAVESSAWMSAAARRWLENAGATAEDAPGRGFNALPLSGVRVSLAERGRALCSLRVPPHLTDAEGNWHAGAIAAAVDNVCAAAIMSVEGIIKVSIHYDISYFTTAKLHDEVEMDGRVVEQKVRMTAVAVEVRKKESGELVAIGRQWMTASRPKVVAAHSKI

SEQ ID NO: 9342 - protein, 166 aa, Triticum aestivum
MGDPAPPAWMAAAARKWLEDAGAIAEDGAGAGDGRRAFNALPLFGVRVSLAERGRAVCSLRVPAHLTDADGNWHAGAIAAAVDDVCAAAIMSVEGIIKVSVHYDISYFAPAKHHEEVEMDGRVVDQKGRMTAVTTEVRKKESGELVAIGRQWMTTSRPKGYQGSKL

SEQ ID NO: 9343 - protein, 290 aa, Panicum virgatum
MAAAKSIKRLPARRVVPAEPTPAGPLRLSWLDRYPTQMALIESLHVFKPAADRVAAAGGDVDASASPARTIERALARALVRYYPLAGRLVLSADGAQQAVDCSNAGVWFTEAAAACSLEDVDYLEAPLMIPKDELLPPTPAGEDERALVLLVQVTAFACGGFVVGFRFSHAVADGPGAAQFMNAVGELARGAEAEAAPVEPQWGRDAIPDPAAALVSSLPRSDGASKRLEYLAIDISADYISHFKAHYVAAHGGAAWCSAFEVLIAKAWQSRTRAAGLRARLPPSTSASL

SEQ ID NO: 9344 - protein, 463 aa, Setaria italica
MAAAKSIERLAARRVVPAEPTPAGPLRLSWLDRYPTQMALIESLHVFKPAPDRAVADASASPARTIERALARALVHYYPLAGRLVLSEDGAQQAVDCSNAGVWFTEAAAACSLEDVDYLEAPLMIPKDEVLPPTPAAGEEDERALVLLVQVTSFACGGFVVGFRFSHAVADGPGAAQFMNAVGELARGGEVVSVEPQWGRDAIPDPAGAMVVASRPPTAPSGSSTRHRHLADYINTSRPVQRGRRLVLGVRGADRQGVAEPHPGRRVRAGLPRPPMLRYERAPDAARLPPARRRRVLRQLLLHHARVGAGGEGGGLLRHGGGQDHQGREAAHAGRVHAVGGGGDGRRRRRPLPDHLRLPDAACVRLDAARVRGGGLRVGPARARRAADKPGLHRHVYPGEALGPQARGAAYHAVRHPGPRRRFPRGHARHELMNRSVLSSLEEREERVNQREAEGEKEARDQG

SEQ ID NO: 9345 - protein, 456 aa, Zea mays
MAAANKSIDRLAARRVVPAEPTPTGPLRLSWLDRYPTQMALIESLHVFKAAPDRPATKTGSTDAAASPARTIERALARALVRYYPLAGRLVLSESGAQQAVDCSNAGVWFTEAEAACTLEDVDYLEAPLMVPKDELLPPTPAGDGEDERALVLLVQVTAFACGGFVVGFRFSHAVADGPGAAQFMTAVGELARAAGQGLALAVPSVEPQWGRDAVPDPAAALVGRLPAPGPGSQRRRLEYLAIDISADYVAHYKAQYSAAAHGGGGAAWCSAFEVLIAKAWRSRTRAAGFDDPDSAVHLCFAVNARPMLHASLPRGGAGFYGNCYYIMRVSAPAGKVAGASVAEVVRMIKDGKRRMPAEFARWAAGELGAGGVDPYQITSDYRTLLVSDWTRLGFAEVDYGWGPPAHVVPLTNLDYIATCILVKPWAHKPGARLITQCVTPDRVAAFHEAMLDTSC

SEQ ID NO: 9346 - protein, 443 aa, Zea mays
MAAAPKSIERLPARRVVPAEPTPAGPLRLSWLDRYPTQMALIESLHVFKAAPDRPAAARGSPAGTIERALARALVHYYPLAGRLVLSESGAQQAVDCSNAGVWFTEAQAACTLEDVDYLEAPLMVPKDDLLPPTPAAEDERALVLLVQVTAFACGGFVVGFRFSHAVADGPGAAQFMTAVGELARASAGGAGAGAVSVEPQWGRDAIPDPAAALVGRLPTPDAGTRRLAYLAMDISADYIGHYKAEYSAAHAAGAGWCSAFEVLIAKAWRSRTRAAGFEPDTLVHVCFAVNARPALHGSLPRGGAGFYGNCYYIMRVSAPAGKVAGSSVAEVVRIVKDGKRRMPAEFARWATGEAGAAGVDPYQITADYRTLLVSDWTRLGFAEVDYGWGPPAHVVPLTNLDYIATCILVKPWAHKPGARLITQCVTPDRVAAFHDGMLDTSC

SEQ ID NO: 9347 - protein, 437 aa, Oryza sativa
MAAAKSVERLGQRRVVPAEPTPAGPLRLSWLDRYPTQMALIESLHVFKPALDRAIGGDDVAVGPARTIERALARALVHYYPLAGRLAFSDSGEVCVDCGDAGVWFTEAEASCSLEDVDYLEYPMMVPKDELLPPTPAGEEERELVLLVQVTAFACGGFVVGFRFSHAVADGPGAAQFMAAVGELARGAGGVSVDPVWGRDAIPDPAAAVIGSLPDPAGAKRLEYLAVDISADYINHFKNQYNAEAHAAAAGVARCSAFEVLIAKAWRSRTRAAGFEPDTTVNLCFAMNARPLLHASLPRGGAGFYGNCYYIMRVSAPAGKVAGSSVTEVVKIIKDGKRRMPSEFSRWAAGDMAGGDPYQITSDYRTLLVSDWTRLGFAEVDYGWGPPAHVVPLTNLDYIATCILVRPWAHKPGARLITQCVTPDRVAAFHEGLLDLN

SEQ ID NO: 9348 - protein, 437 aa, Brachypodium distachyon
MAAANKSVSRLPQRLVLPAEPTPAGPLRLSWLDRYPTQMALIESLHVFKPAPAHDGADPARTIERALAQALVRYYPLAGRLAFTDDGGQSHVDCGGPGSGVWFTEAAAACGLEDVDYLEHPMMIPKDALLPPTPHAAEEGDERRLVLLVQVTSFACGGFVVGFRFSHAVADGPGAAQFMAAVGDLARGAESLSMEPQWGRDAVPDPAGAVVGALPDPAGAKRLEYLAMDISADYIDHFKSQYNSSNNGGGARCSAFEVLVAKAWQSRTRAAGFDPSATVHLCFAMNARPLLHASLPSAGAGFYGNCYYIMRVSAPAGKVSGSSVPEVVKIIKDGKRRMPAEFARWASGEAGAGGEDPYRITSDYRTLLVSDWTRLGFAEVDYGWGPPAHVVPLTNLDYIATCILVKPWAHKPGARLITQCVTPDRVAAFHQGMLDMN

SEQ ID NO: 9349 - protein, 438 aa, Brachypodium distachyon
MAAAKKSVSRLAQRLVLPAEPTPSGPLRLSWLDRYPTQMALIESLHVFKPAPARHADACPGPARTIERALAQALVRYYPLAGRLAFTDDGGQSHVDCGGPRSGVWFTEAEAACGLEDVDYLEHPMMISKDELLPPTPAAEEGDERRLVLLVQVTSFACGGFVVGFRFSHAVADGPGAAQFMAAVGDLARGAESLSMEPQWGRDAVPDPAGAVVGALPDPAGAKRLEYLAMDISADYIDHFKAQYNSTNNGGARCSAFEVLVAKAWQSRTRAAGFDPSTTVHLCFAMNARPLLHASLPSAGAGFYGNCYYIMRVSAPAGKVSGSSVPEVVKIIKDGKRRMPAEFARWASGEAGAGGEDPYRITSDYRTLLVSDWTRLGFAEVDYGWGPPAHVVPLTNLDYIATCILVKPWAHKPGARLITQCVTPDRVAAFHQGMLDMN

SEQ ID NO: 9350 - protein, 497 aa, Zea mays
MWKQFIGKLSWKSMKSSSGSGGSPPAPLSSPRDNGASPRENGATGKPNVSPRSPAAGAGAGAEVRSREDAFVQKVNICCAVYDFSDRGKDSPEKERKRQMLMSLVDCIGAAEEPLTETMIAACVRMFAANLFRVFPPKVRSGTSASETEEDEPFFDPSWYHLQVVYEFLLRFVTSPLVDAKVARKYVDSPFVSKLLDLFDSDDPRERDCLKTILHRIYGKFMGNRPFIRKAVSNIFYRFVFETDHHNGIAELLEVFGSVISGFAKPLKEEHKLFLWKALIPLHKPKSMGVYLPQLTYCITQFIDKEPKLAGTVIRGLLKYWPVTNSQKEMMFLGELEEVLELTDMAEFQKCMVPLFRKIASCLNSSHFQVAERALFLWNNEHLFDMISQNRQVILPIIYPALERNTRWHWNQSVLNVTMNVRKMFRDMDERLLQACHDNFQEEEEKRAVTEERRRLMWEQLERSAARGYHQPTTIAADASSFPAPSSSARLVSLTVT

SEQ ID NO: 9351 - protein, 493 aa, Setaria italica
MWKQFIGKLSWKSMKSSSGGGGGAGSPPAKPPPPLPSPRENGAAGKPSASPPSPLAGAGAEVRSREEAFIQKVNICCVVYDFSDRGKDSPEKERKRQMLMSLVDCIGAAEEPLTETMIAACVRMFAANLFRVFPPKVRSGTTASETEEDEPFFDPSWYHLQVVYEFLLRFVTSPLVDAKVARKYVDSAFVSKLLDLFDSDDPRERDCLKTILHRIYGKFMGNRPFIRKAVSNIFYRFVFETDHHNGIAELLEVFGSVISGFAKPLKEEHKLFLWKALIPLHKPKSVGVYLPQLTYCITQFIEKEPKLAGTVIRGLLKYWPVTNSQKEVMFLGELEEVLELTDMAEFQKCMIPLFRRIACCLNNSHFQIAERALFLWNNEHLFDMISQNRQVILPIVYPALERNTRWHWNQSVLNVTMNVRKMFHDMDERLLLACQNNFEEEEETRAATEERRRLMWEQLERSAARGYHQPVIAADVSFPPPPSSARLVAPTVT

SEQ ID NO: 9352 - protein, 493 aa, Panicum virgatum
MWKQFIGKLSWKVMKSSSGGGGGAGSPLPKMPPPLPLPRENGAAGKPSASPPSPLAGAGAEVRSREEAFIQKVNICCAVYDFSDRGKDSPEKERKRQMLMSLVDCIGAAEEPLTETMIAACVRMFAANLFRVFPPKVRSGTTASETEEDEPFFDPSWYHLQVVYEFLLRFVTSPLVDAKVARKYVDNSFVSKLLDLFDSDDPRERDCLKTILHRIYGKFMGNRPFIRKAVSNIFYRFVFETDHHNGIAELLEVFGSVISGFAKPLKEEHKLFLWKALIPLHKPKSVGVYLPQLTYCITQFIEKEPKLAGTVIRGLLKYWPITNSQKEMMFLGELEEVLELTDMAEFQKCMVPLFRRIASCLNSSHFQVAERALFLWNNEHLFDMISQNRQVILPIIYPALERNTRWHWNQSVLNVTMNVRKMFHDLDERLLLTCQNNFEEEEEKRAATEERRRLMWEQLERSAARGYHQPVIVADVSFPPPPSSARLVAPTVT

SEQ ID NO: 9353 - protein, 503 aa, Oryza sativa
MWKQFIGKLSWKSVKSSSTGGGGGGGGGFSPTAAKPPPPPSPRANGTAAAAKPSASPPPPPPPAAAGAEGRSREEAFVQNVNICCAVFDFSDRGKDTTEKERKRQVLMSLVDCVGAAEEPLTEAMIAASVRMFAANLFRVFPPKARSGAAASETEEDEPFFDPSWYHLQVVYELLLRFVTSPMVDAKAARKYVDSSFISRLLDLFDSDDPRERDSLKTVLHRIYGKFMGNRPFIRKAVSNIFYRFVFETDHHNGIAELLEVFGSVISGFAKPLKEEHKLFLWKALIPLHKPKTVGVYLPQLTYCITQFIEKETKLAGTVIRGLLKYWPVTNSQKEMMFLGELEEVLELTDMAEFQKCMVPLFRRIASCLNSSHFQVAERALFLWNNEHLFDMISQNRQVILPIIYPALERNTRWHWNQSVLNVTLNVKKMFLDMDERLLLACQNNFQAEEEKRAATEERRRLMWEQLERNAAAACHPHPVITTTDSSFPSPPSSTPLVAPTVT

SEQ ID NO: 9354 - protein, 484 aa, Brachypodium distachyon
MWKQFIGKLSWKSLKSSPGGGGGSPTAKSHPMSPRENGGSGKPNASPTSPSGVAAAEGRSREDAFIQKVNICCTVYDFADRGKDSPEKERKRQVLMSLVDCIGAAEEPLTEAMMSACVHMFGVNLFRVFPPKVRSGTAASETEEDDPFFDPSWYHLQVVYELLLRFVTSPFVDPKVARKYVDSSFVSKLLDLFDSDDPRERDCLKTVLHRIYGKFMGNRPFIRKAVSNIFYRFVSEADHHNGIAELLEVFGSVISGFAKPLKEEHKLFLWKALIPLHKPKTVGGYLPQLTYCITQFIEKEPKLAGTVIRGLLKYWPITNSQKEMMFLGELEEVLELIDMAEFQKCMVPLFRRIATCLNSSHFQVAERALFLWNNEHLFDMISQNRQVIVPIVYPALERNARWHWNQSVLNVTMNVRKMFFDMDERLLLACQSNFQLEEEKRTAAEERRRLVWKQLERNAQPVVAGSASFPQPSSSVPPVVPTVT

SEQ ID NO: 9355 - protein, 483 aa, Triticum aestivum
MWKQFIGKLSWKSLKSGPGGGGGGGSPTAKSNPMSPRENGAFGKPPASPRSPSGAAGAEGRSREDAFIEKVTICCTVYDFTDRGKDSPEKERKRQVLMSLVDSIGAAEEPLTEAMMSACVRMFAVNLFRVFPPKVRSGTTTSETEEDEPFFDPSWYHLQVVYELLLRFVTSPFVDPKVARKYVDSSFISKLLDLFDSDDPRERDCLKTVLHRIYGKFMGNRPFIRKAVSNIFYRFVSEADHHNGISELLEVFGSVISGFAKPLKEEHKLFLWKALIPLHKPKTVGVYLPQLTYCITQFIEKEPKLAGTVIRGLLKYWPVTNSQKEMMFLGELEEVLELIDMAEFQKCMVPLFRRIATCLNSSHFQVAERALFLWNNEHLFDMISQNRQVIVPIVYPALERNARLHWNQSVLNVTMNVRKMFFDMDERLLLTCQSNFQADEEKRAAAEERRRLTWEQLERNADPAFRPANAPPSSAPPRVPTVT

SEQ ID NO: 9356 - protein, 483 aa, Hordeum vulgare
MWKQFIGKLSWKSLKSGPGGGGGGGSPTAKSNPMSPRENGAFGKPPASPRSPSGAAGAEGRSREDAFIEKVTICCTVYDFTDRGKDSPEKERKRQVLMSLVDCIGAAEEPLTEAMMSACVRMFAVNLFRVFPPKVRSGTTASETEEDEPFFDPSWYHLQVVYELLLRFVTSPFVDPKVARKYVDSSFISKLLDLFDSDDPRERDCLKTVLHRIYGKFMGNRPFIRKAVSNIFYRFVSEADHHNGISELLEVFGSVISGFAKPLKEEHKLFLWKALIPLHKPKTVGVYLPQLTYCITQFIEKEPKLAGTVIRGLLKYWPVTNSQKEMMFLGELEEVLELIDMAEFQKCMVPLFRRIANCLNSSHFQVAERALFLWNNEHLFGMISQNRQVIVPIVYPALERNARLHWNQSVLNVTMNVRKMFFDMDERLLLACQSNFQADEEKRAAAEERRRLTWEQLERNADPAFQPAKAPPSAAPPRVPTVT

SEQ ID NO: 9357 - protein, 450 aa, Secale cereale
MSPRENGALGKPPASPRSPSGAAGAEGRSREDAFIEKVTICCTVYDFTDRGKDSPEKERKRQVLMSLVDSIGAAEEPLTEAMMSACVRMFAVNLFRVFPPKVRSGTTTSETEEDEPFFDPSWYHLQVVYELLLRFVTSPFVDPKVARKYVDSSFISKLLDLFDSDDPRERDCLKTVLHRIYGKFMGNRPFIRKAVSNIFYRFVSEADHHNGISELLEVFGSVISGFAKPLKEEHKLFLWKALIPLHKPKTVGVYLPQLTYCITQFIEKEPKLAGTVIRGLLKYWPVTNSQKEMMFLGELEEVLELIDMAEFQKCMVPLFRRIATCLNSSHFQVAERALFLWNNEHLFDMISQNRQVIVPIVYPALERNARLHWNQSVLNVTMNVRKMFFDMDERLLLACQSNFQADEEKRAAAEERRRLTWEQLERNADPAFQAANAPPSSAPPRVPTVT

SEQ ID NO: 9358 - protein, 430 aa, Zea mays
MASAAAEAPGASASSAENRLLQSLAERGWRFRDPTDEAIQALLLASPTPSPEAVESELVSMDLRMFGGKCLPDRAAAGGTSKRLSYLHGPVVLQIVSLRDIYHSSIDASFKNPQQRRLLRFGLTDGICEAVAIEFSPIPFITEEIAPGTKIRLENRVPINNGILCLSAKNVTVIGGAVQSLYEEWQMNQKYSGLSRPSLRLSPSDDGVGPPPFEKLDIEARPCRETKVQAYPARKLAVTHDHGPVNSGGKPMNEGSNDENRDNIESKVESKQITQDSRPKEVSEAVPVQNQAAAQKLLQKMSQAVPEDRRGRGHRFKGKGKEEDAQVFTLDEWEKRKAISSKPAAESYVHDTSRDEELARQLQEQLDLEDLHGGAGAGVLHGGAESSDAERLRMSMFSFSGPDEAGGGRRDFRGRGRGRGGGRRRGRGRF

SEQ ID NO: 9359 - protein, 429 aa, Setaria italica
MAAAAAAEAPSASASSAGNHRLLQSLADRGWRFRDPTDEAIQALLLASPTPSPEAMESELVDMDLRSFGGKSPPDRATTAATAKRLSYLHGPIVLQVVSVRDIYRSSIDASFKNPQQRRLLRFGLTDGTCEAVAIEFTPIPFITEEIAPGTKVRLENKIPINNGILCLSAKNVRVIGGTVQSLYEEWQMNQKYSGLSRPSLRLSQSDDGAGPPPFEKLDIEARPCRTTKVQPYPAIKLAVTHDHVPVNSGGKPMNEGSNDVYKDTTKSKVESTQDSRPKEVSETVPVQNQAAAQKLLQKMSQAVPEGRHGRGHRFKGKGKEEDAQVFTLDEWEKRKAIGSKSTSESYMQDTSRDEELARQLQEQLDLEDMHGGADVFHGRPESSDAERLRMSMFSFSGPDEAGGGRREFGGWGRGRGRGRGRGRGRGRF

SEQ ID NO: 9360 - protein, 455 aa, Zea mays
MAKALLSSSLLPALPGAAGGSRSAARPMLLPPLRLRRGRRGASACEVRAGLHGLDSVGGPHLQAALERAEAALYTLADAAVAAADTAAGAGADAGQAAAVQKNSGWFGFISEALEVVLKVLKDGLSAVHVPYSYGFAIILLTIIVKAATLPLTKKQVESTLAMQNLQPQIKAIQQRYAGNQERIQLETARLYKQAGVNPLAGCFPTLATIPVWIGLYQALSNVANEGLLTEGFFWIPSLGGPTTIAARQSGSGITWLFPFVDGHPPLGWHDTICYLVLPVLLVASQYVSMEIMKPPQSDDPSQKNTMLILKFLPFMIGWFSLSVPSGLSIYWFTNNVLSTAQQVWLRKMGGAKPVVTEGGSGIITAGRAKRSNAQPAGERFRQLKEEENRRKFSKALAAGDSDASSSTYDMDDEESDETIEEGGPVEEASTSSDKKLPNYSGKKGKRSKRKRMVQ

SEQ ID NO: 9361 - protein, 456 aa, Setaria italica
MAKALLSSSSSLLPALPRAGGAGAASLLPPLRLRRGGRRRAAACAVRAGLHGLDSLAGPHLQAALERAEAALYTLADAAVVAADAAAGGGDAGEAVTAVQKNGGWFGFISEALEVVLKVLKDGLSAVHVPYSYGFAIILLTIIVKAATLPLTKKQVESTLAMQNLQPQIKAIQQRYAGNQERIQLETARLYRQAGVNPLAGCFPTLATIPVWIGLYQALSNVANEGLLTEGFFWIPSLGGPTTIAARQSGAGISWLFPFVDGHPPLGWHDTICYLVLPVLLVASQFVSMEIMKPPQSDDPSQKTSLLVLKFLPFMIGYFSLSVPSGLSIYWFTNNVLSTAQQVWLRKMGGAKPAVSEGGSGIITAGRAKRSNAQPAGERFRELKEEENRRKLNKALAAGDSKASASTYDSDDEESDDETTEEGGPVEKASSTGSDKKLPSYSGKKGKRSKRKRMVQ

SEQ ID NO: 9362 - protein, 459 aa, Oryza sativa
MAKALLSSSLLPSLQPRAAAARLPMLTLPSLRRHGGRRASACRVRASLHGLDSIAGLDLHAALERAEAALYTLADAAVVAADAAAGGGGGGGGGGGEAAASVAQKNGGWFGFISEALEVVLKVLKDGLSAVHVPYSYGFAIILLTVIVKAATLPLTKQQVESTLAMQNLQPQIKAIQQRYAGNQERIQLETARLYKQAGVNPLAGCFPTLATIPVWIGLYQALSNVANEGLLTEGFFWIPSLGGPTTIAARQSGAGISWLLPFVDGHPPLGWHDTICYLVLPVLLVASQFVSMEIMKPPQTDDPSQKNTLLVLKFLPFMIGWFSLSVPSGLSIYWFTNNILSTAQQVWLRKLGGAKPVVNQGGSGIITAGRAKRTSAQPAQPGERFKQLKEEESKRKGNKALAAGDSDLSASTSEDEESDDETTEEGGPEERYNSSSNKKLPNYSGKKGKRSKRKRMVQ

SEQ ID NO: 9363 - protein, 449 aa, Triticum aestivum
MAKALLSSSLLPSLPRAVAGAGAARLPPLPSLRRRAAGCRVRASLHGLDSVGGLHAALERAEAALYTLADAAVVAADSAAGAAGGGEDAGAAVQKSGGWFGFISDAMEVVLKILKDGLSAVHVPYAYGFAIILLTIVVKAATLPLTKQQVESTMAMQNLQPQLKAIQARYAGNQERIQLETARLYKQAGVNPLAGCLPTLATIPVWIGLYQALSNVANEGLLTEGFFWIPSLGGPTTIAARQSGAGISWLFPFVDGHPPIGWHDTICYLVLPVLLVASQFVSMEIMKPPQSTDPSQKNTQLILKFLPFMIGYFSLSVPSGLSIYWFTNNVLSTAQQIWLRKLGGAKPAVNEGASGIITAGRAKRSGAQSGQGGERFKQLKEEENRRKAVKALGAGDSNGSTTSEDEESDDDTTEEGGPVEETFATGNDKKLPTYSGKKGKRSKRKRIVQ

SEQ ID NO: 9364 - protein, 449 aa, Triticum aestivum
MAKALLSSSLLPSLPRAVAGAGAARLPPLPSLRRRAAGCRVRASLHGLDSVGGLHAALERAEAALYTLADAAVVAADSAAGAAGGGADADVAVQKSGGWFGFISDAMEVVLKILKDGLSAVHVPYAYGFAIILLTIVVKAATLPLTKQQVESTMAMQNLQPQLKAIQARYAGNQERIQLETARLYKQAGVNPLAGCLPTLATIPVWIGLYQALSNVANEGLLTEGFFWIPSLGGPTTIAARQSGAGISWLFPFVDGHPPIGWHDTICYLVLPVLLVASQFVSMEIMKPPQSTDPSQKNTQLILKFLPFMIGYFSLSVPSGLSIYWFTNNVLSTAQQIWLRKLGGAKPAVNEGASGIITAGRAKRSGAQSGQGGERFKQLKEEENRRKAVKALGAGDSNGSTTSEDEESDDDTTEEGGSVEETFTTGNDKKLPTYSGKKGKRSKRKRIVQ

SEQ ID NO: 9365 - protein, 453 aa, Secale cereale
MAKALLSSSLLPSLPRAVAGAGAARLPPLPSLRRGACRRAAGCRVRAGLHGLDSVGGLHAALERAEAALYTLADAAVVAADSAAGAAGGGADADTAVQKSGGWFGFISDAMEVVLKILKDGLSAVHVPYAYGFAIILLTVIVKAATLPLTKQQVESTMAMQNLQPQLKAIQARYAGNQERIQLETARLYKQAGVNPLAGCLPTLATIPVWIGLYQALSNVANEGLLTEGFFWIPSLGGPTTIAARQSGAGISWLFPFVDGHPPIGWHDTICYLVLPVLLVASQFVSMEIMKPPQSTDPSQKNTQLILKFLPFMIGYFSLSVPSGLSIYWFTNNVLSTAQQIWLRKLGGAKPAVNETASGIITAGRAKRSGGQSGQGGERFKQLKEEENRRKAVKALGAGDSNGSATSEDEDSDDDTTEEGGPVEETFATGNDKKLPTYSGKKGKRSKRKRIVQ

SEQ ID NO: 9366 - protein, 441 aa, Brachypodium distachyon
MAKALLSSTLLPSLPRGGAVAFRGLPPLRTAGHRGRAAGCAVRASLDSVGGLHAALERAEAALYTLADAAVVAGAAGGDLDQAVQKKGGWFGFISDAMEVVLKVLKDGLSAVHVPYSYGFAIILLTIVVKAATLPLTKQQVESTLAMQNLQPQLKAIQQRYAGNQERIQLETARLYKQAGVNPLAGCLPTLATIPVWIGLYQALSNVANEGLLTEGFFWIPSLGGPTTIAARQSGAGISWLFPFVDGHPPIGWHDTIAYLVLPVLLVASQFVSMEIMKPPQSTDPSQKNTQLILKFLPFMIGYFSLSVPSGLSIYWFTNNVLSTAQQVWLRKLGGAKPIVNEGGSGIITAGRAKRSSAQSGQGGERFKQLKEEESRRKATKALAAGDTKASVETSEDEETDDEITEEGGAVEETYASGSDKKLPTYSGKKGKRSKRKRIVQ

SEQ ID NO: 9367 - protein, 451 aa, Avena sativa
MAKALLSSSLLPSLPRAVAGGAARLPPLPSLSRSGCRRAAGCRVRASLHGLDSVGGLHAALERAEAALYTLADAAVVAGAGGAGAGGGDVEQAVQKSGGWFGFISDAMEVVLKVMKDGLSAVHVPYAYGFAIILLTVAVKAATLPLTKQQVESTLAMQNLQPQLKAIQKRYEGNQERIQLETARLYKTAGVNPLAGCLPTLATIPVWIGLYQALSNVANEGLLTEGFFWIPSLGGPTTIAARQSGAGISWLFPFVDGHPPIGWHDSICYLVLPVLLVASQFVSMEIMKPPQSTDPSQKNTQLILKFLPFMIGYFSLSVPSGLSIYWFTNNVLSTAQQIWLRKLGGAKPVVNEGASGIITAGRAKRSGAQSGQGGERFKQLKEEENRRKAAKALGAGDSNGSASTSDDEESDDDTTEEGEAVEETYIAGTDKKLPTYSGKKGKRSKRKRIVQ

SEQ ID NO: 9368 - protein, 475 aa, Zea mays
MEKEAAAELEIPGECQYAGDPVLVRPSQPTPRHTLHLSNLDDQRFLRFSIKYLYVFGADAAVPADALRAALGRVLADYYPLAGRLRPSAEEDGKLVVDCNAEGALFAEGRLPGLAAADFLSGSDRPHKSWRKLHYRVEAQSFVAVPPLVVQVTWLACGGMVLCTAINHCICDGIGTAQFLHAWARAVRGGGGRDALDAGGDDTALPFHDRRALRPRCPPRVAFAHPEYSTRGIINAAVANGNGNGSANEAPSLLARLLGQPLAPVSLTFTAAHLLRLKRQCVPSLKCTSFEALAAHVWRAWVRALDPPGALRVKLLFSVNVRRRLRPELPRGYYGNGFVLGCARSTAAQLTSPSCGSAARYGVRLVQDAKACVDDDYVRSMVDLLEERRGARPDLAASLVISAWTRLGLEDLDFGAGKAAHMGPLTSEIYCVFLPVVGDPHAVTVLVSVPQAAADKFQHFCLGFLKDVEVDAKLT

SEQ ID NO: 9369 - protein, 481 aa, Setaria italica
MERESAPATAELEIPGECQYSGEPAVVRPCQPTPRHTLYLSNLDDQRFLRFSIKYLYVFAAPAAVPTDALRAALARVLVDYYPLAGRLRPSDDDEGKLVVDCNAEGALFAEGCLPGLTAAEFLRRRARPHKSWRKLLYRVEAQSFVAVPPLVVQVTRLGCGGMVLCTAINHCLCDGIGTAQFLHAWAHAARAGHGALDAVDIGDGSAMLAPPFHDRRALRPRCPPRVAFTHPEYNSCGGIGAVANGNGNGNGSEAPSLLARLLGQSLAPVTLTFTAAHLLRLKRQCAPPLKCTSFEALAAHVWRAWVRALDPPGALRVKLLFSVNVRRRVKPELPRGYYGNGFVLGCAESTAAQLVSPSPSAAARYGVRLVQEAKECVDDDYVRSMVDLLEERRGARPDLAASLVISAWTRLGLEDLDFGAGAAAHMGPLTSEIYCVFVPVIGDPHGATVLVSVPQAAADRFQHYCLGFLKDADVDAKLMS

SEQ ID NO: 9370 - protein, 445 aa, Saccharum officinarum
MAAAAPLLLALAVLAAAAWPSLAAEGPAAALQDPAELLRRAKEPAFADWMVGVRRRIHENPELGYEEFQTSELVRRELDALGIPYRHPFAVTGVVATVGTGGPPFVALRADMDALPLQESVEWEHKSKVPGKMHGCGHDAHVAMLLGSAKILQEHRDELMGTVVLVFQPAEEGGGGAQKMIEAGALENIDAIFGLHIADSVPIGVLASRPGPIMAGSGFFEAVISGKGGHAALPHHTIDPILAASNVIVSLQQLVSREADPLDSQVVTVGKFQGGGAFNVIPDSVTIGGTFRAFLKESFNQLKQRIEEVIVSQASVQRCSASVDFLTKDRPFFPPTINSPELHDFFVNVASEMVGSRNVRDRQPLMGAEDFSFYAEAIPSTYYYFVGMYNETRGLQAPHHSPYFTVNEDALPYGAAAQVALAARYLLEHQQPAATTDKAKPHDEL

SEQ ID NO: 9371 - protein, 450 aa, Zea mays
MAAATPRLLLAVAGLTLAVLAAAVSPSLAAGPPVLQDPAELLRLAKEPAFADWMVGVRRRIHENPELGYEEFQTSELVRRELHAMGIPYRHPFAVTGVVATVGTGGPPFVALRADMDALPLQESVEWEHKSKVPGKMHGCGHDAHVAMLLGSAKILQEHRDELKGTVVLVFQPAEEGGGGAKKMIEDRAVENIDAIFGLHIADSVPIGVLASRPGPIMAGSGFFEAVISGKGGHAALPHHTIDPILAASNVIVSLQQLVSREADPLDSQVVTVGKFQGGGAFNVIPDSVTIGGTFRAFLKESFNQLKQRIEEVIVSQASVQRCSAAVDFLSKDRPFFPPTINSPELHDFFVNVAGEMVGSRNVRDRQPLMGAEDFAFYAEAVPSTYYYFVGMYNETRGPQAPHHSPYFTINEDALPYGAAGQAALAARYLLERQQPAAATADKAETHDEL

SEQ ID NO: 9372 - protein, 445 aa, Panicum virgatum
MAAAPPPLLLAGLALAVIAAAGWPPAVTAALEDPAGLLRRAKEPAFADWMVGVRRRIHENPELGYEEFETSELVRRELEAMGIPYRHPFAVTGVVATVGTGGPPFVALRADMDALPLQESVEWEHKSKVPGKMHGCGHDAHVAMLLGSAKILQEHRDELKGTVVLVFQPAEEGGGGAQKMIEAGAVENIEAIFGLHVADSVPIGVLASRPGPIMAGSGFFEAVISGKGGHAALPHHTIDPILAASNVIVSLQQLVSREADPLDSQVVTVGKFQGGGAFNVIPDSVTIGGTFRAFLKDSFNQLKQRIEEVIVSQASVQRCSATVDFQTKDRPFFPPTSNSPELHDFFVNVASEMVGSKNVRDRQPLMGAEDFAFYADAIPSTYYYFVGMYNETRGLQAPHHSPYFTINEDALPYGAAAHAALAARYLLEHQEPAATPDKAKSHDEL

SEQ ID NO: 9373 - protein, 445 aa, Setaria italica
MGTAAPPLLLAGLALAVLAAAGWPSVATAALEDPAGLLRRAKEPDFAGWMVGVRRRIHENPELGYEEFETSALVRRELDAMGIPYKHPFAVTGVVATVGTGGPPFVALRADMDALPMQESVEWEHRSKVPGKMHGCGHDAHVAMLLGSAKILQEHRDELKGTVVLVFQPAEEGGGGAQKMIEAGAVENIDAIFGIHIADSIPIGVLASRPGPIMAGSGFFEAVISGKGGHAALPHHTIDPILAASNVIVSLQQLVSREADPLDSQVVTIGKFQGGGAFNVIPDSVTIGGTFRAFLKESFNQLKQRIEEVIVSQASVQRCTATVDFLTKDRPFFPPTINSPELHDFFVNVASEMVGSKNVRDRQPLMGAEDFAFYAEAIPSTYYYFVGMYNETRGPQAPHHSPYFTINEDALPYGAAAQAAMAARYLHEHQQPASTLDKAKTHDEL

SEQ ID NO: 9374 - protein, 445 aa, Pennisetum glaucum
MGTAAPTLLLAGLALAVLAAAGWPPVATAALEDPAGLLRRAKEPAFADWMVGVRRRIHENPELGYEEFETSALVRRELDAMGIPYKHPFAVTGVVAAVGTGGPPFVALRADMDALPMQESVEWEHKSKVPGKMHGCGHDAHVAMLLGSAKILQEHRDELKGTVVLVFQPAEEGGGGAQKMIEAGAVENIDAIFGIHIADAIPVGVLASRPGPIMAGSGFFEAVISGKGGHAALPHHTIDPILAASNVIVSLQQLVSREADPLDSQVVTVGKFQGGGAFNVIPDSVTIGGTFRAFLKESFNQLKQRIEEVIVSQASVQRCSATVDFLTKDRPFFPPTINTPELHDFFVNVASDMVGSKNVRDRQPLMGAEDFAFYAEAIPSTYYYFVGMYNETRGPQAPHHSPYFTINEDALPYGAAAQAAMAARYLLEHQQPTSTLDKAKTHDEL

SEQ ID NO: 9375 - protein, 447 aa, Setaria italica
MAAAAPPPLLACFALAVLAAAVWPSLGAGASLLDDPAGLLRRAKEPAFADWMVAVRRRIHENPELGYEEFETSELVRRELDAMGIPYRHPFAVTGVVATIGTGGPPFVALRADMDALPMQESVEWEHKSKVPGKMHGCGHDANVAMLLGSAKILQEHHDELKGTVVLVFQPAEEGGGGAQKMIEAGALENVDAIFGVHVADSVPIGVLASRPGPIMAGSGCFEAVISGKGGHAALPHHTIDPILAASNVIVSLQQLISREADPLDSQVVTIGKFQGGGAFNVIPDSVTIGGTFRAFLKESFNQLKQRIEQVIVSQASVQRCNATVDFLTNRIPFFPPTINSPELHSFFVNMAGEMVGSKNVRDRQPLMGAEDFAFYAEVIPSTYYYFVGMYNKTRGPQASHHSTYFTVNEDALPYGAAAQAALAAHYLLEHEQPAATPDKAKAHEEL

SEQ ID NO: 9376 - protein, 444 aa, Brachypodium distachyon
MAARASPLLLLLLPAAIVLAAAAAPSSAAAGLDDPAGLLRRAKEAEFMDWMVGVRRRIHENPELGYEEFATSELVRRELDAMGIPYRHPFAVTGVVATVGTGGPPFVALRADMDALPMQESVEWEHKSKVPGKMHGCGHDAHTAMLLGSAKILQEHRDELQGTVVLLFQPAEEGGGGAMKMVEDGAVENIEAMFGLHVADIVPIGVLASRPGPIMAGSGFFEAVISGKGGHAALPHHTIDPILAASNVIVSLQQLVSREADPLDSQVVTVGKFQGGGAFNVIPDSVTIGGTFRAFLKESFNQLKQRIEEVIVSQASVQRCSAVVDFLKKDRPFFPPTINSPELHDFFGKVASEMVGPNNVRDRQPLMGAEDFSFYAEAVPTTYYYFVGMLNETRGPQAPHHSPYFTINEDAMPYGAAMQTSLAARYLLEHQPVKAAKSEPRDEL

SEQ ID NO: 9377 - protein, 442 aa, Oryza sativa
MAAASSSRVLLAAVAVLAAALAGCGAGAALDDPAGLLRRAKEAEFAGWMVGLRRRIHENPELGYEEFATSELVRRELDALGIPYRHPFAVTGVVATVGTGGPPFVALRADMDALPMQESVEWEHKSKVPGKMHGCGHDAHVAMLLGSARILQEHRDELKGTVVLVFQPAEEGGGGAKKMIDDGAVENIEAIFGVHVADVVPIGVVASRPGPVMAGSGFFEAVISGKGGHAALPHHTIDPILAASNVIVSLQQLVSREADPLDSQVVTVGKFQGGGAFNVIPDSVTIGGTFRAFLKESFNQLKQRIEEVIVSQASVQRCNAVVDFLDKDRPFFPPTINSAGLHDFFVKVASEMVGPKNVRDKQPLMGAEDFAFYADAIPATYYYFLGMYNETRGPQAPHHSPYFTINEDALPYGAALQASLAARYLLEHQPPTTGKAKAHDEL

SEQ ID NO: 9378 - protein, 441 aa, Hordeum vulgare
MAAGASPLLLLRVALVLIAAAAAWAAALDDPAGLLRRAKEAEFLDWMVGVRRRIHENPELGYEEFATSELVRRELDAMGIPYRHPFALTGVVATVGTGGPPFVALRADMDALPMQESVEWEHKSKVPGKMHGCGHDAHVAMLLGSAKILQEHRDELKGTVVLLFQPAEEGGGGAKKMVEAGAVENIEVMFGIHVADTVPIGVLASRPGPIMAGSGFFEAVISGKGGHAALPHHTIDPILAASNVIVSLQQLVSREADPLDSQVVTVGKFQGGGAFNVIPDSVTIGGTFRAFLKESFNQLKQRIEEVIVTQASVQRCSAVVDFLDKDRPFFPPTINNPELHDFFVKVGSEMVGPNKVREKQPLMGAEDFSFYTEVVPKTYYYFVGMLNETRGPQAPHHSPYFTINEDTLPYGAAMQASLAARYLLEHQLVTAAKVVEPRDEL

SEQ ID NO: 9379 - protein, 435 aa, Secale cereale
MAAGLLRVALFLIAAAATWAAALDDPAGLLRRAKEAEFMDWMVGVRRRIHENPELGYEEFATSELVRRELDAMGIPYRHPFAVTGVVATVGTGGPPFVALRADMDALPMQESVEWEHKSKVPGKMHGCGHDAHVAMLLGSARILQEHRDDLKGTVALLFQPAEEGGGGAKKMVEVGALENIEVMFGLHVADSVPIGVLASRPGPIMAGSGFFEAVISGKGGHAALPHHTIDPILAASNVIVSLQQLVSREADPLDSQVVTVGKFQGGGAFNVIPDSVTIGGTFRAFLKESFNQLKQRIEEVIVTQASVQRCSAVVDFLDKDKPFFPPTINNPELHDFFAKVGSEMVGPNNVREKQPLMGAEDFSFYTEAVPKTYYYFVGMLNETRGPQAPHHSPYFTINEDALPYGAAMQASLAARYLLEHQHVTAAKVEPRDEL

SEQ ID NO: 9380 - protein, 394 aa, Triticum aestivum
MVGVRRRIHENPELGYEEFATSELVRRELDAMEIPYRHPFAVTGVVATVGTGGPPFVALRADMDALPMQESVEWEHKSKVPGKMHGCGHDAHVAMLLGSAKILQEHRDKLKGTVALLFQPAEEGGGGAKKMVEAGAVVNIEIMFGLHVADSVPIGVLASRPGPIMAGSGFFEAVISGKGGHAALPHHTIDPILAASNVIVSLQQLVSREADPLDSQVVTVGKFQGGGAFNVIPDSVTIGGTFRAFLKESFNQLKQRIEEVIVTQASVQRCSAVVDFLDKDKPFFPPTINNPELHDFFAKVGSEMVGPNNVREKQPLMGAEDFSFYTEAVPKTYYYFVGMLNETRGPQAPHHSPYFTINEDALPYGAAMQASLAARYLLEHQPATAAKVEPRDEL

SEQ ID NO: 9381 - protein, 394 aa, Triticum aestivum
MVGVRRRIHENPELGYEEFATSELVRRELDAMEIPYRHPFAVTGVVATVGTGGPPFVALRADMDALPMQESVEWEHKSKVPGKMHGCGHDAHVAMLLGSAKILQEHRDKLKGTVALLFQPAEEGGGGAKKMVEAGAVVNIEIMFGLHVADSVPIGVLASRPGPIMAGSGFFEAVISGKGGHAALPHHTIDPILAASNVIVSLQQLVSREADPLDSQVVTVGKFQGGGAFNVIPDSVTIGGTFRAFLKESFNQLKQRIEEVIVTQASVQRCSAVVDFLDKDKPFFPPTINNPELHDFFAKVCSEMVGPNNVREKQPLMGAEDFSFYTEAVPKTYYYFVGMLNETRGPQAPHHSPYFTINEDALPYGAAMQASLAARYLLEHQPATAAKVEPRDEL

SEQ ID NO: 9382 - protein, 394 aa, Triticum aestivum
MVGVRRRIHENPELGYEEFDTSELVRRELDAMGIPYRHPFAVTGVVATVGTGGPPFVALRADMDALPMQESVEWEHKSKVPGKMHGCGHDAHVAMLLGSAKILQEHRDELKGTVALLFQPAEEGGGGAKKMVEAGAVENIEVMFGLHVADSVPIGVLASRPGPIMAGSGFFEAVISGKGGHAALPHHTIDPILAASNVIVSLQQLVSREADPLDSQVVTVGKFQGGGAFNVIPDSVTIGGTFRAFMKESFNQLKQRIEEVIVTQASVQRCSAVVDFLDKDKPFFPPTINNPELHDFFAKVCSEMVGPNNVREKQPLMGAEDFSFYTEAVPKTYYYFVGMLNETRGPQAPHHSPYFTINEDALPYGAAMQASLAARYLLEHQPATAAKVEPRDEL

SEQ ID NO: 9383 - protein, 644 aa, Zea mays
MDTTTQGLEFGGGINSPKPYCYWSTTQDTTVHKDSTPEAYSTFSISNSKASKRKQGAMSGAKGGNPLLTLGLGCSPSSSYNSKLSSGTACITSSSLLKEIDEESSIDLGLNLGLYIGNDIGHCQQKSHAGFENVLSTNSPKLDLQLSLSTSSPESVVIDANRSPDGLAMPMANSPLAIVEEGSVPHSWVFEHSIVSSSHASKATHGFPLSKKTNGGNASVPSHVMSSTMFTSVKGPVASASETTNSQQRNSNAKSCQFPGCVKGARGASGRCIAHGGGRRCQKPGCEKGAEGRTIYCKAHGGGRRCQFLGCTKSAEGRTDHCIAHGGGRRCSHEGCSRAARGKSGLCIKHGGGKRCQKENCTKSAEGHSGLCIAHGGGRRCQFPDCTKGAQGSTKFCKAHGGGKRCTFVGCTRGAEGSTSFCKGHGGGKRCAFQGGGVCPKSVHGGTQYCVAHGGGKRCASFGCTKSARGRTEYCVRHGGGKRCKFESCTKSAQGSTDFCKAHGGGTRCLWGQADTSFGAGAQQCDKFVRSKTGLCSAHSALIQDHCVHGGGTLGSAIYQSVHVKPTEMINGDKTLLDPAIPVTNSGVHPPVLAQSMIDPLPEGRVHGGGLLALLSRGGSRTSAGGSELCFGQDRVDLRLSGSP

SEQ ID NO: 9384 - protein, 340 aa, Zea mays
MRICESGDGDDVAGLVFQQEQQEEVQASGELVRLKAKHALVGAGARVLFYPTLLYNVLRNRFEADFRWWDRVDQFILLGAVPFPSDVPRLKQLGVQGVVTLNEPYETLVPTSLYQANEIEHLVIPTRDYLFAPSFEDISQAIDFIHRNASQGGTTYVHCKAGRGRSTTIVLCYLIKYRNMTPEAALDHVRSIRPRVLLAPSQWHAVNSFGALTGGQLPVRSTNLACFLEAIEAGCTNTTGNDDYHVMEFDCEDSGLPLYQIMLPRPASPTGSGCTDAVLVTEADLEGYDTYIGTRKDAVSLEVATRSPIMRRLSCLFGSLKLSNSNCEPASSRFTEVRAC

SEQ ID NO: 9385 - protein, 336 aa, Setaria italica
MRICELGDGDGGLAGQQEQQEEEVGASGGGEVVRLKAKRALVGAGARVLFYPTLLYNVLRNRFEADFRWWDRVDQFILLGAVPFPSDVPRLKQLGVRGVVTLNEPYETLVPTSLYQAHEIEHLMIPTRDYLFAPSVEDISQAIDFIHRNASQGGTTYVHCKAGRGRSTTIVLCYLIKYRSMTPEAALDHVRSIRPRVLLAPSQWQVVSTFGTLVTGQLPVRSTKLGSFLEAIDACRTDTEYDDYHAMEFDYEDSGLPLSQIMLPRPTSPTGCIDAVLITEADLEGYDTYVNTRKDALEVATRRPIMRRLSCLFGSLKLNSSNCEPAQSCFSEVRAC

SEQ ID NO: 9386 - protein, 160 aa, Saccharum officinarum
MRICELGDGDAGLAWQQEQQEEEVQASGGGELVRLKAKRALVGAGARVLFYPTLLYNVLRNRFEADFRWWDRVDQFILLGAVPFPSDVPRLKQLGVQGVVTLNEPYETLVPTSLYQANEIEHLVIPTRDYLFAPSLEDISQAIDFIHRNASQGGTTYVHW

SEQ ID NO: 9387 - protein, 156 aa, Pennisetum glaucum
MTPEAALDHIRSIRPRVLLAPSQWQVVCTFGTLGTGQLPVRSTKLGSYLEALEACRANTENDDCYSMEFDFEDSGLPLSQIMLPRPVSPTGCIDAVFITEADLEGYDEYVDTRKDALEEATRRPIMKRLSCLFGSLKLINNNCEPAPSRFTEVHAC

SEQ ID NO: 9388 - protein, 262 aa, Zea mays
MAAASLARLSRRATTSTSVAAPAFRRLLSATSTAPAAASAPPPPPSAAAAAAVGADRVRWDYRGQRQLVPLGQWMPKVAVDAYVAPEAVLAGQVTVHDGASVWSGAVLRGDLNKITLGFCANVQERCVLHAAWAAPTGLPAETLVDRYVTVGAYCLLRSCTIEPECIIGQHSILMEGSLVETNSILEAGSVLPPGRRIPTGELWAGSPARFVRKLTNEEIMDIPKLATAINDLMQSHFSEFLPYSNAYLEVEKLKKSFSIPL

SEQ ID NO: 9389 - protein, 262 aa, Setaria italica
MAAASLSRLSRRATSSAVAAAPSLRRLLSATSTAPAAQSAPPPPPSAAAAAAAGADRVRWDYRGQRQLVPLGQWMPKVAVDAYVAPEAVLAGQVTVHDGASVWSGAVLRGDLNKITLGFCANVQERCVLHAAWAAPTGLPAETLVDRYVTVGAYSLLRSCTIEPECIIGQHSILMEGSLVETNSILEAGSVLPPGRRIPTGELWAGSPARFVRKLTNEEIMEIPKLATAINDLMQSHFSEFLPYSTAYLEVEKLKKSFSIPL

SEQ ID NO: 9390 - protein, 262 aa, Pennisetum glaucum
MAAASLSRLSRRASSSAVAAAPSLRRLLSATSTAPAAPSAPPPPSSAAAAAAAGPDRVRWDYRGQRQFVPLGQWLPKVAVDAYVAPEAVLAGQVTVHDGASVWSGAVLRGDLNKITLGFCANVQERCVLHAAWAAPTGLPAETLVDRYVTVGAYSLLRSCTIEPECIIGQHSILMEGSLVETNSILEAGSVLPPGRRIPTGELWAGSPARFVRKLTNEEIMEIPKLATAINDLMQSHFSEFLPYSNAYLEVEKLKKSFSIPL

SEQ ID NO: 9391 - protein, 261 aa, Setaria italica
MAAASLSRLSRRATSSAVAAAPSLRRLLSATSTAPAAQSAPPPPPSAAAAAAAGADRVRWDYRGQRQLVPLGQWMPKVAVDAYVAPEAVLAGQVTVHDGASVWSGAVLRGDLNKITLGFCANVQERCVLHAAWAAPTGHIPHLVDRYVTVGAYSLLRSCTIEPECIIGQHSILMEGSLVETNSILEAGSVLPPGRRIPTGELWAGSPARFVRKLTNEEIMEIPKLATAINDLMQSHFSEFLPYSTAYLEVEKLKKSFSIPL

SEQ ID NO: 9392 - protein, 263 aa, Zea mays
MAATSLARLSRRTTISATAAAPSLRRLLSVTSTASVAATAPPPPPPSATGAAAVGADRVRWDYRGQRKLVPLGQWMPKVAVDAYVAPEAVLAGQVTVHDGASVWSGAVLRGDLNKITLGFCANVQERCVLHAAWTAPTGLPAETLVDRYVTVGAYCLLRSCTIEPECIIGQHSVLMEGSLVETNSILEAGSVLPPGRRIPTGELWAGSPARFVRKLTNEEIMEIPKLATAINDLMQSHFSEFLPYSNAYLEVEKLKKSFSIPL

SEQ ID NO: 9393 - protein, 257 aa, Panicum virgatum
LSRLSHRATSSAVAAAPSLRRLFSATSTAPAAQSAPPPPPSAASAAEAGADRVRWDYRGQRQLVPLGQWMPKVAVDAYVAPEAVLAGQVTVHDGASVWSGSVLRGDLNKITLGFCANVQERCVLHAAWAAPTGLPAETLVDRYVTVGAYSLLRSCTIEPECIIGQHSILMEGSLVETNSILEAGSVLPPGRRIPTGELWAGSPARFVRKLTNEEIMEIPKLATAINDLMQSHFSEFLPYSTAYLEVEKLKKSFSIPL

SEQ ID NO: 9394 - protein, 175 aa, Oryza sativa
MMHSGSIVHERNRQYAPTVTYRSTRVSAGKTCGRRPGGVEDASLLDVGAEAEGDLVEVAAQHGAAPHGGAVVDGDLPGQHGLGGDVGVDGHLGHPLPERHQLALPAVVPPHPIRARRGGRGGGGGRRWGRRRGGGRGRCGGGEEAAEGGRRGPVGEARERGGGHGGGRGGVRGLG

SEQ ID NO: 9395 - protein, 258 aa, Oryza sativa
MAAASLSRLSHRAAAPSLRRLLSATASAPSPAAASPPPPPPSAAAAAAAGADRVRWDYRGQRQLVPLGQWMPKVAVDAYVAPEAVLAGQVTVYDGASVWSGAVLRGDLNKITLGFCANVQERCVLHAAWSAPTGLPADTLVDRYVTVGAYCLLRSCTIEPECIIGQHSILMEGSLVETNSILEAGSVLPPGRRIPTGELWAGNPARFVRKLTNEEIMEIPKLAVAINDLMQSHFSEFLPYSTAYLEVEKLKKSFSIPL

SEQ ID NO: 9396 - protein, 256 aa, Triticum aestivum
MAAASLSRLSRRASAAAAPSLRRILSSTATAPAAPSSSPPPVAAAAAGADRVRWDYRGQRQLVPLGQWLPKVAVDAYVAPDAVLAGQVTVHDGASVWSGSVLRGDLNKITLGFCANVQERSVLHAAWSASTGLPAETLVDRYVTVGAYCLLRSCTIEPECIIGQHSILMEGSLVETNSVLEAGSVLAPGRRIPTGELWAGNPARFVRKLTNEEIMEIPKLAVAINDLMQSHFSEFLPYSNAYLEVEKLKKSFSIPL

SEQ ID NO: 9397 - protein, 256 aa, Secale cereale
MAAASLSRLSRRASAAAAPSLRRILSSTATAPAAPSSSPPPVAAAAAGADRMRWDYRGQRQLVPLGQWLPKVAVDAYVAPDAVLAGQVTVHDGASVWSGSVLRGDLNKITLGFCANVQERSVLHAAWSASTGLPAETLVDRYVTVGAYCLLRSCTIEPECIIGQHSILMEGSLVETNSVLEAGSVLAPGRRIPTGELWAGNPARFVRKLTNEEIMEIPKLAVAINDLMQSHFSEFLPYSNAYLEVEKLKKSFSIPL

SEQ ID NO: 9398 - protein, 257 aa, Brachypodium distachyon
MAAASLSRLSRRASAAAAPSLRRILSSTATSSPSPAAPSPPLPPAAAAGADRMRWDYRGQRQLIPLGQWLPKVAVDAYVAPEAVLAGQVTVHDGASVWSGAVLRGDLNKITLGFCANVQERCVLHAAWSAPTGLPAETLVDRYVTVGAYCLLRSCTIEPECIIGQHSILMEGSLVETNSILEAGSVLAPGRRIPTGELWAGNPARFVRKLTNEEIMEIPKLAVAINDLMQSHFSEFLPYSTAYLEVEKLKKSFSIPL

SEQ ID NO: 9399 - protein, 259 aa, Hordeum vulgare
MAAASLSRLSRRASAAAAPSLRRILSSTATACPSPAAPSSSPPPVAAAAAGADRVRWDYRGQRQLVPLGQWLPKVAVDAYVAPEAVLAGQVTVHDGASVWSGSVLRGDLNKITLGFCANVQERSVLHAAWSASTGLPAETLVDRYVTVGAYCLLRSCTIEPECIIGQHSILMEGSLVETNSVLEAGSVLAPGRRIPTGELWAGNPARFVRKLTNEEIMEIPKLAVAINDLMQSHFSEFLPYSNAYLEVEKLKKSFSIPL

SEQ ID NO: 9400 - protein, 259 aa, Leymus cinereus x Leymus triticoides
MAAASLSRLSRRASAAAAPSLRRILSSTATACPSPAAPSSSPPPVAAAAAGADRVRWDYRGQRQLVPLGQWLPKVAVDAYVAPDAVLAGQVTVHDGASVWSGSVLRGDLNKITLGFCANVQERSVLHAAWSASTGLPAETLVDRYVTVGAYCLLRSCTIEPECIIGQHSILMEGSLVETNSVLEAGSVLAPGRRIPTGELWAGNPARFVRKLTNEEIMEIPKLAVAINDLMQSHFSEFLPYSNAYLEVEKLKKSFSIPL

SEQ ID NO: 9401 - protein, 292 aa, Pseudoroegneria spicata
  misc_feature (12)..(12): Xaa can be any naturally occurring amino acid
  misc_feature (37)..(37): Xaa can be any naturally occurring amino acid
  misc_feature (78)..(78): Xaa can be any naturally occurring amino acid
RLQKPVCTQCRXQVRVESDEDRLLARPTHLPDHHATXAAASLSRVSRRASAAAAASLRRILSSTATAPAAPSSSPPPXAAAAAGADRVRWDYRGQRQLVPLGQWLPKVAVDAYVAPDAVLAGQVTVHDGASVWSGSVLRGDLNKITLGFCANVQERSVLHAAWSASTGLPAETLVDRYVTVGAYCLLRSCTIEPECIIGQHSILMEGSLVETNSVLEAGSVLAPGRRIPTGELWAGNPARFVRKLTNEEIMEIPKLAVAINDLMQSHFSEFLPYSNAYLEVEKLKKSFSIPL

SEQ ID NO: 9402 - protein, 259 aa, Festuca arundinacea
  misc_feature (33)..(33): Xaa can be any naturally occurring amino acid
MAAASMSRLSRRASASAGPFLRRILYSTATASXSPAASSPPLSPAAAAAAGADRVRWDYRGQRQLVPLGQWLPKVAVDAYVAPEAVLAGQVTVHDGASVWSGSVLRGDLNKITLGFCANVQERCVLHAAWSAPTGLPAETLVDRYVTVGAYCLLRSCTIEPECIIGQHSILMEGSLVETNSILEAGSVLAPGRRIPTGELWAGNPARFVRKLTNEEIMEIPKLAVAINDLMQSHFSEFLPYSNAYLEVEKLKESFSFPL

SEQ ID NO: 9403 - protein, 259 aa, Avena sativa
MAAASLSRLSRRASASTRPSLRQILYSTATASPSPAAPSPPLPLAAAAAAGADRVRWDYRGQRQLVPLGQWLPKVAVDAYVAPEAVLAGQVTVHDGASVWSGSVLRGDLNKITLGFCANVQERCVLHAAWSAPTGLPAETLVDRYVTVGAYCLLRSCTIEPECIIGQHSILMEGSLVETNSILEAGSVLAPGRRIPTGELWAGNPARFVRKLTNEEIMEIPKLAVAINDLMQSHFSEFLPYSNAYLEVEELKKWYSFPL

SEQ ID NO: 9404 - protein, 299 aa, Zea mays
MSIGLGKKTQDIPARVPMLTTTMNKKIWDVTDQTQHKLDFNAKHLVFGHLYLLPRPFNWTSEGNRLLQGDGERLLQLLYLQISVRVRQELREMALHQIVDGSCQLRNLHDLLIGQLPNEPGRASSPELAGRNPPSWGQYRASFEDRVGLHQRTFHEDRVLANDALRLDGARAQQTVGAHCHVPVHELMTITCGSRPCGMEDASLLYVGAEAERDLVEVPPQDGAAPDGGAVVDGDLAGKHGLGGYVSVHGHLGHPLSQRNKLPLPAVVPPHPIRAHGRGAGRAGRRRRGGCRDRGCGGY

SEQ ID NO: 9405 - protein, 212 aa, Saccharum officinarum
AAVGADRVRWDYRGQRQLVPLGQWMPKVAVDAYVAPEAVLAGQVTVHDGASVWSGAVLRGDLNKITLGFCANVQERCVLHAAWAAPTGLPAETLVDRYVTVGAYCLLRSCTIEPECIIGQHSILMEGSLVETNSILEAGSVLPPGRRIPTGELWAGSPARFVRKLTNEEIMEIPKLATAINDLMQSHFSEFLPYSNAYLEVEKLKKSFSIPL

SEQ ID NO: 9406 - protein, 282 aa, Zea mays
MAGGGQAAISFMTRMAKVAAGLGVAASAASTSFYTVDGGERAVIFDRVRGVLPRTMSEGTHLLVPILQKPFIFDIRTRPHSFSSTSGTKDLQMVSLTLRVLSRPDVEHLPDIFTSLGLEYDEKVLPSIGNEVLKAVVAQFNADQLLTERPHVSALVRESLTKRAREFNIVLDDVAITHLAYGQEFAQAVEKKQVAQQEAERSRFLVARAEQERRAAIVRAEGESEAARLISEATTTAGNGLIELRRIEAAKEIASVLSRTPNVSYIPAGDNGQMLLGLNAAR

SEQ ID NO: 9407 - protein, 282 aa, Setaria italica
MAGGGQAAVSFLTRIAKVAAGIGVAASAASTSLYTVDGGERAVIFDRLRGVLPRTEAEGTHLLVPILQKPFIFDIRTRPHSFSSTSGTKDLQMVSLTLRVLSRPDVDRLPEIFNSLGLEYDEKVLPSIGNEVLKAVVAQFNADQLLTERPHVSALVRESLTQRAREFNIVLDDVAITHLAYGPEFAQAVEKKQVAQQEAERSRFLVARADQERRAAIVRAEGESEAARLISEATTTAGNGLIELRRIEAAKEIAGVLARSPNVSYIPAGDNGQMLLGLNAAR

SEQ ID NO: 9408 - protein, 282 aa, Panicum virgatum
MAGGGQAAVSFLTRIAKVAAGIGVAASAASTSLYTVDGGERAVIFDRMRGVLPGTESEGTHFRVPFLQKPFIFDIRTRPHSFASTSGTKDLQMVSLTLRVLSRPDVDHLPEIFTSLGLEYDEKVLPSIGNEVLKAVVAQFNADQLLTERPHVSALVRESLTQRAREFNIVLDDVAITHLAYGPEFAQAVEKKQVAQQEAERSRFLVARAEQERRAAIVRAEGESEAARLISEATTTAGNGLIELRRIEAAKEIAGVLARSPNVSYIPAGDNGQMLLGLNAAR

SEQ ID NO: 9409 - protein, 282 aa, Oryza sativa
MAGGGQAAASLLTKLAQAAAGLGIAASAASTALYTVDGGQRAVIFDRFRGVLPETSSEGTHFIVPWLQKPFIFDIRTRPHSFSSTSGTKDLQMVSLTLRVLARPDIDRLPDIFTSLGLEYDEKVLPSIGNEVLKAVVAQFNADQLLTERPHVSALVRDSLIRRAAEFNIVLDDVAITHLAYGPEFSQAVEKKQVAQQEAERSRFLVARAEQERRAAIVRAEGESEAARLISEATAAAGTGLIELRRIEAAKEIAGELARSPNVSYIPAGDSSQMLLGLSGAR

SEQ ID NO: 9410 - protein, 282 aa, Brachypodium distachyon
MAGGGQAAVSFLTKIAKAAAGVGLAASAVSTSLYTVDGGQRAVIFDRFRGVLPETVSEGTHVLVPWLQKPFIFDIRTRPHSFSSTSGTKDLQMVSLTLRVLSRPDVERLPDIFTSLGLDYDDKVLPSIGNEVLKAVVAQFNADQLLTDRPHVSALVRDALVRRAGEFNIVLDDVAITHLAYGHEFALAVEKKQVAQQEAERSRFLVARAEQERRAAIVRAEGESESARLISEATAAAGNGLIELRRIEAAKEIAGVLARSPNISYIPSSDNSQMLLGLSAAR

SEQ ID NO: 9411 - protein, 282 aa, Hordeum vulgare
MAGGGQAAVSFLTKVAKVAAGLGLAASAVSTSLYTVDGGQRAVIFDRFQGVLPAVVSEGTHFLVPWLQKPFLFDIRTRPHSFSSTSGTKDLQMVSLTLRVLARPDVERLPEIFTNLGLDYDDKVLPSIGNEVLKAVVAQFNADQLLTDRPHVSALVREALVRRAGEFNIVLDDVAITHLAYGHDFAQAVEKKQVAQQEAERSRFLVARAEQERRAAIVRAEGESESARLISDATALVGNGLIELRRIEAAKEIAGVIARSPNVSYIPSGNNGKMLLGLSTAR

SEQ ID NO: 9412 - protein, 282 aa, Triticum aestivum
MAGGGQAAVSFLTKVAKVAAGLGLTASAVSTSLYTVDGGQRAVIFDRFQGVLPAVVSEGTHFLVPWLQKPFLFDIRTRPHSFSSTSGTKDLQMVSLTLRVLARPDVERLPEIFTNLGLDYDDKVLPSIGNEVLKAVVAQFNADQLLTDRPHVSALVREALVRRAGEFNIVLDDVAITHLAYGHDFAQAVEKKQVAQQEAERSRFLVARAEQERRAAIVRAEGESESARLISDATALVGNGLIELRRIEAAKEIAGVIARSPNVSYIPSGNNGQMLLGLSTAR

SEQ ID NO: 9413 - protein, 282 aa, Triticum aestivum
MSGGGQAAVSFLTKVAKVAAGLGLTASAVSTSLYTVDGGQRAVIFDRFQGVLPAVVSEGTHFLVPWLQKPFLFDIRTRPHSFSSTSGTKDLQMVSLTLRVLARPDVERLPEIFTNLGLDYDDKVLPSIGNEVLKAVVAQFNADQLLTDRPHVSALVREALVRRAGEFNIVLDDVAITHLAYGHDFAQAVEKKQVAQQEAERSRFLVARAEQERRAAIVRAEGESESARLISDATALVGNGLIELRRIEAAKEIAGVIARSPNVSYIPSGNNGQMLLGLSTAR

SEQ ID NO: 9414 - protein, 258 aa, Pennisetum glaucum
VASAASTSLYTVDGGERAVIFERLRGVLPKTEAEGTHLLVPVLQKPFIFDIRTRPHSFSSTSGTKDLQMVSLTLRVLSRPDVDRLPEIFNSLGLEYDEKVLPSIGNEVLKAVVAQFNADQLLTERPHVSALVRESLTQRAREFNIVLDDVAITHLAYGPEFAQAVEKKQVAQQEAERSRFLVARADQERRAAIVRAEGESEAARLISEATTTAGNGLIELRRIEAAKEIAGVLARSPNVSYIPASDNGQMLLGLNAAR

SEQ ID NO: 9415 - protein, 282 aa, Secale cereale
MAGGGQAAGSFLTKVAKVAAGLGLTASGVSTSLYTVDGGQRAVIFDRFQGVLPAVVSEGTHFLVPWLQKPFLFDIRTRPHSFSSTSGTKDLQMVSLTLRVLARPDVERLPEIFTNLGLDYDDKVLPSIGNEVLKAVVAQFNADQLLTDRPHVSALVREALVRRAGEFNIVLDDVAITHLAYGHDFAQAVEKKQVAQQEAERSRFLVARAEQERRAAIVRAEGESESARLISDATALVGNGLIELRRIEAAKEIAGVIARSPNVSYIPSSNNGQMLLGLSTAR

SEQ ID NO: 9416 - protein, 276 aa, Leymus cinereus x Leymus triticoides
AAVSFLTKVAKVAAGLGLTASAVSTSLYTVDGGQRAVIFDRFQGVLPAVVSEGTHFLVPWLQKPFLFDIRTRPHSFSSTSGTKDLQMVSLTLRVLARPDVERLPEIFTSLGLDYDDKVLPSIGNEVLKAVVAQFNADQLLTDRPHVSALVREALIRRAGEFNIVLDDVAITHLAYGHDFAQAVEKKQVAQQEAERSRFLVARAEQERRAAIVRAEGESESARLISEATALVGNGLIELRRIEAAKEIAGVIARSPNVSYIPSGNNGQMLLGLSTAR

SEQ ID NO: 9417 - protein, 282 aa, Avena sativa
MAGGGQAAVSFLTKLAKVAAGVGVAASAVTTSLYTVDGGQRAVIFDRFQGVLPEVVSEGTHFLIPWLQKPFIFDIRTRPHSFSSNSGTKDLQMVSLTLRVLSRPDVGRLPEIFTSLGLDYDEKVLPSIGNEVLKAAVAQFNADQLLTERPRVSELVRETLVKRAAEFNIVLDDVAITHLAYGHDFALAVEKKQVAQQEAERSKFLVARAEQERRAAIVRAEGESESARLISEATALVGNGLIELRRIEAAKEIAGVLARSPNISYIPSGQNGQMLLGLSAAR

SEQ ID NO: 9418 - protein, 284 aa, Saccharum officinarum
MAGGPAAVSFLTNIAKAAVGLGAAASLASASLYTVDGGERAVIFDRFRGVLPETVGEGTHFLVPWLQKPFIFDIRTRPHNFSSNSGTKDLQMVNLTLRLLSRPDVQHLPTIFTSLGLEYDDKVLPSIGNEVLKAVVAQFNADQLLTERPHVSALVRDALIRRAREFNIILDDVAITHLSYGIEFSLAVEKKQVAQQEAERSKFLVAKAEQERRAAIVRAEGESESARLISEATAMAGTGLIELRRIEAAKEIAAELARSPNVAYIPAGENGKMLLGLNAAGFGR

SEQ ID NO: 9419 - protein, 284 aa, Pennisetum glaucum
MAGGPAAVSFLTNIAKAAAGLGAAASLLSASLFTVDGGERAVIFDRFRGVLPQTVSEGTHFIVPWLQKPYIFDIRTRPHNFSSNSGTKDLQMVNLTLRLLSRPDVEHLPTIFTSLGLEYDDKVLPSIGNEVLKAVVAQFNADQLLTDRPHVSALVRDALIRRAREFNIILDDVAITHLSYGIEFSQAVEKKQVAQQEAERSKFLVAKAEQERRAAIVRAEGESESARLISEATAMAGTGLIELRRIEAAKEIAAELSRSPNVAYIPAGDNGKMLLGLNAAGFGR

SEQ ID NO: 9420 - protein, 284 aa, Sorghum bicolor
MAGGPAAVSFLTNIAKAAAGLGIAASLTSASLYTVDGGERAVIFDRFRGVLPETVGEGTHFLVPWLQKPFIFDIRTRPHNFSSNSGTKDLQMVNLTLRLLSRPDVQHLPTIFTSLGLEYDDKVLPSIGNEVLKAVVAQFNADQLLTERPHVSALVRDALIRRAREFNIILDDVAITHLSYGIEFSLAVEKKQVAQQEAERSKFLVAKAEQERRAAIVRAEGESESARLISEATAMAGTGLIELRRIEAAKEIAAELARSPNVAYIPSGENGKMLLGLNAAGFGR

SEQ ID NO: 9421 - protein, 239 aa, Triticum aestivum
MAGGPAAVSFLTNIAKVAAGLGAAASLASASLYTVDGGERAVIFDRFRGVLPETVGEGTHFLVPWLQKPSSSTSARARTTSPPTRGPRTCRWSTSRSVSSPAPTSSTSPPSSPPSDSSTTTKCSPPSATRCSRPSSPSSMPTSSSPTAPTSPPSSATLSSAAPASSTSSSTTSPSPTSPMVSSSRWPLRRSRSRSRRPSAPSSSSPRRSRRGGRPSCALRERASPRASSLRPRRWLGQG

SEQ ID NO: 9422 - protein, 284 aa, Panicum virgatum
MAGGPAAVSFLTNIAKAAAGLGAAASLLSASLYTVDGGERAVIFDRFRGVLPETVTEGTHFLVPWLQKPYIFDIRTRPHNFSSHSGTKDLQMVNLTLRLLSRPDVDHLPTIFTSLGLEYDDKVLPSIGNEVLKAVVAQFNADQLLTERPHVSALVRDALIRRAREFNIILDDVAITHLSYGIEFSQAVEKKQVAQQDAERSKFLVAKAEQERRAAIVRAEGESESARLISEATAMAGAGLIELRRIEAAKEIAAELSRSPNVAYIPAGDNGKMLLGLNAAGFGR

SEQ ID NO: 9423 - protein, 187 aa, Triticum aestivum
MAGGPAAVSFLTNIAKVAAGLGAAASLASASLYTVDGGERAVIFDRFRGVLPETVGEGTHFLVPWLQKPSSSTSARARTTSPPTRGPRTCRWSTHAPSPLPPRRPAPPHHLHLPRTRVRRQSAPLHRQRGAQGRRRPVQCRPAPHRPPPRLRPRPRRSHPPRPRVQHHPRRRRHHPPLLWYRVLAGR

SEQ ID NO: 9424 - protein, 284 aa, Setaria italica
MAGGPAAVSFLTNIAKVAAGLGAAASLLSASLFTVDGGERAVIFDRFRGVLPQTVSEGTHFIVPWLQKPYIFDIRTRPHNFSSNSGTKDLQMVNLTLRLLSRPDVEHLPTIFTSLGLEYDDKVLPSIGNEVLKAVVAQFNADQLLTDRPHVSALVRDALIRRAREFNIILDDVAITHLSYGIEFSQAVEKKQVAQQEAERSKFLVAKAEQERRAAIVRAEGESESARLISEATAMAGTGLIELRRIEAAKEIAAELSRSPNVAYIPAGDNGKMLLGLNASGFGR

SEQ ID NO: 9425 - protein, 284 aa, Zea mays
MAGGPAAVSFLTNIAKVAAGLGAAASLASASLYTVDGGERAVIFDRFRGVLPETVGEGTHFLVPWLQKPFIFDIRTRPHNFSSNSGTKDLQMVNLTLRLLSRPDVQHLPTIFTSLGLEYDDKVLPSIGNEVLKAVVAQFNADQLLTDRPHVSALVRDALIRRAREFNIILDDVAITHLSYGIEFSLAVEKKQVAQQEAERSKFLVAKAEQERRAAIVRAEGESESARLISEATAMAGTGLIELRRIEAAKEIAAELARSPNVAYIPSGENGKMLLGLNATGFGR

SEQ ID NO: 9426 - protein, 286 aa, Oryza sativa
MAGGPAAVSFLTNIAKAAAGLGAAASLLSASLYTVDGGERAVIFDRFRGVLPETVGEGTHFLVPWLQKPFVFDIRTRPHNFSSNSGTKGPCRWSTSPFRPPLPPPTSVHLPTIFTSLGLEYDDKVLPSIGNEVLKAVVAQFNADQLLTERPHVSALVRDALIRRAREFNIILDDVAITHLSYGIEFSQAVEKKQVAQQEAERSKFLVAKAEQERRAAIVRAEGESESARLISEATAAAGTGLIELRRIEAAREIAAELARSPNVAYVPAGDNGRMLLGLNAAGFGR

SEQ ID NO: 9427 - protein, 285 aa, Hordeum vulgare
MAGGPAAVSFLTNIAKAAAGLGAAASLLSASLYTVDGGERAVVFDRFRGVLPDTVGEGTHFIVPWLQKPYIFDIRTRPHNFSSNSGTKDLQMVNLTLRLLSRPDVVNLPTIFTSLGLEYDDKVLPSIGNEVLKAVVAQFNADQLLTDRPHVSALVRDSLIKRAREFNIILDDVAITHLSYGADFSQAVEKKQVAQQEAERSKFLVAKAEQERRAAIVRAEGESESARLISEATAIAGTGLIELRRIEAAKEIAAELARSPNIAYIPSGDNGNMLLGLNAAGMGGR

SEQ ID NO: 9428 - protein, 285 aa, Brachypodium distachyon
MAGSPAAVKFLTNIAKAAAGLGVGASLLSASLYTVDGGERAVVFDRFRGVLPDTVGEGTHFIVPWLQKPYIFDIRTRPHNFSSNSGTKDLQMVNLTLRLLSRPDVANLPTIFTSLGLEYDDKVLPSIGNEVLKAVVAQFNADQLLTDRPHVSALVRDSLIKRAREFNIILDDVAITHLSYGIEFSLAVEKKQVAQQEAERSKFLVAKAEQERRAAIVRAEGESESARLISEATAIAGTGLIELRRIEAAKEIAAELARSPNVAYIPSGQNGQMLLGLNAAGFGGR

SEQ ID NO: 9429 - protein, 285 aa, Triticum aestivum
MSGGPAAVSFLTNIAKAAAGLGAAASLLSASLYTVDGGERAVVFDRFRGVLPDTVGEGTHFIVPWLQKPYIFDIRTRPHNFSSNSGTKDLQMVNLTLRLLSRPDVVNLPTIFTSLGLEYDDKVLPSIGNEVLKAVVAQFNADQLLTDRPHVSALVRDSLIKRAREFNIILDDVAITHLSYGADFSQAVEKKQVAQQEAERSKFLVAKAEQERRAAIVRAEGESESARLISEATAIAGTGLIELRRIEAAKEIAAELARSPNVAYIPSGDNGKMLLGLNAAGFGGR

SEQ ID NO: 9430 - protein, 285 aa, Triticum aestivum
MSGGPAAVSFLTNIAKAAAGLGAAASLLSASLYTVDGGERAVVFDRFRGVLPETVGEGTHFIVPWLQKPYIFDIRTRPHNFSSNSGTKDLQMVNLTLRLLSRPDVVNLPTIFTSLGLEYDDKVLPSIGNEVLKAVVAQFNADQLLTDRPHVSALVRDSLIKRAREFNIILDDVAITHLSYGADFSQAVEKKQVAQQEAERSKFLVAKAEQERRAAIVRAEGESESARLISEATAIAGTGLIELRRIEAAKEIAAELARSPNVAYIPSGDNGKMLLGLNAAGFGGR

SEQ ID NO: 9431 - protein, 281 aa, Pseudoroegneria spicata
  misc_feature (5)..(5): Xaa can be any naturally occurring amino acid
  misc_feature (13)..(14): Xaa can be any naturally occurring amino acid
  misc_feature (17)..(17): Xaa can be any naturally occurring amino acid
  misc_feature (21)..(21): Xaa can be any naturally occurring amino acid
  misc_feature (23)..(24): Xaa can be any naturally occurring amino acid
  misc_feature (27)..(27): Xaa can be any naturally occurring amino acid
  misc_feature (30)..(30): Xaa can be any naturally occurring amino acid
  misc_feature (39)..(39): Xaa can be any naturally occurring amino acid
  misc_feature (43)..(43): Xaa can be any naturally occurring amino acid
  misc_feature (48)..(48): Xaa can be any naturally occurring amino acid
  misc_feature (53)..(54): Xaa can be any naturally occurring amino acid
  misc_feature (56)..(56): Xaa can be any naturally occurring amino acid
  misc_feature (62)..(62): Xaa can be any naturally occurring amino acid
  misc_feature (70)..(71): Xaa can be any naturally occurring amino acid
  misc_feature (80)..(80): Xaa can be any naturally occurring amino acid
  misc_feature (84)..(84): Xaa can be any naturally occurring amino acid
  misc_feature (94)..(94): Xaa can be any naturally occurring amino acid
  misc_feature (118)..(118): Xaa can be any naturally occurring amino acid
MAGGXAAVSFLTXXAKXAAGXGXXASXLSXSLYTVDGGXRAVXFDRFXGVLPXXVXEGTHFXVPWLQKPXXFDIRTRPHXFSSXSGTKDLQMVXLTLRVLARPDVERLPEIFTNLGLXYDDKVLPSIGNEVLKAVVAQFNADQLLTDRPHVSALVREALVRRAGEFNIVLDDVAITHLAYGHDFAQAVEKKQVAQQEAERSRFLVARAEQERRAAIVRAEGESESARLISDATALVGNGLIELRRIEAAKEIAGVIARSPNVSYIPSGNNSQMLLGLSTAR

SEQ ID NO: 9432 - protein, 285 aa, Secale cereale
MSGGPAAVSLLTNIAKAAAGLGAAASLLSASLYTVDGGERAVVFDRFRGVLPDTVGEGTHFIVPWLQKPYIFDIRTRPHNFSSNSGTKDLQMVNLTLRLLSRPDVVNLPTIFTSLGLEYDDKVLPSIGNEVLKAVVAQFNADQLLTDRPHVSALVRDSLIKRAREFNIILDDVAITHLSYGADFSQAVEKKQVAQQEAERSKFLVAKAEQERRAAIVRAEGESESARLISEATAIAGTGLIELRRIEAAKEIAAELARSPNVAYIPSGDNGKMLLGLNAAGFGGR

SEQ ID NO: 9433 - protein, 285 aa, Avena sativa
MAGGPAAVKFLTNIAKAAAGLGAAGSLLSASLYTVDGGERAVIFDRFRGVLPDTVGEGTHFIVPWLQKPYIFDIRTRPHNFSSNSGTKDLQMVNLTLRLLSRPDVVNLPTIFTSLGLEYDDKVLPSIGNEVLKAVVAQFNADELLTDRPVVSALVRESLIKRAREFNIILDDVAITHLSYGIEFSLAVEKKQVAQQEAERSKFLVAKAEQERRAAIVRAEGESESARLISEATAIAGTGLIELRRIEAAKEIAAELARSPNVAYIPSSDNGKMLLGLNAAGFGGR

SEQ ID NO: 9434 - protein, 251 aa, Saccharum officinarum
MEVVGGVSLRPSPAPARIRTTLSSVDVGGRLALRAPGAPRGQLPARRALVVEARGRSWSERQMQQQRRMPQLPKIEDDGNPRFVIFIRTANVYFWYPLNIITGGTTAKIMLAAKDNFLGKYIYKDTLARNLAAVIYKDEDEIIDTAKEQYRVLKTENEFRYGYKVVEKGNIRSALTTSNVIELPKKDELKTVVDKVKDFFGDVTAGAKESFAQITGSAVSKEEEEAESKEKFRSRRRKKQRKSKEGLKTEK

SEQ ID NO: 9435 - protein, 246 aa, Pennisetum glaucum
MEVVGGVSLRPPSARIGQLSPVDVGGRFLLRAAPRRQPAARRVLVVEARGRNWSERQMQQQRRMPQLPKIEDDGNPRFVIFIRTANVYFWYPLNIITGGTTAKIMLAAKDNFLGKYIYKDTLARNLAAVIYKDEDEIIDTAKEQYRVLKTENEFRYGYKVVENGNVRSALATSNVIELPKKDELKTVVDKVKDFFGDVTSGAKESFAQITGSAVTKEDEEAEGKGKFRSKRRKKQRKSKQGLKTEK

SEQ ID NO: 9436 - protein, 250 aa, Panicum virgatum
MEVVGGVSLRPPSAQAPARIWQLSSVDVGGRCFVLRAAPRRQPARRALVVEARGRSWSERQMLQQRRAPQLPKVEDDGNPRFVIFIRTANVYFWYPLNVITGGTTAKIMLAAKDNFLGKYIYKDTLARNLAAVIYKDEDEIIDTAKAQYRVLKTENEFRYGYKVVENGNIRSALTTSNVIELPKKDELKTVVDKVKDFFGDVTAGAKESFAQITGTAETKEEEAEGKEEKFRSKRRKKQRKSKQRLKTEK

SEQ ID NO: 9437 - protein, 314 aa, Sorghum bicolor
VLGGAVAGRAGPHLPQPAAAGDAHRRAAGVQVLGAGGRRPLLLAGDRHRGVEPAAEQAGPDRPHGRATHRPQRRLVPPDQRLRAALRSALLVHRRQVSVKSGNALLEIPRSEISDSIVETVAPRLSNVTFLDISSCTKIGARALEAFGKHCKSLVGLRRVMHPIDLVDKVCQHDEAHAIACSMPKLRHLEMGYMLIATEAVLEILGQCRDLKFLDLRGCWTVDDKFLRERHPGLRVLGPRVDDCYENSYWEECSDYSDDSSIYSWEFMDDDYYAVGSDDEAIWDDGQGLENLEVRFYGGGFSESFAGFDWPPSP

SEQ ID NO: 9438 - protein, 325 aa, Setaria italica
MGECEDAEEYRCWEELLPDALGLIFRNLPLQEVLTVVPRVCKSWGRVVAGPYCWQEIDIEEWSQQQSKPEQIGRMVEMLVGRSGGSCRRISVSGLPCDPLLSFIGDRARALRALEIPRSEISDSIVETVAPRLSNVTFLDISSCTKIGARALEAFGKHCKSLVGLRRVMHPIDLVDKECQHDEAHAIARSMPKLRHLEMGYMLIRTEAVAEILGQCRDLKFLDLRGCWAVDDKLLRERHPGLRVLGPRVEDCYENTYWEECSDYSDDDSSIYSWEFMDDVDGYYAVGSDDEAIWDDGQGLENLEVRFYGGGFSESLAGFDWPPSP

SEQ ID NO: 9439 - protein, 327 aa, Panicum virgatum
MGKCEDSEEYRCWEELLPDALGLIFRNLPLQEVLTVLPRVCKSWGRVVAGPYCWQEIDIEEWSQQQSKPEQIGRMVELLVGRSGGSCRRISVSGLPCDPLLSFIGDHARALRALEIPRSEISDSIVETVAPRLSNVTFLDISSCTKIGARALEAFGKHCKSLVGLRRVMHPIDLADKECQHDEAHAIACSMPKLRHLEMGYMLITTEAVAEILGQCRELKFLDLRGCWAVDDKLLRERHPGLRVLGPRVEDCYENSFWEECSDYSDDDDDSIYSWEFMDDGDGYYAGVGSDDEAIWDDGQGLENLEVRFYGGGFSESFAGFDWPPSP

SEQ ID NO: 9440 - protein, 318 aa, Pennisetum glaucum
MGECEDAEEYRCWEELLPDALGLIFRNLPLQEVLTVVPRVCKSWGRVVAGPYCWQEIDIEEWSQQQSKPEQIGRMVELLVGRSGGSCHRISVSGLPCDPLLSFIGEHARALRALEIPRSEISDSIVETVAPRLSNVTFLDISSCTKIGARALEAFGKHCKSLVGLRRVMHPIDLVDKECQHDEAHAIARSMPKLRHLEMGYMLIRTEAVAEILGQCRDLKFLDLRGCWAVDDKLLRERHPGLRVLGPRVEDCYENTYWEECSDYSDDDSSIYSWEFMDDVDGYYAVGSDDEAIWDDGQGLENLEVRFYGGGFNESFAG

SEQ ID NO: 9441 - protein, 331 aa, Zea mays
MGECEDGKEYRCWEELLPDALGLIFRNLPLQEVLTVLPRVCKSWGRVVAGPYCWQEIDIEEWSQQQSKPEQIARMVELLVGRSAGSCRRISVSGLPCDPRFSFIGDNARALRTLEIPRSEISDSMVESVAPRLPNVTFLDISSCTKIGARGLEAFGKHCKSLAGLRRVMHPIDLADRACQHDEAHAIACSMPRLRHLEMGYMLVATEAVAEILGRCRELRFLDLRGCWAVDDKLLPRDRHPGLRVLGPRVDDCYENSYWEECSDDYSDDSSIYSWELMDDVDDDYDYAAAGSDDDEAVWDDDGQGLENLEVRFYGGGFGETFAGFDWPPSP

SEQ ID NO: 9442 - protein, 335 aa, Zea mays
MGECEDGKEYRCWEELLPDALGLIFRNLPLQEVLTVLPRVCKSWGRVVAGPYCWQEIDIEEWSQQQSKPEQIGRMVELLVGRSGGSCRRISVSGLPCDPLFSFIADNARALGTLEIPRSEISDSVVEAVAPRLSNVTFLDISSCTKIGARALEAFGRHCRSLVGLRRVMHPIDLADKVCQHDEAHAIARSMPRLRHLEMGYMLVATEAVLEILEQCSELKFLDLRGCWAVDDRFLRERHPGLRVLGPRVVDDCYENSYWEECSDYYSDEDEDYDDDVVSWGLFVDDDDDYYYAVGSDDDEAIWDDAQGLENLEVRFYGGGGFGESFAGFDWPPSP

SEQ ID NO: 9443 - protein, 324 aa, Oryza sativa
MGECGGGEYRCWEELLPDALGLVFRNLPLREVLTVVPRVCKSWSRVVAGPYCWQEIDIEEWRQQQGKPEQLVRMVEMLVARSCGSCRRISVSGLPGDPLFSFIGDHARALRTLEIPRSEISDAAVESVAPRLPNVTFLDISSCTKIGARALEAFGKNCKSLVGLRRVMHPTDVAGKACQRDEARAIACTMPRLRHLEMGYMVIATDAVLDILARCRDLRFLDLRGCWAVDDKFLQERHPGLRVLGPGVDDCFENSYLEECSDYSDDSSIYSWELMEDDDDDYYAVGSDDEAIWDDGQGLENLEVRFYGGGFSESYAGFDWPPSP

SEQ ID NO: 9444 - protein, 317 aa, Oryza sativa
MGECSEHRCWDELLPDALGLIFRKLSLKDVLTVVPRVCKSWGRVVAGPYCWQEIDIQEWSQQQSKPDQLKRMVRMLVARSGGSFHRISVSGLPGDPLFTFIGDHARSLKTMELPRSDISDSLVENVAPRLSNVTFLDISSCTKIGARALEAFGKHCKSLIGLRRVMHPTDVVGRASQHDEARAIACNMPKLRHLEIGYMLIATKAVVEIASQCHDLKFLDLRGCWNVDDKLLQESYPGLKVVGPYVDDCYENSFWEECSDDSDDSIYWELMDDDYYAAGSDDEGIWDDGQGLEGLEVRFYGGGFSESHAGFDWPPSP

SEQ ID NO: 9445 - protein, 287 aa, Zea mays
MGQGGQEKSFNFLQVLLEGSIAGGTAGVVVETALYPIDTIKTRLQAARGGSRIEWKGLYSGLAGNLTGVLPASAIFVGVYEPTKRKLLETLPENLSAVAHFTAGAIGGIAASLVRVPTEVVKQRMQTGQFKSAPDAVRLIVAKEGFKGLYAGYGSFLLRDLPFDAIQFCIYEQLRIGYKLVAKRELNDPENALIGAFAGAITGAITTPLDVMKTRLMVQGQGNQYTGIVSCAQTILREEGPKAFLKGIEPRVLWIGIGGSIFFGMLEKTKSMLAERRNRELRAVKDE

SEQ ID NO: 9446 - protein, 286 aa, Sorghum bicolor
MGEGGEEKSFNFLQILLEGSIAGGTAGVVVETALYPIDTIKTRLQAARGGSRIEWKGLYSGLAGNLAGVLPASAIFVGVYEPTKRKLLETLPENLSAVAHFTAGAIGGIAASLVRVPTEVVKQRMQTGQFKSAPDAVRLIVGKEGFKGLYAGYGSFLLRDLPFDAIQFCIYEQLRIGYKLVARRELNDPENALIGAFSGAITGAITTPFDVMKTRLMVQGQGNQYTGIVSCAQTILREEGPKAFLKGIEPRVLWIGIGGSIFFGVLEKTKSMLAERRKRELPVKDE

SEQ ID NO: 9447 - protein, 284 aa, Panicum virgatum
MGEGGEEKSFNFLQVLLEGSIAGGTAGVVVETALYPIDTIKTRLQAARGGSRIEWKGLYSGLAGNLAGVLPASAIFVGVYEPTKRKLLETLPENLSAVAHFTAGAIGGIAASLVRVPTEVVKQRMQTGQFKKAPDAVRLIVAKEGFKGLYAGYGSFLLRDLPFDAIQFCIYEQLRIGYKLVAKRELNDPENALIGAFAGAITGAITTPLDVMKTRLMVQGQGTQYAGIVNCAQTILREEGPRAFLKGIEPRVLWIGIGGSIFFGVLEKTKSMLAERRNRDLKDE

SEQ ID NO: 9448 - protein, 289 aa, Setaria italica
MGGGEGGQEKSFNFLQVLLEGSIAGGTAGVVVETALYPIDTIKTRLQAARGGSRIEWKGLYSGLAGNLAGVLPASAIFVGVYEPTKRKLLETLPENLSAVAHFTAGAIGGIAASLVRVPTEVVKQRMQTRQFKSAPDAVRLIVAKEGFKGLYAGYGSFLLRDLPFDAIQFCIYEQIRIGYKLVAKRELNDPENALIGAFAGAITGAVTTPLDVMKTRLMVQGQGNQYSGIVSCAQTILREEGPMAFLKGIEPRVLWIGIGGSIFFGVLEKTKSMLAERRNREVGTLKDE

SEQ ID NO: 9449 - protein, 289 aa, Pennisetum glaucum
MGGGEGGQENSFNFFQVLLEGSIAGGTAGVVVETALYPIDTIKTRLQAARGGSRIEWKGLYSGLAGNLVGVLPASAIFVGVYEPSKRKLLETLPENLSAVAHFTAGAIGGIAASLVRVPTEVVKQRMQTRQFKSAPDAVRLIVAKEGFKGLYAGYGSFLLRDLPFDAIQFCIYEQLRIGYKVLAKRELNDPENALIGAFAGAITGAITTPLDVMKTRLMVQGQGSQYSGIVSCAQTILREEGPRAFLKGIEPRVLWIGIGGSIFFGVLEKTKSMLAERRNRQVGTLKDE

SEQ ID NO: 9450 - protein, 288 aa, Oryza sativa
MAVGGEEEKPFNFLQILCEGVIAGGTAGVVVETALYPIDTIKTRLQAARGGSQIQWKGLYSGLAGNIAGVLPASAVFVGIYEPTKRKLLETFPENLSAVAHFTAGAIGGIAASLIRVPTEVVKQRMQTGQFRSAPDAVRLIVGKEGFRGLYAGYGSFLLRDLPFDAIQFCIYEQLRIGYKVVAKRELNDPENALIGAFAGAITGAITTPLDVMKTRLMVQGSANQYSGIVSCAQTILREEGPGAFLKGIEPRVLWIGIGGSIFFGVLEKTKSMLAERRSREPPAGKDE

SEQ ID NO: 9451 - protein, 287 aa, Brachypodium distachyon
MGGGGEEKPFNFLQVLCEGVIAGGTAGVVVETALYPIDTIKTRLQAARAGSQIQWKGLYSGLGGNLVGVLPASALFVGIYEPTKRKLLDVFPENLSAVAHLTAGAVGGFAASLIRVPTEVVKQRMQTGQFKSAPGAVRLIVGKEGFKGLYAGYGSFLLRDLPFDAIQFCIYEQLRIGYKLVAKRELNDPENALIGAFAGAITGAITTPLDVLKTRLMVQGQTKQYSGIVSCAKTILREEGPGAFLKGIEPRVLWIGIGGSIFFGVLEKTKAVLAERSSRKTLANKDE

SEQ ID NO: 9452 - protein, 285 aa, Triticum aestivum
GGEEKPFNFLQILCEGVIAGGAAGVVVETALYPIDTIKTRLQAARAGSQIQWKGLYSGLGGNLVGVLPASALFVGIYEPTKRKLLDMFPENLSAVAHLTAGAVGGLGASLIRVPTEVVKQRMQTGQFRTAPDAVRLIVAKEGFRGLFAGYGSFLLRDLPFDAIQFCIYEQLRIGYKLMAKRELKDPENALIGAFAGAITGAITTPLDVLKTRLMIQGQTKQYSGIVSCAKTILREEGPGAFLKGIEPRVLWIGIGGSIFFGVLEKTKSVLAERSSRKAALAEKDE

SEQ ID NO: 9453 - protein, 284 aa, Oryza sativa
MGEGGDGRSFNFLQVLFEGVIAGGAAGVVVETALYPIDTIKTRLQAAKGGSKIQWKGLYAGLGGNIAGVLPASAIFIGVYEPTKRKLLEMFPENLSAVAHLTAGAIGGAASSLIRVPTEVVKQRMQMSQFKTAPDAVRLIIRKEGFKGLYAGYGSFLLRDLPFDAIQFCIYEQLRIGYKLAAKRDLKDGENALIGAFAGAITGAITTPLDVLKTRLMVQGQANQYRGIISCAQTILREEGAGAFLKGIEPRVLWIGIGGSIFFGVLEKTKSILAERNSRKVRIL

SEQ ID NO: 9454 - protein, 292 aa, Triticum aestivum
MGGGGGGEGEEKPFNFLQILCEGVIAGGAAGVVVETALYPIDTIKTRLQAARAGSQIQWKGLYSGLGGNLVGVLPASALFVGIYEPTKRKLLDMFPENLSAVAHLTAGAVGGLGASLIRVPTEVVKQRMQTGQFRTAPDAVRLIVAKEGFRGLFAGYGSFLLRDLPFDAIQFCIYEQLRIGYKLMAKRELKDPENALIGAFAGAITGAITTPLDVLKTRLMVQGQTKQYSGIVSCAKTILREEGPGAFLKGIEPRVLWIGIGGSIFFGVLEKTKSVLAERSSRKAALAEKDE

SEQ ID NO: 9455 - protein, 290 aa, Hordeum vulgare
MGASGGGEDKPFNFLQILCEGVIAGGTAGVVVETALYPIDTIKTRLQAARAGSQIQWKGLYSGLGGNLVGVLPASALFVGIYEPTKRKLLDMFPENLSAVAHLTAGAVGGLGASLIRVPTEVVKQRMQTGQFRTAPDAVRLIVAKEGFRGLFAGYGSFLLRDLPFDAIQFCIYEQLRIGYKLMAKRELKDPENALIGAFAGAITGAITTPLDVLKTRLMIQGQTKQYSGIVSCAKTILREEGPGAFLKGIEPRVLWIGIGGSIFFGVLEKTKSVLAERSSRKAVLAEKDK

SEQ ID NO: 9456 - protein, 290 aa, Triticum aestivum
MGASGGGEDKPFNFLQILCEGVIAGGAAGVVVETALYPIDTIKTRLQAARAGSQIQWKGLYSGLGGNLVGVLPASALFVGIYEPTKRKLLDMFPENLSAVAHLTAGAVGGLGASLIRVPTEVVKQRMQTGQFRTAPDAVRLIVAKEGFRGLFAGYGSFLLRDLPFDAIQFCIYEQLRIGYKLMAKRELKDPENALIGAFAGAITGAITTPLDVLKTRLMVQGQTKQYSGIVSCAKTILREEGPGAFLKGIEPRVLWIGIGGSIFFGVLEKTKSVLAERSSRKAALAEKDK

SEQ ID NO: 9457 - protein, 290 aa, Triticum aestivum
MGASGGGEDKPFNFLQILCEGVIAGGAAGVVVETALYPIDTIKTRLQAARAGSQIQWKGLYSGLGGNLVGVLPASALFVGIYEPTKRKLLDMFPENLSAVAHLTAGAVGGLGASLIRVPTEVVKQRMQTGQFRTAPDAVRLIVAKEGFRGLFAGYGSFLLRDLPFDAIQFCIYEQLRIGYKLMAKRELKDPENALIGAFAGAITGAITTPLDVLKTRLMIQGQTKQYSGIVSCAKTILREEGPGAFLKGIEPRVLWIGIGGSIFFGVLEKTKSVLAERSSRKAALAEKDE

SEQ ID NO: 9458 - protein, 285 aa, Secale cereale
AGEEKPFNFLQILCEGVIAGGAAGVVVETALYPIDTIKTRLQAARAGSQIQWKGLYSGLGGNLVGVLPASALFVGIYEPTKRKLLDMFPENLSAVAHLTAGAVGGLGASLIRVPTEVVKQRMQTGQFRTAPDAVRLIVAKEGFRGLFAGYGSFLLRDLPFDAIQFCIYEQLRIGYKLMAKRELKDPENALIGAFAGAITGAITTPLDVLKTRLMVQGQTKQYSGIVSCAKTILREEGPGAFLKGIEPRVLWIGIGGSIFFGVLEKTKSVLTERSSRKAALAEKDE

SEQ ID NO: 9459 - protein, 287 aa, Brachypodium distachyon
MGGCGQERPFNFLQVLCEGVIAGGAAGVVVEAALYPIDTIKTRLQAVQAGSQIQWEGLYSGLGGNLVGVLPASALFVGIYEPTKKKLLDVLPENLSAVAHLTAGAVGGFAASLFRVPTEVIKQRMQTGQFRSAPNAVRLIVRKEGFKGLYAGYGSFLLRDLPFDAIQFCIYEQLRIGYKLVAKRELNDPENALIGAFAGAITGAITTPLDVLKTRLMVQGQTKQYSGIVSCAQTILREEGPVAFLRGIEPRVLWIGIGGSIFFGVLEKTKAVLAERSSHKTLADKDQ

SEQ ID NO: 9460 - protein, 168 aa, Secale cereale
MGGGAGGGDGEEKPFNFLQILCEGVIAGGAAGVVVETALYPIDTIKTRLQAARAGSQIQWKGLYSGLGGNLVGVLPASALFVGIYEPTKRKLLDMFPENLSAVAHLTAGAVGGLGASLIRVPTEVVKQRMQTGQFRTAPDAVRLIVAKEGFRGLFAGYGSFLLRDLPI

SEQ ID NO: 9461 - protein, 182 aa, Secale cereale
MGGGAGGGDDKPFNFLQILCEGVIAGGAAGVVVETALYPIDTIKTRLQAARAGSQIQWKGLYSGLGGNLVGVLPASALFVGIYEPTKRKLLDMFPENLSAVAHLTAGAVGGLGASLIRVPTEVVKQRMQTGQFRTAPDAVRLIVAKEGFRGLLLVMVHFYFEIFRLMPFNSAYMSNFELVTS

SEQ ID NO: 9462 - protein, 128 aa, Secale cereale
DKPFNFLQILCEGVIAGGAAGVVVETALYPIDTIKTRLQAARAGSQIQWKGLYSGLGGNLVGVLPASALFVGIYEPTKRKLLDMFPENLSAVAHLTAGAVGGLGASLIRVPTEVVKQRMQTGQFRTAT

SEQ ID NO: 9463 - protein, 282 aa, Secale cereale
EKPFNFLQILCEGVIAGGAAGVVVETALYPIDTIKTRLQAARAGSQIQWKGLYSGLGGNLVGVLPASALFVGIYEPTKRKLLDMFPENLSAVAHLTAGAVGGLGASLIRVPTEVVKQRMQTGQFRTAPDAVRLIVAKEGFRGLFAGYGSFLLRELPFDAIQFCIYEQLRIGYKLMAKRELKDPENALIGAFAGAITGAITTPLDVLKTRLMIQGQTKQYSGIVSCAKTILREEGPGAFLKGIEPRVLWIGIGGSIFFGVLEKTKSVLAERSSRKAALAEKDE

SEQ ID NO: 9464 - protein, 295 aa, Triticum aestivum
GGRAGMGASGGGEDKPFNFLQILCEGVIAGGAAGVVVETALYPIDTIKTRLQAARAGSQIQWKGLYSGLGGNLVGVLPASALFVGIYEPTKRKLLDMFPENLSAVAHLTAGAVGGLGASLIRVPTEVVKQRMQTGQFRTAPDAVRLIVAKEGFRGLFAGYGSFLLRDLPFDAIQFCIYEQLRIGYKLMAKRELKDPENALIGAFAGAITGAITTPLDVLKTRLMIQGQTKQYSGIVSCAKTILREEGPGAFLKGIEPRVLWIGIGGSIFFGVLEKTKSVLAERSSRKAALAEKDE

SEQ ID NO: 9465 - protein, 358 aa, Hordeum vulgare
AIVSKGLPNPFLLFSAALPPPASPPPPPRLKLPAHLLPRGSSFRLPPILARRGRAAVSVSRRREDMGGASAPPPVEEKPFNFIQILCEGVIAGGAAGVVVETALYPIDTIKTRLQAARAGSQIQWKGLYSGLGGNLVGVLPASALFVGIYEPTKRKLLDMFPENLSAVAHLTAGAVGGLGSSLIRVPTEVVKQRMQTGQFRTAPDAVRLIVAKEGFRGLFAGYGSFLLRDLPFDAIQFCIYEQLRIGYKIMAKRELKDPENALIGAFAGAITGAITTPLDVLKTRLMIQGQTKQYSGIVSCAKTILREEGPGAFLKGIEPRVLWIGIGGSIFFSVLEKTKSVLAERSSRKAALAEKDE

SEQ ID NO: 9466 - protein, 328 aa, Manihot esculenta
MGPFTLAIDAKGSSKVPSGFADAPIRKMQNSSHLKARKAFASMSVQEEKPFDFLRTLFEGVIAGGTAGVVVETALYPIDTIKTRLQAARGGGKIILKGLYSGLAGNLAGVLPASALFVGVYEPTKQKLLRMFPENLSAVAHLTAGAIGGVAASLIRVPTEVVKQRMQTGQFTSAPDAVRLIVSKEGFKGLYAGYGSFLLRDLPFDAIQFCIYEQLRIGYKAAARRELNDPENAIIGAFAGALTGAITTPLDVIKTRLMVQGSANRYKGIFDCVQTVVREEGPAALLKGIEPRVLWIGIGGSIFFGVLESTKRYLVQRRPTPTQDQKQD

SEQ ID NO: 9467 - protein, 327 aa, Vitis vinifera
MGPFTLAIDAKKSSLAVSDSSNRKVQNAQLGKKKFFASISTGEEKEFNFLRVLLEGIVAGGTAGVVVETALYPIDTIKTRLQAVRGGGKIVWNGLYSGLAGNLAGVLPASAIFVGVYEPTKQKLLQIFPENLTAVAHLTAGAIGGLAASLVRVPTEVVKQRMQTGQFASAPDAVRMIVSKEGFKGLYAGYRSFLLRDLPFDAIQFCIYEQMRIGYKLAAKRDLNDPENALIGAFAGALTGAITTPLDVIKTRLMVQGPANQYNGIIDCVQTIVREEGPPALLKGIGPRVLWIGIGGSIFFGVLERTKRALAQRRPSPNQHSDSPKQD

SEQ ID NO: 9468 - protein, 324 aa, Gossypium raimondii
MGPFTLAVDTKSSSLVSSDVSNRKIKNLQLQTKKCFASVSMEEEKPFDFLRILFEGIIAGGTAGVVVETALYPIDTIKTRLQAARGGGKIVLKGLYSGLAGNLAGVLPASAVFVGVYEPTKQKLLKLFPENLSAVAHLTAGAIGGIAASLIRVPTEVVKQRMQTGQFTSASNAVHVIASKEGFKGLYAGYGSFLLRDLPFDAIQFCIYEQIRIGYKAAARRDLNDPENAIIGAFAGALTGAITTPLDVIKTRLMVQGSANQYKGIFDCVQTIIREEGPSALLKGIQPRVLWIGIGGSIFFGVLESTKRLLAERRPKPTQQSQHD

SEQ ID NO: 9469 - protein, 324 aa, Theobroma cacao
MGPFTLAIDTKSSSIVSSDVSNRKIQNLQLETRKCFASVSMEEEKPFNFLRILFEGIIAGGTAGVVVETALYPIDTIKTRLQAARGGGKIVLKGLYSGLAGNLAGVLPASALFVGVYEPTKQKLLKLFPENLSAFAHLTAGAVGGIAASLIRVPTEVVKQRMQTGQFTSASDAVRLIASKEGFKGLYAGYGSFLLRDFPFDAIQFCIYEQLRIGYKAAARRDLNDPENAIIGAFAGALTGAITTPLDVIKTRLMVQGSGNQYKGIFDCVQTIVREEGPPALLKGIGPRVLWIGIGGSIFFGVLESTKRFLAQTRPPPSQHSKHD

SEQ ID NO: 9470 - protein, 320 aa, Citrus clementina
MAPLTLGVDAKTSSDVSNWKMQNLQLETKKLFASVSMGEEKPFDFFRILFEGVIAGGTAGVVVETALYPIDTIKTRLQAVRGGGKINFKGLYSGLAGNLAGVLPASALFVGVYEPTKQKLLQIFPENLSAAAHLTAGAIGGFAASLVRVPTEVVKQRLQTGQYASAPDAVRLIASKEGFKGLYAGYGSFLLRDLPFDAIQFCIYEQLRISYKAAARRDLNDPENAIIGAFAGAITGAITTPLDVIKTRLMVQGSANQYKGIFDCVQTIVREEGPPALLKGIGPRVMWIGIGGSIFFGVLERTKRMLAQRRPVHDQNSKED

SEQ ID NO: 9471 - protein, 85 aa, Citrus sinensis
MAPLTLGADAKTSSDVSNWKMQNLQLETKKLFASVSMGEEKPFDFFRILFEGVIAGGTAGVVVETALYPIDTIKTRLQAVRGGGK

SEQ ID NO: 9472 - protein, 307 aa, Platanus occidentalis
TFKNKMRNSQLEPPKLFASVSMEEEKPFDFLRVLFEGVIAGGTAGVVVETALYPIDTIKTRLQAARGGGQILLKGLYSGLAGNLAGVLPASAIFVGVYEPTKQKLLRIFPENLTAFAHLTAGAIGGAAASLVRVPTEVVKQRMQTGQFASAPDAVRLIVAKEGFKGLYAGYGSFLLRDLPFDAIQFCIYEQLRLGCKLAAKRDLNDPENAIIGAFAGALTGAITTPLDVIKTRLMVQGSANQYKGVFDCVQTIVREEGSLALLKGIGPRVLWIGIGGSIFFGVLERTKRLLAERRPGAQSSDSNKQD

SEQ ID NO: 9473 - protein, 242 aa, Saccharum officinarum
MAAPTAAVDTTAPPLPPSAEPATAPAPDQKVSPPPHAPQPDAPAPAPAPAPAPVPAPAPAPAPAPAPRKRKLEEAGFHASEYYKIRAVVADLRVRFFQVYQATDFRNTDAARDILKEINVVMDLSKKMRLKLGATSDPVKPLEKPSAGLVKDELVKPSEKPSAGPVTEEPVKPQEKPSAGPVKDEPVKPSEKPSAEPVKNEPTEPVPAGENNQAPGVSQTTISPNNAGVGAPVVKHDNSEAK

SEQ ID NO: 9474 - protein, 224 aa, Zea mays
MAAPTAAVDTAAPPPPPSAEAAAAPVLDQKVSPAAAPQPDAPAPAPAPKKRKLEEAGFHTSEYYKIRAVVADLRVRFVQVHEATDFRNTDAAREIMREINVVMDLSKKMRLKLGATSEPVKPLEKPSVGLVKDELVKPSEKPSSGPVTGEPVKPPEKPSAGPVKDEPMKPSEKPSAEPVKNEPSEPALAGENNRAPRVSQTTSSPNNAGIDAPVVKHDNSEARK

SEQ ID NO: 9475 - protein, 106 aa, Zea mays
MDLSKKMRLKLGATSEPVKPLEKPSAGFVKDELVKPSEKPSAGPVNDEPVKPSEKPSAGPVKNEPTEPAPAGENNQAPTVGQTTVSPNNAGVGAPVVKHDNSEAQK

SEQ ID NO: 9476 - protein, 109 aa, Saccharum officinarum
MVDKNDGSEGLKFNTSNLIQTTEEVARAFIAAASAATAQSARPSVVYSSKDESGSPMQKLQQQFSKIMKGFSSSPDLSGTYNPEVLTTQKRQWSRVIGASENHHICSRA

SEQ ID NO: 9477 - protein, 830 aa, Zea mays
MVDKNDGSEGIKFNTSNLIQTTEEVARAFIAAASAATAQSARTSVVYSSKDESGSPMQKLQQHFSKIMKGFSSAPDLSGTYNPEVLTTQKRQWSRYQMKSLGDRCIREPSHLFESIVIVGLPPHADIQELENIALGRNDEDGKRSKNLFGNSHHQVHAITNLEPQVLFAYPPEKPLPLKYKDTLSFCLPGGVQVHAVERTPSFSELNEILLGQEQLKESNQSFVFRLQVADNSALYGCCVLVEEIVQRPSKLVSMLMNEKPVFPRRSRYVITTPRCYCILSRLPFFELHFGVLQSILMEERLEWLTDGVSMLTSLSLEESCENDICEGTAVTAQKHYLDSNTTDVDKSSESSNGVSSTELSDTDSSSGCRENQLDFVSKEQQQNSSCEEQSNFKREIVTCSDASEVSDHFVPEDTSSDQSGVKHHELHSAPSIPDESGARNCDDSPKENVDDEELDLFIIDTILPLMRSRLCEDCESSPSSQGSPSEGRNFDTQESDSEEPSSIGDGDLVKHNNILQWAKAKKYGSLQVVCQYYQLQCPARGSTLAFHPLEHLHSLSFHRPGETVLHIAGSTIELRSRDTSLEVAEMRNALFAEEESTALSTWAVASICGCLRLEHVMTLFAAALLEKQIVIVCSNLGMLSASVLSILPLIRPYQWQSLLMTVLPNDMMDFLDAPVPYIVGVQNKTSDVLNRLTNAVVIDANRNQIKSSSVPQLPQHRELLSALRPYHSILVGESYLARKRPVYECTDAQVEGAKGFLAVLRDYLDTLCSNLRSHTITNVQSNNDKVSLLLKESFIGSFPSRDRPFMKLFVDTQLFSVHTDLVLSFYQKD

SEQ ID NO: 9478 - protein, 362 aa, Panicum virgatum
MVDKNDGSEGLKFNTSHLIQTTEEVARAFIAAASAATAQSARPSVVYSSKDESGSPMQKLHQQFSKIMKGFSSSPDLSGPYNPEVLTTQKRQWSRFQLKSLGNRCIREPSHLFESIVIVGLPPQADIHELENIALGTNDEDGKRPRNLFGNNHHQVHAISNLEPQVLFAYPPEKPLPLKYKDTLSFCLPGGVQVHAVERTPSFSELNEILLGQEQLKESNQSFVFRLQVADDSTLYGCCVLVEEIVQRPSKLLSMLMNEKPIFPRRSRYVITTPRCYCILSRLPFFELHFGVLQSILMEERLEWLTDGVSMLTSLSLEEACEENDICEGTEDTVQKQYLDGSTTEVDKSSESSTGGFFKGAV

SEQ ID NO: 9479 - protein, 827 aa, Setaria italica
MVDKNDGSEGLKFNTSHLIQTTEEVARAFIAAASAATTQSTRPSVVYSSKDESGSPMQKLQQQFSKIMKGFSSSPDLSGPYNPEVLTTQKRQWSRFQLKSLGNRCIREPSHLFESIVIVGLPPQADIHELENIALGRNDEDGKRSRNLFSNSHHQVHAISNLEPQVLFAYPPEKPLPLKYKDTLSFCLPGGVQVHAVERTPSFSELNEILLGQEQLKESNQSFVFRLQVADDSTLYGCCVLVEEIVQRPSKLVSMLMNEKPVFPRRSRYMITTNRCYCILSRLPFFELHFGVLQSILMEERLEWLTDGVSILTSLSLEEACEENDICEGTEVTAKQYLDANTTDMDKSSESSTGVSSKELSDTDSSSGCKDTQLDFVSNEGEQQDNSCVKEQSDLETETAIHCDTPKVSDHCVPEDTSSDQSEVKPHELDSGARKNCDDSPQGNEGDEQLDLFITDTILPLMRSRLCEDCESSPSSQDSPSEGRNLRCDTQDSDSEEPSSIGHGDLVRHNNILQWAKAKKYGSLQVVCQYYQLQCPARGSSLTFHPLEHLHPLSFHRPGETVLHIAGSTIELRSRDTSLEVAEMRNALFAEEESTALSTWAVASICGCLRLEHVMTLFAAALLEKQIVIVCSNLGMLSASVLSIIPLIRPYQWQSLLIPVLPIDMMDFLDAPVPYIVGVQNKASDVLNRLANAVVIDANRNQIKSSSVPQLPQHRELLASLRPYHSILVGESYLARKRPVYECTDSQVEAAKGFLAVLRDYLDTLCSNLRSHTITNVQSNNDKVSLLLRESFIGSFPSRDRPFMKLFVDTQLFSVHTDLVLSFYQKD

SEQ ID NO: 9480 - protein, 776 aa, Pennisetum glaucum
DESGSPMQKLQQQFSKIMKGFSSSPDLSGPYNPEVLTTQKRQWSRFQLKSLGNRCIREPSHLFESIVIVGLPPQADTNELENIALGRNDEDGKRSRNLFGNSHHQVHAISNLEPQVLFAYPPEKPLPLKYKDTLSFCLPGGVQVHAVERTPSFSELNEILLGQEQLKESNQSFVFRLQVADDSTLYGCCVLVEEIVQRPSKLVSMLMNEKPVPRRSRYVITTPRCYCILSRLPFFDLHFGVLQSILMEERLEWLTDGVSMLTSLSLEEACEENDICEGTEVTAKQYLDANTTDMDKSSESSTGVSSKELSDTDSSSGCKDTQLDLVSNEEEHQDHSCVKEHSDLETETVIHCDTPRVSDHCVPVHTSSDQSKVKPHELDSGARKNCDDSPQGNEGDEQLDLFITDTILPLMRSRLSEDCESSPSSQDSPSEGRNLRSDTQDSDSEEPSSIGHGDLVRHDNILQWAKAKKYGSLQVVCQYYQLQCPTRGSSLTFHPLEHLHPLNFHRPGETVLHIAGSTIELRSRDTSLEVAEMRNALFAEEESTALSTWAVASICGCLRLEHVMTLFAAALLEKQIVIVCSNLGMLSASVLSIIPLIRPYQWQSLLMPVLPIDMMDFLDAPVPYIVGVQNRTSDVLNRLTNAVVIDANRNQIKSSSVPQLPQHRELLSSLRPYHSILVGESYLARKRPVYECTDAQVEAAKGFLAVLRDYLDTLCSNLRSHTITNVQSNNDKVSLLLRESFIGSFPSRDRPFMKLFVDTQLFSVHTDLVLSFYQKD

SEQ ID NO: 9481 - protein, 832 aa, Oryza sativa
MVDKNDGSEGLKFNTSHLMQTTEEVARAFIAAASAATVQSTRPSVVYSSREESGSPMQKLQQQFSKILKGFSTSPEVSGSYNPEVLTTQKRQWSRFQLKSLGNRCIREPSHLFESIVIVGLPPQADIHELENIALGSNEEDVKKPRNIFGNNHHQVHALSNLEPQVLFAYPPERPLPLKYKDILSFCLPGGVQVHAVERTPSFSELNEILLGQEQLKESNQSFVFRLQVADDSTLYGCCVLVEEIVQRPSKLVSMLTSEKPVFPRRSRYVITTPRCYCIFSRLPFFELHFGVLQSILMEERLEWLTDGVSLLTSLSPEETCEDDVVCEGTELATEKQYFDGHAVDLEKSSESSVGVCSKELSDTDSSSECRDNQLDLNCKEVQQECVVQDDLVTGTAPQCDTLERPDNCLSEDTTADQSGIELHELDSVPVILKESDTTENCGYSLQDDVNDEQLDIFVNDTILPLMRSRLCEGSELSPGSQDSPSEGINFRSDSHESDLEEPSSIGHGDLVGHNNISQWAKAKKYGSLQVVSQYYQLQCPARGSSLTFHPLDHLHPLRFHRPGETVLHIAGSTIDLRSCDTSLEVAEMRNALFAEEESTALSTWAVASICGCLRLEHVMTLFAAALLEKQIIIVCSNLGMLSASVLSIIPLIRPYQWQSLLIPVLPNDMMDFLDAPVPYIVGVQNKTSDVHSRLVNAVVIDANKNQIKSTSVPQLPQQKELLSALRPYHSRLVGESFLARKRPVYECTDAQVEAAKGFLAVLRSYLDSLCSNLRSHTITNVQSNNDKVSLLLRESFIGSFPTRERPFMKLFVDTQLFSVHTDLVLSFYQKD

SEQ ID NO: 9482 - protein, 829 aa, Brachypodium distachyon
MVDKNDGSEGLKFNKSHLMQTTEEVARAFIAAASAATVQPTRPSVVYSSGEESGSPMQKLQQQFSKILKGFSNSPEVSGPYNPEVLTTHKRQWSRFQLKSLGNRCIREPSHLFESIVIVGLPPQADIHELENIALGRNDDDTKKSRNLFGNNHHQVHAISNLEPQVLFAYPPEKSLPLKYKDIVSFCLPGGAQVNAVERTPSFSELNEILLGQEQLKESNQSFVFRLQVADDPTLYGCCVLVEEIVQRPSKLVSMLTNEKPVFPRRSRYVVTTPRCYCILSRLPFFELHFGVLQSILMEERLEWLTDGVSMLTSLSPEETCEDDDIHEDTEIAGAEQYLDGTTLEKSSETSVEASPKELSDTDSSSGCGDNQLVTSQEVQPESCSPVKEEQNSPVTGMITQYDKAEESDNCVSGETVIDMSSVKLHELDSVPFVSNENCCNFSHENVIDGELDIFVNDTILPLIRSRLSEGSESSPSSQDSPSEGINLRSDTNELDLEEPSSIGHGDVVGHSSILQWAKAKKYGSLQVVCQYYQLQCPARGSSLNFHPLEHLHPLRFHRPGETALHIAGSTIDLRSRDTSLEVAEMRNALFAEEESTALSTWAVASICGCLRLEHVMTLFAAALLEKQIVIVCSNLGMLSASVLSVIPLIRPYHWQSLLIPVLPNDMLDFLDAPVPYIVGVHNKTSDLQSRLGNAVIIDANKNQIKSTSVPQFPQQRELLSALRPYHSRLVGESFLARKRPVYECTDAQVEAAKGFLAVLRSYLDSLCSNLRSHTITNVQSNNDKVSLILKESFIGSFPARDRPFMKLFVDTQLFSVHTDLVLSYYQKD

SEQ ID NO: 9483 - protein, 396 aa, Zea mays
MLRACTRVGGAGAGGCGRRERLMASLIPFLPPSPYSTHLPRQPQSQPPTAATQPAAAARPSRFRLLFARAAAQRQRDSEPAPAAEERRSLAVRTGELFLGLAALLLRGTGAERSGGAAVEEMEARDGVVWEQRPQDVDAERRRRELTSPGFSFSAAGLLFPYHLGAAQCLMDRGYITETTPLAGSSAGAIICAVIASGNTMQDALQVTKVLADNCRSKGTAFRLGAVLKDVLVEFLPDDLHIRCNGRIRVAITQLSWRPRALLVDQFDSKEDVINAVITSSFIPGYLAPRPATFFRNRLGIDGGLTLFMPPTSAAETVRICAFPASRLGLQDIGISPDCNPENRASPRQLFNWALEPAADETLDKLYELGYLDAAVWAEQNYAELIAKNDQSLVAD

SEQ ID NO: 9484 - protein, 404 aa, Setaria italica
MLRACARVGGGGGRQGGALMASLITFLPSSSFSSSHLPRKPQLPPTPPTPAPTAARPSRFNLLFARAAARRDPEPSPAPAEAPPDAAVPAAEERRSLAVRTGELFLGLAALLLRGTGARRGGGGAAVEEVEARDGVVWEQRPEDVEAERRRRELTTPGFSFSAAGLLFPYHLGAAQYLMDKGYITERTPLAGSSAGAIICAVIASGNTMQDALQVTKDLADNCRSNGTAFRLGAVLRDVLDKFLPDDLHIRCNGRIRVAITQLSWRPRGLLVDQFDSKEDVINAVITSSFIPGYLAPRPATFFRNRLCIDGGLTLFMPPTSASETVRICAFPASRLGLQGIGISPDCNPENRASPRQLFNWALEPAEDEILDKLYELGYRDAAVWAEQNSTELTSKNDQPLAVD

SEQ ID NO: 9485 - protein, 413 aa, Panicum virgatum
MLRACTRVGGGGVGAGGRRGGALMASLIHFLPSSAYYSSHLPPKPQPQPQPRPAPTPAPAAAAAARPSRLRLLFARAAARRDPEPLPFPTEAPPDPAVGERRSLAVRTGELFLGLAALLLRGTGAVRGGGGGGAAAVEEVEARDGVVWEQRPEDVEAERRRRELTSPGFSFSAAGLLFPYHLGVAQCLMDKGYITERTPLAGSSAGAIICAVIASRNTMQDALQVTKDLADNCRSKGTAFRLGAVLRDVLDKFLPDDLHIRCNGRIRVAITQLSWRPRGLLVDQFDSKEDVINAVITSSFIPGYLAPRPATYFRNRLCIDGGLTLFMPPTSASETVRICAFPANRLGLQGIGISPDCNPENRASPRQLFNWALEPAEDEILDKLYELGYMDAAVWVEQKSTELNAKNEPLAVE

SEQ ID NO: 9486 - protein, 367 aa, Oryza sativa
MASSLLSSAASGLPPKPQPPSSTPPSSASARPRGFRRFMLARAAAGRDPEPPPLPEGTEKRSLAVRTGEVFLGLAALLVRAGRGGGAAVEEVEAKDGVVWEQRPEDVEAERRRRELTGPGFSFSAAGLLFPYHIGVAQCLIDRGYLTERTPLAGSSAGAIICAVIASGNTMRDALQVTKDLADNCRSNGTAFRLGAVLKDVLDRFLPDDVHIRCNGRIRVAITQLSWRPRGLLVDQFDSKDDVISAVITSSFIPGYLAPRPATFFRNRLCIDGGLTLFMPPTSASETVRICAFPASRLGLQGIGISPDCNPENRASPRQLFNWALEPAEDEVLDKLYELGYLDAAVWADQNQVELIVKNEQPLRVTD

SEQ ID NO: 9487 - protein, 405 aa, Panicum virgatum
MSALLDLLMGIFRQQTLGGAALDLAALAAPLWVAALVGLLIGWAWRPRWAGVVVGDNTQQAAPPPPARVTATAEASRLESAAVVPRTVVAPVAPEEEQLVVNTGDLMHLWRLVEEKDGGPSWIHMMERTLPTMRYQAWRRDPPNGPPQYRSSTIFEDASPEVVRDFFWDDEFRIKNSWDDMLLQHETLEECTKTGTMVVRWVRKFPFFCSDREYIIGRRIWASGKTFYCVTKGVPRPSVPRQNKPRRVDLYYSSWCIRPVESRKGDGAMTACEVLLFHHEDMGIPWEIAKLGVRQGMWGCVKRIEPGLRAYQVARTAGEPISKCAAMAHVTTKFNADELNTEDNTEASSSNNNMEIEKPKHWTNNIPKVLMIGGAVALACTFDGGLLTKAVIFGTARRFAGPGRR

SEQ ID NO: 9488 - protein, 110 aa, Panicum virgatum
MSALLDLLMGIFRQQTLGGAALELAALAAPLWVAALVGLLIGWAWRPRWAGVVVGDNAHQAAQLPAHPPPARATAAAEASRLESAAVVPRTMVAPVAPGGRAIARSTPVT

SEQ ID NO: 9489 - protein, 419 aa, Zea mays
MSALLDLLMGIFRQQTLGGAALELAALAAPLSLAALVGLLIGWAWRPRWAGVVVVDNAQQMAQLPAAAAPPDRATATAVVSRNEAAAVVPRTVVAHAAAEDEQQQLAVNTGDLMHLWRLVDEKDGGPSWIHMMDRTLPTMRYQAWRRDPPSGPPQYRSSTIFEDASPEVVRDFFWDDEFRMKNSWDDMLLQHETLEECTETGTMVVRWVRKFPFFCSDREYIIGRRIWASGKTFYCVTKGVPRPSVPRQNKPRRVDLYYSSWCIRPVESRKGDGAMSACEVLLFHHEDMGIPWEIAKLGVRQGMWGCVKRIEPGLRAYQVGRTAGEAVSKCAAMAQVTTRFSADELVIAGPGNTEASSSSSGDGAEVGKATKHWANSIPKVLMVGGAVALACCTFDGGLLTKAVIFGTARRFAGGPGRR

SEQ ID NO: 9490 - protein, 196 aa, Saccharum officinarum
MDLSAVQAALSDKSYSALAPLCDELLLQAASKGATTDEWPYSVHLLAHLYINDLNSARFFWKSLPQEVKDTRPELAAVWRIGQCLWNRDYAGVNTAAQGFEWGPDLADFITAFLESYRQRIFKLLTSAYSTISVADVAHFMGMSEEDATNYAVQNGWSLDAATRMLTVKKPKAQTNQKLDASKLQRLTECVFHLEH

SEQ ID NO: 9491 - protein, 196 aa, Zea mays
MDLSAVQAALSDKSYTAVASLCDELLLQAASKGTNTDEWPYSVHLLAHLYINDLNSARFFWKSLPQEVKDTRPELAAVWRIGQCLWNRDYAGVNTAAQGFEWGPDLTEFITAFLESYRQRIFKLLTSAYSTISVADVAHFMGMSEEDATNYAVQIGWSLGAATKMLTVKKPKAQINQKLDASKLQRLTECVFHLEH

SEQ ID NO: 9492 - protein, 196 aa, Zea mays
MDLSAVQAALSDKSYSTLASLCDELLLQAASQGFTTDEWPYSVHLLAHLYINDLNSARFFWKSLPQEVKDTRPELAAVWRIGQCLWKRDYAGVNTAAQGFEWGPDLADFITAFLESYRQRIFKLLTSAYSTIRVADVAHFMGMSEEDATNYAVQNGWSLDAAAKMLTVKKPKSQTNQKLDASKLQRLTECVFHLEN

SEQ ID NO: 9493 - protein, 56 aa, Panicum virgatum
MGMSEEDSTNYAVQNGWSLDAGTKMLTVKKPKAQTNQKLDASKLQRLTECVFHLEH

SEQ ID NO: 9494 - protein, 196 aa, Setaria italica
MDLSAVQTALADKSYSALAPLCDDILLQAASRGATTDEWPYAVHLLAHLYLNDLNSARFFWKSLPQEVKDARPELAAVWRIGQCLWNRDYAGVYTAAQGFEWGTDLADFITSFLESYRKRIFQLLTSAYSTIIVADVAHFMGMSEEDATNYAVQNGWSLDAATNMLTVKKPKAQTNQKLDASKLQRLTECVFHLEH

SEQ ID NO: 9495 - protein, 196 aa, Panicum virgatum
MDLSAVQAALSDKSYSTLAPLCDELLLQAASRGTTTDEWPHAVHLLAHLYLNDLNSARFFWKSLPQEVKDASPELAAVWRIGQCLWNRDYAGVYTAAQGFEWGPDLADFTTAFLESYRQRIFQLLTSAYSTISVADVAHFMGMSEEDSTNYAVQKGWSLDVGTKMLTVKKPKAQTNQKLDASKLQRLTECVFHLEH

SEQ ID NO: 9496 - protein, 196 aa, Cenchrus ciliaris
MDLSVVQAALAHKSYSALAPLCDDLLLQAASRGTATDEWPYAVHLLAHLYLNDLNSARFFWKSLPQEVKDARPELVAVWRIGQCLWNRDYAGVYTAAQGFEWGPDLADFITSFLESYRKRIFQLLTSAYSTIIVADVAHFMGMSEEDATNYAVQNGWSLDAATNMLTVKKPKVQTNQKLDASKLQRLTECVFHLEH

SEQ ID NO: 9497 - protein, 196 aa, Pennisetum glaucum
MDLSAVQAALADKSYSALAPLCDDILLQAASRGAATDEWPYAVHLLAHLYLNDLNSARFFWKSLPQEVKDARPELAAVWRIGQCLWNRDYAGVYTAAQGFEWGPDLADFIASFLESYRKRIFQLLTSAYSTIIVADVAHFMGMSDDDATNYAVQNGWSLDAATNMLTVKKPKVQTNQKLDASKLQRLTECVFHLEH

SEQ ID NO: 9498 - protein, 196 aa, Panicum virgatum
  misc_feature (5)..(5): Xaa can be any naturally occurring amino acid
MDLSXVQAALSDKSYSGLAPLCDDLLLQTASRGATTDEWPYAVHLLAHLYLNDLNSARFFWKSLPQEVKDARPELVAVWRIVQCLWNRDHAGVYTAAQGFEWGPDLADFITAFLESYRKRIFQLLTSAYSTISVPDVAHFMGMSEEDATNYAVGNGWSLDASTKMLTVKKPKTQTNQKLDASKLQRLTECVFHLEH

SEQ ID NO: 9499 - protein, 196 aa, Avena sativa
MDLSTVHAALSAKSYPDLAPLCDDLFLQVASQGAATDGWPYAVHLLAHLYLNDLNSARFLWKTVPQEVKDAHPELAAVWKIGQCLWNRDNAGVYTTAQGFEWGPEIADFVSAFIESYRKRIFELLTSAYSTISVADVAHFMGMSEEDATNYAMQNGWSLDAATKMLTVRKQKAQTNQKLDASKLQRLTECVFHLEH

SEQ ID NO: 9500 - protein, 196 aa, Brachypodium distachyon
MDLSAIHAALSAKSYSTLGPLCDDLLLQVASRGAATDDWPYAVHLLAHLYLNDLNSARFLWKTVPQEVKDARPELAAIWKIGQCLWNRDYAGVYTTAHEFEWSPEIADFVAGFLESYRKRIFELLTSAYSTIIVADVSHFMGMSEEDATNYAVQNGWSLDAATKMLTVRKQKAQTNQKLDASKLQRLTECVFHLEH

SEQ ID NO: 9501 - protein, 196 aa, Triticum aestivum
MDLSAVHAALSAKSYSAIATLCDDLLLQVASRGVATDDWPYAVHLLAHLYLNDLNSARFLWKTVPQEVKDAHPELGAIWKIGQCLWNRDYAGVYTSAQGFEWGPEIADFVAAFLESYRKRIFELLTSAYTTISIADVAHFMGMSEEDATNYAVQNGWSLDVATKMLTVRKQKPQTNQKLDASKLQRLTECVFHLEH

SEQ ID NO: 9502 - protein, 196 aa, Oryza sativa
MDLAAVHAALAGKSYSSVAPLCDDLFLQAASRGAATDGWPYAVHLLAHLYLNDLNSARFLWKSTPQEAKDARPELAAVWRIGQCLWNRDYAGVYAAAQGFEWSPEIADFVAAFLESYRKRIFQLLTSAYSTISVADVAHFMGMNEEDATNYAMQNGWSLDAAARMLTVVKPKVKTNQKLDASKLQRLTECVFHLEH

SEQ ID NO: 9503 - protein, 196 aa, Hordeum vulgare
MDLSAVHAALSAKSYSAMATLCDDLLLQVASRGVATDDWPYAVHLLAHLYLNDLNSARFLWKTVPQEVKDAHPELGAIWKIGQCLWNRDYAGVYTSAQGFEWGPEIADFMAGFLESYRKRIFELLTSAYTTISIADVAHFMGMSEEDATNYAVQNGWSLDAAAKMLTVRKQKPQTNQKLDASKLQRLTECVFHLEH

SEQ ID NO: 9504 - protein, 216 aa, Setaria italica
MATAARAVVAARPARPLLPSRRLPSYSSARPPRQSGGGVGSVRCMARRPDSSYSPLRSGQGGDRAPTEMAPLFPGCDYEHWLIVMDKPGGEGATKQQMIDCYIQTLAQVVGSEEEAKKRIYNVSCERYFGFGCEIDEETSNKLEGLPGVLFVLPDSYVDAENKDYGAELFVNGEIVQRSPERQRRVEPVPQRAQDRPRYSDRTRYVKRRENQSYQR

SEQ ID NO: 9505 - protein, 215 aa, Zea mays
MATAARALVAARPARPLLPSRRLPSSSSIRPARQRAGVGCVRCMARRPDSTYSPLRSGQGGDRAPTEMAPLFPGCDYEHWLIVMDKPGGEGATKQQMIDCYIQTLAQVVGSEEEAKKRIYNVSCERYFGFGCEIDEETSNKLEGLPGVLFVLPDSYVDAENKDYGAELFVNGEIVQRSPERQRRVEPVPQRAQDRPRYSDRTRYVKRRENQSYQR

SEQ ID NO: 9506 - protein, 217 aa, Zea mays
MATVARTLVAACPARSLLRFRSRRLPSSSSIRPARQRAGVGSVRCMARRPDSSYSPLRSGQGGDRAPTEMAPLFPGCDYEHWLIVMDKPGGEGATKQQMIDCYIQTLAQVLGSEEEAKKKIYNVSCERYFGFGCEIDEETSNKLEGLPGVLFVLPDSYVDAENKDYGAELFVNGEIVQRSPERQRRVEPVPQRAQDRPRYSDRTRYVKRRENQSYQR

SEQ ID NO: 9507 - protein, 215 aa, Brachypodium distachyon
MATAARAIAAARLAQPLLVSRRLPSSSARPTRPRGGGGSAVRCMARRPDASYSPLRSGQGGDRAPTEMAPLFPGCDYEHWLIVMDKPGGEGATKQQMIDCYIQTLAKVVGSEEEAKKKIYNVSCERYFGFGCEIDEETSNKLEGLPGVLFVLPDSYVDAENKDYGAELFVNGEIVQRSPERQRRVEPVPQRAQDRPRYSDRTRYVKRRENQAYQR

SEQ ID NO: 9508 - protein, 214 aa, Triticum aestivum
MATAARAVAAAARPARPVLLSRRLPCPSARPARPRVGRAVRCMARRPDASYSPLRPGQGGDRAPTEMAPLFPGCDYEHWLIVMDKPGGEGATKHQMIDCYIQTLAKVVGSEEESKKRIYNVSCERYFGFGCEIDEETSNKLEGLPGVLFVLPDSYVDAENKDYGAELFVNGEIVQRSPERQRRVEPVPQRAQDRPRYSDRTRYVKRRENQAYQR

SEQ ID NO: 9509 - protein, 215 aa, Triticum aestivum
MATAARAVAAAARPARPVLLPRRLPCPSARPARWPRVGRAVRCMARRPDASYSPLRPGQGGDRAPTEMAPLFPGCDYEHWLIVMDKPGGEGATKQQMIDCYIQTLAKVVGSEEESKKRIYNVSCERYFGFGCEIDEETSNKLEGLPGVLFVLPDSYVDAENKDYGAELFVNGEIVQRSPERQRRVEPVPQRAQDRPRYSDRTRYVKRRENQAYQR

SEQ ID NO: 9510 - protein, 224 aa, Brachypodium distachyon
QPPLLRSPAMATAARAIAAARLAQPLLVSRRLPSSSARPTRPRGGGGSAVRCMARRPDASYSPLRSGQGGDRAPTEMAPLFPGCDYEHWLIVMDKPGGEGATKQQMIDCYIQTLAKVVGSEEEAKKKIYNVSCERYFGFGCEIDEETSNKLEGLPGVLFVLPDSYVDAENKDYGAELFVNGEIVQRSPERQRRVEPVPQRAQDRPRYSDRTRYVKRRENQAYQR

SEQ ID NO: 9511 - protein, 211 aa, Pseudoroegneria spicata
AARAVAAAARPAHPVLLSPRLPCPSARPARPRVGRAVRCMARRPDASYSPLRPGQGGDRAPTEMAPLFPGCDYEHWLIVMDKPGGEGATKQQMIDCYIQTLAKVVGSEEEAKKRIYNVSCERYFGFGCEIDEETSNKLEGLPGVLFVLPDSYVDAENKDYGAELFVNGEIVQRSPERQRRVEPVPQRAQDRPRYSDRTRYVKRRENQAYQR

SEQ ID NO: 9512 - protein, 223 aa, Oryza sativa
MATAAAAARAVAAAGRPAQGVPLSRRLTTASSSSARPLRPRGGRAAGSVRCMARRPESSYSPLRSGQGGDRAPTEMAPLFPGCDYEHWLIVMDKPGGEGATKQQMIDCYIQTLAKVVGSEEEAKKKIYNVSCERYFGFGCEIDEETSNKLEGLPGVLFVLPDSYVDAENKDYGAELFVNGEIVQRSPERQRRVEPVPQRAQDRPRYSDRTRYVKRRENQAYQR

SEQ ID NO: 9513 - protein, 220 aa, Triticum aestivum
RQRPLPPWPPQRAPSPPPRARCTWCSCRGASPAPPRAPRGLASAAPSAAWRGGPTPRTRRCGRGWAGTARPFLWRRSSPAGLRALAHRHGQARRRGRPKQQMIDCYIQTLAKVVGSEEDAKKRIYNVSCERYFGFGCEIDEETSNKLEGLPGVLFVLPDSYVDAENKDYGAELFVNGEIVQRSPERQRRVEPVPQRAQDRPRYSDRTRYVKRRENQAYQR

SEQ ID NO: 9514 - protein, 198 aa, Secale cereale
PVLLSRRLPCPSARPARRRVGCAVRCMARRPDASYSPLRPGQGGDRAPTEMAPLFPGCDYEHWLIVMDKPGGEGATKQQMIDCYIQTLAKVVGSEEEAKKRIYNVSCERYFGFGCEIDEETSNKLEGLPGVLFVLPDSYVDAENKDYGAELFVNGEIVQRSPERQRRVEPVPQRAQDRPRYSDRTRYVKRRENQAYQR

SEQ ID NO: 9515 - protein, 232 aa, Festuca arundinacea
ARGSSPLPERCSPAMATAARAVAAARPAQPVLLFRRVPSSSARPTRPRGGRGGVGCAIRCMARRPDASYSPLRSKQGGDRAPTEMAPLFPGCDYEHWLIVMDKPGGEGAAKQQMIDCYIQTLAKVVGSEEEAKKRIYNVSCERYFGFGCEIDEETSNKLEGLPGVLFVLPDSYVDAENKDYGAELFVNGEIVQRSPERQRRVEPVPQRAQDRPRYSDRTRYVKRRENQAYQR

SEQ ID NO: 9516 - protein, 247 aa, Panicum virgatum
FRTPSPRHFTFTSASLRPFPSRPTNQPPHPSPAMATAARAVVAARPARPLLPSRRLPSFSSARAPLQRGGVGSVRCMARRPDSYSPLRSGQGGDRAPTEMAPLFPGCDYEHWLIVMDKPGGEGATKQQMIDCYIQTLAQVVGSEEEAKKRIYNVSCERYFGFGCEIDEETSNKLEGLPGVLFVLPDSYVDAENKDYGAELFVNGEIVQRSPERQRRVEPVPQRAQDRPRYSDRTRYVKRRENQSYQR

SEQ ID NO: 9517 - protein, 182 aa, Hordeum vulgare
RPRVGRAVRCMARRPDASYSPLRPGQGGDRAPTEMAPLFPGCDYEHWLIVMDKPGGEGATKQQMIDCYIQTLAKVVGSEEEAKKRMYNVSCERYFGFGCEIDEETSNKLEGLPGVLFVLPDSYVDAENKDYGAELFVNGEIVQRSPERQRRVEPVPQRAQDRPRYSDRTRYVKRRENQAYQR

SEQ ID NO: 9518 - protein, 197 aa, Saccharum officinarum
TSRRRASNSWAAVCDTFFSTKQVFENHRIVFTVGTSIASVLTAWAGYSLRQVHQSRIERRLESIESSLKGNHKVEHEEIKKIVTSSNISAPACVATAMTTMVVGYTLGWRGGAWYAQRAFRREQQKMMMGHMKSHNRWHWRPFNRLRNRLRNSRLASKNKSADAHPSVGQSSEAPSTSSIGASANVSSASQPAAGSA

SEQ ID NO: 9519 - protein, 196 aa, Zea mays
MVVRRLGGAGRALLTLPNIRRRASNSWAAVCDTFFSTKQVFENHRIVFTVGTSIASVLTAWAGYSLRHVQQSRIEQRLESIESSLKGNHKVEHEEIKKIVTSSNISAPSLCSHGNDHNGCWVRGRLARWCLVRSKGLEKRATKAGGDGSHEVARQMALAALQQAQEQQVSLQEQARRRPSKHRGPLDVKQRGLCGR

SEQ ID NO: 9520 - protein, 209 aa, Setaria italica
MVVRRLGGAGRALLTLPNIRRRATNSWAAVRDTFFSTKQVFESHRIVFTVGTSVASVLTAWAGYSLRHVQQSRIDRRLESIESSLKDNHKVEHEEIKKIVTSSNISTPACVATAMTTMVVGYALGWRGGAWYARRAFRREQQKLMMGHMKSQGRWHWRPFNRLKNRLRRASKNKSEDAHRSLAQSTDAPSSSGASANISNTAQPAAGNA

SEQ ID NO: 9521 - protein, 198 aa, Zea mays
MVVRRLGGTGRALLTLPNIRRRASNSWAAVCDTFFSTKQVFESHRIVFTVGTSIASVLTAWAGYSLRHVQQLKIERRLESIESSLKDNHKVEHEEIKKIVTSSNISAPGCVATAMTTMVVGYALGWRGGAWYARRAFRREQQKLMMGHMKSSQNRWHWRPFNRLRNSRLTASKNKSTDALSTSRSGASANVGSAAGSA

SEQ ID NO: 9522 - protein, 200 aa, Pennisetum glaucum
AGRALLTLPNIRRRATNSWAAVRDTFFSTKQVFENHRIVFTVGTSVASVLTAWAGYSLRHVQQTRIDRRLESIESSLKDNHKVEHEEIKKIVTSSNISTPACVATAMTTMVVGYALGWRGGAWYARRAFRREQQKLMMGHMKSQGRWHWRPFNRLKNRLRRASKNKSEDAQGLAQSTDAPSSSGASANISNTAQPAAGSA

SEQ ID NO: 9523 - protein, 315 aa, Zea mays
MGGGVMRTAAKVGIARGAAAVAAAKGGRFRHAAPAFATAPAATGSDAAPLVSASGGEVPPAAAQWAASWELDDWEFADCGDVAPAAVVAEREATAAAAKPRLVFAPPSREEAEEATTELRDAIGRAYFNESPVEVVKEQDKEFNKLATDAIIPSMPGHVVQAFTLLKSSTEAQSVVASLASDRNVWDAVLKNEKVMEFYKTHQTTPVQTFPEEAATAESPGKFEDATSENASNSELPTGSGASFADFVDNAKKKVMDVVHNITDFFRDLFNDSAEAQTGAGPSAEKGFSATEMAVGGSFMALTIAVILVVLFKRA

SEQ ID NO: 9524 - protein, 314 aa, Zea mays
MGGGVMRTAAKVSIAGGAAAAKSGRFRNAAPVFATAPAAAGSEAAPLVSVSSGEVPPAAAQWAASWELDDWEFADWRDDAAAAAAVVEREATAAAAKPRLVFAPPSREEAEEATTELRDAVERAYFNESPVEVVKEQDKEFNKLATDAMIPSMPGHVVQAFTLLKSSTEAQSVVASLASDRNVWDAVLKNEKVMEFYKTHQTTLVQTSPNEAVTVELPGKLEDAASENTSSGELPAGSGPSFSDFVDNAKKTVMDVVHNITDFFKDLFDDSAKTQTGAGPSAAEKGPSTADMAVGGSFMALAIAVILVVMFKRA

SEQ ID NO: 9525 - protein, 310 aa, Setaria italica
MGGGVMRTAAKVGIAGGAAAASAAKGGRFRHAAPAFATAPAAASGAEAAPLVSSASGAEVPPAAAQWAASWELDDWEFADWRDDAASVVVAEREAAAAAAKPRLVFAPPSREEAEEATTELRDAIERAYFNESPVEVVKEQDKELNKLATDAIIPSMPGHVVQAFTLLKSSPEAQSVVASLASDRNVWDAVLKNEKVMEFYKTHQTTLVQTFPEEAATVESPEKFEDATSENAPTGSPFADFVDKAKKTMMDVVDNITHFFQDLLHPPAEAQAGAGSSAEKGPSLAEMAVGGSFMALTIAVILVVLFKRA

SEQ ID NO: 9526 - protein, 303 aa, Panicum virgatum
MGGGVMRTAAKVGIAGGAAAAAAAKGGRFRHAAPAFATAPAGAEAAPLVSAGGAEAPPAAAQWAASWEVDDWEFADWRDDAAAVAVAEREAAPKPRLVFAPPSREEAEEATTELRDAIERAYFNESPVEVVKEQDKEINKLATDAIIPSMPGHVVQAFTLLKSSPEAQSVVASLASDRNVWDAVLKNEKVMEFYKTHQTTLVQTFPEEVATGESPEKFEDAASENASAASPFADFVDNAKKTVMDVIDNITHFFQDLFGHPTGAQAGAGSSAEKGPSVGEMAVGGSFMALTIAVILVVLFKRA

SEQ ID NO: 9527 - protein, 1009 aa, Setaria italica
MWAPSRGSSSGSGRRTWRRRIVDYLADDQTDASDNESFITAHSDELGFGAASVSSAAGGGGGVGGGGAEGMLPAFLADQGDLVEVMLELDEESMVVRSVTPTAAALYGPTSLAAGAGAGGASARTPDGARSLSRCSSTSSRIRRKFAWLRSPSPSPSQRHPVPASAASDQQAVREAALAARERRRVQARLNRSRSGARRALKGLRFISRTTGDDAAGGGDLWRRVEERFNALARDGLVSRDDFGDCIGMKDSKDFAVGIFDALARRRRQNLERISKEELYDFWLQISDQSFDARLQIFFDMVDTNVDGRITREEVQELIVLSASANKLAKLKEQAEEYASLIMEELDPENLGYIELWQLEALLLQRDAYMTYSRPMSSGSAGQWSQGLSAGAGAGAGAGGQQRDGVASQVRRRLSPRRAAARARVAAAEGWRRAWVLALWLAAMAALFTWRFVQYRRSSAFRVMGYCLPTAKGAAETLKLNMALVLLPVCRNTLTWLRSTWARFFVPFDDSIAFHKIIATAIALGICLHAGNHLACDFPRLIASGPDEYRLVARFFGRDKPTYRALLAGAEGVTGIVMVTLMAVSFTLATRPFRKREEMAKGAAAAAAGGGGRRLLRWSFPLGHLAGFNAFWYSHHLLIVVYLLLLVHGWFMFLVDRWYQRTTWMYISVPLVLYVGERTLRAFRSKAYAVKILKVCLLPGNVLTITMSKPYGFRYRSGQYIFLQCPTISPFEWHPFSITSAPGDDYISVHIQTRGDWTQELKRIFVENYFTPCVPIRAAFGELGAAEQKSPPRLLVDGPYGAPAQDFRNYDVLLLVGLGIGATPFISILRDLLNNIKLADELMDLAMETSKSEDSANSLSTASSSNKRRAYRTSCAHFYWVTREPGSFEWFKGVMNEVAEMDKKGVIELHNYLTSVYEERDARTTLLSMVQALNHAKHGVDIVSGTRVRTHFARPNWKEVFARIASKHPNSTVGVFYCGRPTLAKELKKLSLDMSHKTGTRFDFHKEYF

SEQ ID NO: 9528 - protein, 1009 aa, Zea mays
MWAPSRGSSSGSGRRTWRRRIADYLADDQTDVSDNESFITAHSDEHAAPASGAGGMLPAFLADQGDLVEVMLELDEESMVVRSVTPTAAALCGPTSLPLPGARSLSRCSSTSSRIRRKFAWLRSPSPRPPAATAASDQQVVVREAALAARERRRAQARLDRSRSGARRALKGLRFISRTTGSSDADAGAGAGLWRGVEERFNALATDGLLARDDFGDCIGTYVRPNKQTKQPPYVCCYGSHERRHRRRSSVAGMVDSKEFAVGIFDALARRRRQNLERISKDELYEFWLQISDQSFDARLQIFFDMVDTNVDGRITREEVQELIVLSASANKLSKLKEQAEEYASLIMEELDPENLGYIELWQLEALLLQRDAYMTYSRPMSSGSAAQWSQGLSGGAGAGGQPSAQQQQGVASRWRRWSPRRAAARARVAAAESWRRAWVLALWVAAMAALFAWRFVQYRRSAAFRVMGYCLPTAKGAAETLKLNMALVLLPVCRNTLTWLRSTWARFFVPFDDSIAFHKIIATAIALGICLHAGNHLACDFPRLIASAPEEYRLVARFFGRDRPSYRGLLAGAEGVTGIVMVTLMAVSFTLATRPFRKREEASRDKKKAAACACRGVPLAGFNAFWYSHHLLIVVYLLLLVHGWFMFLVDKWYQRTTWMYISVPLALYVGERTLRAFRSKAYAVKILKVCLLPGNVLTVTMSKPYGFRYRSGQYIFLQCPTISPFEWHPFSITSAPGDDCVSVHVQTRGDWTQELKRIFVENYFTPCVPRRAAFGDLGAVDHKTKSPPRLLVDGPYGAPAQDFRNYDVLLLVGLGIGATPFISILRDLLNNIKLADELMDLAMETGRAEDSASNLSASTASGGGNKRRAYRTTCAHFYWVTREPGSFEWFKGVMNEVAEMDNKGVIELHNYLTSVYEERDARTTLLSMVQALNHAKHGVDIVSGTRVRTHFARPNWKEVFTRIASKHPNSTVGVFYCGRPTLAKELKKLSLDMSHRTGTRFDFHKEYF

SEQ ID NO: 9529 - protein, 326 aa, Saccharum officinarum
MGVKGFVEGGIASIVAGCSTHPLDLIKVRMQLQGEAAAAPQPALRPALAFHAGGHAVALPHHHDIPVPPPRKPGPLAVGAQILRSEGARGLFSGVSATMLRQTLYSTTRMGLYDILKTKWTPPDNNGVLPLHRKIAAGLVAGGVGAAVGNPADVAMVRMQADGRLPLAERRNYAGVGDAIGRMARDEGVRSLWRGSSLTVNRAMIVTASQLATYDQAKEAILARRGPGADGLATHVAASFTAGIVAAAASNPVDVVKTRMMNMKVAPGAPPPYAGAVDCALKTVRSEGPMALYKGFIPTVMRQGPFTVVLFVTLEQVRKVFKGVEF

SEQ ID NO: 9530 - protein, 326 aa, Zea mays
MGVKGFVEGGIASIVAGCSTHPLDLIKVRMQLQGEAAAAVAPQPALRPALAFHAGGHAVALPHHHDIPAPPRKPGPLAVGAQILRSEGAAGLFSGVSATMLRQTLYSTTRMGLYDILKTRWARENGGVLPLHRKILAGLVAGGVGAAVGNPADVAMVRMQADGRLPLAERRNYRGVGDAIGRMARDEGVRSLWRGSSLTVNRAMIVTASQLATYDQAKEAILARRGPGADGLATHVAASFTAGIVAAAASNPVDVVKTRMMNMKVAPGAPPPYAGAVDCALKTVRSEGPMALYKGFIPTVMRQGPFTVVLFVTLEQVRKVFKGVEF

SEQ ID NO: 9531 - protein, 325 aa, Cenchrus ciliaris
MGLKGFVEGGIASIVAGCSTHPLDLIKVRMQLQGEAAAAPQPALRPALAFHAGGHTVALPHHPHDIPAPPRKPGPVAVGAQILRSEGAAALFSGVSATMLRQTLYSTTRMGLYDILKTKWTRENGGVLPLHRKIAAGLVAGGVGAAVGNPADVAMVRMQADGRLPLAERRNYRSVGDAIGRMARDEGVRSLWRGSSLTVNRAMIVTASQLATYDQAKEAILARRGPGADGLATHVAASFTAGIVAAAASNPVDVVKTRMMNMKVAPGAPPPYAGAVDCALKTVRSEGPMALYKGFIPTVMRQGPFTVVLFVTLEQVRKVFKGVEF

SEQ ID NO: 9532 - protein, 326 aa, Setaria italica
MGVKGFVEGGIASIVAGCSTHPLDLIKVRMQLQGEAAAAVPPQPALRPALAFHAGGHTVALPHHHDIPAPPRKPGPVAVGAQILRSEGAAALFSGVSATMLRQTLYSTTRMGLYDILKTKWTQENGGVLPLHRKIAAGLVAGGVGAAVGNPADVAMVRMQADGRLPLAERRNYRSVGDAIGRMARDEGVRSLWRGSSLTVNRAMIVTASQLATYDQAKEAILARRGPGADGLATHVAASFTAGIVAAAASNPVDVVKTRMMNMKVAPGAPPPYAGAVDCALKTVRSEGPMALYKGFIPTVMRQGPFTVVLFVTLEQVRKVFKGVEF

SEQ ID NO: 9533 - protein, 326 aa, Pennisetum glaucum
MGLKGFVEGGIASIVAGCSTHPLDLIKVRMQLQGEVAAPQPALRPALAFHAGGHTVSLPHHHHHDIPVAPPRKPGPVAVGAQILRSEGAAALFSGVSATMLRQTLYSTTRMGLYDILKTKWTKENGGVLPLHRKIAAGLVAGGVGAAVGNPADVAMVRMQADGRLPLAERRNYRSVGDAIGRMARDEGVRSLWRGSSLTVNRAMIVTASQLATYDQAKEAILARWGSGADGLGTHVAASFTAGIVAAAASNPVDVVKTRMMNMKVAPGAPPPYAGAVDCALKTVRAEGPMALYKGFIPTVMRQGPFTVVLFVTLEQVRKVFKGVEF

SEQ ID NO: 9534 - protein, 323 aa, Panicum virgatum
MGGVKGFVEGGIASIVAGCSTHPLDLIKVRMQLQGEAAAPQPAMRPALAVPAGGQTVALPQDVPVAPPRKPGPLAVGAQILRSEGAAGLFSGVSATMLRQTLYSTTRMGLYDILKTKWTQDNGGVLPLHHKIAAGLIAGGIGAAVGNPADVAMVRMQADGRLPLAERRNYRSVGDAIGRMARDEGVRSLWRGSSLTVNRAMIVTASQLATYDQAKEAILARRGPGADGLATHVAASFTAGLVAAAASNPVDVVKTRMMNMKVAPGAPAPYAGAVDCALKTVRSEGPMALYKGFIPTVMRQGPFTVVLFVTLEQVRKVFKGVEF

SEQ ID NO: 9535 - protein, 325 aa, Avena sativa
MGMKGFVEGGIASIVAGCSTHPLDLIKVRMQLQGEAAAAAAAPQPALRPALAFQSGTHTVSLPAHDIPAPRKPGPISIGTQILRAEGAAGLFSGISATVLRQTLYSTTRMGLYDILKKRWTQENGGVLPLHRKIAAGLIAGGVGAAVGNPADLAMVRMQADGRLPLADRRNYRSVGDAIARMTRDEGVRSLWRGSSLTVNRAMIVTASQLATYDQAKEAILARRGPGADGLVTHVAASFAAGIVAAAASNPVDVVKTRVMNMKVAPGAPPPYAGAMDCALKTVRSEGVMALYKGFIPTVSRQGPFTVVLFVTLEQVRKVFKDVDF

SEQ ID NO: 9536 - protein, 327 aa, Oryza sativa
MGFKGFVEGGIASIVAGCSTHPLDLIKVRMQLQGEASAAAAAVAPAQAALRPALAFHAGQAVAIPHDVIAPPRKPGPIAVGAQILRAEGAAGLFSGVSATMLRQTLYSTTRMGLYDILKKKWTQENGGVLPLHRKIAAGLIAGGVGAAVGNPADVAMVRMQADGRLPLAERRNYRSVGDAIGRMARDEGVRSLWRGSSLTVNRAMIVTASQLATYDQAKEAILARRGPGADGLGTHVVASFAAGLVAAAASNPVDVVKTRVMNMKVAPGAPPPYSGAIDCALKTVRSEGVMALYKGFIPTVSRQGPFTVVLFVTLEQVRKVFNGVEF

SEQ ID NO: 9537 - protein, 324 aa, Triticum aestivum
MGVKGFVEGGIASIVAGCSTHPLDLIKVRMQLQGESSAAAAAPQPALRPALAFQAGAHTVTLPHAPAPVPKPGPIGICTQILRAEGAAGLFSGISATMLRQTLYSTTRMGLYDILKKRWTQENGGVLPLHLKIAAGLIAGGVGAAVGNPADLAMVRMQADGRLPLADRRNYRSVGDAIARMTRDEGVRSLWRGSALTVNRAMIVTASQLATYDQAKEAILARRGPAADGLGTHVAASFAAGIVAAAASNPVDVVKTRVMNMKVAPGAPPPYAGALDCALKTVRSEGVMALYKGFIPTVSRQGPFTVVLFVTLEQVRKVFKDAEF

SEQ ID NO: 9538 - protein, 139 aa, Oryza sativa
MVADTPEKSPAAPSARRICAPTAIGPGFLGGAITSCGIATACPAWNASAGRSAACAGATAAAAADASPCSCILTLIKSSGCVEHPATMDAMPPSTNPLNPIAPPLHKSDGKKPNQKERRPKLQESSKERSNLFYSYCCQ

SEQ ID NO: 9539 - protein, 325 aa, Secale cereale
MGVKGFVEGGIASIVAGCSTHPLDLIKVRMQLQGESSAAAAAVPQPALRPALAFQTGAHTVTLPHAPTPVPKPGPIGICTQILRAEGAAGLFSGISATMLRQTLYSTTRMGLYDILKKRWTQENGGVLPLHRKIAAGLIAGGVGAAVGNPADLAMVRMQADGRLPLADRRNYRSVGDAIARMTRDEGVRSLWRGSALTVNRAMIVTASQLATYDQAKEAILARRGPAADGLGTHVAASFAAGIVAAAASNPVDVVKTRVMNMKVAPGAPPPYAGALDCALKTVRSEGVMALYKGFIPTVSRQGPFTVVLFVTLEQVRKVFKDVEF

SEQ ID NO: 9540 - protein, 325 aa, Triticum aestivum
MGVKGFVEGGIASIVAGCSTHPLDLIKVRMQLQGESSAAAAAVPQPALRPALAFQAGAHTVTLPHAPTPVPKPGPIGICTQILRAEGAAGLFSGISATMLRQTLYSTTRMGLYDILKKRWTQENAGVLPLHRKIAAGLIAGGVGAAVGNPADLAMVRMQADGRLPLADRRNYRSVGDAIARMTRDEGVRSLWRGSALTVNRAMIVTASQLATYDQAKEAILARRGPAADGLGTHVAASFAAGIVAAAASNPVDVVKTRVMNMKVAPGAPPPYAGALDCALKTVRSEGVMALYKGFIPTVSRQGPFTVVLFVTLEQVRKVFKDVEF

SEQ ID NO: 9541 - protein, 324 aa, Triticum aestivum
MGVKGFVEGGIASIVAGCSTHPLDLIKVRMQLQGESSAAAAAPQPALRPALAFQAGAHTVTLPHAPASVPKPGPIGICTQILRAEGAAGLFSGISATMLRQTLYSTTRMGLYDILKKRWTQENGGVLPLHLKIAAGLIAGGVGAAVGNPADLAMVRMQADGRLPLADRRNYRSVGDAIARMTRDEGVRSLWRGSALTVNRAMIVTASQLATYDQAKEAILARRGPAADGLGTHVAASFAAGIVAAAASNPVDVVKTRVMNMKVAPGAPPPYAGALDCALKTVRSEGVMALYKGFIPTVSRQGPFTVVLFVTLEQVRKVFKDAEF

SEQ ID NO: 9542 - protein, 330 aa, Brachypodium distachyon
MGMKGFVEGGIASIVAGCSTHPLDLIKVRMQLQGESAAAAAVPQAAALRPALAFQAGGAHTVSLPHVHDVAPPPVRKPGPIAIGTQILRAEGAAGLFSGVSATVLRQTLYSTTRMGLYDILKKRWSQENGGVLPLHRKIAAGLIAGGIGAAVGNPADLAMVRMQADGRLPLAERRNYRSVGDAIGRMARDEGVRSLWRGSALTVNRAMIVTASQLATYDQAKEAILARRGPAADGLATHVAASFAAGIVAAAASNPVDVVKTRVMNMKVAPGAPPPYAGAMDCALKTVRSEGVMALYKGFIPTVSRQGPFTVVLFVTLEQVRKVFKDVEF

SEQ ID NO: 9543 - protein, 325 aa, Hordeum vulgare
MGVKGFVEGGIASIVAGCSTHPLDLIKVRMQLQGESSAAAVPQPALRPALAFQAGAQTVALPHAPTPASVAKPGPIGICTQILRAEGAAGLFSGISATMLRQTLYSTTRMGLYDILKKRWTQENAGVLPLHLKIAAGLIAGGVGAAVGNPADLAMVRMQADGRLPLADRRNYRSVGDAIARMTRDEGVRSLWRGSALTVNRAMIVTASQLATYDQAKEAILARRGPGADGLGTHVAASFAAGIVAAAASNPVDVVKTRVMNMKVAPGAPPPYAGALDCALKTVRSEGVMALYKGFIPTVSRQGPFTVVLFVTLEQVRKVFKDVEF

SEQ ID NO: 9544 - protein, 1709 aa, Sorghum bicolor
MAAANAPIAMREALTLTSLGIAPQFVTFTHVTMESEKYICVRETSPQNSVVIIDMAMPMQPLRRPITADSALMNPNTRILALKAQIPGTTQDHLQIFNIEAKTKIKSHQMPEQVVFWKWITPKLLGLVTQTSVYHWSIEGDSEPTKMFDRTANLANNQIINYRCDPAEKWLVLIGIAPGAPERPQLVKGNMQLFSVDQQRSQALEAHAASFATFKVVGNENPSTLICFASKTTNAGQITSKLHVIELGAQPGKPGFSKKQADLFFPPDFQDDFPVAMQVSQKYGLIYVITKLGLLFVYDLETAAAVYRNRISPDPIFLTAESSSTGGFYAINRRGQVLHATVNDATVVPFVSGQLNNLELAVNLAKRANLPGAENLVVQRFQELFAQTKYKEAAELAAESPQGLLRTPETVAKFQSVPVQAGQTPPLLQYFGTLLTRGKLNAFESLELSRLVVNQNKKNLLENWLAEDKLECSEELGDLVKTVDNDLALKIYIKARATPKVVAAFAERREFDKILIYSKQVGYTPDYLFLLQTILRTDPQGAVNFALMMSQMEGGCPVDYNTITDLFLQRNMIREATAFLLDVLKPNLPEHAFLQTKVLEINLVTYPNVADAILANGMFSHYDRPRIAQLCEKAGLYLRALQHYSELPDIKRVIVNTHAIEPQALVEFFGTLSREWALECMKDLLLVNLRGNLQIVVQAAKEYSEQLGVDACIKLFEQFKSYEGLYFFLGSYLSSSEDPDIHFKYIEAAARTGQIKEVERVTRESNFYDAEKTKNFLMEAKLPDARPLINVCDRFGFVPDLTHYLYTNNMLRYIEGYVQKVNPGNAPLVVGQLLDDECPEDFIKGLILSVRSLLPVEPLVDECEKRNRLRLLTQFLEHLVSEGSQDVHVHNALGKIIIDSNNNPEHFLTTNPFYDSRVVGKYCEKRDPTLAVVAYRRGQCDDELINVTNKNSLFKLQARYVVERMDGDLWDKVLQPENEYRRQLIDQVVSTALPESKSPEQVSAAVKAFMTADLPHELIELLEKIVLQNSAFSGNFNLQNLLILTAIKADPSRVMDYVNRLDNFDGPAVGEVAVEAQLYEEAFAIFKKFNLNVQAVNVLLDNIRSIERAEEFAFRVEEDAVWSQVAKAQLREGLVSEAIESFIRADDAAHFLDVIRAAEEANVYDDLVKYLLMVRQKAREPKVDGELIFAYAKIDRLSDIEEFILMPNVANLQNVGDRLYDEELYEAAKIIYAFISNWAKLAVTLVKLKQFQGAVDAARKANSAKTWKEVCFACVDAEEFRLAQICGLNIIVQVDDLEEVSEYYQNRGCFNELIALMESGLGLERAHMGIFTELGVLYARYRPEKLMEHIKLFSTRLNIPKLIRACDEQQHWKELTYLYIQYDEFDNAATTIMNHSPDAWDHMQFKDVCVKVANVELYYKAVHFYLQEHPDLINDMLNVLALRLDHTRVVDIMRKAGQLHLVKPYMVAVQSNNVSAVNEALNELYVEEEDYERLRESVDMHDNFDQIGLAQKLEKHELLEMRRIAAYIYKKAGRWKQSIALSKKDNMYKDCMETCSQSGDRELSEDLLVYFIEQGKKECFASCLFICYDLIRPDVALELAWMNNMLDFAFPYLLQFIREYTSKVDDLVKDKIESQKEERAKEKEEKDLVAQQNMYAQLLPLALPAPPMPGMGGPPPMGGMGMPPMGGMGMPPMGPGPMPAFGMPPMGSY

SEQ ID NO: 9545 - protein, 746 aa, Zea mays
MAAANAPIAMREALTLTSLGIAPQFVTFTHVTMESEKYICVRETSPQNSVVIIDMAMPMQPLRRPITADSALMNPNTRILALKAQIPGTTQDHLQIFNIEAKTKVKSHQMPEQVVFWKWITPKLLGLVTQTSVYHWSIEGDSEPLKMFDRTANLANNQIINYRCDPAEKWLVLIGIAPGAPERPQLVKGNMQLFSVDQQRSQALEAHAASFATFKVVGNENPSTLICFASKTTNAGQITSKLHVIELGAQPGKPGFSKKQADLFFPPDFQDDFPVAMQVSQKYGLIYVITKLGLLFVYDLETAAAVYRNRISPDPIFLTAESSSTGGFYAINRRGQVLHATVNDATVVPFVSGQLNNLELAVNLAKRANLPGAENLVVQRFQELFAQTKYKEAAELAAESPQGLLRTPETVAKFQSVPVQAGQTPPLLQYFGTLLTRGKLNAFESLELSRLVVNQNKKNLLENWLAEDKLECSEELGDLVKTVDNDLALKIYIKARATPKVVAAFAERREFDKILIYSKQVGYTPDYLFLLQTILRTDPQGAVNFALMMSQMEGGCPVDYNTITDLFLQRNMIREATAFLLDVLKPNLPEHAFLQTKVLEINLVTYPNVADAILANGMFSHYDRPRIAQLCEKAGLYLRALQHYSELPDIKRAIVNTHVIEPQALVEFFGTLSREWALECMKDLLLVNLRGNLQIVVQAAKEYSEQLGVDACIKLFEQFKSYEGLYFFLGSYLKLQRGPRYPFTST

SEQ ID NO: 9546 - protein, 1710 aa, Setaria italica
MAAANAPIAMREALTLTSLGIAPQFVTFTHVTMESEKYICVRETSPQNSVVIIDMAMPMQPLRRPITADSALMNPNTRILALKAQIPGTTQDHLQIFNIEAKTKIKSHQMPEQVVFWKWITPKLLGLVTQTSVYHWSIEGDSEPTKMFDRTANLANNQIINYRCDPAEKWLVLIGIAPGAPERPQLVKGNMQLFSVEQQRSQALEAHAASFATFKVAGNENPSTLICFASKTTNAGQITSKLHVIELGAQPGKPGFSKKQADLFFPPDFQDDFPVAMQVSQKYGLVYVITKLGLLFVYDLETAAAVYRNRISPDPIFLTAESSSTGGFYAINRRGQVLHATVNDATVVPFVSGQLNNLELAVNLAKRANLPGAENLVVQRFQELFAQTKYKEAAELAAESPQGLLRTPETVAKFQSVPVQAGQTPPLLQYFGTLLTRGKLNAFESLELSRLVVNQNKKNLLENWLAEDKLECSEELGDLVKTVDNDMALKIYIKARATPKVVAAFAERREFDKILIYSKQVGYTPDYLFLLQTILRTDPQGAVNFALMMSQMEGGCPVDYNTITDLFLQRNMIREATAFLLDVLKPNLPEHAFLQTKVLEINLVTYPNVADAILANGMFSHYDRPRIAQLCEKAGLYLRALQHYSELPDIKRVIVNTHAIEPQALVEFFGTLSREWALECMKDLLVVNLRGNLQIVVQAAKEYSEQLGVDACIKLFEQFKSYEGLYFFLGSYLSSSEDPDIHFKYIEAAARTGQIKEVERVTRESNFYDAEKTKNFLMEAKLPDARPLINVCDRFGFVPDLTHYLYTNNMLRYIEGYVQKVNPGNAPLVVGQLLDDECPEDFIKGLILSVRSLLPVEPLVDECEKRNRLRLLTQFLEHLVSEGSQDVHVHNALGKIIIDSNNNPEHFLTTNPFYDSRVVGKYCEKRDPTLAVVAYRRGQCDDELINVTNKNSLFKLQARYVVERMDGDLWDKVLQPENEYRRQLIDQVVSTALPESKSPEQVSAAVKAFMTADLPHELIELLEKIVLQNSAFSGNFNLQNLLILTAIKADPSRVMDYVNRLDNFDGPAVGEVAVEAQLYEEAFAIFKKFNLNVQAVNVLLDNIRSIERAEEFAFRVEEDAVWSQVAKAQLREGLVSEAIESFIRADDAAHFLDVIHAAEEANVYNDLVKYLLMVRQKAREPKVDGELIFAYAKIDRLSDIEEFILMPNVANLQNVGDRLYDEELYEAAKIIYAFISNWAKLAVTLVKLKQFQGAVDAARKANSAKTWKEVCFACVDAEEFRLAQICGLNIIVQVDDLEEVSEYYQNRGCFNELIALMESGLGLERAHMGIFTELGVLYARYRYEKLMEHIKLFSTRLNIPKLIRACDEQQHWKELTYLYIQYDEFDNAATTIMNHSPDAWDHMQFKDVCVKVANVELYYKAVHFYLQEHPDLINDMLNVLALRLDHTRVVDIMRKAGQLHLVKPYMVAVQSNNVSAVNEALNELYVEEEDYERLRESVDMHDNFDQIGLAQKLEKHELLEMRRIAAYIYKKAGRWKQSIALSKKDNMYKDCMETCSQSGDRELSEDLLVYFIEQGKKECFASCLFICYDLIRPDVALELAWMNNMIDFAFPYLLQFIREYSSKVDDLVKDKIESQNEERAKEKEEKDLVAQQNMYAQLLPLALPAPPMPGMGGPPPPMGGMGMPPMGGMGMPPMGPGPMPAFGMPPMGSY

SEQ ID NO: 9547 - protein, 1710 aa, Setaria italica
MAAANAPIAMREALTLTSLGIAPQFVTFTHVTMESEKYICVRETSPQNSVVIIDMAMPMQPLRRPITADSALMNPNTRILALKAQIPGTTQDHLQIFNIEAKTKIKSHQMPEQVVFWKWITPKLVGLVTQTSVYHWSIEGDSEPTKMFDRTANLANNQIINYRCDPAEKWLVLIGIAPGAPERPQLVKGNMQLFSVDQQRSQALEAHAASFATFKVVGNENPSTLICFASKTTNAGQITSKLHVIELGAQPGKPGFSKKQADLFFPPDFQDDFPVAMQVSQKYGLIYVITKLGLLFVYDLETAAAVYRNRISPDPIFLTAESSSTGGFYAINRRGQVLHATVNDATVVPFVSGQLNNLELAVNLAKRANLPGAENLVVQRFQELFAQTKYKEAAELAAESPQGLLRTPETVAKFQSVPVQAGQTPPLLQYFGTLLTRGKLNAFESLELSRLVVNQNKKNLLENWLAEDKLECSEELGDLVKTVDNDMALKIYIKARATPKVVAAFAERREFDKILIYSKQVGYTPDYLFLLQTILRTDPQGAVNFALMMSQMEGGCPVDYNTITDLFLQRNMIREATAFLLDVLKPNLPEHAFLQTKVLEINLVTYPNVADAILANGMFSHYDRPRIAQLCEKAGLYLRALQHYSELPDIKRVMVNTHAIEPQALVEFFGTLSREWALECMKDLLVVNLRGNLQIVVQAAKEYSEQLGVDACIKLFEQFKSYEGLYFFLGSYLSSSEDPDIHFKYIEAAARTGQIKEVERVTRESNFYDAEKTKNFLMEAKLPDARPLINVCDRFGFVPDLTHYLYTNNMLRYIEGYVQKVNPGNAPLVVGQLLDDECPEDFIKGLILSVRSLLPVEPLVDECEKRNRLRLLTQFLEHLVSEGSQDVHVHNALGKIIIDSNNNPEHFLTTNPFYDSRVVGKYCEKRDPTLAVVAYRRGQCDDELINVTNKNSLFKLQARYVVERMDGDLWDKVLQPENEYRRQLIDQVVSTALPESKSPEQVSAAVKAFMTADLPHELIELLEKIVLQNSAFSGNFNLQNLLILTAIKADPSRVMDYVNRLDNFDGPAVGEVAVEAQLYEEGFAIFKKFNLNVQAVNVLLDNIRSIERAEEFAFRVEEDAVWSQVAKAQLREGLVSEAIESFIRADDAAHFLDVIHAAEEANVYNDLVKYLLMVRQKAREPKVDGELIFAYAKIDRLSDIEEFILMPNVANLQNVGDRLYDEELYEAAKIIYAFISNWAKLAVTLVKLKQFQGAVDAARKANSAKTWKEVCFACVDAEEFRLAQICGLNIIVQVDDLEEVSEYYQNRGCFNELIALMESGLGLERAHMGIFTELGVLYARYRYEKLMEHIKLFSTRLNIPKLIRACDEQQHWKELTYLYIQYDEFDNAATTIMNHSPDAWDHMQFKDVCVKVANVELYYKAVHFYLQEHPDLINDMLNVLALRLDHTRVVDIMRKAGQLHLVKPYMVAVQSNNVSAVNEALNELYVEEEDYERLRESVDMHDNFDQIGLAQKLEKHELLEMRRIAAYIYKKAGRWKQSIALSKKDNMYKDCMETCSQSGDRELSEDLLVYFIEQGKKECFASCLFICYDLIRPDVALELAWMNNMIDFAFPYLLQFIREYSSKVDDLVKDKIESQNEERAKEKEEKDLVAQQNMYAQLLPLALPAPPMPGMGGPPPPMGGMGMPPMGGMGMPPMGPGPMPAFGMPPMGSY

SEQ ID NO: 9548 - protein, 1710 aa, Zea mays
MAAANAPIAMREALTLTSLGIAPQFVTFTHVTMESEKYICVRETSPQNSVVIIDMAMPMQPLRRPITADSALMNPNTRILALKAQIPGTTQDHLQIFNIEAKTKIKSHQMPEQVVFWKWITPKLLGLVTQTSVYHWSIEGDSEPTKMFDRTANLANNQIINYRCDPAEKWLVLIGIAPGAPERPQLVKGNMQLFSVDQQRSQALEAHAASFATFKVVGNENPSTLICFASKTTNAGQITSKLHVIELGAQPGKPGFSKKQADLFFPPDFQDDFPVAMQVSQKYGLIYVITKLGLLFVYDLETAAAVYRNRISPDPIFLTAESSSTGGFYAINRRGQVLHATVNDATVVPFVSGQLNNLELAVNLAKRANLPGAENLVVQRFQELFAQTKYKEAAELAAESPQGLLRTPETVAKFQSVPVQAGQTPPLLQYFGTLLTRGKLNAFESLELSRLVVNQNKKNLLENWLAEDKLECSEELGDLVKTVDNDLALKIYIKARATPKVVAAFAERREFDKILIYSKQVGYTPDYLFLLQTILRTDPQGAVNFALMMSQMEGGCPVDYNTITDLFLQRNMIREATAFLLDVLKPNLPEHAFLQTKVLEINLVTYPNVADAILANGMFSHYDRPRIAQLCEKAGLYLRALQHYAELPDIKRAIVNTHAIEPQALVEFFGTLSREWALECMKDLLLVNLRGNLQIVVQAAKEYSEQLGVDACIKLFEQFKSYEGLYFFLGSYLSSSEDPEIHFKYIEAAARTGQIKEVERVTRESNFYDAEKTKNFLMEAKLPDARPLINVCDRFGFVPDLTHYLYTNNMLRYIEGYVQKVNPGNAPLVVGQLLDDECPEDFIKGLILSVRSLLPVEPLVDECEKRNRLRLLTQFLEHLVSEGSQDVHVHNALGKIIIDSNNNPEHFLTTNPFYDSRVVGKYCEKRDPTLAVVAYRRGQCDDELIIVTNKNSLFKLQARYVVERMDGDLWDKVLQPENEYRRQLIDQVVSTALPESKSPEQVSAAVKAFMTADLPHELIELLEKIVLQNSAFSGNFNLQNLLILTAIKADPSRVMDYVNRLDNFDGPAVGEVAVEAQLYEEAFAIFKKFNLNVQAVDVLLDNIRSIERAEEFAFRVEEDAVWSQVAKAQLREGLVSEAIESFIRADDAAHFLDVIRAAEEANVYNDLVKYLLMVRQKAREPKVDGELIFAYAKIDRLSDIEEFILMPNVANLQNVGDRLYDEELYEAAKIIYAFISNWAKLAVTLVKLKQFQGAVDAARKANSAKTWKEVCFACVDAEEFRLAQICGLNIIIQVDDLEEVSEYYQNRGCFSELIALMESGLGLERAHMGIFTELGVLYARYRSEKLMEHIKLFSTRLNIPKLIRACDEQQHWKELTYLYIQYDEFDNAATTIMNHSPDAWDHMQFKDVCVKVANVELYYKAVHFYLQEHPDLINDMLNVLALRLDHTRVVDIMRKAGQLHLVKPYMVAVQSNNVSAVNEALNELYVEEEDYERLRESVDMHDNFDQIGLAQKLEKHELLEMRRIAAYIYKKAGRWKQSIALSKKDNMYKDCMETCSQSGDRELSEDLLVYFIEQGKKECFASCLFICYDLIRPDVALELAWMNNMLDFAFPYLLQFIREYTSKVDDLVKDRIESQNEERVKEKEEKDLVAQQNMYAQLLPLALPAPPMPGMGGPPPPMGGMGMPPMGGMGMPPMGPGPMPAFGMPAMGSY

SEQ ID NO: 9549 - protein, 1707 aa, Zea mays
MAAANAPIAMREALTLTSLGIAPQFVTFTHVTMESEKYICVRETSPQNSVVIIDMAMPMQPLRRPITADSALMNPDARILALKAQIPGTTQDHLQIFNIEAKTKIKSHQMPEQVVFWKWITPKLLGLVTQTSVYHWSIEGDSEPTKMFDRTANLANNQIINYRCDPAEKWLVLIGIAPGAPERPQLVKGNMQLFSVDQQRSQALEAHAASFATFKVVGNENPSTLICFASKTTNAGQITSKLHVIELGAQPGKPGFSKKQADLFFPPDFQDDFPVAMQVSQKYGLIYVITKLGLLFVYDLETAAAVYRNRISPDPIFLTAESSSTGGFYAINRRGQVLHATVNDATVVPFVSGQLNNLELAVNLAKRANLPGAENLVVQRFQELFAQTKYKEAAELAAESPQGLLRTPETVAKFQSVPVQAGQTPPLLQYFGTLLTRGKLNAFESLELSRLVVNQNKKNLLENWLAEDKLECSEELGDLVKTVDNDLALKIYIKARATPKVVAAFAERREFDKILIYSKQVGYTPDYLFLLQTILRTDPQGAVNFALMMSQMEGGCPVDYNTITDLFLQRNMIREATAFLLDVLKPNLPDHAFLQTKVLEINLVTYPNVADAILANGMFSHYDRPRIAQLCEKAGLYLRALQHYSELPDIKRVIVNTHAIEPQALVEFFGTLSREWALECMKDLLLVNLRGNLQIVVQAAKEYSEQLGVDACIKLFEQFKSYEGLYFFLGSYLSSSEDPDIHFKYIEAAARTGQIKEVERVTRESNFYDAEKTKNFLMEAKLPDARPLINVCDRFGFVPDLTHYLYTNNMLRYIEGYVQKVNPGNAPLVVGQLLDDECPEDFIKGLILSVRSLLPVEPLVDECEKRNRLRLLTQFLEHLVSEGSQDVHVHNALGKIIIDSNNNPEHFLTTNPFYDSRVVGKYCEKRDPTLAVVAYRRGQCDDELINVTNKNSLFKLQARYVVERMDGDLWDKVLQPENEYRRQLIDQVVSTALPESKSPEQVSAAVKAFMTADLPHELIELLEKIVLQNSAFSGNFNLQNLLILTAIKADPSRVMDYVNRLDNFDGPAVGEVAVEAQLYEEAFAIFKKFNLNVQAVDVLLDNIRSIDRAEEFAFRVEEDAVWSQVAKAQLREGLVSEAIESFIRADDAAHFLDVIRAAEEANVYNDLVKYLLMVRQKAREPKVDGELIFAYAKIDRLSDIEEFILMPNVANLQNVGDRLYDEELYEAAKIIYAFISNWAKLAVTLVKLKQYQGAVDAARKANSAKTWKEVCFACVDAEEFRLAQICGLNIIVQVDDLEEVSEYYQNRGCFSELIALMESGLGLERAHMGIFTELGVLYARYRSEKLMEHIKLFSTRLNIPKLIRACDEQQHWKELTYLYIQYDEFDNAATTIMNHSPDAWDHMQFKDVCVKVAIVELYYKAVHFYLQEHPDLINDMLNVLALRLDHTIVVDIMRKAGQLHLVKPYMVAVQSNNVSAVNEALNELYVEEEDYERLRESVDMHDNFDQIGLAQKLEKHELLEMRRIAAYIYKKAGRWKQSIALSKKDNMYKDCMETCSQSGDRELSEDLLVYFIEQGKKECFASCLFICYDLIRPDVALELAWMNNMVDFAFPYLLQFIREYTSKVDDLVKDKIESQKEERAKEKEEKDLVAQQNMYAQLLPLALPAPPMPGMGGPPPPMGGMGMPPMGGMGMPPMGPGPMPAFGMGGY

SEQ ID NO: 9550 - protein, 1702 aa, Zea mays
MAAANAPIAMREALTLTSLGIAPQFVTFTHVTMESEKYICVRETSPQNSVVIIDMAMPMQPLRRPITADSALMNPNARILALKAQIPGTTQDHLQIFNIEAKTKIKSHQMPEQVVFWKWITPKLLGLVTQTSVYHWSIEGDSEPTKMFDRTANLANNQIINYRCDPAEKWLVLIGIAPGAPERPQLVKGNMQLFSVDQQRSQALEAHAASFATFKVVGNENPSTLICFASKTTNAGQITSKLHVIELGAQPGKPGFSKKQADLFFPPDFQDDFPVAMQVSQKYGLIYVITKLGLLFVYDLETAAAVYRNRISPDPIFLTAESSSTGGFYAINRRGQVLHATVNDATVVPFVSGQLNNLELAVNLAKRANLPGAENLVVQRFQELFAQTKYKEAAELAAESPQGLLRTPETVAKFQSVPVQAGQTPPLLQYFGTLLTRGKLNAFESLELSRLVVNQNKKNLLENWLAEDKLECSEELGDLVKTVDNDLALKIYIKARATPKVVAAFAERREFDKILIYSKQVGYTPDYLFLLQTILRTDPQGAVNFALMMSQMEGGCPVDYNTITDLFLQRNMIREATAFLLDVLKPNLPEHAFLQTKVLEINLVTYPNVADAILANGMFSHYDRPRIAQLCEKAGLYLRALQHYSELPDIKRAIVNTHAIEPQALVEFFGTLSREWALECMKDLLLVNLRGNLQIVVQAAKEYCEQLGVDACIKLFEQFKSYEGLYFFLGSYLSSSEDPDIHFKYIEAAARTGQIKEVERVTRESNFYDAEKTKNFLMEAKLPDARPLINVCDRFGFVPDLTHYLYTNNMLRYIEGYVQKVNPGNAPLVVGQLLDDECPEDFIKGLILSVRSLLPVEPLVDECEKRNRLRLLTQFLEHLVSEGSQDVHVHNALGKIIIDSNNNPEHFLTTNPFYDSRVVGKYCEKRDPTLAVVAYRRGQCDDELINVTNKNSLFKLQARYVVERMDGDLWDKVLQPENEYRRQLIDQVVSTALPESKSPEQVSAAVKAFMTADLPHELIELLEKIVLQNSAFSGNFNLQNLLILTAIKADPSRVMDYVNRLDNFDGPAVGEVAVEAQLYEEAFAIFKKFNLNVQAVDVLLDNIRSIERAEEFAFRVEEDAVWSQVAKAQLREGLVSEAIESFIRADDAAHFLDVIRAAEEANVYNDLVKYLLMVRQKAREPKVDGELIFAYAKIDRLSDIEEFILMPNVANLQNVGDRLFEEELYEAAKIIYAFISNWAKLAVTLVKLKQFQGAVDAARKANSAKTWKEVCFACVDAEEFRLAQICGLNIIVQVDDLEEVSEYYQNRGCFSELIALMESGLGLERAHMGIFTELGVLYARYRSEKLMEHIKLFSTRLNIPKLIRACDEQQHWKELTYLYIQYDEFDNAATTIMNHSPDAWDHMQFKDVCVKVANVELYYKAVHFYLQEHPDLINDMLNVLALRLDHTRVVDIMRKAGQLHLVKPYMVAVQSNNVSAVNEALNELYVEEEDYERLRESVDMHDNFDQIGLAQKLEKHELLEMRRIAAYIYKKAGRWKQSIALSKKDNMYKDCMETCSQSGDRELSEDLLVYFIEQGKKECFASCLFICYDLIRPDVALELAWMNNMMDFAFPYLLQFIREYTSKVDDLVKDKIESQKEERAKEKEEKDLVAQQNMYAQLLPLALPAPPMPGMGGPPPPMGGMGMPPMGMPPMPAFGMPPMGSY

SEQ ID NO: 9551 - protein, 1701 aa, Pennisetum glaucum
MREALTLTSLGIAPQFVTFTHVTMESEKYICVRETSPQNSVVIIDMAMPMQPLRRPITADSALMNPNTRILALKAQIPGTTQDHLQIFNIEAKTKIKSHQMPEQVVFWKWIAPKLLGLVTQTSVYHWSIEGDSEPTKMFDRTANLANNQIINYRCDPAEKWLVLIGIAPGAPERPQLVKGNMQLFSVDQQRSQALEAHAASFATFKVVGNENPSTLICFASKTTNAGQITSKLHVIELGAQPGKPGFSKKQADLFFPPDFQDDFPVAMQVSQKYGLIYVITKLGLLFVYDLETASAVYRNRISPDPIFLTAESSSTGGFYAINRRGQVLHATVNDATVVPFVSGQLNNLELAVNLAKRANLPGAENLVVQRFQELFAQTKYKEAAELAAESPQGLLRTPETVAKFQSVPVQAGQTPPLLQYFGTLLTRGKLNAFESLELSRLVVNQNKKNLLENWLAEDKLECSEELGDLVKTVDNDMALKIYIKARATPKVVAAFAERREFDKILIYSKQVGYTPDYLFLLQTILRTDPQGAVNFALMMSQMEGGCPVDYNTITDLFLQRNMIREATAFLLDVLKPNLPEHAFLQTKVLEINLVTYPNVADAILANGMFSHYDRPRIAQLCEKAGLYLRALQHYSELPDIKRVIVNTHAIEPQALVEFFGTLSREWALECMKDLLVVNLRGNLQIVVQAAKEYSEQLGVDACIKLFEQFKSYEGLYFFLGSYLSSSEDPDIHFKYIEAAARTGQIKEVERVTRESNFYDAEKTKNFLMEAKLPDARPLINVCDRFGFVPDLTHYLYTNNMLRYIEGYVQKVNPGNAPLVVGQLLDDECPEDFIKGLILSVRSLLPVEPLVDECEKRNRLRLLTQFLEHLVSEGSQDVHVHNALGKIIIDSNNNPEHFLTTNPFYDSRVVGKYCEKRDPTLAVVAYRRGQCDEELINVTNKNSLFKLQARYVVERMDGDLWDKVLQPENEYRRQLIDQVVSTALPESKSPEQVSAAVKAFMTADLPHELIELLEKIVLQNSAFSGNFNLQNLLILTAIKADPSRVMDYVNRLDNFDGPAVGEVAVEAQLYEEAFAIFKKFNLNVQAVDVLLDNIRSIERAEEFAFRVEEDAVWSQVAKAQLREGLVSEAIESFIRADDATHFLDVIHAAEEANVYNDLVKYLLMVRQKAREPKVDGELIFAYAKIDRLSDIEEFILMPNVANLQNVGDRLYDEELYEAAKIIYAFISNWAKLAVTLVKLKQFQGAVDAARKANSAKTWKEVCFACVDAEEFRLAQICGLNIIVQVDDLEEVSEYYQNRGCFNELIALMESGLGLERAHMGIFTELGVLYARYRHEKLMEHIKLFSTRLNIPKLIRACDEQQHWKELTYLYIQYDEFDNAATTIMNHSPDAWDHMQFKDVCVKVANVELYYKAVHFYLQEHPDLINDMLNVLALRLDHTRVVDIMRKAGQLHLVKPYMVAVQSNNVSAVNEALNELYVEEEDYERLRESVDMHDNFDQIGLAQKLEKHELLEMRRIAAYIYKKAGRWKQSIALSKKDNMYKDCMETCSQSGDRELSEDLLVYFIEQGKKECFASCLFICYDLIRPDVALELAWMNNMIDFAFPYLLQFIREYTSKVDDLVKDKIESQNEERAKEKEEKDLVAQQNMYAQLLPLALPAPPMPGMGGPPPPMGGMGMPPMGGMGMPPMGPGPMPAFGMPPMGSY

SEQ ID NO: 9552 - protein, 1708 aa, Oryza sativa
MAAANAPIAMREALTLTSLGIAPQFVTFTHVTMESEKYICVRETSPQNSVVIVDMAMPAQPLRRPITADSALMNPNTRILALKAQIPGTTQDHLQIFNIEAKTKIKSHQMPEQVVFWKWITPKLLGLVTQTSVYHWSIEGDSEPAKMFDRTANLANNQIINYRCDPSEKWLVLIGIAPGAPERPQLVKGNMQLFSVDQQRSQALEAHAASFASFKVVGNENPSTLICFASKTTNAGQITSKLHVIELGAQPGKPGFSKKQADLFFPPDFQDDFPVAMQISQKYGLIYVITKLGLLFVYDLETAAAVYRNRISPDPIFLTAESSASGGFYAINRRGQVLHATVNDATIVPFVSSQLNNLELAVNLAKRANLPGAENLVVQRFQELFAQTKYKEAAELAAESPQGLLRTPETVAKFQSVPVQAGQTPPLLQYFGTLLTRGKLNAYESLELSRLVVNQNKKNLLENWLAEDKLECSEELGDLVKTVDNDLALKIYIKARATPKVVAAFAERREFDKILIYSKQVGYTPDYLFLLQTILRTDPQGAVNFALMMSQMEGGCPVDYNTITDLFLQRNMIREATAFLLDVLKPNLPEHAFLQTKVLEINLVTYPNVADAILANGMFSHYDRPRVAQLCEKAGLYLRALQHYTELPDIKRVMVNTHAIEPQALVEFFGTLSREWALECMKDLLLVNLRGNLQIVVQAAKEYSEQLGVDACIKLFEQFKSYEGLYFFLGAYLSSSEDPDIHFKYIEAAARTGQIKEVERVTRESNFYDAEKTKNFLMEAKLPDARPLINVCDRFGFVPDLTHYLYTNNMLRYIEGYVQKVNPGNAPLVVGQLLDDECPEDFIKGLILSVRSLLPVEPLVDECEKRNRLRLLTQFLEHLVSEGSQDVHVHNALGKIIIDSNNNPEHFLTTNPFYDSRVVGKYCEKRDPTLAVVAYRRGQCDDELINVTNKNSLFKLQARYVVERMDGDLWDKVLQPENEYRRQLIDQVVSTALPESKSPEQVSAAVKAFMTADLPHELIELLEKIVLQNSAFSGNFNLQNLLILTAIKADPSRVMDYVNRLDNFDGPAVGEVAVEAQLFEEAFAIFKKFNLNVQAVNVLLDNIRSIERAEEFAFRVEEDAVWSQVAKAQLREGLVSEAIESFIRADDATHFLDVIRAAEEANVYDDLVKYLLMVRQKAREPKVDGELIFAYAKIDRLSDIEEFILMPNVANLQNVGDRLYDEELYEAAKIIYAFISNWAKLAVTLVKLKQFQGAVDAARKANSAKTWKEVCFACVDAEEFRLAQICGLNIIVQVDDLEEVSEYYQNRGCFNELISLMESGLGLERAHMGIFTELGVLYARYRPEKLMEHIKLFSTRLNIPKLIRACDEQQHWKELTYLYIQYDEFDNAATTIMNHSPDAWDHMQFKDVAVKVANVELYYKAVHFYLQEHPDLINDLLNVLALRLDHTRVVDIMRKAGQLHLVKPYMVAVQSNNVSAVNEALNELYVEEEDYERLRESVDMHDNFDQIGLAQKLEKHELLEMRRIAAYIYKKAGRWKQSIALSKKDNMYKDCMETCSQSGDRELSEDLLVYFIEQGKKECFASCLFICYDLIRADVALELAWMNNMVDFAFPYLLQFIREYTSKVDELVKDRIESQNEVRAKEKEEKDLVAQQNMYAQLLPLALPAPPGMGGPPPPMGMPGMPPMGGMGMPPMGPGPMPAYGMPPMGSY

SEQ ID NO: 9553 - protein, 1708 aa, Oryza sativa
MAAANAPIAMREALTLTSLGIAPQFVTFTHVTMESEKYICVRETSPQNSVVIVDMAMPAQPLRRPITADSALMNPNTRILALKAQIPGTTQDHLQIFNIEAKTKIKSHQMPEQVVFWKWITPKLLGLVTQTSVYHWSIEGDSEPAKMFDRTANLANNQIINYRCDPSEKWLVLIGIAPGAPERPQLVKGNMQLFSVDQQRSQALEAHAASFASFKVVGNENPSTLICFASKTTNAGQITSKLHVIELGAQPGKPGFSKKQADLFFPPDFQDDFPVAMQISQKYGLIYVITKLGLLFVYDLETAAAVYRNRISPDPIFLTAESSASGGFYAINRRGQVLHATVNDATIVPFVSSQLNNLELAVNLAKRANLPGAENLVVQRFQELFAQTKYKEAAELAAESPQGLLRTPDTVAKFQSVPVQAGQTPPLLQYFGTLLTRGKLNAYESLELSRLVVNQNKKNLLENWLAEDKLECSEELGDLVKTVDNDLALKIYIKARATPKVVAAFAERREFDKILIYSKQVGYTPDYLFLLQTILRTDPQGAVNFALMMSQMEGGCPVDYNTITDLFLQRNMIREATAFLLDVLKPNLPEHAFLQTKVLEINLVTYPNVADAILANGMFSHYDRPRVAQLCEKAGLYLRALQHYTELPDIKRVMVNTHAIEPQALVEFFGTLSREWALECMKDLLLVNLRGNLQIVVQAAKEYSEQLGVDACIKLFEQFKSYEGLYFFLGAYLSSSEDPDIHFKYIEAAARTGQIKEVERVTRESNFYDAEKTKNFLMEAKLPDARPLINVCDRFGFVPDLTHYLYTNNMLRYIEGYVQKVNPGNAPLVVGQLLDDECPEDFIKGLILSVRSLLPVEPLVDECEKRNRLRLLTQFLEHLVSEGSQDVHVHNALGKIIIDSNNNPEHFLTTNPFYDSRVVGKYCEKRDPTLAVVAYRRGQCDDELINVTNKNSLFKLQARYVVERMDGDLWDKVLQPENEYRRQLIDQVVSTALPESKSPEQVSAAVKAFMTADLPHELIELLEKIVLQNSAFSGNFNLQNLLILTAIKADPSRVMDYVNRLDNFDGPAVGEVAVEAQLFEEAFAIFKKFNLNVQAVNVLLDNIRSIERAEEFAFRVEEDAVWSQVAKAQLREGLVSEAIESFIRADDATHFLDVIRAAEEANVYDDLVKYLLMVRQKAREPKVDGELIFAYAKIDRLSDIEEFILMPNVANLQNVGDRLYDEELYEAAKIIYAFISNWAKLAVTLVKLKQFQGAVDAARKANSAKTWKEVCFACVDAEEFRLAQICGLNIIVQVDDLEEVSEYYQNRGCFNELISLMESGLGLERAHMGIFTELGVLYARYRPEKLMEHIKLFSTRLNIPKLIRACDEQQHWKELTYLYIQYDEFDNAATTIMNHSPDAWDHMQFKDVAVKVANVELYYKAVHFYLQEHPDLINDLLNVLALRLDHTRVVDIMRKAGQLHLVKPYMVAVQSNNVSAVNESLNELYVEEEDYERLRESVDMHDNFDQIGLAQKLEKHELLEMRRIAAYIYKKAGRWKQSIALSKKDNMYKDCMETCSQSGDRELSEDLLVYFIEQGKKECFASCLFICYDLIRADVALELAWMNNMVDFAFPYLLQFIREYTSKVDELVKDRIESQNEVRAKEKEEKDLVAQQNMYAQLLPLALPAPPGMGGPPPPMGMPGMPPMGGMGMPPMGPGPMPAYGMPPMGSY

SEQ ID NO: 9554 - protein, 1710 aa, Brachypodium distachyon
MAAANAPIAMREALTLTSLGIAPQFVTFTHVTMESDRYICVRETSPQNSVVIVDMAMPSQPLRRPITADSALMNPNTRILALKAQIAGTTQDHLQIFNIEAKTKVKSHQMPEQVVFWKWITPKLLGLVTQTSVYHWSIEGDSEPTKMFDRTANLANNQIINYRCDPAEKWLVLIGIAPGAPERPQLVKGNMQLFSVDQQRSQALEAHAASFATFKVAGNENPSTLICFASKSSNAGQITSKLHIIELGAQPGKPGFSKKQADLFFPPDFQDDFPVAMQISQKYGLVYVITKLGLLFVYDLETAAAVYRNRISPDPIFLTAESSTTGGFYAINRRGQVLHATVNDATVVPFVSGQLNNLELAVNLAKRANLPGAENLVVQRFQELFAQTKYKEAAELAAESPQGILRTPETVAKFQSVPVQAGQTPPLLQYFGTLLTKGKLNAYESLELSRLVVNQNKKNLLENWLAEDKLECSEELGDLVKTVDNDLALKIYIKARATPKVVAAFAERREFDKILIYSKQVGYTPDYLFLLQTILRTDPQGAVNFALMMSQMEGGCPLDYNTITDLFLQRNMIREATAFLLDVLKPNLPEHAFLQTKVLEINLVTYPNVADAILANGMFSHYDRPRIAQLCEKAGLYLRALQHYAELPDIKRVIVNTHAIEPQALVEFFGTLSKEWALECMKDLLLVNLRGNLQIVVQAAKEYSEQLGVDACIKLFEQFKSYEGLYFFLGSYLSSSEDPDIHFKYIESAARTGQIKEVERVTRESNFYDAEKTKNFLMEAKLPDARPLINVCDRFGFVPDLTHYLYTNNMLRYIEGYVQKVNPGNAPLVVGQLLDDECPEDFIKGLILSVRSLLPVEPLVDECEKRNRLRLLTQFLEHLVSEGSQDVHVHNALGKIIIDSNNNPEHFLTTNPFYDSRVVGKYCEKRDPTLAVVAYRRGQCDEELINVTNKNSLFKLQARYVVERMDGDLWDKVLQPENEYRRQFIDQVVSTALPESKSPEQVSAAVKAFMTADLPHELIELLEKIVLQNSAFSGNFNLQNLLILTAIKADSSRVMDYVNRLDNFDGPAVGEVAVEAQLYEEAFSIFKKFNLNVQAVNVLLDNIQSIERAEEFAFRVEEDAVWSQVAKAQLREGLVSEAIESFIRADDAAHFLDVIRAAEEANVYDDLVKYLLMVRQKSREPKVDGELIFAYAKTDRLSDIEEFILMPNVANLQNVGDRLYDEELYEAAKIIYAFISNWAKLAVTLVKLKQFQSAVDAARKANSAKTWKEVCFACVDAEEFRLAQICGLNIIVQVDDLEEVSEYYQNRGCFHELISLMESGLGLERAHMGIFTELGVLYARYRPEKLMEHIKLFSTRLNIPKLIRACDEQQHWKELTYLYIQYDEFDNAATTIMNHSPDAWDHMQFKDVCVKVANVEIYYKAVHFYLQEHPDLINDLLNVLALRLDHTRVVDIMRKAGQLHLVKPYMVAVQSNNVSAVNEALNELYVEEEDYERLRESVDMHDNFDQIGLAQKLEKHELLEMRRIASYIYKKAGRWKQSIALSKKDNMYKDCMETCSQSGDRELSEDLLVYFIEQGKKECFASCLFICYDLIRADVALELAWTNNMLDFAFPYLLQFIREYTSKVDDLVKDRIESQKEEKAKEQEEKEVVAQQNMYAQLLPLALPAPPGMGGMGMPPMGGMGMPPPMGGMGMPPMGPGPMPAYGMPPMGSY

SEQ ID NO: 9555 - protein, 1708 aa, Secale cereale
MAAANAPIAMREALTLTSLGIAPQFITFTHVTMESDRYICVRETSPQNSVVIIDMAMPSQPLRRPITADSALMNPNTRILALKAQIPGTTQDHLQIFNIEAKTKIKSHQMPEQVVFWKWITPKLLGLVTQASVYHWSIEGDSEPIKMFDRTANLANNQIINYRCDPAEKWLVLIGIAPGAPERPQLVKGNMQLFSVDQQRSQALEAHAASFATLKVPGNENPSTLICFASKASNAGTVTSKLHIIELGAQPGKPGFSKKQADLFFPPDFQDDFPVAMQISQKYGLVYVITKLGLLFVYDLETAAAVYRNRISPDPIFLTAESSTTGGFYAINRRGQVLHATVNDATVVPFVSGQLNNLELAVNLAKRANLPGAENLVVQRFQELFAQTKYKEAAELAAESPQGLLRTPETVAKFQSVPVQAGQTPPLLQYFGTLLTRGKLNAYESLELSRLVVNQNKKNLLENWLAEDKLECSEELGDLVKTVDNDLALKIYIKARATPKVVAAFAERREFDKILIYSKQVGYTPDYLFLLQTILRTDPQGAVNFALMMSQMEGGCPLDYNTITDLFLQRNMIREATAFLLDVLKPNLEEHAFLQTKVLEINLVTYPNVADAILANGMFSHYDRPRIAQLCEKAGLYLRALQHYAELPDIKRVIVNTHAIEPQALVEFFGTLSKEWALECMKDLLLVNLRGNLQIVVQAAKEYCEQLGVDACIKLFEQFKSYEGLYFFLGSYLSSSEDPDIHFKYIESAARTGQIKEVERVTRESNFYDAEKTKNFLMEAKLPDARPLINVCDRFGFVPDLTHYLYTNNMLRYIEGYVQKVNPGNAPLVVGQLLDDECPEDFIKGLILSVRSLLPVEPLVDECEKRNRLRLLTQFLEHLVSEGSQDVHVHNALGKIIIDSNNNPEHFLTTNPFYDSRVVGKYCEKRDPTLAVVAYRRGQCDEELINVTNKNSLFKLQARYVVERMDGDLWDKVLQPDNEYRRQFIDQVVSTALPESKSPEQVSAAVKAFMTADLPHELIELLEKIVLQNSAFSGNFNLQNLLILTAIKADSSRVMDYVNRLDNFDGPAVGEVAVEAQLYEEAFAIFKKFNLNVQAVDVLLDNIRSIERAEEFAFRVEEDAVWSQVAKAQLREGLISEAIESFIRADDVTHFLDVIRAAEEANVYHDLVKYLLMVRQKAREPKVDSELIFAYAKIDRLSDIEEFILMPNVANLQNVGDRLYDEELYEAAKIIYAFISNWAKLAVTLVKLKQFQSAVDAARKANSAKTWKEVCFACVDAEEFRLAQICGLNIIVQVDDLEEVSEYYQNRGCFSELISLMESGLGLERAHMGIFTELGVLYARYRPEKLMEHIKLFSTRLNIPKLIRACDEQQHWKELTYLYIQYDEFDNAATTIMNHSPDAWDHMQFKDVCVKVANVEIYYKAVHFYLQEHPDLINDLLNVLALRLDHTRVVDIMRKAGQLHLVKPYMVAVQSNNVSAVNEALNELYVEEEDYERLRESVDMHDNFDQIGLAQKLEKHELLEMRRIAAYIYKKAGRWKQSIALSKKDNMYKDCMETCSQSGDRELSEDLLVYFIEQGKKECFASCLFICYDLIRADVALELAWTNNMLDFAFPYLLQFIREYTSKVDDLVKDRIESQKEEKAKESEEKELVAQQNMYAQLLPLALPAPPGMMGGPPPMGGMGMPPMGGMGMPPMGPGPMPAYGMPPMGSY

SEQ ID NO: 9556 - protein, 1708 aa, Brachypodium distachyon
MAAAANAPIAMREALTLTSLGIAPQFVTFTHVTMESDRYICVRETSPQNSVVIVDMAMPSQPLRRPITADSALMNPNTRILALKAQIAGTTQDHLQIFNIEAKTKVKSHQMPEQVVFWKWITPKLLGLVTQASVYHWSIEGDSEPIKMFDRTANLANNQIINYRCDPAEKWLVLIGIAPGAPERPQLVKGNMQLFSVDQQRSQALEAHAASFATFKVPGNENPSTLICFASKSTNAGQITSKLHVIELGAQPGKPGFSKKQADLFFPPDFQDDFPVAMQISQKYGLIYVITKLGLLFVYDLETAAAVYRNRISPDPIFLTAESSTTGGFYAINRRGQVLHATVNDATVVPFVSGQLNNLELAVNLAKRANLPGAENLVVQRFQELFSQTKYKEAAELAAESPQGLLRTPETVAKFQSVPVQAGQTPPLLQYFGTLLTRGKLNAYESLELSRLVVNQNKKNLLENWLAEDKLECSEELGDLVKTVDNDLALKIYIKARATPKVVAAFAERREFDKILIYSKQVGYTPDYLFLLQTILRTDPQGAVNFALMMSQMEGGCPLDYNTITDLFLQRNMIREATAFLLDVLKPNLEEHGFLQTKVLEINLVTYPNVADAILANGMFSHYDRPRIAQLCEKAGLYLRALQHYAELPDIKRVIVNTHAIEPQALVEFFGTLSKEWALECMKDLLLVNLRGNLQIVVQAAKEYSEQLGVDACIKLFEQFKSYEGLYFFLGSYLSSSEDPDIHFKYIESAARTGQIKEVERVTRESNFYDAEKTKNFLMEAKLPDARPLINVCDRFGFVPDLTHYLYTNNMLRYIEGYVQKVNPGNAPLVVGQLLDDECPEDFIKGLILSVRSLLPVEPLVDECEKRNRLRLLTQFLEHLVSEGSQDVHVHNALGKIIIDSNNNPEHFLTTNPFYDSRVVGKYCEKRDPTLAVVAYRRGQCDEELINVTNKNSLFKLQARYVVERMDGDLWDKVLLPENEYRRQFIDQVVSTALPESKSPEQVSAAVKAFMEADLPHELIELLEKIVLQNSAFSGNFNLQNLLILTAIKADPSRVMDYVNRLDNFDGPAVGEVAVEAQLYEEAFAIFKKFNLNVQAVNVLLDNIRSIERAEEFAFRVEEDAVWSQVAKAQLREGLVSEAIESFIRADDAAHFLDVIRAAEEADVYHDLVKYLLMVRQKAREPKVDGELIFAYAKIDRLSDIEEFILMPNVANLQNVGDRLYDEELYEAAKIIYAFISNWAKLAVTLVKLKQFQGAVDAARKANSAKTWKEVCFACVDAQEFRLAQICGLNIIVQVDDLEEVSEYYQNRGCFDELISLMESGLGLERAHMGIFTELGVLYARYRTGKLMEHIKLFSTRLNIPKLIRACDEQQHWKELTYLYIQYDEFDNAATTIMNHSPDAWDHMQFKDVAVKVANVEIYYKAVHFYLQEHPDLINDLLNVLALRLDHTRVVDIMRKAGQLHLVKPYMVAVQSNNVSAVNEALNELYVEEEDYERLRESVDMHDNFDQIGLAQKLEKHELLEMRRIAAYIYKKAGRWKQSIALSKKDNMYKDCMETCSQSGDRELSEDLLVYFIEQGKKECFASCLFICYDLIRADVALELAWTNNMLDFAFPYLLQFIREYTSKVDDLVKDRIESQKEEKAKEQEEKDVVAQQNMYAQLLPLALPAPPGMGGPPPMGMPPMGGMGMPPMGGMGMPPMPAYGMPPMGSY

SEQ ID NO: 9557 - protein, 1700 aa, Hordeum vulgare
MREALTLTSLGIAPQFITFTHVTMESDRYICVRETSPQNSVVIIDMAMPSQPLRRPITADSALMNPNTRILALKAQIPGTTQDHLQIFNIEAKTKIKSHQMPEQVVFWKWITPKLLGLVTQASVYHWSIEGDSEPTKMFDRTANLANNQIINYRCDPAEKWLVLIGIAPGAPERPQLVKGNMQLFSVDQQRSQALEAHAASFATFKVPGNENPSTLICFASKASNAGTLTSKLHIIELGAQPGKPGFSKKQADLFFPPDFQDDFPVAMQISQKYGLVYVITKLGLLFVYDLETAAAVYRNRISPDPIFLTAESSTTGGFYAINRRGQVLHATVNDATVVPFVSGQLNNLELAVNLAKRANLPGAENLVVQRFQELFAQTKYKEAAELAAESPQGLLRTPETVAKFQSVPVQAGQTPPLLQYFGTLLTRGKLNAYESLELSRLVVNQNKKNLLENWLAEDKLECSEELGDLVKTVDNDLALKIYIKARATPKVVAAFAERREFDKILIYSKQVGYTPDYLFLLQTILRTDPQGAVNFALMMSQMEGGCPLDYNTITDLFLQRNMIREATAFLLDVLKPNLEEHAFLQTKVLEINLVTYPNVADAILANGMFSHYDRPRIAQLCEKAGLYLRALQHYAELPDIKRVIVNTHAIEPQALVEFFGTLSKEWALECMKDLLLVNLRGNLQIVVQAAKEYCEQLGVDACIKLFEQFKSYEGLYFFLGSYLSSSEDPDIHFKYIESAARTGQIKEVERVTRESNFYDAEKTKNFLMEAKLPDARPLINVCDRFGFVPDLTHYLYTNNMLRYIEGYVQKVNPGNAPLVVGQLLDDECPEDFIKGLILSVRSLLPVEPLVDECEKRNRLRLLTQFLEHLVSEGTQDVHVHNALGKIIIDSNNNPEHFLTTNPFYDSRVVGKYCEKRDPTLAVVAYRRGQCDEELINVTNKNSLFKLQARYVVERMDGDLWDKVLQPDNEYRRQFIDQVVSTALPESKSPEQVSAAVKAFMTADLPHELIELLEKIVLQNSAFSGNFNLQNLLILTAIKADSSRVMDYVNRLDNFDGPAVGEVAVEAQLYEEAFAIFKKFNLNVQAVDVLLDNIRSIERAEEFAFRVEEDAVWSQVAKAQLREGLVSEAIESFIRADDVTHFLDVIRAAEEANVYHDLVKYLLMVRQKAREPKVDSELIFAYAKIDRLNDIEEFILMPNVANLQNVGDRLYDEELYEAAKIIYAFISNWAKLAVTLVKLKQFQGAVDAARKANSAKTWKEVCFACVDAEEFRLAQICGLNIIVQVDDLEEVSEYYQNRGCFSELISLMESGLGLERAHMGIFTELGVLYARYRPEKLMEHIKLFSTRLNIPKLIRACDEQLHWKELTYLYIQYDEFDNAATTIMNHSPDAWDHMQFKDVCVKVANVEIYYKAVHFYLQEHPDLINDLLNVLALRLDHTRVVDIMRKAGQLHLVKPYMVAVQSNNVSAVNEALNELYVEEEDYERLRESVDMHDNFDQIGLAQKLEKHELLEMRRIAAYIYKKAGRWKQSIALSKKDNMYKDCMETCSQSGDRELSEDLLVYFIEQGKKECFASCLFICYDLIRADVALELAWTNNMLDFAFPYLLQFIREYTSKVDDLVKDRIESQKEEKAKDNEEKELVAQQNMYAQLLPLALPAPPGMMGGPPPPMGGMGMPPMGGMGMPPMGPGPMPAYGMPPMGSY

SEQ ID NO: 9558 - protein, 1661 aa, Secale cereale
NSVVIIDMAMPSQPLRRPITADSALMNPNTRILALKAQIPGTTQDHLQIFNIEAKIKIKSHQMPEQVVFWKWITPKLLGLVTQASVYHWSIEGDSEPIKMFDRTANLANNQIINYRCDPAEKWLVLIGIAPGAPERPQLVKGNMQLFSVDQQRSQALEAHAASFATLKVPGNENPSTLICFASKASNAGTVTSKLHIIELGAQPGKPGFSKKQADLFFPPDFQDDFPVAMQISQKYGLVYVITKLGLLFVYDLETAAAVYRNRISPDPIFLTAESSTTGGFYAINRRGQVLHATVNDATVVPFVSGQLNNLELAVNLAKRANLPGAENLVVQRFQELFAQTKYKEAAELAAESPQGLLRTPETVAKFQSVPVQAGQTPPLLQYFGTLLTRGKLNAYESLELSRLVVNQNKKNLLENWLAEDKLECSEELGDLVKTVDNDLALKIYIKARATPKVVAAFAERREFDKILIYSKQVGYTPDYLFLLQTILRTDPQGAVNFALMMSQMEGGCPLDYNTITDLFLQRNMIREATAFLLDVLKPNLEEHAFLQTKVLEINLVTYPNVADAILANGMFSHYDRPRIAQLCEKAGLYLRALQHYAELPDIKRVIVNTHAIEPQALVEFFGTLSKEWALECMKDLLLVNLRGNLQIVVQAAKEYCEQLGVDACIKLFEQFKSYEGLYFFLGSYLSSSEDPDIHFKYIESAARTGQIKEVERVTRESNFYDAEKTKNFLMEAKLPDARPLINVCDRFGFVPDLTHYLYTNNMLRYIEGYVQKVNPGNAPLVVGQLLDDECPEDFIKGLILSVRSLLPVEPLVDECEKRNRLRLLTQFLEHLVSEGSQDVHVHNALGKIIIDSNNNPEHFLTTNPFYDSRVVGKYCEKRDPTLAVVAYRRGQCDEELINVTNKNSLFKLQARYVVERMDGDLWDKVLQPDNEYRRQFIDQVVSTALPESKSPEQVSAAVKAFMTADLPHELIELLEKIVLQNSAFSGNFNLQNLLILTAIKADSSRVMDYVNRLDNFDGPAVGEVAVEAQLYEEAFAIFKKFNLNVQAVDVLLDNIRSIERAEEFAFRVEEDAVWSQVAKAQLREGLISEAIESFIRADDVTHFLDVIRAAEEANVYHDLVKYLLMVRQKAREPKVDSELIFAYAKIDRLSDIEEFILMPNVANLQNVGDRLYDEELYEAAKIIYAFISNWAKLAVTLVKLKQFQSAVDAARKANSAKTWKEVCFACVDAEEFRLAQICGLNIIVQVDDLEEVSEYYQNRGCFSELISLMESGLGLERAHMGIFTELGVLYARYRPEKLMEHIKLFSTRLNIPKLIRACDEQQHWKELTYLYIQYDEFDNAATTIMNHSPDAWDHMQFKDVCVKVANVEIYYKAVHFYLQEHPDLINDLLNVLALRLDHTRVVDIMRKAGQLHLVKPYMVAVQSNNVSAVNEALNELYVEEEDYERLRESVDMHDNFDQIGLAQKLEKHELLEMRRIAAYIYKKAGRWKQSIALSKKDNMYKDCMETCSQSGDRELSEDLLVYFIEQGKKECFASCLFICYDLIRADVALELAWTNNMLDFAFPYLLQFIREYTSKVDELVKDRIESQKEEKAKESEEKELVAQQNMYAQLLPLALPAPPGMMGGPPPMGGMGMPPMGGMGMPPMGPGPMPAYGMPPMGSY

SEQ ID NO: 9559 - protein, 460 aa, Elaeis guineensis
MAAANAPISMREALTLPTIGINPQFITFTHVTMESEKYICVRETSPQNSVVIIDMNMPMQPLRRPITADSALMNPNSRILALKAQIPGTTQDHLQVFNIEMKTKMKSHQMPEQVVFWKWITPKMLGLVTQTSVYHWSIEGDSEPVKMFDRTANLTNNQIINYRCDPMEKWLVLIGIAPGAPERPQLVKGSMQLFSVDQQRSQALEAHAASFASFKVAGNENPSILICFATKTSNAGQITSKLHVIELGAQPGKPGFSKKQADLFFPPDFADDFPVAMQISQKYSLIYVITKLGLLFVYDLETATAVYRNRISPDPIFLTAEASSIGGFYAVNRRGQVLLATVNEATIVPFVSGQLNNLELAVNLAKRGNLPGAENLVVQRFQELFSQTKYKEAAELAAESPQGILRTPETVAKFQSVPVQSGQTPPLLQYFGTLLTRGKLNAFESLELSRLVVNQNKKIY

SEQ ID NO: 9560 - protein, 1719 aa, Musa acuminata
MAAANAPIVMREALTLPSIGINPQFITFTHVTMESDKYICVRETSPQNSVVIVDMNMPMQPLRRPITADSALMNPNSRILALKAQIPGTTQDHLQIFNIEAKTKIKSHQMPEQVVFWKWITPKMLGLVTQTSVYHWSIEGETEPIKMFDRAANLTNNQIINYKCDPTEKWLVLIGIAPGAPERPQLVKGNMQLFSLDQQRSQALEAHAASFASFKVVGNEKPSLLICFSSKTLNAGQITSKLHVIELGAQPGKPGFTKKQADLFFPPDFADDFPVAMQISQKYSLVYVITKLGLLFVYDLETATAVYRNRISADPIFLTTEASNVGGFYAINRKGQVLLATVNEAAIVPFVSGQLNNLELAINLAKRGNLPGAENLVVQRFQELFSQTKYKEAAELAAESPQGILRTPETVAKFQSVPVQAGQTPPLLQYFGTLLTRGKLNGFESLELSRLVVNQNKKNLLENWLAEDKLECSEELGDLVKTVDNDLALKIYIKARATPKVVAAFAERREFDKILIYSKQVGYTPDYLFLLQTILRSDPQGAVNFALMMSQMEGGCPVDYNTITDLFLQRNMIREATAFLLDVLKPNLPEHAFLQTKVLEINLVTYPNVADAILANGMFSHYDRPRIAQLCEKAGLYVRALQHYTELPDIKRVIVNTHAIEPQALVEFFGTLSREWALECMKDLLLVNLRGNLQIIVQTAKEYSDQLGVDACIKLFEQFKSYEGLYFFLGSYLSSSEDPDIHFKYIEAAAKTGQLKEVERVTRESNFYDPEKTKNFLMEAKLPDARPLINVCDRFGFVPDLTHYLYTNNMLRYIEGYVQKVNPGNAPLVVGQLLDDECPEDFIKGLILSVRSLLPVEPLVAECEKRNRLRLLTQFLEHLVSEGSQDVHVHNALGKIIIDSNNNPEHFLTTNPYYDSRVVGKYCEKRDPTLAVVAYRRGQCDDELINVTNKNSLFKLQARYVVERMDADLWEKVLQPENEYRRQLIDQVVSTALPESKSPEQVSAAVKAFMTADLPHELIELLEKIVLQNSAFSGNFNLQNLLILTAIKADPPRVMDYINRLDNFDGPAVGEVAVEAQLYEEAFAIFKKFNLNVQAVNVLLDNIQSIERAVEFAFRVEEDAVWSQVAKAQLRAGLVSDAIESFIRADDETQFLDVIRAAEDANVYHDLVKYLLMVRQKTKEPKVDGELIFAYAKIDRLGEIEEFILMPNVANLQNVGDRLFDDALYEAAKIIFAFISNWAKLACTLVKLKQFQGAVDAARKANSTKTWKEVCFACVDAEEFRLAQICGLNIIIQVDDLEEVSEYYQNRGCFNELISLMESGLGLERAHMGIFTELGVLYARYRPETLMEHIKLFSTRLNIPKLIRVCDEQQHWKELTYLYIQYDEFDNAATTIMNHSPDAWDHMQFKDVVVKVANVELYYKAVHFYLQEHPDLINDVLHVLALRVDHTRVVDIMRKAGHLHLVKPYMVAVQSNNVAAVNEALNEIYVEEEDYDRLRESVDLHDNFDQIGLAQRIEKHELLEMRRIAAYIYKKAGRWKQSIALSKKDNLYKDAMETCSQSGDRELSEELLVYFIEQGKKECFASCLFICYDLIRPDVALELAWMNNMIDFAFPYLLQFIREYASKVDELVKDKIEAQNEVKSKEKVEKDLVAQQNMYAQLLPLALPAPPMPSMGGSNMGGPYGAPPPMPGMGMPPPMPGMGMPGMGMPPMPPFGMPPMENY

SEQ ID NO: 9561 - protein, 1705 aa, Theobroma cacao
MAAANAPIAMKEVLTLPSIGINPQFITFTNVTMESDKYICVRETAPQNSVVIIDMNMPMQPLRRPITADSALMNPNSRILALKAQLPGTTQDHLQIFNIEMKAKMKSHQMPEQVVFWKWISPKMLGLVTQTTVYHWSIEGDSEPTKMFERTANLVNNQIINYKCDPSEKWLVLIGIAPGAPERPQLVKGNMQLFSVDQQRSQALEAHAASFAQFKVPGNENPSTLISFATKTFNAGQITSKLHVIELGAQPGKPSFSKKQADLFFPPDFQDDFPVAMQISHKYSLIYVITKLGLLFVYDLETATAVYRNRISPDPIFLTSEASSVGGFYSINRRGQVLLATVNDATIVPFVSGQLNNLELAVNLAKRGNLPGAENLVVQRFQELFAQTKYKEAAELAAESPQGILRTPDTVAKFQSVPVQAGQTPPLLQYFGTLLTRGKLNAFESLELSRLVVNQNKKNLLENWLAEDKLECSEELGDLVKTVDNDLALKIYIKARATPKVVAAFAERREFDKILIYSKQVGYTPDYLFLLQTILRTDPQGAVNFALMMSQMEGGSPVDYNTITDLFLQRNLIREATAFLLDVLKPNLPEHAFLQTKVLEINLVTFPNVADAILANGMFSHYDRPRIAQLCEKAGLYVRALQHYTELPDVKRVIVNTHAIEPQALVEFFGTLSREWALECMKDLLLVNLRANLQIIVQVAKEYCEQLGVDACIKLFEQFKSYEGLYFFLGSYLSSSEDPDIHFKYIEAAAKTGQIKEVERVTRESNFYDAEKTKNFLMEAKLPDARPLINVCDRFGFVPDLTHYLYTNNMLRYIEGYVQKVNPGNAPLVVGQLLDDECPEDFIKGLILSVRSLLPVEPLVEECEKRNRLRLLTQFLEHLVSEGSQDVHVHNALGKIIIDSNNNPEHFLTTNPYYDSRVVGKYCEKRDPTLAVVAYRRGQCDDELINVTNKNSLFKLQARYVVERMDADLWEKVLNPENEYRRQLIDQVVSTALPESKSPEQVSAAVKAFMTADLPHELIELLEKIVLQNSAFSGNFNLQNLLILTAIKADPSRVMDYINRLDNFDGPAVGEVAVEAQLYEEAFAIFKKFNLNVQAVNVLLDNIRSIDRAVEFAFRVEEDAVWSQVAKAQLREGLVSDAIESFIRADDATQFLDVIQAAEDGDVYPDLVRYLLMVRQKVKEPKVDSELIYAYAKIDRLGEIEEFILMPNVANLQNVGDRLFDEDLYEAAKIIFAFISNWAKLAVTLVRLKQFQGAVDAARKANSAKTWKEVCFACVDAEEFRLAQICGLNIIVQVDDLEEVSEYYQNRGCFNELISLMESGLGLERAHMGIFTELGVLYARYRPEKLMEHIKLFSTRLNIPKLIRACDEQQHWKELTYLYIQYDEFDNAATTVMNHSPEAWDHMQFKDIAVKVANVELYYKAVHFYLQEHPDLINDMLNVLALRVDHTRVVDIMRKAGHLRLVKPYMVAVQSNNVSAVNEALNEIYVEEEDYDRLRESIDFHDNFDQIGLAQKIEKHELLEMRRVAAYIYKKAGRWKQSIALSKKDNLYKDAMETASQSGDRELAEELLVYFIEQGKKECFASCLFVCYDLIRPDVTLELAWMNNMIDFAFPYLLQFIREYTGKVDELIKYKIEAQIEEKAKEQEEKEVIAQQNMYAQLLPLALPAPPMPGMGGSTMGGVGMPPPPMGGMGMPPMPPFGMPPMGSY

SEQ ID NO: 9562 - protein, 1705 aa, Musa acuminata
MAAASAPIVMREALTLPSIGINPQFITFTHVTMESDKYVCVRETSPQNSVVIVDMNMPMQPLRRPITADSALMNPNSRILALKAQIPGTTQDHLQVFNIEAKTKIKSHQMPEQVVFWKWITPKMLGLATQTSVYHWSIEGEAEPLKMFDRAANLTNNQIINYRCDPTEKWLVLIGIAPGAPERPQLVKGNMQLFSVDQQRSQALEAHASSFASFKVAGNENPSVLICFASKTMNAGQTTSKLHVIELGAQPGKPGFTKKQADLFFPPDFADDFPVSMQISQKYSLIYVITKLGLLFVYDLETATAVYRNRISPDPIFLTTEAPNVGGFYAINRKGQVLLATVNEATLVPFVSGQLNNLELAVNLAKRGNLPGAENLVVQRFQELFSQTKYKEAAELAAESPQGILRTPETVAKFQSVPVQAGQTPPLLQYFGTLLTKGKLNAFESLELSRLVVNQNKKNLLENWLAEDKLECSEELGDLVKTVDNDLALKIYIKARATPKVVAAFAERREFDKILIYSKQVGYTPDYLFLLQTILRSDPQGAVNFALMMSQMDGGCPVDYNTITDLFLQRNMIREATAFLLDVLKPNLPEHAFLQTKVLEINLVTYPNVADAILANGMFSHYDRPRIAQLCEKAGLYVRALQHYSELPDIKRVIVNTHAIEPQALVEFFGTLSREWALECMKDLLLVNLRGNLQIIVQTAKEYSEQLGVDACIKLFEQFKSYEGLYFFLGFYLSSSEDPDIHFKYIEAAAKTGQLKEVERVTRESNFYDPEKTKNFLMEAKLPDARPLINVCDRFGFVPDLTHYLYTNNMLRYIEGYVQKVNPGNAPLVVGQLLDDECPEDFIKGLILSVRSLLPVEPLVAECEKRNRLRLLTQFLEHLVSEGSQDVHVHNALGMIIIDSNNNPEHFLTTNPYYDSRVVGKYCEKRDPTLAVVAYRRGQCDDELINVTNKNSLFKLQARYVVERMDADLWEKVLHPENEYRRQLIDQVVSTALPESKSPEQVSAAVKAFMTADLPHELIELLEKIVLQNSAFSGNFNLQNLLILTAIKADPPRVMDYINRLDNFDGPAVGEVAVEAQLYEEAFAIFKKFNLNVQAVNVLLDNIQSVERAVEFAFRVEEDAVWSQVAKAQLRQGLVSDAIESFIRADDETQFLDVIRAAEDANVYHDLVKYLLMVRQKVKEPKVDGELIFAYAKIDRLGEIEEFILMPNVANLQNVGDRLFDDALYEAAKIIFAFISNWAKLAITLVKLKQFQGAVDAARKANSSKTWKEVCFACVDAEEFRLAQICGLNVIIQVDDLEEVSDYYQNKGCFNELISLMESGLGLERAHMGIFTELGVLYARYRPEKLMEHIKLFSTRLNIPKLIRVCDEQQHWKELTYLYIQYDEFDNAATTIMNHSPDAWDHMQFKDVIVKVANVELYYKAVHFYLQEHPDLINDVLHVLALRVDHTRVVDIMRKAGHLHLVKPYMVAVQSNNVAAVNEALNEIYVEEEDYDRLRESVDLHDNFDQIGLAQRIEKHELLEMRRIAAYIYKKAGRWKQSIALSKKDNLYKDAMETCSQSGDRELSEELLVFFIEQGKKECFASCLFICYELIRPDVALELAWMNNMIDFAFPYLLQFIREYTSKVDELVKYKIEAQNEVKSKEKEEKDLVAQQNMYAQLLPLALPAPSMPGMGGPNAGGPYTAPAPMAGMGMPPMPPFGMPPMGSY

SEQ ID NO: 9563 - protein, 1705 aa, Ricinus communis
MAAANAPITMKEVLTLPTIGISPQFITFTNVTMESDKYICVRETAPQNSVVIIDMNMPMQPLRRPITADSALMNPNSRILALKAQLPGTTQDHLQIFNIEMKAKMKSHQMPEQVVFWKWISPKMLGLVTQTSVYHWSIEGDSEPVKMFERTANLVNNQIINYRCDPSEKWLVLIGIAPGSPERQQLVKGNMQLFSVDQQRSQALEAHAAAFAQFKVPGNENPSTLISFATKTFNAGQITSKLHVIELGAQPGKPSFTKKQADLFFPPDFADDFPVAMQISHKYSLIYVITKLGLLFVYDLETASAVYRNRISPDPIFLTAEASSAGGFYSINRRGQVLLATVNEATIVPFVSGQLNNLELAVNLAKRGNLPGAENLVVQRFQELFAQTKYKEAAELAAESPQGILRTPDTVAKFQSVPVQTGQTPPLLQYFGTLLTRGKLNAFESLELSRLVVNQNKKNLLENWLAEDKLECSEELGDLVKTVDNDLALKIFIKARATPKVVAAFAERREFDKILIYSKQVGYTPDYLFLLQTILRSDPQGAVNFALMMSQMEGGCPVDYNTITDLFLQRNLIREATAFLLDVLKPNLPEHSFLQTKVLEINLVTFPNVADAILANGMFSHYDRPRIAQLCEKAGLYIRALQHYSELPDIKRVIVNTHAIEPQALVEFFGTLSREWALECMKDLLLVNLRGNLQIIVQAAKEYCEQLGVDACIKLFEQFKSYEGLYFFLGSYLSSSEDPDIHFKYIEAAAKTGQIKEVERVTRESNFYDAEKTKNFLMEAKLPDARPLINVCDRFGFVADLTHYLYSNNMLRYIEGYVQKVNPGNAPLVVGQLLDDECPEDFIKGLILSVRSLLPVEPLVEECEKRNRLRLLTQFLEHLVSEGSQDVHVHNALGKIIIDSNNNPEHFLTTNPYYDSRVVGKYCEKRDPTLAVVAYRRGQCDDELINVTNKNSLFKLQARYVVERMDADLWEKVLNPENEYRRQLIDQVVSTALPESKSPEQVSAAVKAFMTADLPHELIELLEKIVLQNSAFSGNFNLQNLLILTAIKADPSRVMDYINRLDNFDGPAVGEVAVEAQLYEEAFAIFKKFNLNVQAVNVLLDNIRSIDRAVEFAFRVEEDAVWSQVAKAQLREGLVSDAIESFIRADDATQFLEVIRAAEDANVYHDLVRYLLMVRQKAKEPKVDSELIFAYAKIDRLSDIEEFILMPNVANLQNVGDRLFDEALYEAAKIIFAFISNWAKLAVTLVRLKQFQGAVDAARKANSAKTWKEVCFACVDAEEFRLAQICGLNIIIQVDDLEEVSEYYQNRGYFNELISLMESGLGLERAHMGIFTELGVLYARYRPDKLMEHIKLFSTRLNIPKLIRACDEQQHWKELTYLYIQYDEFDNAATTIMNHSPEAWDHMQFKDVAVKVANVELYYKAVHFYLQEHPDLINDLLNVLALRVDHTRVVDIMRKAGHLLLVKPYMIAVQSNNVSAVNEALNQIYVEEEDYERLRESIDLHDNFDQIGLAQKIEKHELLEMRRVAAYIYKKAGRWKQSIALSKKDNLYKDAMETASQSGDRELAEELLVYFIDQGKKECFASCLFVCYDLIRVDVALELAWMNNMVDFAFPYLLQFIREYTGKVDELVKDKIEAQKEVKAKEQEEKDVIAQQNMYAQLLPLALPAPPMPGMGGPTMGGGFVPPPPMGGMGMPPMPPFGMPPMGSY

SEQ ID NO: 9564 - protein, 1701 aa, Citrus clementina
MAAANAPISMKEVLTLPSVGINPQFITFTNVTMESDKYICVRETAPQNSVVIIDMNQPMQPLRRPITADSALMNPNSRILALKAQLPGTTQDHLQIFNIELKAKIKSHQMSEQVVFWKWISPKMLGVVTQTSVYHWSIEGDSEPVKMFDRTANLTNNQIINYKCDPTEKWLVLIGIAPGSAERPQLVKGNMQLFSVDQQRSQALEAHAASFAQFKVPGNENPSVLISFATKSFNAGQVTSKLHVIELGAQPGKPSFTKKQADLFFPPDFADDFPVAMQISHKYGLIYVITKLGLLFVYDLETAAAVYRNRISPDPIFLTSEASSLGGFYAINRRGQVLLATVNEATIVPFVSGQLNNLELAVNLAKRGNLPGAENLVVQRFQELFAQTKYKEAAELAAESPQGLLRTPDTVAKFQSVPVQAGQTPPLLQYFGTLLTRGKLNAFESLELSRLVVNQNKKNLLENWLAEDKLECSEELGDLVKTVDNDLALKIYIKARATPKVVAAFAERREFDKILIYSKQVGYTPDYLFLLQTILRTDPQGAVNFALMMSQMEGGCPVDYNTITDLFLQRNLIREATAFLLDVLKPNLPEHGFLQTKVLEINLVTFPNVADAILANGMFSHYDRPRIAQLCEKAGLYMRALQHYTELPDIKRVIVNTHAIEPQSLVEFFGTLSREWALECMKDLLLVNLRGNLQIIVQTAKEYCEQLGVEACIKLFEQFKSYEGLYFFLGSYLSSSEDPDIHFKYIEAAAKTGQIKEVERVTRESNFYDPEKTKNFLMEAKLPDARPLINVCDRFGFVPDLTHYLYTNNMLRYIEGYVQKVNPGNAPLVVGQLLDDECPEDFIKGLILSVRSLLPVEPLVEECEKRNRLRLLTQFLEHLVSEGSQDVHVHNALGKIIIDSNNNPEHFLTTNPYYDSRVVGKYCEKRDPTLAVVAYRRGQCDDELINVTNKNSLFKLQARYVVERMDADLWEKVLTPENEYRRQLIDQVVSTALPESKSPEQVSAAVKAFMTADLPHELIELLEKIVLQNSAFSGNFNLQNLLILTAIKADPSRVMDYVNRLDNFDGPAVGEVAVEAQLYEEAFAIFKKFNLNVQAVNVLLDNIRSIERAVEFAFRVEEDAVWSQVAKAQLREGLVSDAIESFIRADDATQFLDVIRAAEDADVYHDLVRYLLMVRQKVKEPKVDSELIYAYAKIDRLGDIEEFILMPNVANLQNVGDRLYDDTLYEAAKIIYAFISNWAKLAVTLVKLKQFQGAVDAARKANSAKTWKEVCFACVDAEEFRLAQICGLNIIVQVDDLEEVSEYYQNRGYFNELISLMESGLGLERAHMGIFTELGVLYARYRYEKLMEHIKLFSTRLNIPKLIRACDEQQHWKELTYLYIQYDEFDNAATTIMNHSPEAWDHMQFKDVAVKVANVELYYKAVHFYLQEHPDLINDLLNVLALRVDHTRVVDIMRKAGHLLLVKPYMVAVQSNNVSAVNEALNEIYVEEEDYERLRESIDMHDNFDQIGLAQKIEKHELLEMRRVAAYIYKKAGRWKQSIALSKKDKVYKDAMETASQSGDRELAEELLVYFIEQGKKECFASCLFVCYDLIRPDVALELSWMNNMIDFAFPYLLQFIREYTGKVDELVKDKIEAQIEVKSKEKEEKDVIAQQNMYAQLLPLALPAPPMPGMGGGFASTAPPMGGMGMPPMPPFGMPPMGSY

SEQ ID NO: 9565 - protein, 1706 aa, Phalaenopsis aphrodite
MAAANAPISMREVLTLPSAGINPQFITFTHVTMESDKYICVRETSPQNSVVIIDMSMPMQPLRRPITADSALMNPNSRILALKAQLPGTTQDHLQIFNIEMKAKIKSHQMPEQVVFWKWITPKMLGLVTQTSVYHWSIEGESEPVKMFDRTANLTNNQIINYRCDPSEKWLVLIGIAPGSPERPQLVKGNMQLFSVDQQRSQALEAHAASFASFKVVGNENSSILICFASKTHNAGQITSKLHVIELGAQPGKPGFSKKQADLFFPPDFGDDFPVAMQVSSKYSLIYVITKLGLLFVYDLETAAAVYRNRISPDPIFLTSEASSVGGFYAINRRGQVLLATVNEATIVPFVSGQLNNLELAVNLAKRGNLPGAENLVVQRFQELFSQTKYKEAAELAAESPQGLLRTPETVAKFQSVPVQAGQTPPLLQYFGTLLTRGKLNAFESLELSRLVVNQNKKNLLENWLAEDKLECSEELGDLVKTVDNDLALKIYIKARATPKVVAAFAERREFDKILIYSKQVGYTPDYLFLLQTILRSDPQGAVNFALMMSQMEGGSPVDYNTITDLFLQRNLIREATAFLLDVLKPNQPEHAFLQTKVLEINLVTYPNVADAILANGMFSHYDRPRIAQLCEKAGLYVRALQHYSELPDIKRVIVNTHAIEPQALVEFFGTLSKEWALECMKDLLLVNLRGNLQIIVQVAKEYCEQLGFDACIKLFEQFRSYEGLYFFLGSYLSSSEDPEIHFKYIEAAAKTGQIKEVERVTRESNFYDPEKTKNFLMEAKLPDARPLINVCDRHGFVPDLTHYLYTNNMLRYIEGYVQKVNPGNAPMVVGQLLDDECPEDFIKGLILSVRSLLPVEPLVEQCEKRNRLRLLTQFLEHLVSEGSQDVHVHNALGKIIIDSNNNPEHFLTTNPFYDSRVVGKYCEKRDPTLAVVAYRRGQCDDELINVTNKNSLFKLQARYVVERMDADLWAKVLEPENEYRRQLIDQVVSTALPESKSPEQVSAAVKAFMTADLPHELIELLEKIVLQNSAFSGNFNLQNLLILTAIKADPSRVMDYVNRLDNFDGPAVGEVAVEGQLYEEAFAIFKKFNLNVQAVNVLLDNIRSIERAVEFAFRVEEDSVWSQVAKAQLREGLVSDAIESFIRADDATQFLDVIRAAEDANVYHDLVSYLLMVRQKVKEPKVDSELIYAYAKIDRLGDIEEFILMPNVANLQNVGDRLYDAELYEAAKIIFAFISNWAKLASTLVKLKQFQGAVDAARKANSSKTWKEVCFACVDAEEFRLAQICGLNIIVQVDDLEEVSDYYQNRGCFNELISLMESGLGLERAHMGIFTELGVLYARYREEKLMEHIKLFSTRLNIPKLIRVCDEQQHWKELTYLYIQYDEFDNAATTIMNHSPDAWDHMQFKDVSVKVANVELYYKAVHFYLEEHPDLINDLLNVLALRVDHTRVVDILRKAGHLHLIKPYMVAVQSNNVAAVNEALNEIYVEEEDYERLRESVDMHDNFDQIGLAQKLEKHELLEMRRIAAYIYKKAGRWKQSIALSKKDKLYKDAMETASQSGDRELAEELLVYFIEQGKKECFASCLFVCYELIRLDVVLELAWMNNMIDFAFPYLLQVIREYSGKVDELIKDKIETQNEVKAKEKEEKDMVAQQNMYAQLLPLALPAPPIPGMGGVGGGFVPPPPPVAMGGMGMPPMPPFGMPPMGSY

SEQ ID NO: 9566 - protein, 1698 aa, Gossypium raimondii
MAAANAPIAMKEVLTLPSIGINPQFITFTNVTMESDKYICVRETAPQNSVVIIDMSMPMQPLRRPITADSALMNPNSRILALKAQLPGTTQDHLQIFNIEMKAKMKSHQMPEQVVFWKWISPKMLGLVTQTSVYHWSIEGDSVPVKMFERTANLVNNQIINYKCDPSEKWLVLIGIAPGAPERPQLVKGNMQLFSVDQQRSQALEAHAASFAQFKVPGNENPSILISFATKTFNAGQITSKLHVIELGAQPGKPSFSKKQADLFFPPDFQDDFPVAMQISHKYSLIYVITKLGLLFVYDLETASAVYRNRISPDPIFLTSEATSAGGFYAINRRGQVLLATVNEATIVPFVSGQLNNLELAVNLAKRGNLPGAENLVVQRFQELFAQTKYKEAAELAAESPQGILRTPDTVAKFQSVPVQAGQTPPLLQYFGTLLTRGKLNAFESLELSRLVVNQNKKNLLENWLAEDKLECSEELGDLVKTVDNDLALKIYIKARATPKVVAAFAERREFDKILIYSKQVGYAPDYLFLLQTILRTDPQGAVNFALMMSQMEGGCPVDYNTITDLFLQRNLIREATAFLLDVLKPNLPEHAFLQTKVLEINLVTFPNVADAILANGMFSHYDRPRIAQLCEKAGLYVRALQHYTELPDIKRVIVNTHAIEPQSLVEFFGTLSREWALECMKDLLLVNLRGNLQIIVQVAKEYCEQLGVDACIKLFEQFKSYEGLYFFLGSYLSSSEDPDIHFKYIEAAAKTGQIKEVERVTRESNFYDAEKTKNFLMEAKLPDARPLINVCDRFGFVPDLTHYLYTNNMLRYIEGYVQKVNPGNAPLVVGQLLDDECPEDFIKGLILSVRSLLPVEPLVEECEKRNRLRLLTQFLEHLVSEGSQDTHVHNALGKIIIDSNNNPEHFLTTNPYYDSRVVGKYCEKRDPTLAVVAYRRGQCDDELINVTNKNSLFKLQARYVVERMDGDLWEKVLNPENEYRRQLIDQVVSTALPESKSPEQVSAAVKAFMTADLPHELIELLEKIVLQNSAFSGNFNLQNLLILTAIKADPSRVMDYINRLDNFDGPAVGEVAVEAQLYEEAFAIFKKFNLNVQAVNVLLDNIRSIDRAVEFAFRVEEDAVWSQVAKAQLREGLVSDAIESFIRADDATQFLDVIRASEGADVYPDLVRYLLMVRQKVKEPKVDGELIYAYAKIDRLGEIEEFILMPNVANLQNVGDRLFDEALYEAAKIIFAFISNWAKLAVTLVRLKQFQGAVDAARKANSAKTWKEVCFACVDAEEFRLAQICGLNIIIQVDDLEEVSEYYQNRGCFNELISLMESGLGLERAHMGIFTELGVLYARYRYEKLMEHIKLFSTRLNIPKLIRACDEQQHWKELTYLYIQYDEFDNAATTVMNHSPEAWDHMQFKDIIVKVASVELYYKAVHFYLQEHPDLINDMLNVLALRVDHTRVVDIMRKAGHLRLVKPYMVAVQSNNVSAVNEALNEIYVEEEDYDRLRESIDLHDNFDQIGLAQKIEKHELLEMRRVAAYIYKKAGRWKQSIALSKKDNHYRDAMETASQSGERELAEELLVYFIEQGKKECFASCLFVCYDLVRPDVALELAWINNMIDFAFPYLLQFIREYTGKVDELIKDKIEAQKEVKAKEQEEKDVIAQQNMYAQLLPLALPAPPVPGMGGFAPPPMGGMGMPPMPAFGMPPMGSY

SEQ ID NO: 9567 - protein, 1708 aa, Musa acuminata
MAAANAPIVMREALTLPSIGINPQFITFTHVTMESDKYICVRETSPENSVVIVDMNMPMQPLRRPITADSALMNPNSRILALKAKIPGTTQDHLQVFNIEAKSKIKSHQMPEQVVFWKWITPKMLGLVTQTSVYHWSIEGEAEPLKMFDRAANLTNNQIINYKCDPTEKWLVLIGIAPGASERPQLVKGNMQLFSVDQQRSQALEAHAASFASFKVVGNENSSTLICFASKSSNAGQITSKLHVIELGAQPVKPLPGKPGFTKKQADLFFPPDFADDFPVAMQISQKYSLVYVITKLGLLFVYDLETTAAVYRNRISPDPIFLTTEASNIGGFYAINRRGQVLLATVNEATIVPFISGQLNNLELAVSIAKRGNLPGAENLVVQRFQELFSQTKYKEAAELAAESPQGILRTPETVAKFQSVPVQAGQTPPLLQYFGTLLTRGKLNAFESLELSRLVVNQNKKNLLENWLAEDKLECSEELGDLVKTVDNDLALKIYIKARATPKVVAAFAERREFDKILIYSKQVGYTPDYLFLLQTILRSDPQGAVNFALMMSQMEGGCPVDYNTITDLFLQRNLIREATAFLLDVLKPNLPEHAFLQTKVLEINLVTYPNVADAILANGMFSHYDRPRIAQLCEKAGLYVRALQHYSELPDIKRVIVNTHAIEPQALVEFFGTLSTEWALECMKDLLMVNLRGNLQIIVQTAKEYSEQLGVDACIKLFEQFKSYEGLYFFLGSYLSSSEDPDIHFKYIEAAAKTGQLKEVERVTRESNFYDPEKTKNFLMEAKLPDARPLINVCDRFGFVPDLTHYLYTNNMLRYIEGYVQKVNPGNAPLVVGQLLDDECPEDFIKGLILSVRSLLPVEPLVDECEKRNRLRLLTQFLEHLVSEGSQDVHVHNALGKIIIDSNNNPEHFLTTNPYYDSRVVGKYCEKRDPTLAVVAYRRGQCDDELINVTNKNSLFKLQARYVVERMDADLWETVLQPENEYRRQLIDQVVSTALPESKSPEQVSAAVKAFMSADLPHELIELLEKIVLQNSAFSGNFNLQNLLILTAIKADPPRVMDYINRLDNFDGPAVGEVAVEAQLYEEAFAIFKKFNLNVQAVNVLLDNIQSIERAVEFAFRVEEDAVWSQVAKAQLREGLVSDAIESFIRADDETQFLNVIRAAEDANVYHDLVKYLLMVRQKVKEPKVDGELIFAYAKIDRLGEIEEFILMPNVANLQNVGDRLFDDALYEAAKIIFAFISNWAKLACTLVKLKQFQGAVDAARKANSSKTWKEVCFACVDAEEFRLAQICGLNIIIQVDDLEEVSDYYQNRGCFNELISLMESGLGLERAHMGIFTELGVLYARYRSEKLMEHIKLFSTRLNIPKLIRVCDEQQHWKELTYLYIQYDEFDNAATTIMNHSPDAWDHMQFKDVVVKVANVELYYKAVHFYLQEHPDLINDVLHVLALRVDHTRVVDIMRKAGYLHLVKPYMVAVQSNNVAAVNEALNEIYVEEEDYDRLRESVDLHDNFDQIGLAQRIEKHELLEMRRIAAYIYKKAGRWKQSIALSKKDNLYKDAMETCSQSGDRELSEELLVYFIEQGKKECFASCLFICYDLIRPDVALELAWMNNIIDFAFPYLLQFIREYTSKVDELVKDRIEAQNEVKTKEKEEKDLVSQQNMYAQLLPLALPAPPGMGAPNMGGPYAVPPPMPGMGMPPMAPFGMPPMGSY

SEQ ID NO: 9568 - protein, 1705 aa, Papaver somniferum
MAAANAPITMKEALTLPSIGITPQFITFTHVTMESDKYICVRETSPQNSVVIIDMSMPNQPLRRPITADSALMNPNSRILALKAQLPGTTQDHLQIFNIEMKAKMKSHQMPEQVVFWKWISPKILGLVTQTSVYHWTIEGESDPVKMFDRTANLASNQIINYRCDPSEKWLVLIGIAPGSPERPQLVKGNMQLFSVEQQRSQSLEAHAASFASHKIPGNENPSTLICFATKTTNAGQITSKLHVIELGAQPGKPAFSKKQADLFFPPDFADDFPVSMQISHKYSLIYVITKLGLLFVYDLETATAVYRNRISPDPIFLTAEASSVGGFYAVNRRGQVLLATVNEATIVPFVSGQLNNLELAVNLAKRGNLPGAENLVVQRFQELFSQTKYKEAAELAAESPQGILRTPDTVAKFQSVPVQAGQTPPLLQYFGTLLTRGKLNAFESLELSRLVVNQNKKNLLENWLAEDKLECSEELGDLVKTVDNDLALKIYIKARATPKVVAAFAERREFDKILIYSKQVGYTPDYLFLLQTILRSDPQGAVNFALMMSQMEGGCPVDYNTITDLFLQRNLIREATAFLLDVLKPNLPEHGFLQTKVLEINLVTFPNVADAILANGMFSHYDRPRVAQLCEKAGLYVRALQHYAELPDIKRVIVNTHAIEPQSLVEFFGTLSKEWALECMKDLLLVNLRGNLQIIVQTAKEYSEQLGVEACIKLFEQFKSYEGLYFFLGSYLSSSEDPEIHFKYIEAAAKTGQIKEVERVTRESNFYDAEKTKNFLMEAKLPDARPLINVCDRFGFVPDLTHYLYTNNMLRYIEGYVQKVNPGNAPLVVGQLLDDECPEDFIKGLILSVRSLLPVEPLVDECEKRNRLRLLTQFLEHLVSEGSQDVHVHNALGKIIIDSNNNPEHFLTTNPYYDSRVVGKYCEKRDPTLAVVAYRRGQCDSELINVTNKNSLFKLQARYVVERMDSDLWDLVLNPENEYRRQLIDQVVSTALPESKSPEQVSAAVKAFMTADLPHELIELLEKIVLQNSAFSGNFNLQNLLILTAIKADASRVMDYINRLDNFDGPAVGEVAVEAQLFEEAFAIFKKFNLNVQAVNVLLDNIQSIERAEEFAFRVEEDAVWSQVAKAQLREGLVSEAIESFIRADDATHFLDVIKASEDANVYHDLVKYLLMVRQKSKEPKVDSELIYAYAKIDRLGDIEEFILMPNVANLQSVGDRLYDEELYEAAKIIFAFISNWAKLAVCLVKLRQFQGAVDAARKANSAKTWKEICFACVDAEEFRLAQICGLNIIIQVDDLEEVSQFYQNRGCFNELISLMESGLGLERAHMGIFTELGVLYARYRPEKLMEHIKLFSTRLNIPKLIRACDEQQHWKELVYLYIQYDEFDNAATTIMNHSPEAWDHMQFKDVAVKVANVELYYKAVHFYLQEHPDLINDMLNVLALRVDHTRVVDIMRKAGHLLLVKPYMVAVQSNNVSAVNEALNQIYVEEEDYDRLRESIDMHDNFDQIGLAQKVEKHELLEMRRIAAYIYKKAGRWRQSIALSKKDNLYKDAMETCSQSGDRELSEELLVYFIEQGKKECFASCLFVCYDLIRPDVALELAWMNNMIDFAFPYLLQFIREYTGKVDELVKDRIAAQSEVKVKEQEEKDMVAQQNMYAQLLPLALPAPPMPGMGGGGGMGGYGPPPPMGGMGMPPMPAYGMPPMGYQ

SEQ ID NO: 9569 - protein, 1713 aa, Aquilegia formosa
MAAANAPITMKEALTLPSIGINPQFITFTHVTMESDKYICVRETSPQNSVVIIDMNMPNQPLRRPITADSALMNPNSRILALKAQLPGTTQDHLQIFNIEMKAKMKSHQMPEQIVFWKWITPKMLGLVTQTSVYHWSIEGDSEPVKMFDRTANLASNQIINYRCDPAEKWLVLIGIAPGSAERPQLVKGNMQLFSVDQQRSQALEAHAAAYASHKVPGNENPSTLICFASKTTNAGQITSKLHVIELGAQPGKPAFTKKQADLFFPPDFADDFPVAMQISHKYGLIYVITKLGLLFVYDLETATAVYRNRISPDPIFLTSEASSVGGFYAVNRRGQVLLATVNEATIVPFVSGQLNNLELAVNLAKRGNLPGAENLVVQRFQELFSQTKYKEAAELAAESPQGILRTPDTVAKFQSVPVQSGQTPPLLQYFGTLLTRGKLNAFESLELSRLVVNQNKKNLLENWLAEDKLECSEELGDLVKTVDNDLALKIYIKARATPKVVAAFAERREFDKILIYSKQVGYTPDYLFLLQTILRADPQGAVNFALMMSQMEGGCPVDYNTITDLFLQRNLIREATAFLLDVLKPNLPEHAFLQTKVLEINLVTFPNVADAILANGMFSHYDRPRIAQLCEKAGLYVRALQHYAELPDIKRVIVNTHAIEPQSLVEFFGTLSREWALECMKDLLLVNLRGNLQIIVQTAKEYSEQLGVDSCIKLFEQFKSYEGLYFFLGSYLSSSEDPDIHFKYIEAAAKTGQIKEVERVTRESNFYDAEKTKNFLMEAKLPDARPLINVCDRFGFVPDLTHYLYTNNMLRYIEGYVQKVNPGNAPLVVGQLLDDECPEDFIKGLILSVRSLLPVEPLVEECEKRNRLRLLTQFLEHLVSEGSQDVHVHNALGKIIIDSNNNPEHFLTTNPYYDSRVVGKYCEKRDPTLAVVAYRRGQCDDELINVTNKNSLFKLQARYVVERMDSDLWEKVLNPENEYRRQLIDQVVSTALPESKSPEQVSAAVKAFMTADLPHELIELLEKIVLQNSAFSGNFNLQNLLILTAIKADASRVMDYINRLDNFDGPAVGEVAVEAQLYEEAFAIFKKFNLNVQAVNVLLDNIQSIERAVEFAFRVEEDAVWSQVAKAQLREGLVSDAIESFIRADDATQFLDVIRAAEDTNCYHDLVRYLLMVRQKSKEPKVDSELIYAYAKIDRLSDIEEFILMPNVANLQNVGDRLYDESLYEAAKIIYAFISNWAKLAVTLVKLKQFQGAVDAARKANSAKTWKEVCFACVDAEEFRLAQICGLNIIVQVDDLEEVSDYYQNRGCFNELISLMESGLGLERAHMGIFTELGVLYARYRPEKLMEHIKLFSTRLNIPKLIRACDEQQHWKELTYLYIQYDEFDNAATTIMNHSPEAWDHMQFKDVAVKVANVELYYKAVHFYLQEHPDLINDFLNVLALRLDHTRVVDIMRKAGFLHLIKPYMVAVQSTNTPAVNEALNGIYVEEEDYERLRESIDMHDSFDQIGLAQKVEKHELLEMRRIAAYIYKKAGRWKQSIALSKKDSLYKDAMETCSQSGDRELSEELLVYFIEQGKKECFASCLFVCYDLIRPDVALELAWIHNMIDFAFPYLLQFIREYTSKVDDLVKDKIEALSEVKAKEKEEKDMVAQQNMYAQLLPLALPAPPGMGGAGLGGGYGPPPGMPQPFGMPGMPPMQQPGMPPMPQPYGMPQY

SEQ ID NO: 9570 - protein, 1707 aa, Gossypium raimondii
MAAANAPIAMKEVLTLPSVGINPQFITFTNVTMESDKYICVRETAPQNSVVIIDMSMPMQPLRRPITADSALMNPNSRILALKAQLPGTTQDHLQIFNIEMKAKIKSHQMPEPVVFWKWITPKTLGLVTQTSVYHWSIEGDSEPVKMFERTANLVNNQIINYKCDPSEKWLVLIGIAPGAPERPQLVKGNMQLFSVDQQRSQALESHAASFAQFKVPGNENPSILISFATKSFNAGQIVSKLHVIELGAQPGKPSFSKKQADLFFPPDFQDDFPVAMQISHKYSLIYVITKLGLLFVYDLETATAVYRNRISPDPIFLTSEASSAGGFYAINRRGQVLLATVNEATIVPFVSSQLNNLELAVNLAKRGNLPGAENLVVQRFQELFAQTKYKEAAELAAESPQGILRTPDTVAKFQSVPVQAGQTPPLLQYFGTLLTKGKLNAFESLELSRLVVNQNKKNLLENWLAEDKLECSEELGDLVKTVDNDLALKIYIKARATPKVVAAFAERREFDKILIYSKQVGYSPDYLFLLQTILRTDPQGAVNFALMMSQMEGGCPVDYNTITDLFLQRNLIREATAFLLDVLKPNLPEHAFLQTKVLEINLVTFPNVADAILANGMFSHYDRPRIAQLCEKAGLYVRALQHYSELPDIKRVIVNTHAIEPQSLVEFFGTLSREWALECMKDLLLVNLRGNLQIIVQVAKEYCEQLGVEACIKLFEQFKSYEGLYFFLGSYLSSSEDPDIHFKYIEAAAKTGQIKEVERVTRESNFYDAEKTKNFLMEAKLPDARPLINVCDRFGFVPDLTHYLYTNNMLRYIEGYVQKVNPGNAPLVVGQLLDDECPEDFIKGLILSVRSLLPVEPLVDECEKRNRLRLLTQFLEHLVSEGSQDVHVHNALGKIIIESNNNPEHFLTTNPYYDSRVVGKYCEKRDPTLAVVAYRRGQCDDELINVTNKNSLFKLQARYVVERMDGDLWEKVLNPENEYRRHLIDQVVSTALPESKSPEQVSAAVKAFMTADLPHELIELLEKIVLQNSAFSGNFNLQNLLILTAIKADPSRVMDYINRLDNFDGPAVGEVAVEAQLYEEAFSIFKKFNLNVQAVNVLLDNIRSIDRAVEFAFRVEEDAVWSQVAKAQLREGLVSDAIESFIRADDATHFLDVIRASEDANVYPDLVRYLLMVRQKVKEPKVDSELIYAYAKIDRLGEIEEFILMPNVANLQNVGDRLFDEELYEAAKIIFAFISNWAKLAVTLVRLKQFQGAVDAARKANSAKTWKEVCFACVDAEEFRLAQICGLNVIVQVDDLEEVSEYYQNRGCFNELISLMESGLGLERAHMGIFTELGVLYARYRPEKLMEHIKLFSTRLNIPKLIRACDEQQHWKELTYLYIQYDEFDNAATTVMNHSPEAWDHMQFKDIIVKVASVELYYKAVHFYLQEHPDLINDMLNVLALRVDHTRVVDIMRKAGHLRLVKPYMVAVQSNNVSAVNEALNEIYVEEEDYDRLRESIDLHDNFDQIGLAQKIEKHELLEMRRVAAYIYKKAGRWKQSIALSKKDNHYRDAMETASQSGERELAEELLVYFIEQGKKECFASCLFVCYDLIRADVALELAWINNMIDFAFPYLLQFIREYTGKVDELIKDKIEAQKEVKAKEQEEKEVIAQQNMYAQLLPLALPAPPMPGMGGPTMGGGFAPPPPPMGGMGMPPMPPYGMPPMGSSY

SEQ ID NO: 9571 - protein, 1707 aa, Gossypium hirsutum
MAAANAPIAMKEVLTLPSVGINPQFITFTNVTMESDKYICVRETAPQNSVVIIDMSMPMQPLRRPITADSALMNPNSRILALKAQLPGTTQDHLQIFNIEMKAKIKSHQMPEPVVFWKWITPKTLGLVTQTSVYHWSIEGDSEPVKMFERTANLVNNQIINYKCDPSEKWLVLIGIAPGAPERPQLVKGNMQLFSVDQQRSQALESHAASFAQFKVPGNENPSILISFATKSFNAGQIVSKLHVIELGAQPGKPSFSKKQADLFFPPDFQDDFPVAMQISHKYSLIYVITKLGLLFVYDLETATAVYRNRISPDPIFLTSEASSAGGFYAINRRGQVLLATVNEATIVPFVSSQLNNLELAVNLAKRGNLPGAENLVVQRFQELFAQTKYKEAAELAAESPQGILRTPDTVAKFQSVPVQAGQTPPLLQYFGTLLTKGKLNAFESLELSRLVVNQNKKNLLENWLAEDKLECSEELGDLVKTVDNDLALKIYIKARATPKVVAAFAERREFDKILIYSKQVGYSPDYLFLLQTILRTDPQGAVNFALMMSQMEGGCPVDYNTITDLFLQRNLIREATAFLLDVLKPNLPEHAFLQTKVLEINLVTFPNVADAILANGMFSHYDRPRIAQLCEKAGLYVRALQHYSELPDIKRVIVNTHAIEPQSLVEFFGTLSREWALECMKDLLLVNLRGNLQIIVQVAKEYCEQLGVEACIKLFEQFKSYEGLYFFLGSYLSSSEDPDIHFKYIEAAAKTGQIKEVERVTRESNFYDAEKTKNFLMEAKLPDARPLINVCDRFGFVPDLTHYLYTNNMLRYIEGYVQKVNPGNAPLVVGQLLDDECPEDFIKGLILSVRSLLPVEPLVDECEKRNRLRLLTQFLEHLVSEGSQDVHVHNALGKIIIESNNNPEHFLTTNPYYDSRVVGKYCEKRDPTLAVVAYRRGQCDDELINVTNKNSLFKLQARYVVERMDGDLWEKVLNPENEYRRHLIDQVVSTALPESKSPEQVSAAVKAFMTADLPHELIELLEKIVLQNSAFSGNFNLQNLLILTAIKADPSRVMDYINRLDNFDGPAVGEVAVEAQLYEEAFSIFKKFNLNVQAVNVLLDNIRSIDRAVEFAFRVEEDAVWSQVAKAQLREGLVSDAIESFIRADDATHFLDVIRASEDANVYPDLVRYLLMVRQKVKEPKVDSELIYAYAKIDRLGEIEEFILMPNVANLQNVGDRLFDEELYEAAKIIFAFISNWAKLAVTLVRLKQFQGAVDAARKANSAKTWKEVCFACVDAEEFRLAQICGLNVIVQVDDLEEVSEYYQNRGCFNELISLMESGLGLERAHMGIFTELGVLYARYRPEKLMEHIKLFSTRLNIPKLIRACDEQQHWKELTYLYIQYDEFDNAATTVMNHSPEAWDHMQFKDIIVKVASVELYYKAVHFYLQEHPDLINDLLNVLALRVDHTRVVDIMRKAGHLRLVKPYMVAVQSNNVSAVNEALNEIYVEEEDYDRLRESIDLHDNFDQIGLAQKIEKHELLEMRRVAAYIYKKAGRWKQSIALSKKDNHYRDAMETASQSGERELAEELLVYFIEQGKKECFASCLFVCYDLIRADVALELAWINNMIDFAFPYLLQFIREYTGKVDELIKDKIEAQKEVKAKEQEEKEVIAQQNMYAQLLPLALPAPPMPGMGGPTMGGGFAPPPPPMGGMGMPPMPPYGMPPMGSSY

SEQ ID NO: 9572 - protein, 1698 aa, Gossypium raimondii
MAAANAPIAMKEVLTLPSIGISPQFITFTNVTMESEKYICVRETAPQNSVVIIDMNMPMQPLRRPITADSALMNPNSRILALKAQLPGTTQDHLQIFNIELKAKIKSHQMPEQVVFWKWISPKLLGLVTQTSVYHWSIEGESEPVKMFERTANLANNQIINYKCDPSEKWLVLIGIAPGAPERPQLVKGNMQLFSVDQQRSQALEAHAASFAQFKVPGNENPSILISFATKSFNAGQITSKLHVIELGAQPGKSSFSKKQADLFFPPDFQDDFPVAMQISHKYALIYVITKLGLLFVYDLETATAVYRNRISPDPIFLTSEASAVGGFYAINRRGQVLLATVNEATLVPFVSGQLNNLELAVSLAKRGNLPGAENLVVQRFQELFAQTKYKEAAELAAESPQGILRTPDTVAKFQSVPVQAGQTAPLLQYFSILLTRGKLNAFESLELSRLVVNQNKKNLLENWLAEDKLECSEELGDLVKTVDNDLALKIYIKARATPKVVAAFAERREFDKILIYSKQVGYTPDYLFLLQTILRTDPQGAVNFALMMSQMEGGCPVDYNTITDLFLQRNLIREATAFLLDVLKPNLPEHAFLQTKVLEINLVTFPNVADAILANGMFSHYDRPRIAQLCEKAGLYIRALQHYSELPDIKRVIVNTHAIEPQSLVEFFGTLSREWALECMKDLLLVNLRGNLQIIVQVAKEYCEQLGVDSCIKIFEQFKSYEGLYFFLGSYLSSSEDPDIHFKYIEAAAKTGQIKEVERVTRESNFYDAEKTKNFLMEAKLPDARPLINVCDRFGFVPDLTHYLYTNNMLRYIEGYVQKVNPGNAPLVVGQLLDDECPEDFIKGLILSVRSLLPVEPLVEECEKRNRLRLLTQFLEHLVSEGSQDVHVHNALGKIIIDSNNNPEHFLTTNPYYDSRVVGKYCEKRDPTLAVVAYRRGQCDDELINVTNKNSLFKLQARYVVERMDGDLWEKVLNPENEYRRQLIDQVVSTALPESKSPEQVSAAVKAFMTADLPHELIELLEKIVLQNSAFSGNFNLQNLLILTAIKADPSRVMDYINRLDNFDGPAVGEVAVEAQLYEEAFAIFKKFNLNVQAVNVLLDNIRSIDRAVEFAFRVEEDAVWSQVAKAQLREGLVSDAIESFIRADDATQFLDVIRASEDADVYPDLVRYLLMVRQKVKEPKVDGELIYAYAKIDRLGEIEEFILMPNVANLQNVGDRLFDEALYEAAKIIFAFISNWAKLAVTLVRLKQFQGAVDAARKANSAKTWKEVCFACVDAEEFRLAQICGLNIIIQVDDLEEVSEYYQNRGCFNELISLMESGLGLERAHMGIFTELGVLYARYRPEKLMEHIKLFSTRLNIPKLIRACDEQQHWTELTYLYIQYDEFDNAATTVMNHSPEAWDHMQFKDIIVKVASVELYYKAVHFYLQEHPDLINDMLNVLALRVDHTRVVDIMRKAGHLRLVKPYMVAVQSNNVSAVNEALNEIYVEEEDYDRLRESIDLHDNFDQIGLAQKIEKHELLEMRRVAAYIYKKAGRWKQSIALSKKDNHYKDAMETASQSGERELAEELLVYFIEQGKKECFASCLFVCYDLLRADVVLELAWIHNMIDFAFPYLLQFIREYTGKVDELIKDKIEAQKEVKAKEQEEKEVIAQQNMYAQLLPLALPAPPMPGMGGGFAPPPPPMGGMGMPPFGMPPMGSY

SEQ ID NO: 9573 - protein, 1707 aa, Eucalyptus grandis
MAAANAPITMKEALTLPSLGISPQFITFTHVTMESEKYICVRETAPQNSVVIIDMSMPMQPLRRPITADSALMNPNSRILALKAQLSGTTQDHLQIFNIEMKAKMKSYQMPEQVVFWKWITPKLLGLVTQTSVYHWTIEGDAEPVKMFDRTANLVNNQIINYRCDPSEKWLVLIGIAPGSPERPQLVKGNMQLFSVEQQRSQALEAHAASFATYKVPGNENPSTLISFATKTVNAGQIASKLHVIELGAQPGKLSFTKKQADLFFPPDFGDDFPVAMQISHKYSLIYVITKLGLLFVYDLETATAVYRNRISPDPVFLTAEASSVGGFYAVNRRGQVLLATVNEATIVPFVSGQLNNLELAVNLAKRGNLPGAEQLVVQRFQELFAQTKYKEAAELAAESPQGILRTPDTVAKFQSVPVQSGQTPPLLQYFGTLLTRGKLNAFESLELSRLVVNQNKKNLLENWLAEDKLECSEELGDLVKTVDNDLALKIYIKARATPKVVAAFAERREFDKILIYSKQVGYTPDYLFLLQTILRTDPQGAVNFALMMSQMEGGCPVDYNTITDLFLQRNLIREATAFLLDVLKPNLPEHAFLQTKVLEINLVTFPNVADAILANGMFSHYDRPRIAQLCEKAGLFVRALQHYTELPDIKRVIVNTHAIEPQSLVEFFGTLSREWALECMKDLLLVNLRGNLQIIVQVAKEYCEQLGVDACIKIFEQFKSYEGLYFFLGSYLSSSEDPDIHFKYIEAAAKTGQIKEVERVTRESNFYDPEKTKNFLMEAKLPDARPLINVCDRFGFVPDLTHYLYTNNMLRYIEGYVQKVNPGNAPLVVGQLIDDECPEDFIKGLILSVRSLLPVEPLVDECEKRNRLRLLTQFLEHLVSEGSQDVHVHNALGKIIIESNNNPEHFLTTNPYYDSRVVGKYCEKRDPTLAVVAYRRGQCDEELINVTNKNSLFKLQARYVVERMDGDLWEKVLDPENSYRRQLIDQVVSTALPESKSPEQVSAAVKAFMTADLPHELIELLEKIVLQNSAFSGNFNLQNLLILTAIKADPSRVMDYVNRLDNFDGPAVGEVAVEAQLYEEAFAIFKKFNLNVQAVNVLLDNIQSIERAVEFAFRVEEEAVWSQVAKAQLREGLVSDAIESFIRADDATQFLDVIRAAENANVYHDLVKYLLMVRQKTKEPKVDGELIFAYAKIDRLGEIEEFILMPNVANLQNVGDRLYDEGLYEAAKIIFAFISNWAKLASTLVKLGQFQGAVDAARKANSAKTWKEVCFACVDAEEFRLAQMCGLNIIIQVDDLEEVSEYYQNRGYFNELISLMESGLGLERAHMGIFTELGVLYARYRPEKLMEHIKLFATRLNIPKLIRACDEQQHWKELTYLYIQYDEFDNAATTIMNHSPEAWDHMQFKDVVVKVANVELYYKAVHFYLQEHPDLINDVLNVLALRVEHTRVVDIMRKAGHLRLVKPYMVAVQSNNVSAVNEALNEIYVEEEDYDRLRESIDLHDNFDQIGLAQKIEKHELLEMRRVAAYIYKKAGRWKQSIALSKKDNLYKDAIETASQSGDRELAEELLVYFIEKGKKECFASCLFVCYDLIRADIVLELAWMNNMIDFAFPYLLQFIREYTSKVDELVKDKIETQNEVKTKEKEEKDVIAQQNMYAQLLPLALPAPPMPGMGGPGMGGMGAGFAPPPMGGMGMPPMPPFGMPPMGSY

SEQ ID NO: 9574 - protein, 1706 aa, Vinca minor
MAAANAPITMKEALTLTSIGINPSFITFTNVTMESDKYICVRETSPQNSVVIIDMSMPNQPLRRPITADSALMNPNTRILALKAQLPGTTQDHLQIFNIEAKAKMKSYQMPEQVVFWKWITPKMLGLVTQTSVYHWSIEGESEPLKMFDRTANLANNQIINYRCDPSEKWLVLVGIAPGSPERPQLVKGNMQLYSVEQQRSQALEAHAASFASFRVPGNDKDSILISFATKSTNAGQVVSKLHVIELGAQPGKPSFTKKQADLFFPPDFADDFPVAMQISHKYSLIYVITKLGLLFVYDLDTATAVYRNRISPDPIFLTSEASSVGGFYAINRRGQVLLATVNEATIVPFVNGQLNNLELAVNLAKRGNLPGAENLVVHRFQELFAQTKYKEAAELAAESPQGILRTPDTVAKFQSVPVQAGQTPPLLQYFGTLLTRGKLNAFESLELSRLVVNQNKKNLLENWLAEDKLECSEELGDLVKTVDNDLALKIYIKARATPKVVAAFAERREFDKILIYSKQVGYTPDYLFLLQTILRSDPQGAVNFALMMSQMEGGCPVDYNTITDLFLQRNMIREATAFLLDVLKPNLPEHAFLQTKVLEINLVTFPNVADAILANGMFSHYDRPRIAQLCEKAGLYMRALQHYSELPDIKRVIVNTHAIEPQSLVEFFGTLSREWALECMKDLLLVNLRGNLQIIVQVAKEYCEQMGVDACIKIFEQFKSYEGLYFFLGSYLSSSEDPDIHFKYIEAAAKTGQIKEVERVTRESNFYDAEKTKNFLMEAKLPDARPLINVCDRFGFVPDLTHYLYTNNMLRYIEGYVQKVNPGNAPLVVGQLLDDECPEDFIKGLILSVRSLLPVEPLVDECEKRNRLRLLTQFLEHLVSEGSQDVHVHNALGKIIIDSNNNPEHFLTTNPYYDSRVVGKYCEKRDPTLAVVAYRRGQCDDELINVTNKNSLFKLQARYVVERMDGDLWDMVLNPENEFRRQLIDQVVSTALPESKSPEQVSAAVKAFMTADLPHELIELLEKIVLQNSAFSGNFNLQNLLILTAIKADPSRVMDYVNRLDNFDGPAVGEVAVEAQLYEEAFAIFKKFNLNVQAVNVLLDNIRDINRAVEFAFRVEEDAVWSQVAKAQLREGLVSEAIESFIRADDVTQFLEVIKAAEDADVYHDLVKYLLMVRQKTKEPKVDSEIIYAYAKIDRLSDIEEFILMPNVANLPNVGDRLYDEALYEAAKIIYAFISNWAKLAVTLVKLKQFQGAVDAARKANSSKTWKEVCFACVDAEEFRLAQICGLNIIVQVDDLEEVSEYYQNRGCFNELISLMESGLGLERAHMGIFTELGVLYARYRYEKLMEHIKLFSTRLNIPKLIRACDEQQHWKELTYLYIQYDEFDNAATTVMNHSPDAWDHMQFKDIIVKVANVELYYKAVHFYLQEHPDLINDVLNVLALRVDHTRVVDIMRKAGHLRLVKPYMVAVQSNNVSAVNEALNEIYVEEEDYDRLRESIDLHDSFDQIGLAQKIEKHELLEMRRVAAYIYKKAGRWKQSIALSKKDNLYKDAMETASQSGDRELAEELLVYFIEQGKKECFASCLFVCYDLIRADVALELAWMNNMIDFAFPYLLQFIREYTGKVDDLIKDKIESLKEVKAKENEEKDVIMQQNMYAQLLPLALPAPPGMGGGFAQPPPPHMGGMGMPPPGMGMPPMPQFGMPPMGY

SEQ ID NO: 9575 - protein, 1705 aa, Malus domestica
MAAANAPITMKEALTLPSVGINPQFITFTHVTMESDKYICVRETSPQNSIVIIDMSMPMQPLRRPITADSALMNPNSKILALKAGVQGTTQDHLQIFNIEMKAKLKSHLMPEQIVFWKWITPKMLGLVTQTTVYHWSIEGESEPVKVFERTANLANNQIINYRCDPSEKWLVLIGIAPGAPERPQLVKGNLQLFSVDQQRSQALEAHAASFAQYKVPGNENPSTLISFATKTLNAGQITSKLHVIELGAQPGKPSFTKKQADLFFPPDFADDFPVAMQMSHKYSLIYVITKLGLLFVYDLETASAVYRNRISPDPIFLTTEASSVGGFYAVNRRGQVLLATINEQTIVPFVSGQLNNLELAVNLAKRGNLPGAENLVVQRFQELFAQTKYKEAAELAAESPQGILRTPDTVAKFQSVPVQAGQTPPLLQYFGTLLTRGKLNAFESLELSRLVVNQNKKNLLENWLAEDKLECSEELGDLVKTVDNDLALKIYIKARATPKVVAAFAERREFDKILIYSKQVGYTPDYLFLLQTILRADPQGAVNFALMMSQMEGGCPVDYNTITDLFLQRNLIREATAFLLDVLKPNLPEHAFLQTKVLEINLVTFPNVADAILANGMFSHYDRPRIAQLCEKAGLYVRALQHYSELPDIKRVIVNTHAIEPQSLVEFFGTLSKEWALECMKDLLLVNLRGNLQIIVQVAKEYSEQLGVDQCMKLFEQFKSYEGLYFFLGSFLSSSEDPDIHFKYIEAAAKTGQIKEVERVTRESNFYDAEKTKNFLMEAKLPDARPLINVCDRFGFVPDLTHYLYTNNMLRYIEGYVQKVNPGNAPLVVGQLLDDECPEDFIKGLILSVRSLLPVEPLVDECEKRNRLRLLTQFLEHLVSEGSQDVHVHNALGKIIIDSGNNPEHFLTTNPYYDSRVVGKYCEKRDPTLAVVAYRRGQCDDELINVTNKNSLFKLQARYVVERMDEDLWGKVLDPENEYRRQLIDQVVSTALPESKSPEQVSAAVKAFMTADLPHELIELLEKIVLQNSAFSGNFNLQNLLILTAIKADPSRVMDYINRLDNFDGPAVGEVAVEAQLYEEAYAIFKKFNLNVQAVNVLLDNIRSIDRAVEFAFRVEEDAVWSQVAKAQLREGLVSDAIESFIRADDATQFLDVIRASEDADVYHDLVRYLLMVRQKVREPKVDSELIYAYAKIDRLADIEEFILMPNVANLQNVGDRLYDEALYEAAKIIYAFISNWAKLAVTLVKLKQFQGAVDAARKANSSKTWKEVCFACVDAEEFRLAQICGLNIIIQVDDLEEVSEYYQNRGCFNELISLMESGLGLERAHMGIFTELGVLYARYRPEKLMEHIKLFANRLNIPKLIRACDEQQHWKELTYLYIQYDEFDNAATTIMNHSPEAWDHMQFKDVAVKVANVELYYKAVHFYLQEHPDLINDILNVLALRVDHTRVVDIMRKAGHLLLVKPYMVAVQSNNVSAVNEALNEIYVEEEDYERLRESIDLHDSFDQIGLAQKIEKHELLEMRRVAAYIYKKAGRWKQSIALSKKDKLYKDAMETASQSGDRELAEELLVYFIEQGKKECFASCLFVCYDLIRPDIALELAWMNNMIDFAFPYLLQFIREYTGKVDELVKDKIEAQKEVKAKEQEDKEVIAQQNMYAQLLPLALPAPPMPGMGGGMGGGYAPPPPMGGMPPMGMPPFGMPPMGSSY

SEQ ID NO: 9576 - protein, 1699 aa, Chelidonium majus
MAAANAPITMKEALTLPSIGITQQFITFTHVTMESDKYICVRETSPQNSVVIIDMSMPNQPLRRPITADSALMNPNSRILALKAQLPGTTQDHLQIFNIEMKAKMKSHQMPEQVVFWKWITPKMLGLVTQTSVYHWSIEGDSEPVKMFDRTANLANNQIINYRCDPSEKWLVLIGIAPGSPERPQLVKGNMQLFSVDQQRSQALEAHAASFASYKVPGNENPSILISFASKTTNAGQITSKLHVIELGAQPGKPAFTKKQADLFFPPDFADDFPVAMQISHKYSLIYVITKLGLLFVYDLETATAVYRNRISPDPIFLTAEASSVGGFYAVNRRGQVLLATVNEATIIPFVSGQLNNLELAVNLAKRGNLPGAENLVVQRFQELFSQTKYKEAAELAAESPQGILRTPDTVAKFQSVPVQAGQTPPLLQYFGTLLTRGKLNAFESLELSRLVVNQNKKNLLENWLAEDKLECSEELGDLVKTVDNDLALKIYIKARATPKVVAAFAERREFDKILIYSKQVGYTPDYLFLLQTILRSDPQGAVNFALMMSQMEGGCPVDYNTITDLFLQRNMIREATAFLLDVLKPNLPEHAFLQTKVLEINLVTFPNVADAILANGMFSHYDRPRVAQLCEKAGLYVRALQHYAELPDIKRVIVNTHAIEPQSLVEFFGTLSKEWALECMKDLLLVNLRGNLQIIVQTAKEYSEQLGVEACIKLFEQFKSYEGLYFFLGSYLSSSEDPDIHFKYIEAAAKTGQIKEVERVTRESNFYDAEKTKNFLMEAKLPDARPLINVCDRFGFVPDLTHYLYTNNMLRYIEGYVQKVNPGNAPLVVGQLLDDECPEDFIKGLILSVRSLLPVEPLVEECEKRNRLRLLTQFLEHLVSEGSQDVHVHNALGKIIIDSNNNPEHFLTTNPYYDSRVVGKYCEKRDPTLAVVAYRRGQCDEELVNVTNKNSLFKLQARYVVERMDSDLWEKVLDPDNEYRRQLIDQVVSTALPESKSPEQVSAAVKAFMTADLPHELIELLEKIVLQNSAFSGNFNLQNLLILTAIKADASRVMDYINRLDNFDGPAVGEVAVEAQLFEEAFAIFKKFNLNVQAVNVLLDNIQSIERAVEFAFRVEEDAVWSQVAKAQLREGLVSDAIESFIRADDSTEFLAVIKAAEDANVYHDLVRYLLMVRQKSKEPKVDSELIYAYAKIDRLGDIEEFILMPNVANLQNVGDRLFDETLYEAAKIIFAFISNWAKLASTLVRLRQFQGAVDAARKANSSKTWKDVCFACVDAEEFRLAQICGLNIIIQVDDLEEVSQYYQNRGCFNELISLMESGLGLERAHMGIFTELGVLYARYRPEKLMEHIKLFSTRLNIPKLIRACDEQQHWKELTYLYIQYDEFDNAATTIMNHSPEAWDHMQFKDVAVKVANVELYYKAVHFYLQEHPDLINDMLNVLALRVDHTRVVDIMRKAGHLRLVKPYMVAVQSNNVSAVNEALNEIYVEEEDYDRLRESIDMHDNFDQIGLAQKVEKHELLEMRRIAAYIYKKAGRWKQSIALSKKDNLYKDAMETCSQSGDRELSEELLVYFIEQGKKECFAACLFVCYDVIRPDVALELAWMNNMIDFVFPYLLQFIREYTGKVDELVKDRIAAQSEVKAKEKEEKDMVAQQNMYAQLLPLALPAPPMPGMGGGYGPPPPMGGMGMPPMPPYGMPPMGY

SEQ ID NO: 9577 - protein, 1705 aa, Castanea mollissima
MAAANAPITMKEALTLPSIGINPQFITFTHVTMESDKYICVRETSPQNSVVIIDMSMPMQPLRRPITADSALMNPNSRILALKAQIQGTNQDHLQIFNIEMKAKMKSYQMPEQIVFWKWITPKMLGLVTQTSVYHWSIEGDSEPVKMFDRTANLANNQIINYRCDPSEKWLVLIGIAPGAPERPQLVKGNMQLFSIDQQRSQALEAHAASFAQFKVPGNDYPSVLISFATKTLNAGQITSKLHIIELGAQPGKPSFTKKQADLFFPPDFADDFPVAMQISQKYNLIYVITKLGLLFVYDMETATAVYRNRISPDPIFLTAEASSLGGFYAVNRRGQVLLATVNEQTIVPFVSGQLNNLELAVNLAKRGNLPGAEQLVVQRFQELFAQTKYKEAAELAAESPQGILRTPDTVAKFQSVPVQAGQTPPLLQYFGTLLTRGKLNAFESLELSRLVVNQNKKNLLENWLAEDKLECSEELGDLVKTVDNDLALKIYIKARATPKVVAAFAERREFDKILIYSKQVGYTPDYLFLLQTILRSDPQGAVNFALMMSQMEGGCPVDYNTITDLFLQRNLIREATAFLLDVLKPNLPEHGFLQTKVLEINLVTFPNVADAILANGMFSHYDRPRIGQLCEKAGLYIRALQHYTELPDIKRVIVNTHAIEPQSLVEFFGTLSREWALECMKDLLLVNLRGNLQIIVQAAKEYCEQLGIDSCIKLFEQFKSYEGLYFFLGSFLSSSEDPDIHFKYIEAAAKTGQIKEVERVTRESNFYDPEKTKNFLMEAKLPDARPLINVCDRFGFVPDLTHYLYSNNMLRYIEGYVQKVNPGNAPLVVGQLLDDECPEDFIKGLILSVRSLLPVEPLVEECEKRNRLRLLTQFLEHLVSEGSQDVHVHNALGKIIIDSNNNPEHFLTTNPYYDSRVVGKYCEKRDPTLAVVAYRRGQCDDELINVTNKNSLFKLQARYVVERMDGDLWEKVLNPENVYRRQLIDQVVSTALPESKSPEQVSAAVKAFMTADLPHELIELLEKIVLQNSAFSGNFNLQNLLILTAIKADPSRVMDYINRLDNFDGPAVGEVAVEAQLYEEAFAIFKKFNLNVQAVNVLLDNIRSIERAVEFAFRVEEDAVWSQVGKAQLREGLVSDAIESFIRADDATQFLDVIRASEDADVYHDLVRYLLMVRQKVKEPKVDSELIYAYAKIDRLSDIEEFILMPNVANLQNVGDRLYDEALYEAAKIIFAFISNWAKLAITLVKLRQFQGAVDAARKANSSKTWKEVCFACVDAEEFRLAQICGLNIIIQVDDLEEVSEYYQNRGCFNELISLMESGLGLERAHMGIFTELGVLYARYRPEKLMEHIKLFSTRLNIPKLIRACDEQQHWKELTYLYIQYDEFDNAATTIMNHSPEAWDHMQFKDVAVKVANVELYYKAVHFYLQEHPDLINDLLNVLALRVDHTRVVDIMRKAGHLHLVKPYMVAVQSNNVAAVNEALNGIYVEEEDYDRLRESIDLHDNFDQIGLAQKIEKHELLEMRRVAAYIYKKAGRWKQSIALSKKDNLYKDAMETASQSGDRELAEELLVYFIEKGKKECFASCLFVCYDLIRADIALELAWMNNMIDFALPYLLQFIREYTGKVDELVKDKIEALNEVKIKEKEEKDVIQQQNMYAQLLPLALPAPPMPGMGGAPGMGGFVPPPMGGMGMPPMPPFGMPPMGSSY

SEQ ID NO: 9578 - protein, 1702 aa, Gossypium hirsutum
MAAANAPIAMKEVLNLPSIGISPQFITFTNVTMESEKYICVRETAPQNSVVIIDMNMPMQPLRRPITADSALMNPNSRILALKAQLPGTTQDHLQIFNIELKAKIKSHQMPEQVVFWKWISPKLLGLVTQTSVYHWSIEGESEPVKMFERTANLANNQIINYKWDPSEKWLVLIGIAPGAPERPQLVKGNMQLFSVDQQRSQALEAHAASFAQFKVPGNENPSILISFATKSFNAGQITSKLHVIELGAQPGKSSFSKKQADLFFPPDFQDDFPVAMQISHKYALIYVITKLGLLFVYDLETATAVYRNRISPDPIFLTSEASAVGGFYAINRRGQVLLATVNEATLVPFVSGQLNNLELAVSLAKRGNLPGAENLVVQRFQELFAQTKYKEAAELAAESPQGILRTPDTVAKFQSVPVQAGQTAPLLQYFSILLTRGKLNAFESLELSRLVVNQNKKNLLENWLAEDKLECSEELGDLVKTVDNDLALKIYIKARATPKVVAAFAERREFDKILIYSKQVGYTPDYLFLLQTILRTDPQGAVNFALMMSQMEGGCPVDYNTITDLFLQRNLIREATAFLLDVLKPNLPEHAFLQTKVLEINLVTFPNVADAILANGMFSHYDRPRIAQLCEKAGLYVRALQHYSELPDIKRVIVNTHAIEPQSLVEFFGTLSREWALECMKDLLLVNLRGNLQIIVQVAKEYCEQLGVDSCIKIFEQFKSYEGLYFFLGSCLSSSEDPDIHFKYIEAAAKTGQIKEVERVTRESNFYDAEKTKNFLMEAKLPDARPLINVCDRFGFVPDLTHYLYTNNMLRYIEGYVQKVNPGNAPLVVGQLLDDECPEDFIKGLILSVRSLLPVEPLVEECEKRNRLRLLTQFLEHLVSEGSQDVHVHNALGKIIIDSNNNPEHFLTTNPYYDSRVVGKYCEKRDPTLAVVAYRRGQCDDELINVTNKNSLFKLQARYVVERMDGDLWEKVLNPENEYRRQLIDQVVSTALPESKSPEQVSAAVKAFMTADLPHELIELLEKIVLQNSAFSGNFNLQNLLILTAIKADPSRVMDYITRLDNFDGPAVGEVAVEAQLYEEAFAIFKKFNLNVQAVNVLLDNIRSIDRAVEFAFRVEEDAVWSQVAKAQLREGLVSDAIESFIRADDATQFLDVIRASEDADVYPDLVRYLLMVRQKVKEPKVDGELIYAYAKIDRLGEIEEFILIPNVANLQNVGDRLFDEALYEAAKIIFAFISNWAKLAVTLVRLKQFQGAVDAARKANSAKTWKEVCFACVDAEEFRLAQICGLNIIIQVDDLEEVSEYYQNRGCFNELISLMESGLGLERAHMGIFTELGVLYARYRPEKLMEHIKLFSTRLNIPKLIRACDEQQHWKELTYLYIQYDEFDNAATTVMNHSPESWDHMQFKDIIVKVASVELYYKAVHFYLQEHPDLINDMLNVLALRVDHTRVVDIMRKAGHLRLVKPYMVAVQSNNVSAVNEALNEIYVEEEDYDRLRESIDLHDNFDQIGLAQKIEKHELLEMRRVAAYIYKKAGRWKQSIALSKKDNHYKDAMETASQSGERELAEELLVYFIEQGKKECFASCLFVCYDLLRADVVLELAWIHNMIDFAFPYLLQFIREYTGKVDELIKDKIEAQKEVKAKEQEEKEVIAQQNMYAQLLPLALPAPPMPGMGGGFAPPPPPMGGMGMPPSMPPFGMPPMGSY

SEQ ID NO: 9579 - protein, 1707 aa, Cucumis sativus
MAAASAPITMKEAITLPSIGINPQFITFTHVTMESDKFICVRETAPQNSVVIIDMNMPMQPLRRPITADSALMNPNSRILALKAQVQGSTQDHLQIFNIEQKSKMKSHLMPEQVVFWKWITPKTLGLVTQTSVYHWSTDGESEPVKVFERTANLANNQIINYRCDPSEKWLVLIGIAPGSPERPQLVKGNMQLFSVDQQRSQALEAHAAAFAQFKLPGNENPSTLISFATKTLNAGQITSKLHVIELGAQPGKQSFTKKQADLFFPPDFADDFPVAMQISHKYSLIYVITKLGLLFVYDLETAAAVYRNRISPDPIFLTAEASSVGGFYAINRRGQVLLATVNEQTIISFVSGQLNNLELAVNLAKRGNLPGAENLVVQRFQELFAQTKYKEAAELAAESPQGILRTPDTVAKFQSVPVQTGQTPPLLQYFGTLLTRGKLNAFESLELSRLVVNQNKKNLLENWLGDDKLECSEELGDLVKTVDNDLALKIYIKARATPKVVAAFAERREFDKILIYSKQVGYTPDYLFLLQTILRTDPQGAVNFALMMSQMEGGCPVDYNTITDLFLQRNLIREATAFLLDVLKPNLPEHAFLQTKVLEINLVTFPNVADAILANGMFSHYDRPRIAQLCEKAGLYVRALQHYTELPDIKRVIVNTHAIEPQSLVEFFGTLSREWALECMKDLLLVNLRGNLQIIVQVAKEYCEQLGVDACIKLFEQFKSYEGLYFFLGSYLSSSEDPDIHFKYIESAAKTGQIKEVERVTRESNFYDAEKTKNFLMEAKLPDARPLINVCDRFGFVPDLTHYLYTNNMLRYIEGYVQKVNPGNAPLVVGQLLDDECPEDFIKGLILSVRSLLPVEPLVDECEKRNRLRLLTQFLEHLVSEGSQDVHVHNALGKIIIDSNNNPEHFLTTNPYYDSRVVGKYCEKRDPTLAVVAYRRGQCDDELINVTNKNSLFKLQARYVVERMDGDLWEKVLNPENEYRRQLIDQVVSTALPESKSPEQVSAAVKAFMTADLPHELIELLEKIVLQNSAFSGNFNLQNLLILTAIKADPSRVMDYINRLDNFDGPAVGEVAVEAQLYEEAFAIFKKFNLNVQAVNVLLDNIQSIERAVEFAFRVEEDAVWSQVAKAQLREGLVSDAIESFIRADDATQFLEVIRAAEDANVYHDLVRYLLMVREKAKEPKVDSELIYAYAKIDRLAEIEEFILMPNVANLQNVGDRLYDEALYEAAKIIFAFISNWAKLAVTLVKLKQFQGAVDAARKANSAKTWKEVCFACVDAEEFRLAQICGLNIIIQVDDLEEVSEYYQNRGCFNELISLMESGLGLERAHMGIFTELGVLYARYRHEKLMEHIKLFSTRLNIPKLIRACDEQQHWKELTYLYIQYDEFDNAATTIMNHSPEAWDHMQFKDVAVKVANVELYYKAVHFYLQEHPDLINDLLNVLALRVDHTRVVDIMRKAGHLLLVKPYMIAVQSNNVSAVNEALNGIYVEEEDYDRLRESIDLHDNFDQIGLAQKIEKHELLEMRRVAAYIYKKAGRWKQSIALSKKDNLYKDAMETASQSGDRELAEELLVYFIEQGKKECFASCLFVCYDLIRADVALELAWINNMVDFAFPYLLQFIREYTGKVDELVKDKIEAAKEVKAKEQEEKDVIAQQNMYAQLLPLALPAPPMPGMGGGPGMPGFVPGPPQMGGLGMPPMPPFGMPPMGSSY

SEQ ID NO: 9580 - protein, 1705 aa, Eucalyptus grandis
MAAANAPIAMKEALTLPSVGINPQFITFTHVTMESDKYICVRETSPQNSVVIIDMSMPNQPLRRPITADSALMNPNSRILALKAQLPGTTQDHLQIFNIEMKAKMKSHQMPEQVVFWKWITPKMLGLVTQTSVYHWSIEGDSEPVKMFERTANLVNNQIINYRCDPSEKWLVLVGIAPGSPERPQLVKGNMQLFSVDQQRSQALEAHAAAFASFKVPGNENPSTLISFATKAINAGQVTSKLHVIELGAQPGKASFTKKQADLFFPPDFADDFPVAMQISHQYGLIYAITKLGLLFVYDLETATAVYRNRISPDPIFLTAEASSIGGFYAINRRGQVLLATVNEATIVPFVSGQLNNLELAVNLAKRGNLPGAEQLVVQRFQELFAQTKYKEAAELAAESPQGILRTPDTVAKFQSVPVQSGQTPPLLQYFGTLLTRGKLNAFESLELSRLVVNQNKKNLLENWLAEDKLECSEELGDLVKTVDNDLALKIYIKARATPKVVAAFAERREFDKILIYSKQVGYNPDYLFLLQTILRTDAQGALNFALMMSQMEGGCPVDYNTITDLFLQRNLIREATAFLLDVLKPNLPEHGFLQSKVLEINLVTFPNVADAILANGMFSHYDRPRIAQLCEKAGLYVRALQHYSELPDIKRVIVNTHAIEPQSLVEFFGTLSREWALECMKDLLLVNLRGNLQIIVQVAKEYCEQLGVEPCIKIFEQFKSYEGLYFFLGSYLSSSEDPDIHFKYIEAAAKTGQIKEVERVTRESNFYDPEKTKNFLMEAKLPDARPLINVCDRFGFVPDLTHYLYTNNMLRYIEGYVQKVNPGNTPLVVGQLLDDECPEDFIKGLILSVRSLLPVEPLVDECEKRNRLRLLTQFLEHLVSEGSQDVHVHNALGKIIIDSNNNPEHFLTTNPYYDSRVVGKYCEKRDPTLAVVAYRRGQCDEELINVTNKNSLFKLQARYVVERMDGDLWEKVLNPENEYRRQLIDQVVSTALPESKSPEQVSAAVKAFMTADLPHELIELLEKIVLQNSAFSGNFNLQNLLILTAIKADPSRVMDYVNRLDNFDGPAVGEVAVEAQLYEEAFAIFKKFNMNVQAVNVLLDNIRSIERAVEFAFRVEEEAVWSQVAKAQLREGLVSDAIESFIRADDATQFLDVIQAAENANVYHDLVKYLLMVRQKAKEPKVDSELIYAYAKIDRLGEIEEFILMPNVANLQNVGDRLFDEALYEAAKIIFAFISNWAKLACTLVKLRQFQGAVDAARKANSAKTWKEVCFACVDAEEFRLAQICGLNIIVQVDDLEEVSEYYQNRGCFNELISLMESGLGLERAHMGIFTELGVLYARYRHEKLMEHIKLFSTRLNIPKLIRACDEQQHWKELTYLYILYDEFDNAATTIMNHSPEAWDHMQFKDVIVKVASVELYYKAVHFYLQEHPDQINDVLNVLALRVDHTRVVDIMRKAGHLRLVKPYMVAVQSNNVSAVNEALNEIYVEEEDYDRLRESIDLHDNFDMIGLAQKIEKHELLEMRRVAAYIYKKAGRWKLSIALSKKDNLYKDAMETASQSGERELAEELLVYFIEKGKKECFASCLFVCYDLIRADVALELAWMNNMVDFAFPYLLQFIREYTGKVDELIKDKIESQNEVKAKEKEEKDVIAQQNMYAQLLPLALPAPPMPGMGGPGMGGGFGPPPPMGGMGMPPMPPFGMPPMGSY

SEQ ID NO: 9581 - protein, 1702 aa, Amsonia hubrichtii
MAAANAPITMKEALTLTSIGINPQFITFTNVTMESDKYICVRETAPQNSVVIIDMSMPMQPLRRPITADSALMNPNTRILALKAQLPGTTQDHLQIFNIEAKAKMKSHQMPEQVVFWKWITPKMLGLVTQTSVYHWSIEGESEPVKMFDRTANLSNNQIINYRCDPSEKWLVLIGIAPGSPERPQLVKGNMQLFSVDQQRSQALEAHAASFASFRVPGNDKDSILISFATKSSNAGQVTSKLHVIELGAQPGKPSFSKKQADLFFPPDFADDFPVAMQISQKYSLIFVITKLGLLFVYDLETATAVYRNRISPDPIFLTSEAASVGGFYSINRRGQVLLATVNEATIVPFVSGQLNNLELAVNLAKRGNLPGAENLVVQRFQELFAQTKYKEAAELAAESPQGILRTPDTVAKFQSVPVQAGQTPPLLQYFGTLLTRGKLNAFESLELSRLVVNQNKKNLLENWLAEDKLECSEELGDLVKTVDNDLALKIYIKARATPKVVAAFAERREFDKILIYSKQVGYTPDYLFLLQTILRSDPQGAVNFALMMSQMEGGCPLDYNTITDLFLQRNLIREATAFLLDVLKPNLPEHAYLQTKVLEINLVTFPNVADAILANGMFSHYDRPRIAQLCEKAGLYMRALQHYAELPDIKRVIVNTHAIEPQSLVEFFGTLSREWALECMKDLLLVNLRGNLQIIVQVAKEYCEQLGVDACIKLFEQFKSYEGLYFFLGSYLSSSEDPDIHFKYIEAAAKTGQIKEVERVTRESNFYDAEKTKNFLMEAKLPDARPLINVCDRFGFVPDLTHYLYTNNMLRYIEGYVQKVNPGNAPLVVGQLLDDECPEDFIKGLILSVRSLLPVEPLVEECEKRNRLRLLTQFLEHLVSEGSQDVHVHNALGKIIIDSNNNPEHFLTTNPYYDSRVVGKYCEKRDPTLAVVAYRRGQCDDELINVTNKNSLFKLQARYVVERMDGDLWEKVLNPENEFRRQLIDQVVSTALPESKSPEQVSASVKAFMTADLPHELIELLEKIVLQNSAFSGNFNLQNLLILTAIKADPSRVMDYINRLDNFDGPAVGEVAVEAQLYEEAFAIFKKFNLNVQAVNVLLDNIRDINRAVEFAFRVEEEAVWSQVAKAQLREGLVSDAIESFIRADDATQFLEVIRAAEDADVYHDLVKYLLMVRQKTKEPKVDSEIIYAYAKIDRLGDIEEFILMPNVANLPNVGDRLYDEALYEAAKIIFAFISNWAKLAITLVKLKQFQGAVDAARKANSSKTWKEVCFACVDAEEFRLAQICGLNIIVQVDDLEEVSEYYQNRGCFNELISLMESGLGLERAHMGIFTELGVLYARYRHEKLMEHIKLFSTRLNIPKLIRACDEQQHWKELTYLYIQYDEFDNAGTTVMNHSPDAWDHMQFKDIIVKVANVELYYKAVHFYLQEHPDLINDLLNVLALRVDHSRVVDIMRKAGHLRLVKPYMVAVQSNNVSAVNEALNEIYVEEEDYDRLRESIDLHDNFDQIGLAQKIEKHELLEMRRVAAYIYKKAGRWKQSIALSKKDNLYKDAMETASQSGDRELAEELLVYFIEQGKKECFASCLFVCYDLIRADVALELAWMNNMIDFAFPYLLQFIREYTGKVDDLIKDKIEAMNEVKAKENEEKDVIKQQNMYAQLLPLALPAPPMPGMGGGFAPPPPPPMGGMGMPPMPPFGMPPMGSY

SEQ ID NO: 9582 - protein, 1705 aa, Quercus alba
MAAANAPITMKEALTLPSIGINPQFITFTHVTMESDKYICVRETAPQNSVVIIDMSMPMQPLRRPITADSALMNPNSRILALKAQIQGTNQDHLQIFNIEMKAKMKSHQMPEQIVFWKWITPKMLGLVTQTSVYHWSIEGDSEPVKMFDRTANLANNQIINYRCDPSEKWLVLIGIAPGAPERPQLVKGNMQLFSIDQQRSQALEAHAASFAQFKVPGNDYPSVLISFATKTLNAGQITSKLHIIELGAQPGKPSFTKKQADLFFPPDFADDFPVAMQISQKYNLIYVITKLGLLFVYDMETATAVYRNRISPDPIFLTAEASSLGGFYAVNRRGQVLLATVNEQTIVPFVSGQLNNLELAVNLAKRGNLPGAEQLVVQRFQELFAQTKYKEAAELAAESPQGILRTPDTVAKFQSVPVQAGQTPPLLQYFGTLLTRGKLNAFESLELSRLVVNQNKKNLLENWLAEDKLECSEELGDLVKTVDNDLALKIYIKARATPKVVAAFAERREFDKILIYSKQVGYTPDYLFLLQTILRSDPQGAVNFALMMSQMEGGCPVDYNTITDLFLQRNLIREATAFLLDVLKPNLPEHGFLQTKVLEINLVTFPNVADAILANGMFSHYDRPRIGQLCEKAGLYIRALQHYTELPDIKRVIVNTHAIEPQSLVEFFGTLSREWALECMKDLLLVNLRGNLQIIVQAAKEYCEQLGIDSCIKLFEQFKSYEGLYFFLGSFLSSSEDPDIHFKYIEAAAKTGQIKEVERVTRESNFYDPEKTKNFLMEAKLPDARPLINVCDRFGFVPDLTHYLYSNNMLRYIEGYVQKVNPGNAPLVVGQLLDDECPEDFIKGLILSVRSLLPVEPLVEECEKRNRLRLLTQFLEHLVSEGSQDVHVHNALGKIIIDSNNNPEHFLTTNPYYDSRVVGKYCEKRDPTLAVVAYRRGQCDDELINVTNKNSLFKLQARYVVERMDGDLWEKVLNPENVFRRQLIDQVVSTALPESKSPEQVSAAVKAFMTADLPHELIELLEKIVLQNSAFSGNFNLQNLLILTAIKADPSRVMDYINRLDNFDGPAVGEVAVEAQLYEEAFAIFKKFNLNVQAVNVLLDNIRSIERAVEFAFRVEEDAVWSQVGKAQLREGLVSDAIESFIRADDATQFLDVIRASEDADVYHDLVRYLLMVRQKVKEPKVDSELIYAYAKIDRLSDIEEFILMPNVANLQNVGDRLYDEALYEAAKIIFAFISNWAKLAITLVKLRQFQGAVDAARKANSSKTWKEVCFACVDAEEFRLAQICGLNIIIQVDDLEEVSEYYQNRGCFNELISLMESGLGLERAHMGIFTELGVLYARYRPEKLMEHIKLFSTRLNIPKLIRACDEQQHWKELTYLYIQYDEFDNAATTIMNHSPEAWDHMQFKDVAVKVANVELYYKAVHFYLQEHPDLINDLLNVLALRVDHTRVVDIMRKAGHLHLVKPYMVAVQSNNVAAVNEALNGIYVEEEDYDRLRESIDLHDNFDQIGLAQKIEKHELLEMRRVAAYIYKKAGRWKQSIALSKKDNLYKDAMETASQSGDRELAEELLVYFIEKGKKECFASCLFVCYDLIRADIALELAWMNNMIDFAFPYLLQFVREYTGKVDELVKDKIEALNEVKIKEKEEKDVIQQQNMYAQLLPLALPAPPMPGMGGAPGMGGFVPPPMGGMGMPPMPPFGMPPMGSSY

SEQ ID NO: 9583 - protein, 1702 aa, Tabernaemontana elegans
MAAANAPITMKESLTLTSIGINPQFITFTNVTMESDKYICVRETAPQNSVVIIDMSMPMQPLRRPITADSALMNPNTRILALKAQLPGTTQDHLQIFNIEAKAKMKSHQMPEQVVFWKWITPKMLGLVTQTSVYHWSIEGESEPVKMFDRTANLANNQIINYRCDPSEKWLVLIGIAPGTPERPQLVKGNMQLFSVDQQRSQALEAHAASFASFRVTGNDKDSILISFATKSSNAGQVTSKLHVIELGAQSGKPSFTKKQADLFFPPDFADDFPVAMQISQKYSLIYVITKLGLLFVYDLETATAVYRNRISPDPIFLTSEASSVGGFYAINRRGQVLLATVNEATIVPFVSGQLNNLELAVNLAKRGNLPGAENLVVQRFQELFAQTKYKEAAELAAESPQGILRTPDTVAKFQSVPVQAGQTPPLLQYFGTLLTRGKLNAFESLELSRLVVNQNKKNLLENWLAEDKLECSEELGDLVKTVDNDLALKIYIKARATPKVVAAFAERREFDKILIYSKQVGYTPDYLFLLQTILRSDPQGAVNFALMMSQMEGGCPLDYNTITDLFLQRNMIREATAFLLDVLKPNLPEHAYLQTKVLEINLVTFPNVADAILANGMFSHYDRPRIAQLCEKAGLYMRALQHYSELPDIKRVIVNTHAIEPQSLVEFFGTLSREWALECMKDLLLVNLRGNLQIIVQVAKEYCEQLGVDACIKLFEQFKSYEGLYFFLGSYLSSSEDPDIHFKYIEAAAKTGQIKEVERVTRESNFYDAEKTKNFLMEAKLPDARPLINVCDRFGFVPDLTHYLYTNNMLRYIEGYVQKVNPGNAPLVVGQLLDDECPEDFIKGLILSVRSLLPVEPLVEECEKRNRLRLLTQFLEHLVSEGSQDVHVHNALGKIIIDSNNNPEHFLTTNPYYDSRVVGKYCEKRDPTLAVVAYRRGQCDDELINVTNKNSLFKLQARYVVERMDADLWEKVLNPENEFRRQLIDQVVSTALPESKSPEQVSAAVKAFMTADLPHELIELLEKIVLQNSAFSGNFNLQNLLILTAIKADPSRVMDYINRLDNFDGPAVGEVAVEAQLYEEAFAIFKKFNLNVQAVNVLLDNIRDINRAVEFAFRVEEEAVWSQVAKAQLREGLVSDAIESFIRADDATQFLEVIRAAEDAEVYHDLVKYLLMVRQKAKEPKVDSEIIYAYAKIDRLGDIEEFILMPNVANLPNVGDRLYDEALYEAAKIIFAFISNWAKLASTLVKLKQFQGAVDAARKANSSKTWKEVCFACVDAEEFRLAQICGLNIIVQVDDLEEVSEYYQNRGCFNELISLMESGLGLERAHMGIFTELGVLYARYRHEKLMEHIKLFSTRLNIPKLIRACDEQQHWQELTYLYIQYDEFDNAATTVMNHSPDAWDHMQFKDIIVKVANVELYYKAVHFYLQEHPDLINDLLNVLALRVDHSRVVDIMRKAGHLRLVKPYMVAVQSNNVSAVNEALNEIYVEEEDYDRLRESIDLHDNFDQIGLAQKIEKHELLEMRRVAAYIYKKAGRWKQSIALSKKDNLYKDAMETASQSGDRELAEELLVYFIEQGKKECFASCLFVCYDLIRADVALELAWMNNMIDFAFPYLLQFIREYTGKVDELIKDKIEAVNEVKAKENEEKDIIKQQNMYAQLLPLALPAPPMPGMGGGFAPPQPTPMSGMGMPPMPPFGMPPMGSY

SEQ ID NO: 9584 - protein, 1701 aa, Gossypium raimondii
MAAANAPIAMKEVLTLPSIGISPQFITFTNVTMESDKYICVRETAPQNSVVIIDMNMPMQPLRRPITADSALVNPNSRILALKAQLPGTTQDHLQIFNIEMKAKMKSHQMPEQVVFWKWISPKLLGLVTLTSVYHWSIEGDSEPVKMFERTANLVNNQIINYKCDPSEKWLVLIGIAPGAPEKPQLVKGNMQLFSVDQQRSQALEAHAASFAQFKVPGNENPSILISFATKSFNAGQITSKLHVIELGAQPGKPSFSKKQADLFFPPDFQDDFPVAMQISHKYGLIFVITKLGLLFVYDLETASAVYRNRISPDPIFLTSEASAAGGFYAINRRGQVLLATVNEATIVPFVSGQLNNLELAVNLAKRGNLPGAENLVVQRFQELFAQTKYKEAAELAAESPQGILRTPDTVAKFQSVPVQAGQTPPLLQYFGTLLTRGKLNAFESLELSRLVVNQNKKNLLENWLAEDKLECSEELGDLVKTVDNDLALKIYIKARATPKVVAAFAERREFDKILIYSKQVGYTPDYLFLLQTILRTDPQGAVNFALMMSQMEGGCPVDYNTITDLFLQRNLIREATAFLLDVLKPNLPEHAFLQTKVLEINLVTFPNVADAILANGMFTHYDRPRIAQLCEKAGLFVRALQHYTELPDIKRVIVNTHAIEPQSLVEFFGTLSREWALECMKDLLLVNLRGNLQIIVQVAKEYCEQLGVDACIKLFEQFKSYEGLYFFLGSYLSSSEDPDIHFKYIEAAAKTGQIKEVERVTRESNFYDAEKTKNFLMEAKLPDARPLINVCDRFGFVPDLTHYLYTNNMLRYIEGYVQKVNPGNAPLVVGQLLDDECAEDFIKGLILSVRSLLPVEPLVEECEKRNRLRLLTQFLEHLVSEGSQDVHVHNALGKIIIDSNNNPEHFLTTNPYYDSRVVGKYCEKRDPTLAVVAYRRGQCDDELINVTNKNSLFKLQARYVVERMDGDLWEKVLNPENEYRRQLIDQVVSTALPESKSPEQVSATVKAFMTADLPHELIELLEKIVLQNSAFSGNFNLQNLLILTAIKADPSRVMDYINRLDNFDGPAVGEVAVEAQLYEEAFAIFKKFNLNVQAVNVLLDNIRSIDRAVEFAFRVEEDAVWSQVAKAQLREGLVSDAIESFIRADDATQFLDVIRASEDADVYSDLVRYLLMVRQKVKEPKVDSELIYAYAKTDRLGEIEEFILMPNVANLQNVGDRLFDEALYEAAKIIFAFISNWAKLAVTLVRLKQFQGAVDAARKANSAKTWKEVCFACVDAEEFRLAQICGLNVIIQVDDLEEVSEYYQNRGCFNELISLMESGLGLERAHMGIFTELGVLYARYRAEKLMEHIKLFSTRLNIPKLIRACDEQQHWKELTYLYIQYDEFDNAATTVMNHSPEAWDHMQFKDIIVKVASVELYYKAVHFYLQEHPDLINDMLNVLALRVDHTRVVDIMRKAGHLRLVKPYMVAVQSNNVSAVNEALNEIYVEEEDYDRLRESIDLHDNFDQIGLAQKIEKHELLEMRRVAAYIYKKAGRWKQSIALSKKDNLYKDAMETASQSGDRELAEELLVYFIEQGKKECFAACLFVCYDLIRPDVALEMAWVNNMIDFTFPFLLQFIREYTGKVDELIKDKIEAQKDVKAKEQEEKEVIAQQNMYAQLLPLALPAPPMPGMGGGFAPPPPMGGGMGMPPMPPYGMPQMGSY

SEQ ID NO: 9585 - protein, 1697 aa, Papaver somniferum
MKEALTLPSIGITPQFITFTHVTMESDKYICVRETSPQNSVVIIDMSMPNQPLRRPITADSALMNPNSRILALKAQLPGTTQDHLQIFNIEMKAKMKSHQMPEQVVFWKWISPKMLGLVTQTSVYHWSIEGESDPVKMFDRTANLASNQIINYRCDPSEKWLVLIGIAPGSPERPQLVKGNMQLFSVEQQRSQSLEAHAASFASHKIPGNENPSTLICFATKTTNAGQITSKLHVIELGAQPGKPAFSKKQADLFFPPDFADDFPVSMQISHKYSLIYVITKLGLLFVYDLETATAVYRNRISPDPIFLTAEASSVGGFYAVNRRGQVLLATVNEATIVPFVSGQLNNLELAVNLAKRGNLPGAENLVVQRFQELFSQTKYKEAAELAAESPQGILRTPDTVAKFQSVPVQAGQTPPLLQYFGTLLTRGKLNAFESLELSRLVVNQNKKNLLENWLAEDKLECSEELGDLVKTVDNDLALKIYIKARATPKVVAAFAERREFDKILIYSKQVGYTPDYLFLLQTILRSDPQGAVNFALMMSQMEGGCPVDYNTITDLFLQRNLIREATAFLLDVLKPNLPEHGFLQTKVLEINLVTFPNVADAILANGMFSHYDRPRVAQLCEKAGLYVRALQHYAELPDIKRVIVNTHAIEPQSLVEFFGTLSKEWALECMKDLLLVNLRGNLQIIVQTAKEYSEQLGVEACIKLFEQFKSYEGLYFFLGSYLSSSEDPEIHFKYIEAAAKTGQIKEVERVTRESNFYDAEKTKNFLMEAKLPDARPLINVCDRFGYVPDLTHYLYTNNMLRYIEGYVQKVNPGNAPLVVGQLLDDECPEDFIKGLILSVRSLLPVEPLVDECEKRNRLRLLTQFLEHLVSEGSQDVHVHNALGKIIIDSNNNPEHFLTTNPYYDSRVVGKYCEKRDPTLAVVAYRRGQCDSELINVTNKNSLFKLQARYVVERMDSDLWDLVLNPENEYRRQLIDQVVSTALPESKSPEQVSAAVKAFMTADLPHELIELLEKIVLQNSAFSGNFNLQNLLILTAIKADASRVMDYINRLDNFDGPAVGEVAVEAQLFEEAFAIFKKFNLNVQAVNVLLDNIQSIERAEEFAFRVEEDAVWSQVAKAQLREGLVSEAIESFIRADDATHFLDVIKASEDANVYHDLVKYLLMVRQKSKEPKVDSELIYAYAKIDRLGDIEEFILMPNVANLQSVGDRLYDEELYEAAKIIFAFISNWAKLAVCLVKLRQFQGAVDAARKANSAKTWKEICFACVDAEEFRLAQICGLNIIIQVDDLEEVSQFYQNRGCFNELISLMESGLGLERAHMGIFTELGVLYARYRPEKLMEHIKLFSTRLNIPKLIRACDEQQHWKELVYLYIQYDEFDNAATTIMNHSPEAWDHMQFKDVAVKVANVELYYKAVHFYLQEHPDLINDMLNVLALRVDHTRVVDIMRKAGHLLLVKPYMVAVQSNNVSAVNEALNQIYVEEEDYDRLRESIDMHDNFDQIGLAQKVEKHELLEMRRIAAYIYKKAGRWRQSIALSKKDNLYKDAMETCSQSGYRELSEELLVYFIEQGKKECFASCLFVCYDLIRPDVALELAWMNNMIDFAFPYLLQFIREYTGKVDELVKDRIAAQSEVKVKEQEEKDMVAQQNMYAQLLPLALPAPPMPGMGGGGGMGGGYGPPPPMGGMGMPPMPAYGMPPMGYQ

SEQ ID NO: 9586 - protein, 1701 aa, Prunus persica
MAAANAPITMKEALTLPSVGINPQFITFTHVTMESDKYICVRETSPQNSIVIIDMSMPMQPLRRPITADSALMNPNSKILALKAQVQGTTQDHLQIFNIEMKAKLKSHLMPEQIVFWKWITPKMLGLVTQTTVYHWSIEGESEPVKVFERTANLANNQIINYRCDPSEKWLVLVGIAPGAPERPQLVKGNLQLFSVDQQRSQALEAHAASFAQYKVPGNENPSTLISFATKTLNAGQITSKLHVIELGAQPGKPSFTKKQADLFFPPDFADDFPVAMQMSHKYSLIYVITKLGLLFVYDLETASAVYRNRISPDPIFLTTEASSVGGFYAVNRRGQVLLATINEQTIVPFVSGQLNNLELAVNLAKRGNLPGAENLVVQRFQELFAQTKYKEAAELAAESPQGILRTPDTVAKFQSVPVQTGQTPPLLQYFGTLLTRGKLNAFESLELSRLVVNQNKKNLLENWLAEDKLECSEELGDLVKTVDNDLALKIYIKARATPKVVAAFAERREFDKILIYSKQVGYTPDYLFLLQTILRADPQGAVNFALMMSQMEGGCPVDYNTITDLFLQRNLIREATAFLLDVLKPNLPEHAFLQTKVLEINLVTFPNVADAILANGMFSHYDRPRIAQLCEKAGLYVRALQHYSELPDIKRVIVNTHAIEPQSLVEFFGTLSREWALECMKDLLLVNLRGNLQIIVQVAKEYSEQLGVDQCMKLFEQFKSYEGLYFFLGSFLSSSEDPDIHFKYIEAAAKTGQIKEVERVTRESNFYDAEKTKNFLMEAKLPDARPLINVCDRFGFVPDLTHYLYTNNMLRYIEGYVQKVNPGNAPLVVGQLLDDECPEDFIKGLILSVRSLLPVEPLVEECEKRNRLRLLTQFLEHLVSEGSQDVHVHNALGKIIIDSGNNPEHFLTTNPYYDSRVVGKYCEKRDPTLAVVAYRRGQCDDELINVTNKNSLFKLQARYVVERMDEDLWGKVLDPENEYRRQLIDQVVSTALPESKSPEQVSAAVKAFMTADLPHELIELLEKIVLQNSAFSGNFNLQNLLILTAIKADPSRVMDYINRLDNFDGPAVGEVAVEAQLYEEAFAIFKKFNLNVQAVNVLLDNIRSIDRAVEFAFRVEEDAVWSQVAKAQLREGLVSDAIESFIRADDATQFLDVIRASEDADVYHDLVRYLLMVRQKAREPKVDSELIYAYAKIDRLADIEEFILMPNVANLQNVGDRLYDEALYEAAKIIFAFISNWAKLAITLVKLKQFQGAVDAARKANSAKTWKEVCFACVDAEEFRLAQICGLNIIIQVDDLEEVSEYYQNRGCFNELISLMESGLGLERAHMGIFTELGVLYARYRPEKLMEHIKLFANRLNIPKLIRACDEQQHWKELTYLYIQYDEFDNAATTIMNHSPEAWDHMQFKDVAVKVANVELYYKAVHFYLQEHPDLINDLLNVLALRVDHTRVVDIMRKAGHLLLVKPYMVAVQSNNVSAVNEALNAIYVEEEDYERLRESIDLHDSFDQIGLAQKIEKHELLEMRRVAAYIYKKAGRWKQSIGLSKKDKLYKDAMETASQSGDRELAEELLVYFIEQGKKECFASCLFVCYDLIRADVVLELAWMNNMIDFAFPYLLQFIREYTGKVDELVKDKLEAQKEVKAKEQEEKEVIAQQNMYAQLLPLALPAPPMPGMGGGFAPPPPMGGMPPMGMPPFGMPPMGSSY

SEQ ID NO: 9587 - protein, 1700 aa, Glycine max
MAAANAPIAMREALTLPSIGINPQFITFTHVTMESDKYICVRETAPQNSVVIIDMNMPNQPLRRPITADSALMNPNSRILALKAQLQGTTQDHLQIFNIEMKAKMKSYQMPEQVVFWKWITPKLLGLVTQTSVYHWSIEGDSEPVKMFERTANLANNQIINYRCDPSEKWLVLIGIAPGSPERPQLVKGNMQLFSVDQQRSQALEAHAASFAQFKVPGNENPSTLISFATKTLNAGQIISKLHVIELGAQPGKPSFTKKQADLFFPPDFADDFPVAMQISHKYSLIYVITKLGLLFVYDLETATAVYRNRISPDPIFLTSEATSVGGFYAINRRGQVLLATVNEQTIVNFVSGQLNNLELAVNLAKRGNLPGAEKLVVERFHELFAQTKYKEAAELAAESPQGILRTPDTVAKFQSVPVQAGQTPPLLQYFGTLLTRGKLNAFESLELSRLVVNQNKKNLLENWLAEDKLECSEELGDLVKTVDNDLALKIYIKARATPKVVAAFAERREFDKILIYSKQVGYTPDYLFLLQTILRTDPQGAVNFALMMSQMEGGCPVDYNTITDLFLQRNLIREATAFLLDVLKPNLPEHGYLQTKVLEINLVTFPNVADAILANGMFSHYDRPRIAQLCEKAGLYVRALQHYTELPDIKRVIVNTHAIEPQSLVEFFGTLSREWALECMKDLLLVNLRGNLQIIVQVAKEYCEQLGVDACIKLFEQFRSYEGLYFFLGSYLSSSEDPDIHFKYIEAAAKTGQIKEVERVTRESSFYDPEKTKNFLMEAKLPDARPLINVCDRFGFVPDLTHYLYTNNMLRYIEGYVQKVNPGNAPLVVGQLLDDECPEDFIKGLILSVRSLLPVEPLVEECEKRNRLRLLTQFLEHLVSEGSQDVHVHNALGKIIIDSNNNPEHFLTTNPYYDSRVVGKYCEKRDPTLAVVAYRRGQCDDELINVTNKNSLFKLQARYVVERMDGDLWEKVLNPDNAYRRQLIDQVVSTALPESKSPEQVSAAVKAFMTADLPHELIELLEKIVLQNSAFSGNFNLQNLLILTAIKADPSRVMDYINRLDNFDGPAVGEMAVEAQLYEEAFAIFKKFNLNVQAVNVLLDHIHSIDRAVEFAFRVEEDAVWSQVAKAQLREGLVSDAIESFIRADDATQFLDVIRAAEDGNAYHDLVRYLLMVRHKTKEPKVDSELIYAYAKIDRLSDIEEFILMPNVANLQNVGDRLYDEELYEAAKIIFAFISNWAKLAVTLVKLKQFQGAVDAARKANSAKTWKEVCFACVDAEEFRLAQICGLNIIIQVDDLEEVSEYYQNRGCFNELISLMESGLGLERAHMGIFTELGVLYARYRHEKLMEHIKLFATRLNIPKLIRACDEQQHWKELTYLYIQYDEFDNAATTIMNHSPEAWDHMQFKDVVVKVANVELYYKAVHFYLQEHPDLINDVLNVLALRVDHARVVDIMRKAGHLRLVKPYMVAVQSNNVSAVNEALNEIYVEEEDYDRLRESIDLHDNFDQIGLAQKIEKHELLEMRRVAAYIYKKAGRWKQSIALSKKDNLYKDAMETASQSGDRELAEELLVYFIDQGKKECFASCLFVCYDLIRADIALELAWMNNMIDFAFPYLLQFIREYTGKVDELVKDKIEAQNQVKAKEQEEKEVIAQQNMYAQLLPLALPAPPMPGMGGGFAPPPPMGGLGMPPMPPFGMPPMGSY

SEQ ID NO: 9588 - protein, 1705 aa, Malus domestica
MAAANAPITMKEALTLPSVGINPQFITFTHVTMESDKYICVRETSPQNSIVIIDMSMPMQPLRRPITADSALMNPNSKILALKAGVQGTTQDHLQIFNIEMKAKLKSHLMPEQIVFWKWITPKMLGLVTQTTVYHWSIEGESEPVKVFERTANLANNQIINYRCDPSEKWLVLIGIAPGAPERPQLVKGNLQLFSVDQQRSQALEAHAASFAQYKVPGNENPSTLISFATKTLNAGQITSKLHVIELGAQPGKPSFTKKQADLFFPPDFNDDFPVAMQMSHKYSLIYVITKLGLLFVYDLETASAVYRNRISPDPIFLTTEASSVGGFYAVNRRGQVLLATINEQTIVPFVSGQLNNLELAVNLAKRGNLPGAENLVVQRFQELFAQTKYKEAAELAAESPQGILRTPDTVAKFQSVPVQAGQTPPLLQYFGTLLTRGKLNAFESLELSRLVVNQNKKNLLENWLAEDKLECSEELGDLVKTVDNDLALKIYIKARATPKVVAAFAERREFDKILIYSKQVGYTPDYLFLLQTILRADPQGAVNFALMMSQMEGGCPVDYNTITDLFLQRNLIREATAFLLDVLKPNLPEHAFLQTKVLEINLVTFPNVADAILANGMFSHYDRPRIAQLCEKAGLYVRALQHYSELPDIKRVIVNTHAIEPQSLVEFFGTLSKEWALECMKDLLLVNLRGNLQIIVQVAKEYSEQLGVDQCMKLFEQFKSYEGLYFFLGSFLSSSEDPDIHFKYIEAAAKTGQIKEVERVTRESNFYDAEKTKNFLMEAKLPDARPLINVCDRFGFVPDLTHYLYTNNMLRYIEGYVQKVNPGNAPLVVGQLLDDECPEDFIKGLILSVRSLLPVEPLVEECEKRNRLRLLTQFLEHLVSEGSQDVHVHNALGKIIIDSGNNPEHFLTTNPYYDSRVVGKYCEKRDPTLAVVAYRRGQCDDELINVTNKNSLFKLQARYVVERMDEDLWGKVLDPENEYRRQLIDQVVSTALPESKSPEQVSASVKAFMTADLPHELIELLEKIVLQNSAFSGNFNLQNLLILTAIKADPSRVMDYINRLDNFDGPAVGEVAVEAQLYEEAFAIFKKFNLNVQAVNVLLDNIRSIDRAVEFAFRVEEDAVWSQVAKAQLREGLVSDAIESFIRADDATQFLDVIRASEDADVYHDLVKYLLMVRQKVREPKVDSELIYAYAKIDRLADIEEFILMPNVANLQNVGDRLYDEALYEAAKIIYAFISNWAKLAVTLVKLKQFQGAVDAARKANSSKTWKEVCFACVDAEEFRLAQICGLNIIIQVDDLEEVSEYYQNRGCFNELISLMESGLGLERAHMGIFTELGVLYARYRPEKLMEHIKLFANRLNIPKLIRACDEQQHWKELTYLYIQYDEFDNAATTIMNHSPEAWDHMQFKDVAVKVANVELYYKAVHFYLKEHPDLINDLLNVLALRVDHTRVVDIMRKAGHLLLVKPYMVAVQSNNVSAVNEALNEIYVEEEDYERLRESIDLHDSFDQIGLAQKIEKHELLEMRRVAAYIYKKAGRWKQSIGLSKKDKLYKDAMETASQSGDRELAEELLVYFIEQGKKECFASCLFVCYDLIRPDIALELAWMNNMIDFAFPYLLQFIREYTGKVDELVKDKIEAQKEIKAKEQEDKEVIAQQNMYAQLLPLALPAPPIPGMSGGMGGGYAPPPPMGGMPPMGMPPYGMPPMGSSY

SEQ ID NO: 9589 - protein, 1710 aa, Manihot esculenta
MAATNAPITMKEVLTLPSIGINPQFITFTNVTMESDKYICVRETAPQNSVVIVDMNMPMQPLRRPITADSALMNPNSRILALKAQLPGTTQDHLQIFNIEMKAKMKSHQMPEQVVFWKWISPKMLGLVTQTSVYHWSIEGKIPLCDSDPVKMFDRTANLVNNQIINYKCDPSEKWLVLIGIAPGSPERQQLVKGNMQLFSVDQQRSQALEAHAASFAQFKVPGNENPSILISFATKTFNAGQITSKLHVIELGAQPGKPAFTKKQADLFFPPDFADDFPVAMQISHKYSLIFVITKLGLLFVYDLETATAVYRNRISPDPIFLTAEASSVGGFYAINRRGQVLLATVNEATLVPFVSGQLNNLELAVNLAKRGNLPGAENLVVQRFQELFAQTKYKEAAELAAESPQGILRTPDTVAKFQSVPVQAGQTPPLLQYFGTLLTRGKLNAFESLELSRLVVNQNKKNLLENWLAEDKLECSEELGDLVKTVDNDLALKIYIKARATPKVVAAFAERREFDKILIYSKQVGYTPDYLFLLQTILRSDPQGAVNFALMMSQMEGGCPVDYNTITDLFLQRNLIREATAFLLDVLKPNLPEHGYLQTKVLEINLVTFPNVADAILANGMFSHYDRPRIAQLCEKAGLYIRALQHYSELPDIKRVIVNTHAIEPQALVEFFGTLSREWALECMKDLLLVNLRGNLQIIVQAAKEYCEQLGMDACIKLFEQFKSYEGLYFFLGSFLSSSEDPDIHFKYIESAAKTGQIKEVERVTRESNFYDAEKTKNFLMEAKLPDARPLINVCDRFGFVGDLTHYLYTNNMLRYIEGYVQKVNPGNAPLVVGQLLDDECPEDFIKGLILSVRSLLPVEPLVEECEKRNRLRLLTQFLEHLVSEGSQDVHVHNALGKIIIDSNNNPEHFLTTNPYYDSRIVGKYCEKRDPTLAVVAYRRGQCDDELVNVTNKNSLFKLQARYVVERMDADLWEKVLNPENEYRRQLIDQVVSTALPESKSPEQVSAAVKAFMTADLPHELIELLEKIVLQNSAFSGNFNLQNLLILTAIKADPSRVMDYINRLDNFDGPAVGEVAVEAQLYEEAFSIFKKFNLNVQAVNVLLDNIRSIDRAVEFAFRVEEDAVWSQVARAQLREGLVSDAIESFIRADDATQFLEVIRAAQDANVYHDLVRYLLMVRQKSKEPKVDSELIFAYAKIDRLSDIEEFILMPNVANLQNVGDRLFDEALYEAAKIIFAFISNWGKLASTLVKLHQFQGAVDAARKANSAKTWKEVCFACVDAEEFRLAQICGLNIIIQVDDLEEVSEYYQNRGHFNELISLMESGLGLERAHMGIFTELGVLYARYRPEKLMEHIKLFSTRLNIPKLIRACDEQQHWKELTYLYIQYDEFDNAATTIMNHSPEAWDHMQFKDVAVKVANVELYYKAVHFYLQEHPELINDLLNVLALRVDHTRVVDIMRKAGHLLLVKPYMVAVQSNNVSAVNEALNQIYVEEEDYERLRESIDMHDNFDQIGLAQKIEKHELLEMRRVAAYIYKKAGRWKQSIALSKKDNLYKDAMETASQSGDRELAEELLVYFIEQGKKECFASCLFVCYDLIRADVALELAWMNNMVDFAFPYLLQFIREYTGKVDELIKDKIEAQKEVKAKEQEEKEVIAQQNMYAQLLPLALPAPPMPGMGGPTMGGGFAAPPPMAGMGMPPMPPFGMPPMGSY

SEQ ID NO: 9590 - protein, 1704 aa, Vitis vinifera
MAAANAPITMKEVLTLPSLGISPQFITFTHVTMESDKYLCVRETAPQNSVVIIDMNMPMQPLRRPITADSALMNPNTRILALKAQLPGTTQDHLQIFNIEMKAKMKSYQMPEQIVFWKWITPKMLGLVTQTSVYHWSIEGDSEPVKMFERTANLVNNQIINYRCDPSEKWLVLIGIAPGSPERPQLVKGNMQLFSVEQHRSQALEAHAASFATFKVPGNDQPCTLIGFATKSFNAGQIVSKLHVIELGSNPGKPGFTKKQADLFFPPDFADDFPVAMQISHKYGLIYVITKLGLLFVYDLESASAVYRNRISPDPIFLTAEATSIGGFYAINRRGQVLLATVNEAAIVPFVSGQLNNLELAVNLAKRGNLPGAENLVVQRFQELFAQTKYKEAAELAAESPQGILRTPDTVAKFQSVPMQSGQTPPLLQYFGTLLTRGKLNAFESLELSRLVVNQNKKNLLENWLAEDKLECSEELGDLVKTVDTDLALKIYIKARATPKVVAAFAERREFDKILIYSKQVGYTPDYLFLLQTILRSDPQGAVNFALMMSQMEGGCPIDFNTITDLFLQRNLIREATAFLLDVLKPNLPEHGFLQTKVLEINLVTYPNVADAILANGMFSHYDRPRIAQLCEKAGLYVRALQHYTELPDIKRVIVNTHAIEPQALVEFFGTLSREWALECMKDLLLVNLRGNLQIIVQTAKEYSEQLGVDQCVKLFEQFKSYEGLYFFLGSYLSSSEDPDIHFKYIEAAAKTGQIKEVERVTRESNFYDAEKTKNFLMEAKLPDARPLINVCDRFGFVPDLTHYLYTNNMLRYIEGYVQKVNPSNAPLVVGQLLDDECPEDFIKGLILSVRSLLPVEPLVDECEKRNRLRLLTQFLEHLVSEGSQDVHVHNALGKIIIDSNNNPEHFLTTNPYYDSRVVGKYCEKRDPTLAVVAYRRGQCDEELINVTNKNSLFKLQARYVVERMDSDLWEKVLDPDNDYRRQLIDQVVSTALPESKSPEQVSAAVKAFMTADLPHELIELLEKIVLQNSAFSGNFNLQNLLILTAIKADPSRVMDYINRLDNFDGPAVGEVAVEAQLFEEAFAIFKKFNLNVQAVNVLLDNIQSIERAVEFAFRVEEDAVWSQVAKAQLREGLVSDAIESFIRADDATQFLDVIRAAEDANVYHDLVRYLLMVRQKAKEPKVDSELIYAYAKIDRLGEIEEFILMPNVANLQNVGDRLYDEALYEAAKIIFAFISNWAKLACTLVKLRQFQGAVDAARKANSSKTWKEVCFACVDAEEFRLAQICGLNIIIQVDDLEEVSDYYQNRGCFNELISLMESGLGLERAHMGIFTELGVLYARYRPEKLMEHIKLFSTRLNIPKLIRACDEQQHWKELTYLYIQYDEFDNAATTIMNHSPDAWDHMQFKDVAVKVANVELYYKAVHFYLQEHPDLINDLLNVLALRVDHTRVVDIMRKAGHLHLVKPYMVAVQSNNVSAVNEALNGIYVEEEDYDRLRESIDMHDNFDQIGLAQKIEKHELLEMRRVAAYIYKKAGRWKQSIALSKKDNLYKDAMETASQSGDRELAEELLVYFIEKGKKECFASCLFVCYDLIRPDIALELAWINNMVDFALPYLLQFIREYAGKVDELVKDKLEALNEVKAKEKEEKDVIAQQNMYAQLLPLALPAPPMPGMGGAGMAGGFVPPPMGSMGMPPMPPFGMPPMGTY

SEQ ID NO: 9591 - protein, 1705 aa, Populus trichocarpa
MAAANAPITMKEVLTLPAIGISPQFITFTNVTMESDKYICVRETAPQNSVVIIDMNMPMQPLRRPITADSALMNPNSRILALKAQLPGTTQDHLQIFNIEMKAKMKSYQMPEQIVFWKWITPKMLGLVTQTSVYHWSIEGDSEPVKMFERTANLQSNQIINYKCDPSEKWLVLIGIAPGSPERQQLVKGNMQLFSVDQQRSQALEAHAASFAQYKVPGNENPSTLISFATKSFNAGQITSKLHVIELGAQPGKPSFTKKQADLFFPPDFADDFPVAMQISHKYSLIYAITKLGLLFVYDLETATAVYRNRISPDPIFLTAEASTVGGFYAINRRGQVLLATVNEAMIVPFVSGQLNNLELAVNLAKRGNLPGAENLVVQRFQELFAQTKYKEAAELAAESPQGILRTPDTVAKFQSVPVQPGQTPPLLQYFGTLLTRGKLNAFESLELSRLVVNQNKKNLLENWLAEDKLECTEELGDLVKTVDNDLALKIYIKARATPKVVAAFAERREFDKILIYSKQVGYAPDYLFLLQTILRTDPQGAVNFALMMSQMEGGCPVDYNTITDLFLQRNLIREATAFLLDVLKPNLAEHGYLQTKVLEINLVTFPNVADAILANGMFSHYDRPRIAQLCEKAGLYIRALQHYTDLPDIKRVIVNTHAIEPQALVEFFGTLSREWALECMKDLLLVNLRGNLQIIVQTAKEYCEQLGVDACVKLFEQFKSYEGLYFFLGSYLSSSEDPDIHFKYIEAAARTGQIKEVERVTRESNFYDPEKTKNFLMEAKLPDARPLINVCDRFGFVADLTHYLYSSNMLRYIEGYVQKVNPGNAPSVVGQLLDDECAEDFIKGLILSVRSLLPVEPLVEECEKRNRLRLLTQFLEHLVSEGSQDVHVHNALGKIIIDSNNNPEHFLTTNPYYDSRVVGKYCEKRDPTLAVVAYRRGQCDEELINVTNKNSLFKLQARYVVERMDGDLWEKVLNPENEYRRQLIDQVVSTALPESKSPEQVSAAVKAFMTADLPHELIELLEKIVLQNSAFSGNFNLQNLLILTAIKADPSRVMDYINRLDNFDGPAVGEVAVEAQLYEEAFAIFKKFNLNVQAVNVLLDNIQSIDRAVEFAFRVEEDAVWSQVAKAQLREGLVSEAIESFIRADDATQFLEVIRAAEDANVYQDLLKYLLMVRQKTKEPKVDSELIFAYAKIDRLSDIEEFILMPNVANLQNVGDRLYDEALYEAARIIFQFIANWAKLASTLVKLKQFQSAVDAARKANSAKTWKEVCFACVDAEEFRLAQICGLNIIIQVDDLEEVSEYYQNRGYFNELISLMESGLGLERAHMGIFTELGVLYARYRPEKLMEHIKLFSTRLNIPKLIRACDEQQHWKELTYLYIQYDEFDNAATTIMNHSPEAWDHMQFKDVAVKVANVELYYKAVHFYLQEHPDLINDLLNVLALRVDHTRVVDIMRKAGHLLLVKPYMIAVQSNNVSAVNEALNQIYVEEEDYERLRESIDLHDNFDQIGLAQKIEKHELLEMRRVAAYIYKKAGRWKQSIALSKKDNLYKDAMETASQSGDRELAEELLVYFIEQGKKECFASCLFVCYDLIRPDVALELAWMNNMIDFAFPYLLQFIREYTGKVDELVKYKIEAQKEVKAKEQEEKDVIAQQNMYAQLLPLALPAPPMPGMGGPTMGGGFAPPPPMGGMGMPPMPPFGMPPMGSY

SEQ ID NO: 9592 - protein, 1701 aa, Cajanus cajan
MAAANAPIAMREPLTLPSIGINPQFITFTHVTMESDKYICVRETAPQNSVVIIDMNMPMQPLRRPITADSALMNPNSRILALKAQLQGTTQDHLQIFNIEMKAKMKSYQMPEQVVFWKWITPKLLGLVTQTSVYHWSIEGDSEPVKMFERTANLANNQIINYRCDPSEKWLVLIGIAPGSPERPQLVKGNMQLFSVDQQRSQALEAHAAAFAQFKVPGNENPSTLISFATKTLNAGQIISKLHVIELGAQPGKPSFTKKQADLFFPPDFADDFPVAMQISHKYNLIYVITKLGLLFVYDLETATAVYRNRISPDPIFLTSEATSVGGFYAINRRGQVLLATVNEQTIVNFVSGQLNNLELAVNLAKRGNLPGAEKLVVERFHELFAQTKYKEAAELAAESPQGILRTPDTVAKFQSVPVQAGQTPPLLQYFGTLLTRGKLNAFESLELSRLVVNQNKKNLLENWLAEDKLECSEELGDLVKTVDNDLALKIYIKARATPKVVAAFAERREFDKILIYSKQVGYTPDYLFLLQTILRTDPQGAVNFALMMSQMEGGCPVDYNTITDLFLQRNLIREATAFLLDVLKPNLPEHGFLQTKVLEINLVTFPNVADAILANGMFSHYDRPRVAQLCEKAGLYVRALQHYTELPDIKRVIVNTHAIEPQSLVEFFGTLSREWALECMKDLLLVNLRGNLQIIVQVAKEYCEQLGVDACIKLFEQFRSYEGLYFFLGSYLSSSEDPDIHFKYIEAAAKTGQIKEVERVTRESSFYDPEKTKNFLMEAKLPDARPLINVCDRFGFVPDLTHYLYTSNMLRYIEGYVQKVNPGNAPLVVGQLLDDECPEDFIKGLILSVRSLLPVEPLVEECEKRNRLRLLTQFLEHLVSEGSQDVHVHNALGKIIIDSNNNPEHFLTTNPYYDSRVVGKYCEKRDPTLAVVAYRRGQCDDELINVTNKNSLFKLQARYVVERMDGDLWEKVLNPDNAYRRQLIDQVVSTALPESKSPEQVSAAVKAFMTADLPHELIELLEKIVLQNSAFSGNFNLQNLLILTAIKADPSRVMDYVNRLDNFDGPAVGEMAVEAQLYEEAFAIFKKFNLNVQAVNVLLDNIHSIDRAVEFAFRVEEDAVWSQVAKAQLREGLVSDAIESFIRADDATQFLDVIRAAEDGNVYHDLVKYLLMVRQKTKEPKVDSELIYAYAKIDRLSEIEEFILMPNVANLQNVGDRLYDEELYEAAKIIFAFISNWAKLAVTLVKLKQFQGAVDAARKANSSKTWKEVCFACVDAEEFRLAQICGLNIIIQVDDLEEVSEYYQNRGCFNELISLMESGLGLERAHMGIFTELGVLYARYRPEKLMEHIKLFSTRLNIPKLIRACDEQQHWKELTYLYIQYDEFDNAATTIMNHSPEAWDHMQFKDVVVKVANVELYYKAVHFYLQEHPDLINDVLNVLALRVDHARVVDIMRKAGHLRLVKPYMVAVQSNNVSAVNEALNEIYVEEEDYDRLRESIDLHDNFDQIGLAQKIEKHELLEMRRVAAYIYKKAGRWKQSIALSKKDNLYKDAMETASQSGDRELAEELLVYFIDQGKKECFASCLFVCYDLIRADIVLELAWMHNMIDFAFPYLLQFIREYTGKVDELVKDKIETQIQVKAKEQEEKEVIAQQNMYAQLLPLALPAPPMPGMGGGFAPPPPMGGLGMPPMPPFGMPPMGSSY

SEQ ID NO: 9593 - protein, 1707 aa, Cajanus cajan
MAAANAPITMKEALTLPSIGINTQFITFTHVTMESDKYICVRETAPQNSVVIIDMNMPNQPLRRPITADSALMNPNSRILALKAQLQGTTQDHLQIFNIEMKAKMKSYQMPEQVVFWKWISPKMLGLVTQTSVYHWSIEGDSEPVKMFERTANLANNQIINYRCDPTEKWLVLIGIAPGSPERPQLVKGNMQLFSVDQQRSQALEAHAASFAQFKVPGNENPSVLISFASKTLNAGQIISKLHVIELGAQPGKPSFTKKQADLFFPPDFGDDFPVAMQISHKYNLIYVITKLGLLFVYDLETATAVYRNRISPDPIFLTSEATSVGGFYAINRRGQVLLATVNEQTIVNFVSGQLNNLELAVSLAKRGNLPGAEKLVVERFHELFAQTKYKEAAELAAESPQGILRTPDTVAKFQSVPVQAGQTPPLLQYFGTLLTRGKLNAFESLELSRLVVNQNKKNLLENWLAEDKLECSEELGDLVKTVDNDLALKIYIKARATPKVVAAFAERREFDKILIYSKQVGYTPDYLFLLQTILRTDPQGAVNFALMMSQMEGGSPVDYNTITDLFLQRNLIREATAFLLDVLKPNLPEHGFLQTKVLEINLVTFPNVADAILANGMFSHYDRPRIAQLCEKAGLYVRALQHYTELPDIKRVIVNTHAIEPQSLVEFFGTLSREWALECMKDLLLANLRGNLQIIVQVAKEYCEQLGVDACIKLFEQFRSYEGLYFFLGSYLSSSEDPDIHFKYIEAAAKTGQIKEVERVTRESNFYDAEKTKNFLMEAKLPDARPLINVCDRFGFVPDLTHYLYTNNMLRYIEGYVQKVNPGNAPLVVGQLLDDECPEDFIKGLILSVRSLLPVEPLVEECEKRNRLRLLTQFLEHLVSEGSQDVHVHNALGKIIIDSNNNPEHFLTTNPYYDSRVVGKYCEKRDPTLAVVAYRRGQCDDELINVTNKNSLFKLQARYVVERMDADLWAKVLDPDNEYRRQLIDQVVSTALPESSSPEQVSAAVKAFMTADLPHELIELLEKIVLQNSAFSGNFNLQNLLILTAIKADPSRVMDYVNRLDNFDGPAVGEMAVEAQLYEEAFAIFKKFNLNVQAVNVLLDNIHSIDRAVEFAFRVEEDAVWSQVAKAQLREGLVSDAIESFIRADDATQFLDVIRAAEDGNVYHDLVKYLLMVRQKAKEPKVDSELIYAYAKIDRLSDIEEFILMPNVANLQNVGDRLYDEALYEAAKIIFAFISNWAKLAITLVKLKQFQGAVDAARKANSSKTWKEVCFACVDAEEFRLAQICGLNIIIQVDDLEEVSEYYQNRGCFNELISLMESGLGLERAHMGIFTELGVLYARYRPEKLMEHIKLFSTRLNIPKLIRACDEQQHWKELTYLYIQYDEFDNAATTIMNHSPEAWDHMQFKDVVVKVANVELYYKAVHFYLEEHPDLINDVLNVLALRVDHARVVDIMRKAGHLRLVKPYMVAVQSNNVSAVNEALNEIYVEEEDYDRLRESIDLHDNFDQIGLAQKIEKHELLEMRRVAAYIYKKAGRWKQSIALSKKDNLYKDAMETASQSGERELAEELLVYFIDQGKKECFASCLFVCYDLIRADIVLELAWMHNMIDFAFPYLLQFIREYTGKVDELVKDKIEAQNEVKAKEQEEKEVVAQQNMYAQLLPLALPAPPMPGMGGPGGMGGGFAPPPPMGGLGMPPMPPYGMPPMGSSY

SEQ ID NO: 9594 - protein, 1700 aa, Glycine max
MAAANAPIAMRETLTLPTIGINPQFITFTHVTMESDKYICVRETAPQNSVVIIDMNMPNQPLRRPITADSALMNPNSRILALKAQLQGTTQDHLQIFNIEMKAKMKSYQMPEQVVFWKWITPKLLGIVTQTSVYHWSIEGDSEPVKMFERTANLANNQIINYRCDPSEKWLVLIGIVPGSPERPQLVKGNMQLFSVEQQRSQALEAHAASFAQFKVPGNENPSTLISFATKTLNAGQIISKLHVIELGAQPGKPSFSKKQADLFFPPDFADDFPVAMQISHKYSLIYVITKLGLLFVYDLETATAVYRNRISPDPIFLTSEATSVGGFYAINRRGQVLLATVNEQTIVNFVSGQLNNLELAVNLAKRGNLPGAEKLVVERFHELFAQTKYKEAAELAAESPQGILRTPDTVAKFQSVPVQAGQTPPLLQYFGTLLTRGKLNAFESLELSRLVVNQNKKNLLENWLAEDKLECSEELGDLVKTVDNDLALKIYIKARATPKVVAAFAERREFDKILIYSKQVGYTPDYLFLLQTILRTDPQGAVNFALMMSQMEGGCPVDYNTITDLFLQRNLIREATAFLLDVLKPNLPEHGYLQTKVLEINLVTFPNVADAILANGMFSHYDRPRIAQLCEKAGLYVRSLQHYTELPDIKRVIVNTHAIEPQSLVEFFGTLSREWALECMKDLLLVNLRGNLQIIVQVAKEYCEQLGVDACIKLFEQFRSYEGLYFFLGSYLSSSEDPDIHFKYIEAAAKTGQIKEVERVTRESSFYDPEKTKNFLMEAKLPDARPLINVCDRFGFVPDLTHYLYTSNMLRYIEGYVQKVNPGNAPLVVGQLLDDECPEDFIKGLILSVRSLLPVEPLVEECEKRNRLRLLTQFLEHLVSEGSQDVHVHNALGKIIIDSNNNPEHFLTTNPYYDSRVVGKYCEKRDPTLAVVAYRRGQCDDELINVTNKNSLFKLQARYVVERMDGDLWEKVLNPDNTYRRQLIDQVVSTALPESKSPEQVSAAVKAFMTADLPHELIELLEKIVLQNSAFSGNFNLQNLLILTAIKADPSRVMDYINRLDNFDGPAVGEMAVEAQLYEEAFAIFKKFNLNVQAVNVLLDNIHSIDRAVEFAFRVEEDAVWSQVAKAQLREGLVSDAIESFIRADDATQFLDVIRAAEDGNVYHDLVRYLLMVRQKTKEPKVDSELIYAYAKIDRLSDIEEFILMPNVANLQNVGDQLYDEELYEAAKIIFAFISNWAKLAVTLVKLKQFQGAVDAARKANSAKTWKEVCFACVDAEEFRLAQICGLNIIIQVDDLEEVSEYYQNRGCFNELISLMESGLGLERAHMGIFTELGVLYARYRYEKLMEHIKLFATRLNIPKLIRACDEQQHWKELTYLYIQYDEFDNAATTIMNHSPEAWDHMQFKDVVVKVANVELYYKAVHFYLQEHPDLINDVLNVLALRVDHARVVDIMRKAGHLRLVKPYMVAVQSNNVSAVNEALNEIYVEEEDYDRLRESIDLHDNFDQIGLAQKIEKHELLEMRRVAAYIYKKAGRWKQSIALSKKDNLYKDAMETASQSGDRELAEELLVYFIDQGKKECFASCLFVCYDLIRADIALELAWMNNMIDFAFPYLLQFIREYTGKVDELVKDKIEAQNQVKAKEQEEKEVIAQQNMYAQLLPLALPAPPMPGMGGGFAPPPPMGGLGMPPMPPFGMPPMGSY

SEQ ID NO: 9595 - protein, 1701 aa, Solanum lycopersicum
MAAANAPITMKETLTLQSIGVNPQFITFTNVTMESDKYICVRETSPQNSVVIIDMNMPMQPLRRPITADSALMNPNSRILALKAQVPGTSQDHLQIFNIEAKQKIKSYQMPEQVVFWKWITPKMLGLVTQTAVYHWPIEGDSEPVKMFDRTANLANNQIINYRCDPSEKWLVLIGIAPGSPERPQLVKGNMQLFSVDQQRSQALEAHAAAFASFRVPGNERDSILISFATKSSNAGQVTSKLHVIELGAQPGKPSFTKKQADLFFPPDFADDFPVAMQISHKYSLIYVITKLGLLFVYDLETATAVYRNRISPDPIFLTAEASSIGGFYAINRRGQVLLATVNEATLVPFVSGQLNNLELAVNLAKRGNLPGAENLVVQRFQELFAQTKYKEAAELAAESPQGILRTPDTVAKFQSVPVQAGQTPPLLQYFGTLLTKGKLNAFESLELSRLVVNQNKKNLLENWLAEDKLECSEELGDLVKTVDNDLALKIYIKARATPKVVAAFAERREFDKILIYSKQVGYTPDYLFLLQTILRSDPQGAVNFALMMSQMEGGCPVDYNTITDLFLQRNMIREATAFLLDVLKPNLPEHGFLQTKVLEINLVTFPNVADAILANGMFSHYDRPRIAQLCEKAGLYVRALQHYSELPDIKRVIVNTHAIEPQALVEFFGTLSREWALECMKDLLVINIKGNLQIIVQVAKEYCEQLGVDACIKLFEQFKSYEGLYFFLGSYLSSSEDPDIHFKYIESAARTGQIKEVERVTRESNFYDAEKTKNFLMEAKLPDARPLINVCDRFGFVPDLTHYLYTNNMLRYIEGYVQKVNPGNAPLVVGQLLDDECPEDFIKGLILSVRSLLPVEPLVEECEKRNRLRLLTQFLEHLVSEGSQDVHVHNALGKIIIDSNNNPEHFLTTNPYYDSRVVGKYCEKRDPTLAVVAYRRGQCDDELINVTNKNSLFKLQARYVVERMDGDIWEKVLNPENEFRRQLIDQVVSTALPESKSPEQVSAAVKAFMTADLPHELIELLEKIVLQNSAFSGNFNLQNLLILTAIKADPSRVMDYINRLDNFDGPAVGEVAVEAQLYEEAFAIFKKFNLNVQAVNVLLDNIRDINRAVEFAFRVEEDAVWSQVAKAQLREGLVSDAIESFIRADDATHFLDVIHAAEDADVYHDLVKYLLMVRQKTKEPKVDSELIYAYAKIDRLGDIEEFILMPNVANLPNVGDKLFDEGLYEAAKIIFAFISNWAKLASTLVKLNQFQGAVDAARKANSAKTWKDVCFACVDAEEFRLAQICGLNIIVQVDDLEEVSEYYQNRGCFNELISLMESGLGLERAHMGIFTELGVLYARYRHEKLMEHIKLFSTRLNIPKLIRACDEQQHWKELTYLYIQYDEFDNAATTVMNHSPDAWDHMQFKDIVVKVANVELYYKAVHFYLQEHPDLINDLLNVLALRVDHTRVVDIMRKAGHLRLVKPYMIAVQSNNVSAVNEALNEIYVEEEDYDRLRESIELHDNFDQIGLAQKIEKHELLEMRRVAASIYKKAGRWKQSIALSKKDNLYKDAMETASQSGDRELAEELLVYFIEQGKKECFASCLFVCYDLIRPDVALELAWMNNMIDFAFPYLLQFIREYTGKVDELIKDKIEAQSEAKARENEEKDVMKQQNMYAQLLPLALPAPPMPGMGGGFAAPPPPMGGMGMPPMPPFGMPPMGPY

SEQ ID NO: 9596 - protein, 644 aa, Arnica chamissonis
MAAANAPITMKEALTLPSVGINSQFITFTNVTMESDKFICVRETSPQNSVVIIDMSMPMQPLRRPITADSALMNPISKILALKAQLPGTTQDHLQIFNIEMKAKVKSHQMPEQVVFWKWISPKMLGMVTQTSVYHWSIEGDSEPTKMFDRTANLANNQIINYRCDPSEKWLVLIGIAPGSPERPQLVKGSMQLFSVDQQRSQALEAHAASFASFKVPGNDNPSILISFATKSSNAGQVTSKLHVIELGAQPGKPSFTKKQADLFFPPDFADDFPVAMQISHKYGLIYVITKLGLLFVYDLETATAVYRNRISPDPIFLTSEASSVGGFYAVNRRGQVLLATVNESTIVPFVSGQLNNLELAVNLAKRGNLPGAENLVVQRFQELFAQTKYKEAAELAAESPQGILRTPDTVAKFQSVPVQAGQTPPLLQYFGTLLTKGKLNAFESLELSRLVVNQNKKNLLENWLAEDKLECSEELGDLVKTVDNDLALKIYIKARATPKVVAAFAERREFDKILIYSKQVGYTPDYLFLLQTILRSDPQGAVNFALMMSQMEGGCPVDYNTITDLFLQRNLIREATAFLLDVLKPDLPEHALLQTKVLEINLVTFPNVADAILANGMFSHYDRPRIAQLCEKAGSFCPSPSAL

SEQ ID NO: 9597 - protein, 1699 aa, Euphorbia peplus
MAAANAPIAMKEVLTLPSIGINPQFITFTNVTMESDKYICVRETAPQNSVVIIDMSMPNQPLRRPITADSALMNPNSRILALKAQIQGTTQDHLQIFNIEMKAKLKSYQMPEQVVFWKWISPKMLGLVTQTSVYHWSTEGESEPVKMFDRTANLVNNQVINYRCDPSEKWLVLIGIAPGSPERPQLVKGNMQLFSVEQQRSQALEAHAAAFAQFKVPGNETPSTLISFATKSFNAGQITSKLHVIELGAQPGKPSFSKKQADLFFPPDFADDFPVAMQISHKYSLIYVITKLGLLFVYDLETATAVYRNRISPDPIFLTSEASSVGGFYSINRRGQVLLATVNEATIVSFVSGQLNNLELAVNLAKRGNLPGAENLVVQRFQELFAQTKYKEAAELAAESPQGILRTPDTVAKFQSVPVQSGQTPPLLQYFGTLLTRGKLNAFESLELSRLVVNQNKKNLLENWLAEDKLECSEELGDLVKTVDNDLALKIYIKARATPKVVAAFAERREFDKILIYSKQVGYNPDYLFLLQTILRSDPQGAVNFALMMSQMEGGCPVDYNTITDLFLQRNLIREATAFLLDVLKPNLPEHGFLQTKVLEINLVTFPNVADAILANGMFSHYDRPRIAQLCEKAGLYIRALQHYAELPDIKRVIVNTHAIEPQALVEFFGTLSREWALECMKDLLLVNLRGNLQIIVQTAKEYCEQLGVDACIKLFEQFKSYEGLYFFLGSYLSSSEDPEIHFKYIESAAKTGQIKEVERVTRESNFYDAEKTKNFLMEAKLPDARPLINVCDRFGYVADLTHYLYSNNMLRYIEGYVQKVNPSNAPLVVGQLLDDECPEDFIKGLILSVRSLLPVEPLVEECEKRNRLRLLTQFLEHLVSEGSQDVHVHNALGKIIIDSNNNPEHFLTTNPYYDSRVVGKYCEKRDPTLAVVAYRRGQCDEELINVTNKNSLFKLQARYVVERMDGDLWEKVLVPENEYRRQLIDQVVSTALPESKSPEQVSAAVKAFMTADLPHELIELLEKIVLQNSAFSGNFNLQNLLILTAIKADPSRVMDYINRLDNFDGPAVGEVAVEAQLYEEAFAIFKKFNLNVQAVNVLLDNLRSVDRAVEFAFRVEEDAVWSQVAKAQLREGLVSDAIESFIRADDATQFLEVIRAAEDANVYHDLVKYLLMVRQKTKEPKVDSELIFAYAKIDRLGEIEEFILMPNVANLQNVGDRLFDDALYEAAKIIFAFISNWAKLAVTLVRLKQFQGAVDAARKANSAKTWKEVCFACVDAEEFRLAQICGLNIIVQVDDLEEVSEFYQNRGYFNELISLMESGLGLERAHMGIFTELGVLYARYRPEKLMEHIKLFSTRLNIPKLIRACDEQQHWKELTYLYIQYDEFDNAATTIMNHSPEAWDHMQFKDVAVKVANVELYYKAVHFYLQEHPDLINDLLNVLALRVDHTRVVDIMRKAGHLLLVKPYMVAVQSNNVSAVNEALNQIYVEEEDYERLRESIDMHDNFDQIGLAQKIEKHELLEMRRVAAYIYKKAGRWKQSIALSKKDNLYKDAMETASQSGDRELAEELLVYFIEKGKKECFASCLFVCYDLIRPDVALELAWMNNMVDFAFPYLLQFIREYTGKVDELVKDKLEAQKENKAKEQEEKDVIAQQNMYAQLLPLALPAPPMPGMAPPMPGMAGGYGQPMGMPAMPPYGMPGY

SEQ ID NO: 9598 - protein, 1702 aa, Eutrema halophilum
MAAANAPITMKEVLTLPSIGINQQFITFTNVTMESDKYICVRETAPQNSVVIIDMNMPMQPLRRPITADSALMNPNSRILALKAQVPGTTQDHLQIFNIEAKAKLKSHQMPEQVAFWKWITPKMLGLVTQNSVYHWSIEGDSEPVKMFDRTANLANNQIINYKCSPNEKWLVLIGIAPGSPERAQLVKGNMQLFSVDQQRSQALEAHAASFAQFKVPGNENPSILISFASKSFNAGQITSKLHVIELGAQPGKPSFTKKQADLFFPPDFADDFPVAMQVSHKFGLIYVITKLGLLFVYDLETASAVYRNRISPDPIFLTSEASSVGGFYAINRRGQVLLATVNEATIIPFISGQLNNLELAVNLAKRGNLPGAENLVVQRFQELFAQTKYKEAAELAAESPQGILRTPDTVAKFQSVPVQAGQTPPLLQYFGTLLTRGKLNAYESLELSRLVVNQNKKNLLENWLAEDKLECSEELGDLVKTVDNDLALKIYIKARATPKVVAAFAERREFDKILIYSKQVGYTPDYMFLLQTILRTDPQGAVNFALMMSQMEGGCPVDFNTITDLFLQRNLIREATAFLLDVLKPNLAEHAFLQTKVLEINLVTFPNVADAILANGMFSHYDRPRIAQLCEKAGLYIQSLKHYSELPDIKRVIVNTHAIEPQALVEFFGTLSSEWAMECMKDLLLVNLRGNLQIIVQACKEYCEQLGVDACIKLFEQFKSYEGLYFFLGSYLSMSEDPEIHFKYIEAAAKTGQIKEVERVTRESNFYDAEKTKNFLMEAKLPDARPLINVCDRFGFVPDLTHYLYTNNMLRYIEGYVQKVNPGNAPLVVGQLLDDECPEDFIKGLILSVRSLLPVEPLVEECEKRNRLRLLTQFLEHLVSEGSQDVHVHNALGKIIIDSNNNPEHFLTTNPYYDSRVVGKYCEKRDPTLAVVAYRRGQCDEELINVTNKNSLFKLQARYVVERMDGDLWDKVLDENNDYRRQLIDQVVSTALPESKSPEQVSAAVKAFMTADLPHELIELLEKIVLQNSAFSGNFNLQNLLILTAIKADPSRVMDYINRLDNFDGPAVGEVAVEAQLYEEAFAIFKKFNLNVQAVNVLLDSVKSIERAVEFAFRVEEDAVWSQVAKAQLREGLVSDAIESFIRADDATHFLEVIRATEDANVYDDLVRYLLMVRQKVKEPKVDSELIYAYAKIDRLGEIEEFILMPNVANLQNVGDRLYDEALYEAAKIIYAFISNWGKLAVTLVKLQQFQGAVDAARKANSAKTWKEVCFACVDAEEFRLAQICGLNIIIQVDDLEEVSEFYQNRGCFNELISLMESGLGLERAHMGIFTELGVLYARYRYEKLMEHIKLFSTRLNIPKLIRACDEQQHWQELTYLYIQYDEFDNAATTVMNHSPEAWEHMQFKDIVAKVANVELYYKAVHFYLQEHPDLINDLLNVLALRLDHTRVVDIMRKAGQLRLIKPYMVAVQSNNVSAVNEALNEIYVEEEDYDRLRESIDFHDSFDQIGLAQKIEKHELVEMRRVAAYIYKKAGRWKQSIALSKKDSMYKDCMETASQSGDHELAEQLLVYFIEQGKKECFATCLFVCYDLIRPDVALELAWINNMIDFAFPYLLQFIREYTGKVDELIKDKLEAQKEVKAKEQEEKEVMSQQNMYAQLLPLALPAPPMPGMGGGGYGPPPPMGGMPGMPPMPPFGMPPMGGY

SEQ ID NO: 9599 - protein, 1703 aa, Amborella trichopoda
MAAATAPITMKEALTLTSLGINPQFITFTHVTMESEKYICVRETAPQNSVVIIDMNMPMQPLRRPITADSALMNPNSRILALKAQIPGTTQDHLQIFNIEMKAKMKSHQMPEQVVFWKWITPKMLGLVTQTSVYHWSIEGDSEPVKMFERTANLLNNQIINYRCDPSEKWLVLIGIAPGAAERPQLVKGNMQLFSVDQQRSQALEAHAASFASIKVAGNENPSTLICFASKTTNAGQITSKLHVIELGAQPGKPGFTKRQADLFFPPDFADDFPVAMQISHKYSLIYVITKLGLLFVYDLETATAVYRNRISPDPIFLTTEASSLGGFYAVNRRGQVLLATVNEATIVPFVSGQLNNLELAVNLAKRGNLPGAENLVVQRFQELFSQTKYKEAAELAADSPQGILRTPDTVAKFQSVPVQSGQTPPLLQYFGTLLTKGKLNAFESLELSRLVVNQNKKNLLENWLAEDKLECSEELGDLVKTVDNDLALKIYIKARATPKVVAAFAERREFDKILIYSKQVGYTPDYLFLLQTILRTDPQGAVNFALMMSQMEGGCPVDYNTITDLFLQRNMIREATAFLLDVLKPNLPEHAFLQTKVLEINLVTFPNVADAILANGMFSHYDRPRVAQLCEKAGLYMRALQHYTELPDIKRVIVNTHAIEPQSLVEFFGTLSREWALECMKDLLVVNLRGNLQIIVQVAKEYSEQLGVDACIRIFEQFKSYEGLYFFLGSYLSSSEDPDIHFKYIEAAAKTGQIKEVERVTRESNFYDPEKTKNFLMEAKLPDARPLINVCDRFGFVPDLTHYLYSNNMLRYIEGYVQKVSPANAPLVVGQLLDDECPEDFIKGLILSVRSLLPVEPLVEECEKRNRLRLLTQFLEHLVSEGSQDVHVHNALGKIIIDSNNNPEHFLTTNPYYDSRVVGKYCEKRDPTLAVVAYRRGQCDDELINVTNKNSLFKLQARYVVERMEPELWEKVLNPENTYRRQLIDQVVSTALPESKSPEQVSAAVKAFMTADLPHELIELLEKIVLQNSAFSGNFNLQNLLILTAIKADKSRVMDYINRLENFDGPAVGEVAVEHELYEEAFAIFKKFSLNVQAVNVLLDNIRSIDRAVEFAFRVEEDAVWSQVAKAQLKEGLVSDAIESFIRADDATQFLDVIRAAEETNVYHDLVKYLLMVRQKVKEPKVDSELIYAYAKIDRLGEIEEFILSPNVANLQNVGDRLYDEALYEAAKIIFAYISNWAKLASTLVKLKQFQGAVDAARKANSSKTWKEICFACVDAEEFRLAQICGLNIIVQVDDLEEVSDYYQNRGCFNELISLMESGLGLERAHMGIFTELGILYARYRPEKLMEHIKLFATRLNIPKLIRVCDEQQHWKELTYLYIQYDEFDNAATTMMNHSPEAWDHMQFKDVAVKVANVELYYKAVHFYLQEHPEYINDLLHVLALRVDHTRVVDIMRKAGQLHLVKPYMVEVQSNNVAAVNEALNEIYIEEEDYDRLRESIDLHDNFDQIGLAQKLEKHELLEMRRIAAYIYKKAGRWRQSVQLSKKDNLYQDAMETSSQSGDRELAEELLVYFIEQGKKECFASCLFTCYDLIRPDVALELAWMNNMIDFVFPYLLQFIREYTTKVDELVKDKLEALTETKVKEKEEKDLVAQQNMYAQLLPLALPAPPMAGMGSGFAPPPPMGGMGMPPMPPFGMPPPPPMGGY

SEQ ID NO: 9600 - protein, 1701 aa, Phaseolus coccineus
MAAANAPIAMKEALTLPSIGINPQFITFTHVTMESEKYICVRETSPQNSVVIVDMNMPNQPLRRPITADSALMNPNSRILALKAQLQGTTQDHLQIFNIEMKAKMKSYQMPEQVVFWKWISPKLLGLVTQTSVYHWSIEGDSEPVKMFERTANLANNQIINYRCDPSEKWLVLIGIAPGSPERPQLVKGNMQLFSVDQQRSQALEAHAASFAQFKVPGNENPSILISFATKTLNAGQIISKLHVIELGAQPGKPSFTKKQADLFFPPDFADDFPVSMQISHKYSLIYVITKLGLLFVYDLETATAVYRNRISPDPIFLTSEATSVGGFYAINRRGQVLLATVNEQTIVNFVSGQLNNLELAVNLAKRGNLPGAEKLVVERFHELFAQTKYKEAAELAAESPQGILRTPDTVAKFQSVPVQAGQTPPLLQYFGTLLTRGKLNAFESLELSRLVVNQNKKNLLENWLAEDKLECSEDLGDLVKTVDNDLALKIYIKARATPKVVAAFAERREFDKILIYSKQVGYTPDYLFLLQTILRTDPQGAVNFALMMSQMEGGCPVDYNTITDLFLQRNLIREATAFLLDVLKPNLPEHGFLQTKVLEINLVTFPNVADAILANGMFSHYDRPRIAQLCEKAGLYVRALQHYTELSDVKRVIVNTHAIEPQSLVEFFGTLSREWALECMKDLLLVNLRGNLQIIVQVAKEYCEQLGVDPCIKLFEQFRSYEGLYFFLGSYLSSSEDPDIHFKYIEAAAKTGQIKEVERVTRESSFYDAEKTKNFLMEAKLPDARPLINVCDRFGFVPDLTHYLYTSNMLRYIEGYVQKVNPGNAPLVVGQLLDDECPEDFIKGLILSVRSLLPVEPLVEECEKRNRLRLLSQFLEHLVSEGSQDVHVHNALGKIIIDSNNNPEHFLTTNPYYDSRVVGKYCEKRDPTLAVVAYRRGQCDEELINVTNKNSLFKLQARYVVERMDGDLWDKVLNPDNAYRRQLIDQVVSTALPESKSPEQVSAAVKAFMTADLPHELIELLEKIVLQNSAFSGNFNLQNLLILTAIKADPSRVMDYINRLDNFDGPAVGEMAVEAQLYEEAFAIFKKFNLNVQAVNVLLDNIHSIDRAVEFAFRVEEDAVWSQVATAQLREGLVSDAIESFIRADDTTQFLDVIRAAENANVYHDLVRYLLMVRQKTKEPKVDSELIYAYAKIDRLSDIEEFILMPNVANLQNVGDRLYDEELYEAAKIIFAFISNWAKLAVTLVKLKQFQGAVDAARKANSAKTWKEVCFACVDAEEFRLAQICGLNIIIQVDDLEEVSEYYQNRGCFNELISLMESGLGLERAHMGIFTELGVLYARYRPEKLMEHIKLFATRLNIPKLIRACDEQQHWKELTYLYIQYDEFDNAATTIMNHSPEAWDHMQFKDVVIKVANVELYYKAVHFYLQEHPDLINDVLNVLALRVDHARVVDIMRKAGQLRLVKPYMVAVQSNNVSAVNEALNEIYVEEEDYDRLRESIDFHDNFDQIGLAQKIEKHELLEMRRVAAYIYKKAGRWKQSIALSKKDNLYKDAMETASQSGDRELAEELLVYFIDQGKKECFASCLFVCYDLIRADIALELAWMNNMIDFAFPYLLQFIREYTGKVDELVKDKIEAQSQVKAKEQEEKEVIAQQNMYAQLLPLALPAPPMPGMGGGFAAPPPMGGLGMPPMPPFGMPPMGSSY

SEQ ID NO: 9601 - protein, 1698 aa, Flaveria ramosissima
MAAANAPITMKEALTLPSIGINPQFITFTNVTMESDKFICVRETSPQNSVVIIDMNMPMQPLRRPITADSALMNPISKILALKAQLPGTTQDHLQIFNIEMKAKMKSHQMPEQVVFWKWITPKMLGMVTQTSVYHWSIEGDSEPVKMFDRTANLSNNQIINYKCDPTEKWLVLIGIAPGSPEKPQLVKGNMQLFSVDQQRSQALEAHAASFASLKVPGNENPSVLISFATKSSNAGQVTSKLHVIELGAQPGKPSFTKKQADLFFPPDFADDFPVAMQISNKYGLIYVITKLGLLFVYDLETATAVYRNRISPDPIFLTSEASSVGGFYAVNRRGQVLLATVNEATIVPFVSGQLNNLELAVNLAKRGNLPGAENLVVQRFQELFAQTKYKEAAELAAESPQGILRTPDTVAKFQSVPVQAGQTPPLLQYFGTLLTKGKLNAFESLELSRLVVNQNKKNLLENWLAEDKLECSEELGDLVKTVDNDLALKIYIKARATPKVVAAFAERREFDKILIYSKQVGYSPDYLFLLQTILRTDPQGAVNFALMMSQMEGGCPVDYNTITDLFLQRNLIREATAFLLDVLKPNLPEHAHLQTKVLEINLVTFPNVADAILANGMFSHYDRPRIAQLCEKAGLYVRALQHYSELPDIKRVIVNTQAIEPQSLVEFFGTLSKEWALECMKDLLLVNLRGNLQIIVQVAKEYCEQLGVESCIKLFEQFKSYEGLYFFLGSYLSSSEDPDIHFKYIEAAAKTGQIKEVERVTRESNFYDAEKTKNFLMEAKLPDARPLINVCDRFGFVPDLTHYLYTNNMLRYIEGYVQKVNPGNAPQVVGQLLDDECPEDFIKGLILSVRSLLPVEPLVDECEKRNRLRLLTQFLEHLVSEGSQDVHVHNALGKIIIDSNNNPEHFLTTNPYYDSRVVGKYCEKRDPTLAVVAYRRGQCDDELINVTSKNSLFKLQARYVVERMDGDLWEKVLNPENEYRRQLIDQVVSTALPESKSPEQVSAAVKAFMTADLPHELIELLEKIVLQNSAFSGNFNLQNLLILTAIKADPSRVMDYINRLDNFDGPAVGEMAVEAQLYEEAFAIYKKFNLNVQAVDVLLDNIQSIPRAVEFAYRVEEDAVWSQVAKAQLREGLVSDAIESFIRADDATQFLDVIRASEDTECYHDLVKYLLMVRGKIKEPKVDSELIYAYAKIDRLSDIEEFILMPNVANLHNVGDRLFDEALYEAAKIIYAFISNWAKLAVTLVRLQQFQGAVDAARKANSAKTWKEVCFACVDAEEFRLAQICGLNIIVQVDDLEEVSEYYQNRGCFNELISLMESGLGLERAHMGIFTELGVLYARYRHDKLMEHIKLFSTRLNIPKLIRACDEQQHWKELTYLYIQYDEFDNAATTVMNHSPDAWDHMQFKDIAVKVANVELYYKAVHFYLEEHPDLINDVLNVLALRVDHTRVVDIMRKAGQLPLVKPYMVAVQSNNVSAVNEALNEIYVEEEDYDRLRESIDLHDNFDQIGLAQKIEKHELLEMRRVAAYIYKKAGRWKQSIALSKKDKVYKDAMETASQSGDRELAEELLVYFIEQGKKECFASCLFVCYDLIRPDVALELAWLNNMIDFAFPYLLQFIREYTGKVDELIKDKIEAIKESKAKETEEQDIVKQQNMYAQLLPLALPAPPGMGGGFAPPPAMGGMGMPPMPPFGMPPMGSY

SEQ ID NO: 9602 - protein, 1701 aa, Solanum phureja
MAAANAPITMKETLTLQSIGVNPQFITFTNVTMESDKYICVRETSPQNSVVIIDMNMPMQPLRRPITADSALMNPNSRILALKAQVPGTSQDHLQIFNIEAKQKIKSYQMPEQVVFWKWITPKMLGLVTQTSVYHWPIEGDSEPVKMFDRTANLANNQIINYRCDPSEKWLVLIGIAPGSPERPQLVKGNMQLFSVDQQRSQALEAHAAAFASFRVPGNERDSILISFATKSSNAGQITSKLHVIELGAQPGKPSFTKKQADLFFPPDFTDDFPVAMQISHKYSLIYVITKLGLLFVYDLETATAVYRNRISPDPIFLTAEASSIGGFYAINRRGQVLLATVNEATLVPFVSGQLNNLELAVNLAKRGNLPGAENLVVQRFQELFAQTKYKEAAELAAESPQGILRTPDTVAKFQSVPVQAGQTPPLLQYFGTLLTKGKLNAFESLELSRLVVNQNKKNLLENWLAEDKLECSEELGDLVKTVDNDLALKIYIKARATPKVVAAFAERREFDKILIYSKQVGYTPDYLFLLQTILRSDPQGAVNFALMMSQMEGGCPVDYNTITDLFLQRNMIREATAFLLDVLKPNLPEHGFLQTKVLEINLVTFPNVADAILANGMFSHYDRPRIAQLCEKAGLYVRALQHYSELPDIKRVIVNTHAIEPQALVEFFGTLSREWALECMKDLLVINIKGNLQIIVQVAKEYCEQLGVDACIKIFEQFKSYEGLYFFLGSYLSSSEDPDIHFKYIESAARTGQIKEVERVTRESNFYDAEKTKNFLMEAKLPDARPLINVCDRFDFVPDLTHYLYTNNMLRYIEGYVQKVNPGNAPLVVGQLLDDECPEDFIKGLILSVRSLLPVEPLVEECEKRNRLRLLTQFLEHLVSEGSQDVHVHNALGKIIIDSNNNPEHFLTTNPYYDSRVVGKYCEKRDPTLAVVAYRRGQCDDELINVTNKNSLFKLQARYVVERMDGDIWEKVLNPENEFRRQLIDQVVSTALPESKSPEQVSAAVKAFMTADLPHELIELLEKIVLQNSAFSGNFNLQNLLILTAIKADPSRVMDYINRLDNFDGPAVGEVAVEAQLYEEAFAIFKKFNLNVQAVNVLLDNIRDINRAVEFAFRVEEDAVWSQVAKTQLREGLVSDAIESFIRADDATHFLDVISAAEDADVYHDLVKYLLMVRQKTKEPKVDSELIYAYAKIDRLGDIEEFILMPNVANLPNVGDKLFDEGLYEAAKIIFAFISNWAKLASTLVKLNQFQGAVDAARKANSAKTWKDVCFACVDAEEFRLAQICGLNIIVQVDDLEEVSEYYQNRGCFNELISLMESGLGLERAHMGIFTELGVLYARYRHEKLMEHIKLFSTRLNIPKLIRACDEQQHWKELTYLYIQYDEFDNAATTVMNHSPDAWDHMQFKDIVVKVANVELYYKAVHFYLQEHPDLINDLLNVLALRVDHTRVVDIMRKAGHIRLVKPYMIAVQSNNVSAVNEALNEIYVEEEDYDRLRESIELHDNFDQIGLAQKIEKHELLEMRRVAASIYKKAGRWKQSIALSKKDNLYKDAMETASQSGDRELAEELLVYFIEQGKKECFASCLFVCYDLVRPDVALELAWMNNMIDFAFPYLLQFIREYTGKVDELVKDKIEAQSEAKARENEEKDVMKQQNMYAQLLPLALPAPPMPGMGGGFAAAPPQMGGMGMPPMPPFGMPPMGPY

SEQ ID NO: 9603 - protein, 1708 aa, Fragaria vesca
MAAANAPITMKEALTLPSVGINPQFITFTHVTMESDKYICVRETAPQNSIVIIDMSMPNQPLRRPITADSALMNPNSKILALKAQVQGSTQDHLQIFNIEMKAKLKSYLMPEQIVFWKWITPKMLGLVTQTTVYHWSIEGESEPVKVFERTANLVNNQIINYRCDPSEKWLVLIGIAPGAPERPQLVKGNLQLFSVEQQRSQALEAHAASFAQYKVPGNENPSILISFATKTLNAGQITSKLHVIELGAQSGKPSFSKKQADLFFPPDFADDFPVAMQMSHKYSLIYVITKLGLLFVYDLETASAVYRNRISPDPIFLTTEASSVGGFYAVNRRGQVLLATINEQTIVPFVSGQLNNLELAVNLAKRGNLPGAENLVVQRFQELFAQTKYKEAAELAAESPQGILRTPDTVAKFQSVPVQAGQTPPLLQYFGTLLTRGKLNAFESLELSRLVVNQNKKNLLENWLAEDKLECSEELGDLVKTVDNDLALKIYIKARATPKVVAAFAERREFDKILIYSKQVGYTPDYLFLLQTILRADPQGAVNFALMMSQMEGGCPVDYNTITDLFLQRNLIREATAFLLDVLKPNLPEHAFLQTKVLEINLVTFPNVADAILANGMFSHYDRPRIAQLCEKAGLYVRALQHYSELPDIKRVIVNTHAIEPQSLVEFFGTLSKEWALECMKDLLLVNLRGNLQIIVQVAKEYSDQLGTDQCMKLFEQFKSYEGLYFFLGSFLSSSEDPEIHFKYIEAAAKTGQIKEVERVTRESNFYDAEKTKNFLMEAKLPDARPLINVCDRFGFVPDLTHYLYTNNMLRYIEGYVQKVNPSNAPLVVGQLLDDECPEDFIKGLILSVRSLLPVEPLVEECEKRNRLRLLTQFLEHLVSEGSQDVHVHNALGKIIIDSGNNPEHFLTTNPYYDSRVVGKYCEKRDPTLAVVAYRRGQCDDELINVTNKNSLFKLQARYVVERMDEDLWAKALDPENEYRRQLIDQVVSTALPESKSPEQVSAAVKAFMTADLPHELIELLEKIVLQNSAFSGNFNLQNLLILTAIKADPSRVMDYINRLDNFDGPAVGEVAVEAQLFEEAFAIFKKFNLNVQAVNVLLDNIRSIDRAVEFAFRVEEDAVWSQVGKAQLREGLVSDAIESFIRADDATQFLDVIRASEDADVYHDLVRYLLMVRQKTKEPRVDSELIYAYAKIDRLADIEEFILMPNVANLQNVGDRLYDEALYEAAKIIYAFISNWAKLAVTLVKLKQFQGAVDAARKANSAKTWKEVCFACVDAEEFRLAQICGLNIIIQVDDLEEVSEFYQNRGCFNELISLMESGLGLERAHMGIFTELGVLYARYRPEKLMEHIKLFSTRLNIPKLIRACDEQQHWKELTYLYIQYDEFDNAATTIMNHSPEAWDHMQFKDVAVKVANVELYYKAVHFYLQEHPDLINDILNVLALRVDHTRVVDIMRKAGHLLLVKPYMVAVQSNNVSAVNEALNEIYVEEEDYERLRESIDLHDSFDQIGLAQKIEKHELLEMRRVAAYIYKKAGRWKQSIALSKKDKLYKDAMETASQSGDRELAEELLVYFIEQGKKECFASCLFVCYDLIRPDTALELAWMNNMIDFAFPYLLQFIREYTGKVDELVKDRIEAQNEMKSKEKEEKEVIAQQNMYAQLLPLALPAPPMPGMGGGMGGMGGGYGPPPPMGGMGMPPMPPYGMPPMGSSY

SEQ ID NO: 9604 - protein, 1692 aa, Vinca minor
LTLASIGINPQFITFTNVTMESDKYICVRETSPQNSVVIIDMSMPMQPLRRPITADSALMNPNTRILALKAQLPGTTQDHLQIFNIEAKAKMKSYQMPEQVAFWKWITPKMLGLVTQTAVYHWTIEGESEPLKMFDRTANLANNQIINYRCDPSEKWLVLVGIAPGSPERPQLVKGNMQLYSVEQQRSQALEAHAASFASFRVPGNDKDSILISFATKSTNAGQVVSKLHVIELGAQPGKPSFTKKQADLFFPPDFADDFPVAMQISHKYSLIYVITKLGLLFVYDLDTATAVYRNRISPDPIFLTSEASSVGGFYAINRRGQVLLATVNEATIVPFVSGQLNNLELAVNLAKRGNLPGAENLVVQRFQELFAQTKYKEAAELAAESPQGILRTPDTVAKFQSVPVQAGQTPPLLQYFGTLLTRGKLNAFESLELSRLVVNQNKKNLLENWLAEDKLECSEELGDLVKTVDNDLALKIYIKARATPKVVAAFAERREFDKILIYSKQVGYTPDYLFLLQTILRSDPQGAVNFALMMSQMEGGCPVDYNTITDLFLQRNMIREATAFLLDVLKPNLPEHAFLQTKVLEINLVTFPNVADAILANGMFSHYDRPRIAQLCEKAGLYMRALQHYAELPDIKRVIVNTHAIEPQSLVEFFGTLSREWALECMKDLLLVNLRGNLQIIVQVAKEYCEQMGVDACIKLFEQFKSYEGLYFFLGSYLSSSEDPDIHFKYIEAAAKTGQIKEVERVTRESNFYDAEKTKNFLMEAKLPDARPLINVCDRFGFVPDLTHYLYTNNMLRYIEGYVQKVNPGNAPLVVGQLLDDECPEDFIKGLILSVRSLLPVEPLVDECEKRNRLRLLTQFLEHLVSEGSQDVHVHNALGKIIIDSNNNPEHFLTTNPYYDSRVVGKYCEKRDPTLAVVAYRRGQCDDELINVTNKNSLFKLQARYVVERMDGDLWEMVLNPENEFRRQLIDQVVSTALPESKSPEQVSAAVKAFMTADLPHELIELLEKIVLQNSAFSGNFNLQNLLILTAIKADPSRVMDYVNRLDNFDGPAVGEVAVEAQLYEEAFAIFKKFNLNVQAVNVLLDNIRDINRAVEFAFRVEEDAVWSQVAKAQLREGLVSDAIESFIRADDATQFLEVIKAAEDAEVYHDLVKYLLMVRKKSKEPKVDSEIIYAYAKIDRLSDIEEFILMPNVANLPNVGDRLYDEALYEAAKIIYAFISNWAKLAVTLVKLKQFQGAVDAARKANSSKTWKEVCFACVDAEEFRLAQICGLNIIVQVDDLEEVSEYYQNRGCFNELISLMESGLGLERAHMGIFTELGVLYARYRYEKLMEHIKLFSTRLNIPKLIRACDEQQHWKELTYLYIQYDEFDNAATTVMNHSPDAWDHMQFKDIIVKVANVELYYKAVHFYLQEHPDLINDVLNVLALRVDHTRVVDIMRKAGHLRLVKPYMVAVQSNNVSAVNEALNEIYVEEEDYDRLRESIDLHDSFDQIGLAQKIEKHELLEMRRVAAYIYKKAGRWKQSIALSKKDNLYKDAMETASQSGDRELAEELLVYFIEQGKKECFASCLFVCYDLIRADVALELAWMNNMIDFAFPYLLQFIREYTGKVDDLIKDKIEAMKEVKAKENEEKDVIMQQNMYAQLLPLALPAPPGMGGGFAPPPPPPMGGMGMPPGMGMPPMPQYGMPPMGY

SEQ ID NO: 9605 - protein, 1702 aa, Arabidopsis lyrata
MAAANAPIIMKEVLTLPSVGIGQQFITFTNVTMESDKYICVRETAPQNSVVIIDMNMPMQPLRRPITADSALMNPNSRILALKAQVPGTTQDHLQIFNIEAKAKLKSHQMPEQVAFWKWITPKMLGLVTQTSVYHWSIEGDSEPVKMFDRTANLANNQIINYKCSPNEKWLVLIGIAPGSPERPQLVKGNMQLFSVDQQRSQALEAHAASFAQFKVPGNENPSILISFASKSFNAGQITSKLHVIELGAQPGKPSFTKKQADLFFPPDFADDFPVAMQVSHKFNLIYVITKLGLLFVYDLETASAIYRNRISPDPIFLTSEASSLGGFYAINRRGQVLLATVNEATIIPFISGQLNNLELAVNLAKRGNLPGAENLVVQRFQELFAQTKYKEAAELAAESPQGILRTPDTVAKFQSVPVQAGQTPPLLQYFGTLLTRGKLNTYESLELSRLVVNQNKKNLLENWLAEDKLECSEELGDLVKTVDNDLALKIYIKARATPKVVAAFAERREFDKILIYSKQVGYTPDYMFLLQTILRTDPQGAVNFALMMSQMEGGCPVDYNTITDLFLQRNLIREATAFLLDVLKPNLPEHAFLQTKVLEINLVTFPNVADAILANGMFSHYDRPRVAQLCEKAGLYIQSLKHYSELPDIKRVIVNTHAIEPQALVEFFGTLSSEWAMECMKDLLLVNLRGNLQIIVQACKEYCEQLGVDACIKLFEQFKSYEGLYFFLGSYLSMSEDPEIHFKYIEAAAKTGQIKEVERVTRESNFYDAEKTKNFLMEAKLPDARPLINVCDRFGFVPDLTHYLYTNNMLRYIEGYVQKVNPGNAPLVVGQLLDDECPEDFIKGLILSVRSLLPVEPLVDECEKRNRLRLLTQFLEHLVSEGSQDVHVHNALGKIIIDSNNNPEHFLTTNPYYDSKVVGKYCEKRDPTLAVVAYRRGQCDEELINVTNKNSLFKLQARYVVERMDGDLWEKVLTEENEYRRQLIDQVVSTALPESKSPEQVSAAVKAFMTADLPHELIELLEKIVLQNSAFSGNFNLQNLLILTAIKADPSRVMDYINRLDNFDGPAVGEVAVDAQLYEEAFAIFKKFNLNVQAVNVLLDNVRSIERAVEFAFRVEEDAVWSQVAKAQLRDGLVSDAIESFIRADDATQFLEVIRASEDTNVYDDLVRYLLMVRQKVKEPKVDSELIYAYAKIERLGEIEEFILMPNVANLQNVGDRLYDEALYEAAKIIYAFISNWAKLAVTLVKLQQFQGAVDAARKANSAKTWKEVCFACVDAEEFRLAQICGLNIIIQVDDLEEVSEYYQNRGCFNELISLMESGLGLERAHMGIFTELGVLYARYRYEKLMEHIKLFSTRLNIPKLIRACDEQQHWQELTYLYIQYDEFDNAATTVMNHSPEAWEHMQFKDIVAKVANVELYYKAVHFYLQEHPDIINDLLNVLALRLDHTRVVDIMRKAGHLRLIKPYMVAVQSNNVSAVNEALNEIYVEEEDYDRLRESIDLHDSFDQIGLAQKIEKHELVEMRRVAAYIYKKAGRWKQSIALSKKDNMYKDCMETASQSGDHDLAEQLLVYFIEQGKKECFATCLFVCYDLIRPDVALELAWINNMIDFAFPYLLQFIREYSGKVDELIKDKLEAQKEVKAKEQEEKDVMSQQNMYAQLLPLALPAPPMPGMGGGGYGPPPPMGGMPGMPPMPPYGMPPMGGY

SEQ ID NO: 9606 - protein, 1707 aa, Brassica rapa
MAAANAPITMKEVLTLPSIGINQQFITFTNVTMESDKYICVRETAPQNSVVIIDMNMPMQPLRRPITADSALMNPNSRILALKAQVPGTTQDHLQIFNIEAKAKLKSHQMPEQVSFWKWITPKMLGLVTQTSVYHWSIEGDSEPVKMFDRTANLANNQIINYKCSPNEKWLVLIGIAPGSPERPQLVKGNMQLFSVDQQRSQALEAHAASFAQFKVLGNENPSILISFASKSFNAGQITSKLHVIELGAQPGKPSFSKKQADLFFPPDFADDFPVAMQVSHKFNLIYVITKLGLLFVYDLETASAIYRNRISPDPIFLTSEASSVGGFYAINRRGQVLLATVNEATIIPFISGQLNNLELAVNLAKRGNLPGAENLVVQRFQELFAQTKYKEAAELAAESPQGILRTPDTVAKFQSVPVQAGQTPPLLQYFGTLLTRGKLNSYESLELSRLVVNQNKKNLLENWLAEDKLECSEELGDLVKTVDNDLALKIYIKARATPKVVAAFAERREFDKILIYSKQVGYTPDYMFLLQTILRTDPQGAVNFALMMSQMEGGCPVDYNTITDLFLQRNLIREATAFLLDVLEPNLPEHAFLQTKVLEINLVTFPNVADAILANGMFSHYDRPRVAQLCEKAGLYIQSLKHYSELPDIKRVIVNTHAIEPQALVEFFGTLSSEWAMECMKDLLLVNLRGNLQIIVQACKEYCEQLGVDSCIKLFEQFKSYEGLYFFLGSYLSMSEDPEIHFKYIEAAAKTGQIKEVERVTRESNFYDAEKTKNFLMEAKLPDARPLINVCDRFGFVPDLTHYLYTNNMLRYIEGYVQKVNPGNAPLVVGQLLDDECPEDFIKGLILSVRSLLPVEPLVDECEKRNRLRLLTQFLEHLVSEGSQDVHVHNALGKIIIDSNNNPEHFLTTNPYYDSKVVGKYCEKRDPTLAVVAYRRGQSDEELINVTNKNSLFKLQARYVVERMDGDLWDKVLLEENEYRRQLIDQVVSTALPESKSPEQVSAAVKAFMTADLPHELIELLEKIVLQNSAFSGNFNLQNLLILTAIKADPSRVMDYINRLDNFDGPAVGDVAVDAQLYEEAFAIFKKFNLNVQAVNVLLDNVRSIERAVEFAFRVEEDSVWSQVAKAQLRDGLVSDAIESFIRADDATHFLEVIRATEDANVYDDLVKYLLMVRQKVKEPKVDSELIYAYAKIERLGEIEEFILMPNVANLQQVGDRLYDEALYEAAKIIYAFISNWGKLAVTLVKLQQFQGAVDAARKANSAKTWKEVCFACVDAEEFRLAQICGLNIIIQVDDLEEVSEYYQNRGCFNELISLMESGLGLERAHMGIFTELGVLYARYRYEKLMEHIKLFSTRLNIPKLIRACDEQQHWQELTYLYIQYDEFDNAATTVMNHSPEAWEHMQFKDIVAKVANVELYYKAVHFYLQEHPDIINDLLNVLALRLDHTRVVDIMRKAGQLRLIKPYMVAVQSNNVSAVNEALNEIYVEEEDYDRLRESIDLHDSFDQIGLAQKIEKHELVEMRRVAAYIYKKAGRWKQSIALSKKDNMYKDCMETASQSGDHDLAEQLLVYFIEQGKKECFATCLFVCYDLIRPDVALEHAWINNMLDFAFPYLLQFIREYSGKVDELIKDKLEAQKEVKAKEQEEKDVMSQQNMYAQLLPLALPAPPMPGMGGGPGMGGGYGPPPQMGGMPGMPPMPPYGMPPMGGY

SEQ ID NO: 9607 - protein, 391 aa, Populus trichocarpa
MAAANAPITMKEVLTLPSIGISPQFITFTNVTMESDKYICVRETAPQNSVVIIDMHMPMQPLRRPITADSALMNPNSRILALKAQLPGTTQDHLQIFNIEMKAKMKSYQMPEQIVFWKWITPKMLGLVTQTSVYHWSIEGDSEPVKMFERTANLQSNQIINYKCDPSEKWLVLIGIAPGSPERQQLVKGNMQLFSVDQQRSQALEAHAASFAQFKVPGNENPSTLISFATKSFNAGQVTSKLHVIELGAQPGKPSFTKKQADLFFPPDFVDDFPVAMQISHKYSLIYVITKLGLLFVYDLETATAVYRNRISPDPIFLTAEASVVGGFYAINRRGQVLLATVNEAMIVPFVSGQLNNLELAVNLAKRGNLPGAENLASCPAFPRTVCSNKV

SEQ ID NO: 9608 - protein, 123 aa, Mimulus guttatus
MAAANAPITMKEALTLTSIGINQQFITFTNVTMESDKYICVRETSPQNSVVIIDMSMPNQPLRRPITADSALMNPNTRILALKAQLAGTTQDHLQIFNIEAKAKMKSHQMPEQASGILEVDYP

SEQ ID NO: 9609 - protein, 1706 aa, Eutrema halophilum
MAAANAPITMKEVLTLPSIGINQQFITFTNVTMESDKYICVRETAPQNSVVIIDMNMPMQPLRRPITADSALMNPNSRILALKAQVPGTTQDHLQIFNIEAKAKLKSHQMPEQVAFWKWITPKMLGLVTQTSVYHWSIEGDSEPVKMFDRTANLANNQIINYKCSPNEKWLVLIGIAPGSPERPQLVKGNMQLFSVDQQRSQALEAHAASFAQFKVPGNENPSILISFASKSFNAGQITSKLHVIELGAQPGKPSFTKKQADLFFPPDFADDFPVAMQVSHKFNLIYVITKLGLLFVYDLETASAIYRNRISPDPIFLTSEASSVGGFYAINRRGQVLLATVNEATIIPFISGQLNNLELAVNLAKRGNLPGAENLVVQRFQELFAQTKYKEAAELAAESPQGILRTPDTVAKFQSVPVQAGQTPPLLQYFGTLLTRGKLNVYESLELSRLVVNQNKKNLLENWLAEDKLECSEELGDLVKTVDNDLALKIYIKARATPKVVAAFAERREFDKILIYSKQVGYTPDYMFLLQTILRTDPQGAVNFALMMSQMEGGCPVDYNTITDLFLQRNLIREATAFLLDVLKPNLPEHAFLQTKVLEINLVTFPNVADAILANGMFSHYDRPRVAQLCEKAGLYIQSLKHYSELPDIKRVIVNTHAIEPQALVEFFGTLSSEWAMECMKDLLLVNLRGNLQIIVQACKEYCEQLGVDSCIKLFEQFKSFEGLYFFLGSYLSMSEDPEIHFKYIEAAAKTGQIKEVERVTRESNFYDAEKTKNFLMEAKLPDARPLINVCDRFGFVPDLTHYLYTNNMLRYIEGYVQKVNPGNAPLVVGQLLDDECPEDFIKGLILSVRSLLPVEPLVEECEKRNRLRLLTQFLEHLVSEGSQDVHVHNALGKIIIDSNNNPEHFLTTNPYYDSKVVGKYCEKRDPTLAVVAYRRGQCDEELINVTNKNSLFKLQARYVVERMDGDLWEKVLTEENEYRRQLIDQVVSTALPESKSPEQVSAAVKAFMTADLPHELIELLEKIVLQNSAFSGNFNLQNLLILTAIKADPSRVMDYINRLDNFDGPAVGEVAVDAQLYEEAFAIFKKFNLNVQAVNVLLDNVRSIERAVEFAFRVEEDAVWSQVAKAQLRDGLVSDAIESFIRADDATQFLEVIRASEDTNVYDDLVRYLLMVRQKVKEPKVDSELIYAYAKIERLGEIEEFILMPNVANLQNVGDRLYDEALYEAAKIIYAFISNWAKLAVTLVKLQQFQGAVDAARKANSAKTWKEVCFACVDAEEFRLAQICGLNIIIQVDDLEEVSEYYQNRGCFNELISLMESGLGLERAHMGIFTELGVLYARYRYEKLMEHIKLFSTRLNIPKLIRACDEQQHWQELTYLYIQYDEFDNAATTVMNHSPEAWEHMQFKDIVAKVANVELYYKAVHFYLQEHPDIINDLLNVLALRLDHTRVVDIMRKAGHLRLIKPYMVAVQSNNVSAVNEALNEIYVEEEDYDRLRESIDLHDSFDQIGLAQKIEKHELVEMRRVAAYIYKKAGRWKQSIALSKKDNMYKDCMETASQSGDHDLAEQLLVYFIEQGKKECFATCLFVCYDLIRPDVALELAWINNMIDFAFPYLLQFIREYSGKVDELIKDKIEAQKEVKAKEQEEKEVMSQQNMYAQLLPLALPAPPMPGMGGGGPPGMGGGYGPPPPMGGMPPMPPFGMPPMGGY

SEQ ID NO: 9610 - protein, 1703 aa, Arabidopsis lyrata
MAAANAPITMKEVLTLPSVGINQQFITFTNVTMESDKYICVRETSPQNSVVIIDMNMPMQPLRRPITADSALMNPNSRILALKAQVPGTTQDHLQIFNIEAKAKLKSHQMPEQVVFWKWITPKMLGLVTQNSVYHWSIEGDSEPVKMFDRTANLTNNQIINYKCSPNEKWLVLIGIAPGSPERQQLVKGNMQLFSVDQQRSQALEAHAASFAQFKVPGNENPSILISFASKSFNAGQITSKLHVIELGAQPGKPSFTKKQADLFFPPDFADDFPVAMQVSHKFNLIYVITKLGLLFVYDLETASAIYRNRISPDPIFLTSEASSVGGFYAINRRGQVLLATVNEATIIPFISGQLNNLELAVNLAKRGNLPGAENLVVQRFQELFAQTKYKEAAELAAESPQGILRTPDTVAKFQSVPVQAGQTPPLLQYFGTLLTRGKLNSYESLELSRLVVNQNKKNLLENWLAEDKLECSEELGDLVKTVDNDLALKIYIKARATPKVVAAFAERREFDKILIYSKQVGYTPDYLFLLQTILRTDPQGAVNFALMMSQMEGGSPVDYNTITDLFLQRNLIREATSFLLDVLKPNLPEHAFLQTKVLEINLVTFPNVADAVLANGMFTHYDRPRIAQLCEKAGLYIQSLKHYSELPDIKRVIVNTHAIEPQALVEFFGTLSSEWAMECMKDLLLVNLRGNLQIIVQACKEYCEQLGVDACIKLFEQFKSYEGLYFFLGSYLSMSEDPEIHFKYIEAAAKTGQIKEVERVTRESNFYDAEKTKNFLMEAKLPDARPLINVCDRFGFVPDLTHYLYTNNMLRYIEGYVQKVNPGNAPLVVGQLLDDECPEDFIKGLILSVRSLLPVEPLVEECEKRNRLRLLTQFLEHLVSEGSQDVHVHNALGKIIIDSNNNPEHFLTTNPYYDSKVVGKYCEKRDPTLAVVAYRRGQCDEELINVTNKNSLFKLQARYVVERMDGDLWDKVLDENNDYRRQLIDQVVSTALPESKSPEQVSAAVKAFMTADLPHELIELLEKIVLQNSAFSGNFNLQNLLILTAIKADPSRVMDYINRLDNFDGPAVGEVAVEAQLYEEAFAIFKKFNLNVQAVNVLLDNVRSIERAVEFAFRVEEDSVWSQVAKAQLREGLVSDAIESFIRADDATHFLEVIRVSEDTDVYDDLVKYLLMVRQKVKEPKVDSELIYAYAKIDRLGEIEEFILMPNVANLQNVGDRLYDEALYEAAKIIYAFISNWGKLAVTLVKLQQFQGAVDAARKANSAKTWKEVCFACVDAEEFRLAQICGLNIIIQVDDLEEVSEYYQNRGCFNELISLMESGLGLERAHMGIFTELGVLYARYRYEKLMEHIKLFSTRLNIPKLIRACDEQQHWQELTYLYIQYDEFDNAATTVMNHSPEAWEHMQFKDIVAKVANVELYYKAVHFYLQEHPDLINDLLNVLALRLDHTRVVDIMRKAGHLRLIKPYMIAVQSNNVSAVNEALNEIYVEEEDYDRLRESIDLHDSFDQIGLAQKIEKHELVEMRRVAAYIYKKAGRWKQSIALSKKDNMYKDCMETASQSGEHELAEQLLVYFIEQGKKECFATCLFVCYDLIRPDVALELAWINNMMDFAFPYLLQFIREYSGKVDELIKDKLEAQKEVKAKEQEEKDVMSQQNMYAQLLPLALPAPPMPGMGGGGGYGPPPQMGGMPGMPPMPPYGMPPMGGY

SEQ ID NO: 9611 - protein, 1705 aa, Arabidopsis thaliana
MAAANAPIIMKEVLTLPSVGIGQQFITFTNVTMESDKYICVRETAPQNSVVIIDMNMPMQPLRRPITADSALMNPNSRILALKAQVPGTTQDHLQIFNIEAKAKLKSHQMPEQVAFWKWITPKMLGLVTQTSVYHWSIEGDSEPVKMFDRTANLANNQIINYKCSPNEKWLVLIGIAPGSPERPQLVKGNMQLFSVDQQRSQALEAHAASFAQFKVPGNENPSILISFASKSFNAGQITSKLHVIELGAQPGKPSFTKKQADLFFPPDFADDFPVAMQVSHKFNLIYVITKLGLLFVYDLETASAIYRNRISPDPIFLTSEASSVGGFYAINRRGQVLLATVNEATIIPFISGQLNNLELAVNLAKRGNLPGAENLVVQRFQELFAQTKYKEAAELAAESPQGILRTPDTVAKFQSVPVQAGQTPPLLQYFGTLLTRGKLNSYESLELSRLVVNQNKKNLLENWLAEDKLECSEELGDLVKTVDNDLALKIYIKARATPKVVAAFAERREFDKILIYSKQVGYTPDYMFLLQTILRTDPQGAVNFALMMSQMEGGCPVDYNTITDLFLQRNLIREATAFLLDVLKPNLPEHAFLQTKVLEINLVTFPNVADAILANGMFSHYDRPRVAQLCEKAGLYIQSLKHYSELPDIKRVIVNTHAIEPQALVEFFGTLSSEWAMECMKDLLLVNLRGNLQIIVQACKEYCEQLGVDACIKLFEQFKSYEGLYFFLGSYLSMSEDPEIHFKYIEAAAKTGQIKEVERVTRESNFYDAEKTKNFLMEAKLPDARPLINVCDRFGFVPDLTHYLYTNNMLRYIEGYVQKVNPGNAPLVVGQLLDDECPEDFIKGLILSVRSLLPVEPLVAECEKRNRLRLLTQFLEHLVSEGSQDVHVHNALGKIIIDSNNNPEHFLTTNPYYDSKVVGKYCEKRDPTLAVVAYRRGQCDEELINVTNKNSLFKLQARYVVERMDGDLWEKVLTEENEYRRQLIDQVVSTALPESKSPEQVSAAVKAFMTADLPHELIELLEKIVLQNSAFSGNFNLQNLLILTAIKADPSRVMDYINRLDNFDGPAVGEVAVDAQLYEEAFAIFKKFNLNVQAVNVLLDNVRSIERAVEFAFRVEEDAVWSQVAKAQLREGLVSDAIESFIRADDTTQFLEVIRASEDTNVYDDLVRYLLMVRQKVKEPKVDSELIYAYAKIERLGEIEEFILMPNVANLQHVGDRLYDEALYEAAKIIYAFISNWAKLAVTLVKLQQFQGAVDAARKANSAKTWKEVCFACVDAEEFRLAQICGLNIIIQVDDLEEVSEYYQNRGCFNELISLMESGLGLERAHMGIFTELGVLYARYRYEKLMEHIKLFSTRLNIPKLIRACDEQQHWQELTYLYIQYDEFDNAATTVMNHSPEAWEHMQFKDIVAKVANVELYYKAVHFYLQEHPDIINDLLNVLALRLDHTRVVDIMRKAGHLRLIKPYMVAVQSNNVSAVNEALNEIYAEEEDYDRLRESIDLHDSFDQIGLAQKIEKHELVEMRRVAAYIYKKAGRWKQSIALSKKDNMYKDCMETASQSGDHDLAEQLLVYFIEQGKKECFATCLFVCYDLIRPDVALELAWINNMIDFAFPYLLQFIREYSGKVDELIKDKLEAQKEVKAKEQEEKDVMSQQNMYAQLLPLALPAPPMPGMGGGGYGPPPQMGGMPGMSGMPPMPPYGMPPMGGY

SEQ ID NO: 9612 - protein, 1707 aa, Brassica napus
MAAANAPITMKEVLTLPSIGINQQFITFTNVTMESDKYICVRETAPQNSVVIIDMNMPMQPLRRPITADSALMNPNSRILALKAQVPGTTQDHLQIFNIEAKAKLKSHQMPEQVAFWKWITPKMLGLVTQTSVYHWSIEGDSEPVKMFDRTANLANNQIINYKCSPDEKWLVLIGIAPGSPERPQLVKGNMQLFSVNQQRSQALEAHAASFAQFKVPGNENPSILISFASKSFNAGQITSKLHVIELGAQPGKPSFSKKQADLFFPPDFADDFPVAMQVSHKFNLIYVITKLGLLFVYDLETASAIYRNRISPDPIFLTSEASSVGGFYAINRRGQVLLATVNEATIIPFISGQLNNLELAVNLAKRGNLPGAENLVVQRFQELFAQTKYKEAAELAAESPQGILRTPDTVAKFQSVPVQAGQTPPLLQYFGTLLTRGKLNSYESLELSRLVVNQNKKNLLENWLAEDKLECSEELGDLVKTVDNDLALKIYIKARATPKVVAAFAERREFDKILIYSKQVGYTPDYMFLLQTILRTDPQGAVNFALMMSQMEGGCPVDYNTITDLFLQRNLIREATAFLLDVLKPNLPEHAFLQTKVLEINLVTFPNVADAILANGMFSHYDRPRVAQLCEKAGLYIQSLKHYSELPDIKRVIVNTHAIEPQALVEFFGTLSSEWAMECMKDLLLVNLRGNLQIIVQACKEYCEQLGVDSCIKLFEQFKSYEGLYFFLGSYLSMSEDPEIHFKYIEAAAKTGQIKEVERVTRESNFYDAEKTKNFLMEAKLPDARPLINVCDRFGFVPDLTHYLYTNNMLRYIEGYVQKVNPGNAPLVVGQLLDDECPEDFIKGLILSVRSLLPVEPLVEECEKRNRLRLLTQFLEHLVSEGSQDTHVHNALGKIIIDSNNNPEHFLTTNPYYDSKVVGKYCEKRDPTLAVVAYRRGQCDEELINVTNKNSLFKLQARYVVERMDGDLWDKVLIEENEYRRQLIDQVVSTALPESKSPEQVSAAVKAFMTADLPHELIELLEKIVLQNSAFSGNFNLQNLLILTAIKADPSRVMDYINRLDNFDGPAVGEVAVDAQLYEEAFAIFKKFNLNVQAVNVLLDNVRSIERAVEFAFRVEEDSVWSQVAKAQLRDGLVSDAIESFIRAEDATHFLEVIRATEDANVYDDLVRYLLMVRQKVKEPKVDSELIYAYAKIDRLGEIEEFILMPNVANLQTVGDRLYDEALYEAAKIIYAFISNWAKLAVTLVKLQQFQGAVDAARKANSAKTWKEVCFACVDAEEFRLAQICGLNVIIQVDDLEEVSEFYQNRGCFSELISLMESGLGLERAHMGIFTELGVLYARYRYEKLMEHIKLFSTRLNIPKLIRACDEQQHWQELTYLYIQYDEFDNAATTVMNHSPEAWEHMQFKDIVAKVANVELYYKAVHFYLQEHPDIINDLLNVLALRLDHTRVVDIMRKAGQLRLIKPYMVAVQSNNVSAVNEALNEIYVEEEDYDRLRESIDLHDSFDQIGLAQKIEKHELVEMRRVAAYIYKKAGRWKQSIALSKKDNMYKDCMETASQSGDHDLAEQLLVYFIEQGKKECFATCLFVCYDLIRPDVALELAWINNMIDFAFPYLLQFIREYSGKVDELIKDKLEAQKEVKAKEQEEKDVMSQQNMYAQLLPLALPAPPMPGMGGGPGMGGGYGPPPQMGGMPGMPPMPPYGMPPMGGY

SEQ ID NO: 9613 - protein, 1708 aa, Glycine max
MAAANAPITMKEALTLPSIGINSQFITFTHVTMESDKYICVRETAPQNSVVIIDMNMPNQPLRRPITADSALMNPNSRILALKAQLQGTTQDHLQIFNIEMKAKMKSYQMPEQVVFWKWISPKMLGLVTQTSVYHWSIEGDSEPVKMFERTANLANNQIINYRCDPTEKWLVLIGIAPGSPERPQLVKGNMQLFSVDQQRSQALEAHAASFAQFKVPGNENPSVLISFASKTLNAGQVISKLHVIELGAQPGKPSFTKKQADLFFPPDFADDFPVAMQISHKYNLIYVITKLGLLFVYDLETATAVYRNRISPDPIFLTSEATSVGGFYAINRRGQVLLATVNEQTIVNFVSGQLNNLELAVSLAKRGNLPGAEKLVVERFHELFAQTKYKEAAELAAESPQGILRTPDTVAKFQSVPVQVGQTPPLLQYFGTLLTRGKLNAFESLELSRLVVNQNKKNLLENWLAEDKLECSEELGDLVKTVDNDLALKIYIKARATPKVVAAFAERREFDKILIYSKQVGYTPDYLFLLQTILRTDPQGAVNFALMMSQMEGGSPVDYNTITDLFLQRNLIREATAFLLDVLKPNLPEHGFLQTKVLEINLVTFPNVADAILANGMFSHYDRPRIAQLCEKAGLYVRALQHYTELPDIKRVIVNSHAIEPQSLVEFFGTLSKEWALECMKDLLLANLRGNLQIIVQVAKEYCEQLGVDACIKLFEQFRSYEGLYFFLGSYLSSSEDPDIHFKYIEAAAKTGQIKEVERVTRESNFYDAEKTKNFLMEAKLPDARPLINVCDRFGFVPDLTHYLYTNNMVRYIEGYVQKVNPGNAPLVVGQLLDDECAEDFIKGLILSVRSLLPVEPLVEECEKRWNRLRLLTQFLEHLVSEGSQDVHVHNALGKIIIDSNNNPEHFLTTNPYYDSRVVGKYCEKRDPTLAVVAYRRGQCDDELINVTNKNSLFKLQARYVVERMDGDLWAKVLDPDNEYRRQLIDQVVSTALPESSSPEQVSAAVKAFMTADLPHELIELLEKIVLQNSAFSGNFNLQNLLILTAIKADPSRVMDYVNRLDNFDGPAVGEMAVEAQLYEEAFAIFKKFNLNVQAVNVLLDNIHSIDRAVEFAFRVEEDAVWSQVAKAQLRDGLVSDAIESFIRADDATQFLDVIRAAEDGNVYHDLVKYLLMVRGKAKEPKVDSELIYAYAKIDRLSDIEEFILMPNVANLQNVGDRLYDEALYEAAKIIFAFISNWAKLAITLVKLQQFQGAVDAARKANSSKTWKEVCFACVDAEEFRLAQICGLNIIVQVDDLEEVSEYYQNRGCFNELISLMESGLGLERAHMGIFTELGVLYARYRPEKLMEHIKLFSTRLNIPKLIRACDEQQHWKELTYLYIQYDEFDNAATTIMNHSPEAWDHMQFKDVVVKVANVELYYKAVHFYLEEHPDLINDVLNVLALRVDHARVVDIMRKAGHLRLVKPYMVAVQSNNVSAVNEALNEIYVEEEDYDRLRESIDLHDNFDQIGLAQKIEKHELLEMRRVAAYIYKKAGRWKQSIALSKKDNLYKDAMETASQSGERELAEELLVYFIDQGKKECFASCLFVCYDLIRADIVLELAWMHNMIDFAFPYLLQFIREYTGKVDELVKDKIEAQNEVKVKEQEEKDVVAQQNMYAQLLPLALPAPPMPGMGGPGGMGGGFAPPPPMGGLGMPPMPPYGMPPMGSSF

SEQ ID NO: 9614 - protein, 1707 aa, Eutrema parvulum
MAAANAPITMKEVLTLPSIGINQQFITFTNVTMESDKYICVRETAPQNSVVIIDMNMPMQPLRRPITADSALMNPNSRILALKAQVPGTTQDHLQIFNIEAKAKLKSHQMPEQVAFWKWITPKMLGLVTQTSVYHWSIEGDSEPVKMFDRTANLANNQIINYKCSPNEKWLVLIGIAPGSPERPQLVKGNMQLFSVDQQRSQALEAHAASFAQFKVPGNENPSILISFASKSFNAGQITSKLHVIELGAQAGKPSFSKKQADLFFPPDFADDFPVAMQVSHKFNLIYVITKLGLLFVYDLETASAIYRNRISPDPIFLTSEASSVGGFYAINRRGQVLLATVNEATIIPFISGQLNNLELAVNLAKRGNLPGAENLVVQRFQELFAQTKYKEAAELAAESPQGILRTPDTVAKFQSVPVQAGQTPPLLQYFGTLLTRGKLNSYESLELSRLVVNQNKKNLLENWLAEDKLECSEELGDLVKTVDNDLALKIYIKARATPKVVAAFAERREFDKILIYSKQVGYTPDYMFLLQTILRTDPQGAVNFALMMSQMEGGCPVDYNTITDLFLQRNLIREATAFLLDVLKPNLAEHAFLQTKVLEINLVTFPNVADAILANGMFSHYDRPRVAQLCEKAGLYIQSLKHYSELPDIKRVIVNTHAIEPQALVEFFGTLSSEWAMECMKDLLLVNLRGNLQIIVQACKEYCEQLGVDSCIKLFEQFKSYEGLYFFLGSYLSMSEDPEIHFKYIEAAAKTGQIKEVERVTRESNFYDAEKTKNFLMEAKLPDARPLINVCDRFGFVPDLTHYLYTNNMLRYIEGYVQKVNPGNAPLVVGQLLDDECPEDFIKGLILSVRSLLPVEPLVEECEKRNRLRLLTQFLEHLVSEGSQDVHVHNALGKIIIDSNNNPEHFLTTNPYYDSKVVGKYCEKRDPTLAVVAYRRGQCDEELINVTNKNSLFKLQARYVVERMDGDLWEKVLTEENEYRRQLIDQVVSTALPESKSPEQVSAAVKAFMTADLPHELIELLEKIVLQNSAFSGNFNLQNLLILTAIKADPSRVMDYINRLDNFDGPAVGEVAVDAQLYEEAFAIFKKFNLNVQAVNVLLDNVRSIERAVEFAFRVEEDAVWSQVAKAQLRDGLVSDAIESFIRADDATQFLEVIRASEDTNVYDDLVRYLLMVRQKVKEPKVDSELIYAYAKIERLGEIEEFILMPNVANLQNVGDRLYDEALYEAAKIIYAFISNWAKLAVTLVKLQQFQGAVDAARKANSAKTWKEVCFACVDAEEFRLAQICGLNIIIQVDDLEEVSEYYQNRGCFNELISLMESGLGLERAHMGIFTELGVLYARYRYEKLMEHIKLFSTRLNIPKLIRACDEQQHWQELTYLYIQYDEFDNAATTVMNHSPEAWEHMQFKDIVAKVANVELYYKAVHFYLEEHPDIINDLLNVLALRLDHTRVVDIMRKAGHLRIIKPYMVAVQSNNVSAVNEALNEIYVEEEDYDRLRESIDLHDSFDQIGLAQKIEKHELVEMRRVAAYIYKKAGRWKQSIALSKKDSMYKDCMETASQSGDHDLAEQLLVYFIEQGKKECFATCLFVCYDLIRPDVALELAWINNMIDFAFPYLLQFIREYSGKVDELIKDKLEAQKEVKAKEQEEKDVMSQQNMYAQLLPLALPAPPMPGMGGGPGMGGGYGPPPPMGGMPGMPPMPPFGMPPMGGY

SEQ ID NO: 9615 - protein, 1696 aa, Valeriana officinalis
KESLTLPSIGINPQFITFTNVTMESDKYICVRETSPQNSVVIIDMSMPTQPLRRPITADSALMNPNSRILALKAQLPGTTQDHLQIFNIELKAKMKSYQMPEQVVFWKWISPKLLGLVTQTSVYHWAIEGESEPAKMFDRTANLANNQIINYRCDPTEKWLVLIGIAPGSPERPQLVKGNMQLFSVDQQRSQALEAHAASFATFKVPGNENPSILISFATKSSNAGQVTSKLHVIELGAQPGKPSFTKKQADLFFPPDFADDFPVAMQISHKYSLIYVITKLGLLFVYDLETATAVYRNRISPDPIFLTAEASSVGGFYAINRRGQVLLATVNEATIVPFVSGQLNNLELAVNLAKRGNLPGAENLVVQRFQELFAQTKYKEAAELAAESPQGILRTPDTVAKFQSVPVQSGQTPPLLQYFGTLLTRGKLNAFESLELSRLVVNQNKKNLLENWLAEDKLECSEELGDLVKTVDNDLALKIYIKARATPKVVAAFAERREFDKILIYSKQVGYTPDYLFLLQTILRSDPQGAVNFALMMSQMEGGCPVDYNTITDLFLQRNLIREATAFLLDVLKPNLPEHGFLQTKVLEINLVTFPNVADAILANGMFSHYDRPRIAQLCEKAGLFVRALQHYSELPDIKRVIVNTHAIEPQSLVEFFGTLSREWALECMKDLLLVNLRGNLQIIVQVAKEYSDQLGVEACLKLFEQFKSYEGLYFFLGSYLSSSEDPDIHFKYIEAAAKTGQIKEVERVTRESNFYDAEKAKNFLMEAKLPDARPLINVCDRFGFVPDLTHYLYTNNMLRYIEGYVQKVNPGNAPLVVGQLLDDECPEDFIKGLILSVRSLLPVEPLVEECEKRNRLRLLTQFLEHLVSEGSQDVHVHNALGKIIIDSNNNPEHFLTTNPYYDSKVVGKYCEKRDPTLAVVAYRRGQCDDELISVTNRNSLFKLQARYVVERMDGDLWEKVLNPENEYRRQLIDQVVSTALPESKSPEQVSAAVKAFMTADLPHELIELLEKIVLQNSAFSGNFNLQNLLILTAIKADPSRVMDYINRLDNFDGPAVGEVAVEAQLYEEAFAIFKKFNLNVQAVNVLLDSIQSIPRAVEFAFRVEEDAVWSQVAKAQLRDGLVSDAIESFIRADDATQFLDVIRAAEDGDVYHDLVKYLLMVRQKTKEPKVDSELIYAYAKIDRLGDIEEFILMPNVANLHGVGDRLYDEALYEAAKIIYAFISNWAKLAVTLVKLNQFQGAVDAARKANSSKTWKEVCFACVDAEEFRLAQICGLNIIIQVDDLEEVSEYYQNRGCFNELISLMESGLGLERAHMGIFTELGVLYARYRYEKLMEHIKLFSTRLNIPKLIRACDEQQHWKELTYLYIQYDEFDNAATTVMNHSPDAWDHMQFKDIAVKVANVELYYKAVHFYLQEHPDLINDLLNVLALRVDHSRVVDIMRKAGHLLLVKPYMVAVQSNNVSAVNEALNEIYVEEEDYERLRESTDLHDNFDQIGLAQKIEKHELLEMRRVAAYIYKKAGRWKQSIALSKKDKLYKDAMETASQSGDRELAEELLAYFIEQGKKECFASCLFVCYDLIRADVALEMAWMNNMLDFAFPYLLQFIREYTGKVDELIKDKIEAAIEMKAKENEEKDTIKQQNMYAQLLPLALPAPPMPGMGGMGGGYGPPPPPPMGGMGGMPPMPPYGMPPMGSY

SEQ ID NO: 9616 - protein, 1702 aa, Lotus japonicus
MAAAANAPITMREALTLPSIGINPQFITFTHVTMESDKYICVRETSPQNSVVIVDMSMPMQPLRRPITADSALMNPNSRILALKAQLQGTTQDHLQIFNIEMKAKMKSYQMPEQVVFWKWITPKLLGLVTQTSVYHWSIEGDSEPVKMFERTANLANNQIINYRCDPTEKWLVLIGIAPGSPERPQLVKGNMQLFSVDQQRSQALEAHAASFAQLKVPGNENPSTLISFATKTLNAGQIISKLHVIELGAQPGKPSFTKKQADLFFPPDFADDFPVAMQISHKYNLIYVITKLGLLFVYDLETATAVYRNRISPDPIFLTSEATSVGGFYAINRRGQVLLATVNEQTIVNFVSGQLNNLELAVNLAKRGNLPGAEKLVVERFHELFAQTKYKEAAELAAESPQGILRTPDTVAKFQSVPVQAGQTPPLLQYFGTLLTRGKLNAFESLELSRLVVNQNKKNLLENWLAEDKLECSEELGDLVKTVDNDLALKIYIKARATPKVVAAFAERREFDKILIYSKQVGYTPDYLFLLQTILRTDPQGAVNFALMMSQMEGGCPLDYNTITDLFLQRNLIREATAFLLDVLKPNLPEHGFLQTKVLEINLVTFPNVADAILANGMFSHYDRPRIAQLCEKAGLYVRALQHYTELPDIKRVIVNTHAIEPQSLVEFFGTLSREWALECMKDLLLVNLRGNLQIIVQVAKEYCEQLGVDACIKIFEQFRSYEGLYFFLGSYLSSSEDPDIHFKYIEAAAKTGQIKEVERVTRESTFYDPEKTKNFLMEAKLPDARPLINVCDRFGFVPDLTHYLYTNNMLRYIEGYVQKVNPGNSPLVVGQLLDDECPEDFIKGLILSVRSLLPVEPLVEECEKRNRLRLLSQFLEHLVSEGSQDAHVHNALGKIIIDSNNNPEHFLTTNPYYDSRVVGKYCEKRDPTLAVVAYRRGQCDDELINVTNKNSLFKLQARYVVERMDGDLWEKVLNPDNAYRRQLIDQVVSTALPESKSPEQVSAAVKAFMTADLPHELIELLEKIVLQNSAFSGNFNLQNLLILTAIKADTSRVMDYINRLDNFDGPAVGEMAVEAQLYEEAFAIFKKFNLNVQAVNVLLDNIHSIDRAEEFAFRVEEDAVWSQVAKAQLREGLVSEAIESFIRADDATQFLDVIRAAQNTNAYNDLVRYLLMVRQKTKEPKVDSELIYAYAKIDRLSDIEEFILMPNVANLQNVGDRLYDEELYEAAKIIFAFISNWAKLAVTLVKLKQFQGAVDAARKANSSKTWKEVCFACVDAEEFRLAQICGLNIIVQVDDLEEVSEFYQNRGCFNELISLMESGLGLERAHMGIFTELGVLYARYRPEKLMEHIKLFATRLNIPKLIRACDEQQHWKELTYLYIQYDEFDNAATTIMNHSPEAWDHMQFKDVIVKVANVELYYKSVHFYLQEHPDLLNDVLNVLALRVDHARVVDIMRKAGHLRLVKPYMVAVQSNNVSAVNEALNEIYVEEEDYDRLRESIDLHDNFDQIGLAQKIEKHELLEMRRVAAYIYKKAGRWKQSIALSKKDNLYKDAMETASQSGERELAEELLVYFIDQGKKECFASCLFVCYDLIRADVALELAWIHNIIDFAFPYVLQLLREYTGKVDELVKDKIEAQKEVKAKEQEEKEVIQQQNMYAQLLPLALPAPPMPGMGGGYAPPPPMGGMGMPPMPPFGMPPMGSSY

SEQ ID NO: 9617 - protein, 1701 aa, Silene vulgaris
MAAATAPIVMKEVLTLPSIGINPQFITFNNVTMESEKYICVRETSPQNSVVIVDMNMPMQPLRRPITADSALMNPNTRILALKAQLAGTTQDHLQIFNIETKTKVKSHQMPEQVVFWKWITPKLLGLVTQTSVYHWSIEGDSAPAKMFERTGNLANNQIINYRCDPAEKWLVLIGIAPGSAERPQLVKGSMQLYSVDQQRSQALEAHAASFATYKVPGNENPSTLIVFATKSMNAGQVTSKLHIIELGAQPGKPGFTKKQADLFFPPDFNDDFPVSMQISQKYGLIYVITKLGLLFVYDLETASAVYRNRISPDPIFLTSEASSSGGFYAINRRGQVLLANVNEATIIPFVSGQLNNLELAVNLAKRGNLPGAENLVVQRFQELFAQTKYKEAAELAADSPQGVLRTPDTVAKFQSVPVQAGQTPPLLQYFGTLLTKGKLNAFESLELSRLVVNQNKKNLLENWLAEDKLECSEELGDLVKTVDNDLALKIYIKARATPKVVAAFAERREFDKILVYSKQVGYTPDYLFLLQTILRTDPQGAVNFALMMSQMEGGCPMDYNTITDLFLQRNLIREATAFLLDVLKPNLPEHGYLQTKVLEINLVTFPNVADAILANGMFSHYDRSRVAQLCEKAGLYLQALKHYTDLPDIKRVIVNTHAIEPQALVEFFGTLSKEWALECMKDLLLVNLRGNLQIIVQTAKEYCEQLGVDACIKLFEQFKSYEGLYFFLGSYLSSSEDPDIHFKYIESAAKTGQLKEVERVTRESNFYDAEKTKNFLMEAKLPDARPLINVCDRFGFVPDLTHYLYTSNMLRYIEGYVQKVNPGNAPLVVGQLLDDECPEDFIKGLILSVRSLLPVEPLVEECEKRNRLRLLTQFLEHLVSEGSQDVHVHNALGKIIIESNNNPEHFLTTNPYYDSRVVGKYCEKRDPTLAVVAYRRGQCDDELINVTNKNSLFKLQARYVVERMDGDLWEKVLNPENEYRRQLIDQVVSTALPESKSPEQVSAAVKAFMTADLPHELIELLEKIVLQNSAFSGNSNLQNLLILTAIKADSSRVMDYVNRLDNFDGPAVGEVAVEAQLYEEAFAIFKKFNLNVPAVNVLLDNVQSIDRAVEFAFRVEEDAVWSQVAKAQLRTGLVSDAIESFIRAEDSTQFLDVIRAAEGADVYHDLVKYLLMVRQQTKEPRVDSELIYAYAKIDRLSDIEEFILMPNVANLQNVGDRLFDEALYEAAKIIFAFISNWAKLAVTLVRLKQFQSAVDAARKANSAKTWKEVCFACVDAEEFRLAQICGLNIIIQVDDMEEVSQFYQNRGCFNEIISLMESGLGLERAHMGIFTELGVLYARYRPEKLMEHIKLFSTRLNIPKLIRACDEQQHWKELTFLYIQYDEFDNAASTVMNHSPEAWDHMQFKDVVVKVANVELYYKAVHFYLQEHPDLINDMLNVLALRLDHTRVVDIMRKAGNLHLIKPYMIAVQSNNVSAVNEALNEIYVEEEDYERLRESIDLHDNFDQIGLAQKIEKHELLEMRRVAAYIYKKAGRWKQSIALSKKDKHYKDAMETCSQSGDRELAEELLVYFIQEGKKECFAACLFVCYDVIRPDVALELAWMNNMIDFAFPYLLQFIREYTGKVDDLIKDKIEAQKQVKAKEEEQKDVIAQQNMYAQLLPLALPAPPMPGMGGGGGYGPPPMGGMGMPPMPPFGMPPMGPY

SEQ ID NO: 9618 - protein, 732 aa, Cicer arietinum
MAAANAPILMRETLTLPSIGINPQFITFTHVTMESDKYICVRETAPQNSVVIVDMNMPMQPLRRPITADSALMNPNSRILALKAQLQGTTQDHLQIFNIELKAKMKSYQMPEQVVFWKWISPKLLGLVTVTSVYHWSIEGDAEPVKMFERTANLANNQIINYRCDPTEKWLVLIGIAPGSPERPQLVKGNMQLFSVDQQRSQALEAHAASFAQFKVPGNENPSTLISFATKTLNAGQVISKLHVIELGAQPGKPSFTKKQADLFFPPDFADDFPVAMQISHKYSLIYVITKLGLLFVYDLETATAVYRNRISPDPIFLTSEATSVGGFYAINRRGQVLLATVNEQTIVNFVSGQLNNLELAVSLAKRGNLPGAEKLVVERFHELFAQTKYKEAAELAAESPQGILRTPDTVAKFQSVPVQAGQTPPLLQYFGTLLTRGKLNAFESLELSRLVVNQNKKNLLENWLAEDKLECSEELGDLVKTVDNDLALKIYIKARATPKVVAAFAERREFDKILIYSKQVGYTPDYLFLLQTILRADPQGAVNFALMMSQMEGGCPVDYNTITDLFLQRNLIREATAFLLDVLKPNLPEHGYLQTKVLEINLVTFPNVADAILANGMFSHYDRPRIAQLCEKAGLYVRALQHYTELPDIKRVIVNTHAIEPQSLVEFFGTLSREWALECMKDLLLVNLRGNLQIIVQVAKEYCEQLGIDACIKIFEQFRSYEGLYFSLVHI

SEQ ID NO: 9619 - protein, 1707 aa, Phaseolus coccineus
MAAANAPITMKEALTLPSIGINTQFITFTHVTMESDKYICVRETSPQNSVVIIDMNMPNQPLRRPITADSALMNPNSRILALKAQLQGTTQDHLQIFNIELKAKMKSYQMPEQVVFWKWISPKMLGLVTQTSVYHWSIEGDSEPVKMFERTANLANNQIINYRCDPSEKWLVLIGIAPGSPERPQLVKGNMQLFSVDQQRSQALEAHAASFAQYKVPGNENPSVLISFASKTLNAGQVTSKLHVIELGAQPGKPSFTKKQADLFFPPDFADDFPVAMQISHKYNLIYVITKLGLLFVYDLETATAVYRNRISPDPIFLTSEATSVGGFYAINRRGQVLLATVNEQTIVNFVSGQLNNLELAVSLAKRGNLPGAEKLVVERFHELFAQTKYKEAAELAAESPQGILRTPDTVAKFQSVPVQSGQTPPLLQYFGTLLTRGKLNSFESLELSRLVVNQNKKNLLENWLAEDKLECSEELGDLVKTVDNDLALKIYIKARATPKVVAAFAERREFDKILIYSKQVGYTPDYLFLLQTILRTDPQGAVNFALMMSQMEGGSPVDYNTITDLFLQRNLIREATAFLLDVLKPNLPEHGFLQTKVLEINLVTFPNVADAILANGMFSHYDRPCIAQLCEKAGLYVRALQHYTELPDVKRVIVNTHAIEPQSLVEFFGTLSREWALECMKDLLLANLRGNLQIIVQVAKEYCEQLGVDACIKIFEQFRSYEGLYFFLGSYLSSSEDPDIHFKYIEAAAKTGQIKEVERVTRESNFYDAEKTKNFLMEAKLPDARPLINVCDRFGFVPDLTHYLYTSNMLRYIEGYVQKVNPGNAPLVVGQLLDDECPEDFIKGLILSVRSLLPVEPLVEECEKRNRLRLLTQFLEHLVSEGSQDVHVHNALGKIIIDSNNNPEHFLTTNPYYDSRVVGKYCEKRDPTLAVVAYRRGQCDDELILVTNKNSLFKLQARYVVERMDGDLWAKVLDPDNDYRRQLIDQVVSTALPESSSPEQVSAAVKAFMTADLPHELIELLEKIVLQNSAFSGNFNLQNLLILTAIKADPSRVMDYVNRLDNFDGPAVGEMAVEAQLFEEAFAIFKKFNLNVQAVNVLLDNIHSIDRAVEFAFRVEEDAVWSQVAKAQLRDGLVSDAIESFIRADDATQFLDVIRAAEDANVYHDLVKYLLMVRQKAKEPKVDSELIYAYAKIDRLSDIEEFILMPNVANLQTVGDRLYDEALYEAAKIIFAFISNWAKLAITLVKLKQFQGAVDAARKANSSKTWKEVCFACVDAEEFRLAQICGLNIIIQVDDLEEVSEYYQNRGCFNELISLMESGLGLERAHMGIFTELGVLYARYRPEKLMEHIKLFSTRLNIPKLIRACDEQQHWKELTYLYIQYDEFDNAATTIMNHSPEAWDHMQFKDVVVKVANVELYYKAVHFYLEEHPDLINDVLNVLALRVDHARVVDILRKAGHLRLVKPYMVAVQSSNVSAVNEALNEIYVEEEDYDRLRESIDLYDNFDQIGLAQKIEKHELLEMRRVAAYIYKKAGRWKQSITLSKKDNLYKDAMETASQSGERELAEELLVYFIDQGKKECFASCLFVCYDLIRADIVLELAWMHNMIDFAFPYILQFIREYTGKVDELVKDKIEAQNEVKVKEQEEKDVVAQQNMYAQLLPLALPAPPMPGMGGPAGMGGGFAPPPPMGGLGMPPMPPYGMPPMGSSY

SEQ ID NO: 9620 - protein, 1705 aa, Medicago truncatula
MAAAANAPILMREALTLPSIGINPQHITFTHVTMESDKYICVRETAPQNSVVIVDMNMPNQPLRRPITADSALMNPNSRILALKAQLQGTTQDHLQIFNIELKAKMKSYQMPEQVVFWKWISPKLLGLVTQTSVYHWSIEGDSEPVKMFERTANLANNQIINYRCDPTEKWLVLIGIAPGSPERPQLVKGNMQLFSVEQQRSQALEAHAASFAQFKVPGNENPSTLISFATKTVNAGQVISKLHVIELGAQPGKPSFTKKQADLFFPPDFADDFPVSMQISHKYSLIYVITKLGLLFVYDLETATAVYRNRISPDPIFLTSEATSVGGFYAINRRGQVLLATVNEQTIVNFVSGQLNNLELAVNLAKRGNLPGAEKLVVERFHELFAQTKYKEAAELAAESPQGILRTPDTVAKFQSVPVQAGQTPPLLQYFGTLLTRGKLNAFESLELSRLVVNQNKKNLLENWLAEDKLECSEELGDLVKTVDNDLALKIYIKARATPKVVAAFAEKREFDKILIYSKQVGYTPDYLFLLQSILRTDPQGAVNFALMMSQMEGGCPVDYNTITDLFLQRNLIREATAFLLDVLKPNLPEHGFLQTKVLEINLVTFPNVADAILANGMFSHYDRPRIAQLCEKAGLYVRALQHYTELPDIKRVIVNTHAIEPQALVEFFGTLSKEWALECMKDLLLVNLRGNLQIIVQVAKEYCEQLGVDACIKIFEQFRSYEGLYFFLGSYLSSSEDPDIHFKYIEAAAKTGQIKEVERVTRESSFYDPEKTKNFLMEAKLPDARPLINVCDRFGFVPDLTHYLYTSNMLRYIEGYVQKVNPGNAPLVVGQLLDDECPEDFIKGLILSVRSLLPVEPLVAECEKRNRLRLLTQFLEHLVSEGSQDVHVHNALGKIIIDSNNNPEHFLTTNPYYDSRVVGKYCEKRDPTLAVVAYRRGVCDDELINVTNKNSLFKLQARYVVERMDADLWEKVLNPDNTYRRQLIDQVVSTALPESKSPEQVSASVKAFMTADLPHELIELLEKIVLQNSAFSGNFNLQNLLILTAIKADSSRVMDYVNRLDNFDGPQVGEVAVEAELYEEAFAIFKKFNLNVQAVNVLLDNIHSIDRAVEFAFRVEEDAVWSQVAKAQLREGLVSDAIESFIRADDATQFLDVIRAAQDGNAYQDLVRYLLMVRQKTKEPKVDSELIYAYAKIDRLSDIEEFILMPNVANLQNVGDRLYDEELYEAAKIIFAFISNWAKLAVTLVKLKQFQGAVDAARKANSAKTWKEVCFACVDEEEFRLAQICGLNIIIQVDDLEEVSEYYQNRGCFNELISLMESGLGLERAHMGIFTELGVLYARYRPEKLMEHIKLFATRLNIPKLIRACDEQQHWKELTYLYIQYDEFDNAATTIMNHSPEAWDHMQFKDVIAKVANVELYYKAVHFYLQEHPDLINDVLNVLALRVDHARVVDIMRKAGHLRLVKPYMVAVQSNNVSAVNEALNEIYVEEEDYDRLRESIDLHDNFDQIGLAQKIEKHELLEMRRVAAYIYKKAGRWKQSIALSKKDNLYKDAMETASQSGERELAEELLVYFIDQGKKECFASCLFVCYDLIRVDVALELAWMHNMIDFAFPYLLQFIREYTGKVDELVKHKIESQNEVKAKEQEEKEVIAQQNMYAQLLPLALPAPPMPGMGGGMGGGYAPPPPMGGGMGMPPMPPFGMPMGGY

SEQ ID NO: 9621 - protein, 1703 aa, Arabidopsis thaliana
MAAANAPITMKEVLTLPSIGINQQFITFTNVTMESDKYICVRETSPQNSVVIIDMNMPMQPLRRPITADSALMNPNSKILALKAQVPGTTQDHLQIFNIEAKAKLKSHQMPEQVVFWKWITPKMLGLVTQNSVYHWSIEGDSEPVKMFDRTANLANNQIINYKCSPNEKWLVLIGIAPGSPERQQLVKGNMQLFSVDQQRSQALEAHAASFAQFKVPGNENPSILISFASKSFNAGQITSKLHVIELGAQPGKPSFTKKQADLFFPPDFADDFPVAMQVSHKFNLIYVITKLGLLFVYDLETASAIYRNRISPDPIFLTSEASSVGGFYAINRRGQVLLATVNEATIIPFISGQLNNLELAVNLAKRGNLPGAENLVVQRFQELFAQTKYKEAAELAAESPQGILRTPDTVAKFQSVPVQAGQTPPLLQYFGTLLTRGKLNSYESLELSRLVVNQNKKNLLENWLAEDKLECSEELGDLVKTVDNDLALKIYIKARATPKVVAAFAERREFDKILIYSKQVGYTPDYLFLLQTILRTDPQGAVNFALMMSQMEGGSPVDYNTITDLFLQRNLIREATSFLLDVLKPNLPEHAFLQTKVLEINLVTFPNVADAVLANGMFTHYDRPRIAQLCEKAGLYIQSLKHYSELPDIKRVIVNTHAIEPQALVEFFGTLSSEWAMECMKDLLLVNLRGNLQIIVQACKEYCEQLGVDACIKLFEQFKSYEGLYFFLGSYLSMSEDPEIHFKYIEAAAKTGQIKEVERVTRESNFYDAEKTKNFLMEAKLPDARPLINVCDRFSFVPDLTHYLYTNNMLRYIEGYVQKVNPGNAPLVVGQLLDDECPEDFIKGLILSVRSLLPVEPLVEECEKRNRLRLLTQFLEHLVSEGSQDVHVHNALGKIIIDSNNNPEHFLTTNPYYDSKVVGKYCEKRDPTLAVVAYRRGQCDEELINVTNKNSLFKLQARYVVERMDGDLWDKVLDENNDYRRQLIDQVVSTALPESKSPEQVSAAVKAFMTADLPHELIELLEKIVLQNSAFSGNFNLQNLLILTAIKADPSRVMDYINRLDNFDGPAVGEVAVEAQLYEEAFAIFKKFNLNVQAVNVLLDNVRSIERAVEFAFRVEEDSVWSQVAKAQLREGLVSDAIESFIRADDATHFLEVIRVSEDTDVYDDLVKYLLMVRQKVKEPKVDSELIYAYAKIDRLGEIEEFILMPNVANLQHVGDRLYDEALYEAAKIIYAFISNWGKLAVTLVKLQQFQGAVDAARKANSAKTWKEVCFACVDAEEFRLAQICGLNIIIQVDDLEEVSEYYQNRGCFNELISLMESGLGLERAHMGIFTELGVLYARYRYEKLMEHIKLFSTRLNIPKLIRACDEQQHWQELTYLYIQYDEFDNAATTVMNHSPEAWEHMQFKDIVAKVANVELYYKAVHFYLQEHPDIINDLLNVLALRLDHTRVVDIMRKAGHLRLIKPYMIAVQSNNVSAVNEALNEIYVEEEDYDRLRESIDLHDSFDQIGLAQKIEKHELVEMRRVAAYIYKKAGRWKQSIALSKKDNMYKDCMETASQSGEHELAEQLLVYFIEQGKKECFATCLFVCYDLIRPDVALELAWINNMMDFAFPYLLQFIREYSGKVDELIKDKLEAQKEVKAKEQEEKDVISQQNMYAQMLPLALPAPPMPGMGGGGGYGPPPQMGGMPGMPPMPPYGMPPMGGY

SEQ ID NO: 9622 - protein, 1707 aa, Brassica rapa
MAAANAPITMKEVLTLPSIGINQQFITFTNVTMESDKYICVRETAPQNSVVIIDMNMPMQPLRRPITADSALMNPNSRILALKAQVPGTTQDHLQIFNIEAKAKLKSHQMPEQVAFWKWITPKMLGLVTQTSVYHWSIEGDSEPVKMFDRTANLANNQLINYKCSPDEKWLVLIGIAPGSPERPQLVKGNMQLFSVNQQRSQALEAHAASFAQFKVPGNENPSILISFASKSFNAGQITSKLHVIELGAQPGKPSFSKKQADLFFPPDFADDFPVAMQVSHKFNLIYVITKLGLLFVYDLETASAIYRNRISPDPIFLSSEASSVGGFYAINRRGQVLLATVNEATIIPFISGQLNNLELAVNLAKRGNLPGAENLVVQRFQELFAQTKYKEAAELAAESPQGILRTPDTVAKFQSVPVQAGQTPPLLQYFGTLLTRGKLNSYESLELSRLVVNQNKKNLLENWLAEDKLECSEELGDLVKTVDNDLALKIYIKARATPKVAAAFAERREFDKILIYSKQVGYTPDYMFLLQTILRTDPQGAVNFALMMSQMEGGCPVDYNTITDLFLQRNLIREATAFLLDVLKPNLPEHAFLQTKVLEINLVTFPNVADAILANGMFSHYDRPRVAQLCEKAGPYIQSLKHYSELPDIKRVIVNTHAIEPQALVEFFGTLSSEWAMECMKDLLLVSLRGNLQIIVQACKEYCEQLGVDSCIKLFEQFKSYEGLYFFLGSYLSMSEDPEIHFKYIEAAAKTGQIKEVERVTRESNFYDAEKTKNFLMEAKLPDARPLINVCDRFGFVPDLTHYLYTNNMLRYIEGYVQKVNPGNAPLVVGQLLDDECPEDFIKGLILSVRSLLPVEPLVEECEKRNRLRLLTQFLEHLVSEGSQDTHVHNALGKIIIDSNNNPEHFLTTNPYYDSKVVGKYCEKRDPTLAVVAYRRGQCDEELINVTNKNSLFKLQARYVVERMDGDLWDKVLVEENEYRRQLIDQVVSTALPESKSPEQVSAAVKAFMTADLPHELIELLEKIVLQNSAFSGNFNLQNLLILTAIKADPSRVMDYINRLDNFDGPAVGEVAVDAQLYEEAFAIFKKFNLNVQAVNVLLDNVRSIERAVEFAFRVEEDSVWSQVAKAQLRDGLVSDAIESFIRAEDATHFLEVIRATEDANVYDDLVRYLLMVRQKVKEPKVDSELIYAYAKIDRLGEIEEFILMPNVANLQTVGDRLYDEALYEAAKIIYAFISNWAKLAVTLVKLQQFQGAVDAARKANSAKTWKEVCFACVDAEEFRLAQICGLNVIIQVDDLEEVSEFYQNRGCFSELISLMESGLGLERAHMGIFTELGVLYARYRYEKLMEHIKLFSTRLNIPKLIRACDEQQHWQELTYLYIQYDEFDNAATTVMNHSPEAWEHMQFKDIVAKVANVELYYKAVHFYLQEHPDIINDLLNVLALRLDHTRVVDIMRKAGQLRLIKPYMVAVQSNNVSAVNEALNEIYVEEEDYDRLRESIDLHDSFDQIGLAQKIEKHELVEMRRVAAYIYKKAGRWKQSIALSKKDNMYKDCMETASQSGDHDLAEQLLVYFIEQGKKECFATCLFVCYDLIRPDVALELAWINNMIDFAFPYLLQFIREYSGKVDELIKDKLEAQKEVKAKEQEEKDVMSQQNMYAQLLPLALPAPPMPGMGGGPGMGGGYGPPPPMGGMPGMPPMPPYGMPPMGGY

SEQ ID NO: 9623 - protein, 1707 aa, Plantago ovata
MAAANAPMTMKEVLTLTSIGINSQFVTFTHVTMESDKYICVRETAPQNSVVIIDMNMPMQPLRRPITADSALMNPNSKILALKAQLPGTAQDHLQIFNIEAKAKMKSHQMPEQVVFWKWITPKMLGLVTQSSVYHWSIEGESEPVKMFERTANLSNNQIINYKCDPSEKWLVLIGIAPGSPERPQLVKGNMQLYSVDQQRSQALEAHAASFATFRVPGNDKDSILISFATKTSNAGQLSSKLHIIELGAQGGKPSFTKKQADLFFPPDFNDDFPVAMQISHKFGLIYVITKLGLLFVYDLETATAVYRNRISPDPIFLTSEASSIGGFYAINRRGQVLLATVNEATIIPFISGQLNNLELAVNLAKRGNLPGAENLVVQRFQELFAQTKYKEAAELAAESPQGILRTPDTVAKFQSVPVQAGVTPPLLQYFGTLLTKGKLNAFESLELSRLVVNQGKKNLLENWLAEDKLECSEELGDLVKTVDNDMALKIYIKARATPKVVAAFAERREFDKILIYSKQVGYTPDYLFLLQTILRSDPQGAVNFALMMSQMEGGCPVDYNTITDLFLQRNMIREATAFLLDVLKPNLPEHAFLQTKVLEINLVTFPNVADAILANGMFSHYDRPRIAQLCEKAGLYVRALQHYSELPDIKRVIVNTHAIEPQGLVEFFGTLSKEWALECMKDLLLVNLRGNLQIIVQVAKEYCEQLGVDACIKLFEQFKSYEGLYFFLGSYLSSSEDGDIHFKYIEAAAKTGQIKEVERVTRESNFYDPEKTKNFLMEAKLPDARPLINVCDRFGFVPDLTHYLYSNNMLRYIEGYVQKVNPGNAPLVVGQLLDDECPEDFIKGLILSVRSLLPVEPLVDECEKRNRLRLLTQFLEHLVSEGSQDVHVHNALGKIIIDSNNNPEHFLTTNPYYDSRVVGKYCEKRDPTLAVVAYRRGQCDDELINVTNKNSLFKLQARYVVERMDGDLWAKVLDPENEFRRLLIDQVVSTALPESKSPEQVSAAVKAFMTADLPHELIELLEKIVLQNSAFSGNFNLQNLLILTAIKADPSRVMDYVNRLDNFDGPAVGEVAVEAQLYEEAYAIFKKFNLNVQAVNVLLDNIRDINRAVEFAYRVEEDAVWSQVAIAQLREGLVSDAIESFIRADDATRFLEVIKAAEDMDVYDDLVKYLLMVRQKTKEPKVDSELIYAYAKIDRLGEIEEFILMPNVANLPNVGDRLFDEALYEAAKIIFAFISNWGKLAVTLVRLKQFQGAVDAARKANSSKTWKEVCFACVDAEEFRLAQICGLNIIVQVDDLEEVSEYYQNRGCFNELISLMESGLGLERAHMGIFTELGVLYARYRHEKLMEHIKLFSTRLNIPKLIRACDEQQHWQELTYLYIQYDEFDNAATTVMNHSPEAWEHMQFKDIIVKVANVELYYKAVHFYLQEHPDLINDVLNVLALRVDHTRVVDIMRKAGHLRLIKPYMVAVQSNNVSAVNEALNEIYVEEEDYERLRESTDLHDSFDQIGLAQKIEKHELLEMRRVAAYIYKKAGRWKQSIALSKKDNLYKDAMETASQSGDRELAEELLVYFIEQGKKECFASCLFVCYDLIRPDVALELAWMNNMIDFAFPYLLQFIREYTGKVDELIKDKIEAVKEAKAKENEEQDIVKQQNMYAQLLPLALPAPPGMGAPGMGGYGGPPPPPPMGMGGMGMPPMPPFGMPPMGSY

SEQ ID NO: 9624 - protein, 1700 aa, Glycine max
MAAANAPITMKEALTLPSIGINSQFITFTHVTMESDKYICVRETAPQNSVVIIDMNMPNQPLRRPITADSALMNPNSRILALKAQLQGTTQDHLQIFNIEMKAKMKSYQMPEQVVFWKWISPKMLGLVTQTSVYHWSIEGDSEPVKMFERTANLANNQIINYRCDPTEKWLVLIGIAPGAPERAQLVKGNMQLFSVDQQRSQALEAHAASFAQFKVPGNENPSVLISFASKTLNAGQVISKLHVIELGAQPGRPSFTKKQADLFFPPDFADDFPVAMQISHKYNLIYVITKLGLLFVYDLETATAVYRNRISPDPIFLTSEATSVGGFYAINRRGQVLLATVNEQTIVNFVSGQLNNLELAVSLAKRGNLPGAEKLVVERFHELFAQTKYKEAAELAAESPQGILRTPDTVAKFQSVPVQAGQTPPLLQYFGTLLTRGKLNAFESLELSRLVVNQNKKNLLENWLAEDKLECSEELGDLVKTVDNDLALKIYIKARATPKVVAAFAERREFDKILIYSKQVGYTPDYLFLLQTILRTDPQGAVNFALMMSQMEGGSPVDYNTITDLFLQRNLIREATAFLLDVLKPNLPEHGFLQTKVLEINLVTFPNVADAILANGMFSHYDRPRIAQLCEKAGLYVRALQHYTELPDIKRVIVNTHAIEPQSLVEFFGTLSKEWALECMKDLLLANLRGNLQIIVQVAKEYCEQLGVDACIKLFEQFRSYEGLYFFLGSYLSSSEDPDIHFKYIEAAAKTGQIKEVERVTRESNFYDAEKTKNFLMEAKLPDARPLINVCDRFGFVPDLTHYLYTNNMVRYIEGYVQKVNPGNAPLVVGQLLDDECAEDFIKGLILSVRSLLPVEPLVEECEKRNRLRMLTQFLEHLVSEGSQDVHVHNALGKIIIDSNNNPEHFLTTNPYYDSRVVGKYCEKRDPTLAVVAYRRGQCDDELINVTNKNSLFKLQARYVVERMDGDLWAKVLDPDNEYRRQLIDQVVSTALPESSSPEQVSAAVKAFMTADLPHELIELLEKIVLQNSAFSGNFNLQNLLILTAIKADPSRVMDYVNRLDNFDGPAVGEMAVEAQLYEEAFAIFKKFNLNVQAVNVLLDKIHSIDRAVEFAFRVEEDAVWSQVAKAQLRDGLVSDAIESFIRADDATQFLDVIRAAEDGNVYHDLVKYLLMVRGKAKEPKVDSELIYAYAKIDRLSDIEEFILMPNVANLQNVGDRLYDEALYEAAKIIFAFISNWAKLAITLVKLQQFQGAVDAARKANSSKTWKEVCFACVDAEEFRLAQICGLNIIIQVDDLEEVSEYYQNRGCFNELISLMESGLGLERAHMGIFTELGVLYARYRPEKLMEHIKLFSTRLNIPKLIRACDEQQHWKELTYLYIQYGEFDNAATTIMNHSPEAWDHMQFKDVVVKVANVELYYKAVHFYLEEHPDLINDVLNVLALRVDHARVVDIMRKAGHLRLVKPYMIAVQSNNVSAVNEALNEIYVEEEDYDRLRESIDLHDNFDQIGLAQKIEKHELLEMRRVAAYIYKKAGRWKQSIALSKKDNLYKDAMETASQSGERELAEELLVYFIDQGKKECFASCLFVCYDLIRADIVLELAWMHNMIDFAFPYLLQFIREYTGKVDELVKDKIEAQNEVKAKEQEEKDVVAQQNMYAQLLPLALPAPPMPGMGGFAPPPPMGGLGMPPMPPYGMPPMGSSF

SEQ ID NO: 9625 - protein, 1704 aa, Cajanus cajan
MAANAPIAMREALTLGSVGINPQFITFTHVTMESDKYICVRETAPQNSVVMIDMSMPMQPLRRPITADSALMNPNTRILALKAQVPGTTQDHLQVFNIESKAKIKSYQMSQQVVFWKWITPKTLGIVTQSSVYHWSIEGEGEPVKMFDRTANLANNQIINYRCDPAEKWLVLIGIAPGSPERPQLVKGNMQLFSVDQQRSQALEAHAASFATFRVAGNDKDSTLICFASKSINAGQVVSKMHVIELGAQPGKPSFTKKQADLFFPPDFADDFPVSMQISNKYGLIYVITKLGLLFVYDLESATAVYRNRISPDPIFLTAEASSVGGFYAINRRGQVLLATVNEATIVPFVSGQLNNLELAVSLAKRGNLPGAEELVVKRFQELFAQTKYKEAAELAAQSPQGVLRTSDTIAKFQSVPVQAGQTPPLLQYFGTLLTMGKLNAFESLELSRLVVNQNKKNLLENWLAEDKLECSEELGDLVKTVDNDLALKIYIKARATPKVVAAFAERREFDKILIYSKQVGYTPDYMFLLQTILRTDPQGAVNFALMMSQMEGGCPIDYNTITDLFLQRNLIREATAFLLDVLKPNLPEHGYLQTKVLEINLVTFPNVADAILANGMFSHYDRPRIGQLCEKAGLFIRALQHYTELPDIKRVIVNTHAIEPQALVEFFGTLSREWALECMKDLLLVNLRGNLQIIVQTAKEYSEQLGVDACIKLFEQFKSYEGLYFFLGAYLSSSEDPDIHFKYIEAAAKTGQIKEVERVTRESNFYDAEKTKNFLMEAKLPDARPLINVCDRFGFVPDLTHYLYTSNMLRYIEGYVQKVNPGNAPLVVGQLLDDECPEDFIKGLILSVRSLLPVEPLVEECEKRNRLRLLTQFLEHLVSEGSQDVHVHNALGKIIIDSNNNPEHFLTTNPYYDSRVVGKYCEKRDPTLAVVAYRRGQCDDELVNVTNKNSLFKLQARYVVERMDSDLWEKVLNPENEFRRQLIDQVVSTALPESKSPEQVSAAVKAFMTADLPHELIELLEKIVLQNSAFSGNFNLQNLLILTAVKADPSRVMDYINRLDNFDGPAVGEVAVEAQLYEEAFVIFKKFNLNVQAVNVLLDNLQTIDRAVEFAFRVEEDAVWSQVAKAQLREGLVSDAIESFIRADDADHFLEVIKAAEDADVYHDLVKYLHMVRQKTKEPKVDSELIYAYAKIERLGEIEEFILMPNVANLPNVGDRLYDEALYEAAKIIFAFISNWAKLAVTLVKLKQFQGAVDAARKANSSKTWKEVCFACVDAEEFRLAQICGLNVIIQVDDLEEVSEFYQNRGCFNELISLMESGLGLERAHMGIFTELGVLYARYRPEKLMEHIKLFSTRLNIPKLIRACDEQQHWKELTYLYIQYDEFDNAAATVMNHSPEAWDHMQFKDVIVKVASVELYYKAVHFYLQEHPDIINDMLNVIALRVDHTRVVDIMRKAGHLRLVKPYMIAVQSNNVSAVNEALNEIYVEEEDYDRLRESIDLHDNFDQIGLAQKIEKHELLEMRRVAAYIYKKVGRWKQSIALSKKDNLYKDCMETCSQSGDRELSEDLLIYFIDQGKKECFASCLFVCYDIIRPDVALELAWMNNMIDFAFPYLLQFIREYSGKVDELIKDKIEAQNEEKAKEKEEKDVIAQQNMYAQLLPLALPAPPMPGMGGGYTPSPPPPPMGGMGMPPMPPFGMPPMGGGSY

SEQ ID NO: 9626 - protein, 1699 aa, Solanum phureja
MAAANAPITMKEALTLSSIGVNPQFITFTNVTMESDKYICVRETSPQNSVVIIDMSMPMQPLRRPITADSALMNPNSRILALKAQVPGTTQDHLQIFNIEAKQKIKSYQMPEQVVFWKWITPQILGIVTQTSVYHWPIEGDTEPIKMFDRTANLANNQIINYRCDPSEKWLVLIGIAPGSPERPQLVKGNMQLYSVDQQRSQSLEAHAASFASFRVPGSDRDSILISFATKSLNAGQVISKLHVIELGAQPGKPSFTKKQADLFFPPDFADDFPVSMQISHKYSLVYVITKLGLLFVYDLETATAVYRNRISPDPIFLTAEASSIGGFYAINRRGQVLLATVNETTIIPFVSGQLNNLELAVNLAKRGNLPGAETLVVQRFQELFAQTKYKEAAELAAESPQGILRTSDTVAKFQSVPVQAGQTPPLLQYFGTLLTKGKLNAFESLELSRLVVNQNKKNLLENWLAEDKLECSEELGDLVKTVDNDLALKIYIKARATPKVVAAFAERREFDKILIYSKQVGYTPDYLFLLQTILRSDPQGAVNFALMMSQMEGGCPVDYNTITDLFLQRNMIREATAFLLDVLKPNLPEHGFLQTKVLEINLVTFPNVADAILANGMFSHYDRPRIAQLCEKAGLYVRALQHYTELPDIKRVIVNTHAIEPQALVEFFGTVSREWALECMKDLLVINIKGNLQIIVQVAKEYCEQLGVDACIKLFEQFKSYDGLYFFLGSYLSSSEDPEIHFKYVEAAAKTGQIKEVERVTRESNFYDPEKTKNFLMEAKLPDARPLINVCDRFGFVPDLTHYLYTNNMLRYIEGYVQKVNPANAPLVVGQLLDDECPEDFIKGLILSVRSLLPVEPLVDECEKRNRLRLLTQFLEHLVSEGSQDVHVHNALGKIIIDSNNNPEHFLTTNPYYDSRVVGKYCEKRDPTLAVVAYRRGQCDDELINVTNKNSLFKLQARYVVERMDGDLWEKVLNPENEFRRQLIDQVVSTALPESKSPEQVSATVKAFMTADLPHELIELLEKIVLQNSAFSGNFNLQNLLILTAIKADPSRVMDYINRLDNFDGPAVGEVAVEAQLYEEAFAIFKKFNLNVQAVNVLLDNIRDINRAVEFAFRVEEDAVWSQVAKAQLREGLVSDAIESFIRADDTTQFLDVIRAAEDADVYHDLVKYLLMVRQKTKEPKVDSELIYAYAKIDRLSDIEEFILMPNVANLPNVGDRLYDEALYEAAKIIFAFTSNWAKLAITLVKLNQFQGAVDAARKANSSKTWKEVCFACVDAEEFRLAQICGLNIIVQVDDLEEVSEYYQNRGCFNELISLMESGLGLERAHMGIFTELGVLYARYRYEKLMEHIKLFSTRLNIPKLIRACDEQQHWKELTYLYIQYDEFDNAATTVMNHSPDAWDHMQFKDIAVKVANVELYYKAVHFYLQEHPDLINDLLNVLALRVDHTRVVDIMRKAGHLRLVKPYMIAVQSNNVSSVNEALNEIYVEEEDYDRLRESVDLHDNFDQIGLAQKIEKHELLEMRRVAGYIYKRAGRWKQSIALSKKDNLYKDAMETASQSGDRELAEELLVYFIEQGKKECFASCLFVCYDLIRPDVALELAWMNNMIDFAFPYLLQFIREYTGKVDELIKDKIEAQSEAKAKENEEKDVMKQQNMYAQLLPLALPAPPMPGMGGGFGPSQPPPMGGMGMPPFGMPPMGPY

SEQ ID NO: 9627 - protein, 1728 aa, Solanum lycopersicum
MAAANAPITMKEALTLQSIGVNPQFITFTNVTMESDKYICVRETSPQNSVVIIDMNMPMQPLRRPITADSALMNPNTRILALKAQVPGTTQDHLQIFNIEAKQKIKSHQMPEQVVFWKWITPKMLGLVTQTSVYHWPIEGDSEPVKMFDRTANLANNQIINYRCDPSEKWLVLIGIAPGSPEKPQLVKGNMQLFSVDQQRSQALEAHAASFASIRVPGNDRDSILISFASKTSNAGQVTSKLHVIELGAQPGKPSFSKKQADLFFPPDFADDFPVAMQISHKYGLIYVITKLGLLFVYDLETATAVYRNRISPDPIFLTSEASSIGGFYAVNRRGQVLLATVNEATIIPFISGQLNNLELAVNLAKRGNLPGAENLVVQRFQDLFAQTKYKEAAELAAESPQGILRTPDTVAKFQSVPVQAGQTPPLLQYFGTLLTKGKLNAFESLELSRLVVNQNKKNLLENWLAEDKLECSEELGDLVKTVDNDLALKIYIKARATPKVVAAFAERREFDKILIYSKQVGYTPDYLFLLQTILRSDPQASPLGFHLAPIFLLSDLDLDHEGAVNFALMMSQMEGGCPVDYNTITDLFLQRNMIREATAFLLDVLKPNLPEHGYLQTKVLEINLVTFPNVADAILANGMFSHYDRPRIAQLCEKAGLYIRALQHYSELPDIKRVIVNTHAIEPQALVEFFGTVSREWALECMKDLLVINIKGNLQIIVQVAKEYCEQLGIDACIKLFEQFKSYDGLYFFLGSYLSSSEDPDIHFKYIEAAARTGQIKEVERVTRESNFYDPEKTKNFLMEAKLPDARPLINVCDRFGFVPDLTHYLYTNNMLRYIEGYVQKVNPGNAPLVVGQLLDDECPEDFIKGLILSVRSLLPVEPLVAECEKRNRLRLLTQFLEHLVSEGSQDVHVHNALGKIIIESNNNPEHFLTTNPYYDSRVVGKYCEKRDPTLAVVAYRRGQCDDELINVTNKNSLFKLQARYVVERMDGDLWDKVLVPENEFRRQLIDQVVSTALPESKSPEQVSAAVKAFMTADLPHELIELLEKIVLQNSAFSGNFNLQNLLILTAIKADPSRVMDYINRLDNFDGPAVGEVAVEAQLYEEAFAIFKKFNLNVQAVNVLLDSIRDINRAVEFAFRVEEDAVWSQVAKAQLREGLVSDAIESFIRADDATQFLDVIHAAEDADVYHDLVKYLLMVRQKTKEPKVDSELIYAYAKIDRLGEIEEFILMPNVANLPNVGDRLYDGALYEAAKIIFAFISNWAKLASTLIKLNQFQGAVDAARKANSAKTWKEVCFACVDAEEFRLAQICGLNIIVQVDDLEEVSEFYQNRGCFNELISLMESGLGLERAHMGIFTELGVLYARYRHEKLMEHIKLFSTRLNIPKLIRACDEQQHWKELTYLYIQYDEFDNAATTVMNHSPDAWDHMQFKDIVVKVANVELYYKAVHFYLQEHPDLINDLLNVLALRVDHTRVVDIMRKAGHLRLVKPYMIAVQSNNVSAVNEALNEIYVEEEDYDRLRESIELHDSFDQIGLAQKIEKHELLEMRRVAASIYKKAGRWKQSIALSKKDNLYKDAMETASQSGDRELAEELLVYFIEQGKKECFATCLFVCYDLIRADVALELAWMNNMIDFAFPYLLQFIREYTGKVDELIKDKIEAQKEAKAKENEEKDVMKQQNMYAQLLPLALPAPPMPGMGGAGMGGGFAPPPPQMGGMGMPPMPPFGMPPMGSY

SEQ ID NO: 9628 - protein, 1706 aa, Medicago truncatula
MAAANAPIAMKEVLTLPSVGINAQFITFTHVTMESDKYICVRETSPQNSVVIVDMSMPNQPLRRPITADSALMNPNSRILALKAQLQGTTQDHLQIFNIELKTKMKSHQMPEQVVFWKWISPKMLGLVTQTSVYHWSIEGDSEPVKVFERTANLANNQIINYRCDPTEKWLVLIGIAPGSPERAQLVKGNMQLFSVDQQRSQALEAHAASFAQFKVPGNENPSVLISFASKTFNAGQVISKLHVIELGAQPGKPSFTKKQADLFFPPDFADDFPVAMQISHKYSLIYVITKLGLLFVYDLETATAVYRNRISPDPIFLTSEATSAGGFYAINRRGQVLLATVNEQTIVNFVSGQLNNLELAVSLAKRGNLPGAEKLVVERFHELFSQTKYKEAAELAAESPQGILRTPDTVAKFQSVPVQAGQTPPLLQYFGTLLTRGKLNAFESLELSRLVVNQNKKNLLENWLAEDKLECSEELGDLVKTVDNDLALKIYIKARATPKVVAAFAERREFDKILVYSKQVGYTPDYLFLLQTILRTDPQGAVNFALMMSQMEGGSPIDYNTITDLFLQRNLIREATAFLLDVLKPNLPEHGFLQTKVLEINLVTFPNVADAILANGMFSHYDRPRVAQLCEKAGLYVRALQHYTELPDIKRVIVNTHAIEPQSLVEFFGTLSREWALECMKDLLLANLRGNLQIIVQVAKEYSEQLSVEGCIKIFEQFRSYEGLYFFLGSYLSSSEDPDIHFKYIEAAAKTGQIKEVERVTRESNFYDAEKTKNFLMEAKLPDARPLINVCDRFGFVPDLTHYLYTNNMLRYIEGYVQKVNPGNAPLVVGQLLDDECPEDFIKGLILSVRSLLPVEPLVEECEKRNRLRLLTQFLEHLVSEGSQDVHVHNALGKIIIDSNNNPENFLTTNPYYDSRVVGKYCEKRDPTLAVVAYRRGQCDEELINVTSKNSLFKLQARYVVERMDGDLWDKVLNPDNEYRRQLIDQVVSTALPESSSPEQVSATVRAFMTADLPHELIELLEKIVLQNSAFSGNHNLQNLLILTAIKADSSRVMDYINRLDNFDGPSVGEMAVEAQLYEEAFAIYKKFNLNVQAVNVLLDNIRSIDRAVEFAFRVEEDAVWSQTAKAQLREGLVSDAIESFIRADDTTQFLDVIRAAEDANVYHDLVKYLLMVRQKAKEPKVDGELIYAYAKIDRLSDIEEFILMPNVANLQTVGDRLYDEALYEAAKIIFAFISNWAKLAITLVKLQQFQGAVDAARKANSSKTWKEVCFACVDAEEFRLAQICGLNIIIQVDDLEEVSEYYQNRGYFNELISLMESGLGLERAHMGIFTELGVLYARYRPDKLMEHIKLFSTRLNIPKLIRACDEQQHWKELTFLYIQYDEFDNAATTIMNHSPEAWDHMQFKDVAVKVANVELYYKAVHFYLEEHPDLINDILNVLALRVDHTRVVDIMRKAGHLRLVKPYMVAVQSSNVSAVNEALNEIYVEEEDYDRLRESIDLHDNFDQIGLAQKIEKHELLEMRRVAAYIYKKAGRWKQSIALSKKDNLYKDAMETASQSGERELAEELLVYFIDQGKKECFASCLFVCYDLIRADVVLELAWMHNMIDFAFPYVLQFIREYTGKVDELVKDRIEAQNEVKSKEKEEKDVVAQQNMYAQLLPLALPAPPMPGMGGPGYGGSYGPPPPVSGMGMPQMPPFGMPPMGSSY

SEQ ID NO: 9629 - protein, 1702 aa, Glycine max
MAANAPIIMREALTLASVGINPQFITFTHVTMESDKYICVRETAPQNSVVMIDMTMPMQPLRRPITADSALMNPNTRILALKAHVPGSTQDHLQVFNIESKAKMKSYQMGQQVVFWKWITPKTLGIVTQSSVYHWSIEGDGEPVKVFDRTANLANNQIINYRCDPTEKWLVLIGIAPGSSDRPQLVKGNMQLFSVDQQRSQALEAHAASFATFRVAGNDKDSTLICFASKSINAGQVTSKMHAIELGAQPGKPSFSKKQADLFFPPDFADDFPVSMQISNKYGLIYVITKLGLLFVYDLETATAVYRNRISPDPIFLTTEASSEGGFYAINRRGQVLLATVNEATIVPFVSGQLNNLELAVSLAKRGNLPGAEELVVKRFQELFAQTKYKEAAELAAQSPQGVLRTPDTVAKFQSVPVQAGQTPPLLQYFGTLLTMGKLNAFESLELSRLVVNQNKKNLLENWLAEDKLECSEELGDLVKTVDNDLALKIYIKARATPKVVAAFAERREFDKILIYSKQVGYTPDYMFLLQTILRTDPQGAVNFALMMSQMEGGCPIDYNTITDLFLQRNLIREATAFLLDVLKPNLPEHGYLQTKVLEINLVTFPNVADAILANGMFSHYDRPRIGQLCEKAGLFIRALQHYTELPDIKRVIVNTHAIEPQGLVEFFGTLSREWALECMKDLLLVNLRGNLQIIVQTAKEYSEQLGVDACIKLFEQFKSYEGLYFFLGAYLSSSEDPDIHFKYIEAAAKTGQIKEVERVTRESNFYDAEKTKNFLMEAKLPDARPLINVCDRFGFVPDLTHYLYTSNMLRYIEGYVQKVNPGNAPLVVGQLLDDECPEDFIKGLILSVRSLLPVEPLVEECEKRNRLRLLTQFLEHLVSEGSQDVHVHNALGKIIIDSNNNPEHFLTTNPYYDSRVVGKYCEKRDPTLAVVAYRRGQCDDELVNVTNKNSLFKLQARYVVERMDSDLWEKVLNPENEFRRLLIDQVVSTALPESKSPDQVSAAVKAFMTADLPHELIELLEKIVLQNSAFSGNFNLQNLLILTAVKADPSRVMDYINRLDNFDGPAVGEVAVEAQLYEEAFSIFKKFNLNVQAVNVLLDNLQTIDRAVEFAFRVEEDAVWSQVAKAQLREGLVSDAIESFIRADDSTHFLEVIKAAEDADVYHDLVKYLLMVRQNTKEPKVDSELIYAYAKIEHLGEIEEFILMPNVANLPNVGDRLYDEALYEAAKIIFAFISNWAKLAVTLVKLKQFQGAVDAARKANSSKTWKEVCFACVDAEEFRLAQICGLNVIIQVDDLEEVSEYYQNRGCFNELISLMESGLGLERAHMGIFTELGVLYARYRPEKLMEHIKLFSTRLNIPKLIRACDEQQHWKELTYLYIQYDEFDNAATTVMNHSPEAWDHMQFKDVIVKVASVELYYKAVHFYFKEHPDVINDMLNVIALRVDHTRVVDIMRKAGHLRLVKPYMVAVQSNNVSAVNEALNEIYVEEEDYDRLRESIDLHDNFDQIGLAQKIEKHELLEMRRVAAYIYKKAGRWKQSIALSKKDNLYKDCMETCSQSGDRELSEDLLIYFIEQGKKECFASCLFVCYDIIRPDVALELSWMNNMIDFAFPYLLQFIREYTGKVDELIKDKIEAQNEEKAKEKEEKEVLAQQNMYAQLLPLALPAPPMQGMGGGYAPSPPLPMGGMGMPPMPPFGMPPMDGGY

SEQ ID NO: 9630 - protein, 1699 aa, Prunus persica
MAAASAPMTMKETLTLPSIGINPQFITFTHVTMESDKYICVRETSPQNSVVIIDMNMPMQPLRRPITADSALMNPNSRILALKAQVQGTTQDHLQIFNIEMKAKMKSHQMPEQIVFWKWITPKMLGLVTQTSVYHWLIEGDSEPTKVFERTANLANNQIINYRCDPSEKWLVLIGIAPGSPERPQLVKGNMQLFSVEQKRSQALEAHSASFATFKVPGNENPSILICFASKSFNAGQVTSKLHVIELGAQPGKPSYTKKQADLFFPPDFADDFPVSMQISEKYGLIYVITKLGLLFVYDLETATAVYRNRISPDPIFLTAEASSIGGFYAINRRGQVLLATINEQTIVPFVSGQLNNLGLAVSLAKRGNLPGAEDLVVQRFQELFSQTKYKEAAELAAESPMGILRTPDTVAKFQSVPVQAGQTPPLLQYFGTLLTRGKLNAYESLELSRLVVNQNKKNLLENWLAEDKLECSEELGDLVKTVDNDLALKIYIKARATPKVVAAFAERREFDKILIYSKQVGYTPDYLFLLQTILRSDPQGAVNFALMMAQMEGGCPVDYNTITDLFLQRNLIREATAFLLDVLKPNLPEHGYLQSKVLEINLVTFPNVADAILANGMFSHYDRPRIGQLCEKAGLYLRALQHYTELPDIKRVIVNTHAIDPQALVEFFGTLSEEWALECMKDLLLVNLRGNLQIIVQTAKEYSEQLGVDKCIKLFEQFKSYEGLYFFLGSYLSSSEDPDIHFKYIEAAAKTGQIKEVERVTRESNFYDPEKAKNFLMEAKLPDARPLINVCDRFGFVPDLTHYLYTNNMLRYIEGYVQKVNPGNAPLVVGQLLDDECPEDFIKGLILSVRSLLPVEPLVDECEKRNRLRLLTQFLEHLVSEGSQDVHVHNALGKIIIDSGNNPEHFLTTNPYYDSRVVGKYCEKRDPTLAVVAYRRGQCDDELINVTNKNSLFKLQARYVVERMDDDLWAKVLDPDNEYRRQLIDQVVSTALPESKSPEQVSATVKAFMTADLPHELIELLEKIVLQNSAFSGNFNLQNLLILTAIKADPSRVMDYINRLDNFDGPAVGLMAVEAQLFEEAFAIFKKFNANVDAVNVLLDNIQSIDRAVEFAFRVEEDAVWSQVAKAQLREGLVSDAIESFIRADDATQFLDVIRAAEDANVYHDLVRYLLMVRQKTKEPKVDSELIYAYAKIDRLGEIEEFILMPNVANLQNVGDRLFDEALYEAAKIIFAFISNWAKLACTLVKLNQFQGAVDAARKANSSKTWKFVCFACVDAEEYRLAQICGLNIIIQVDDLEEVSEYYQNRGCFNELISLMESGLGLERAHMGIFTELGVLYARYRPEKLMEHIKLFSTRLNIPKLIRACDEQQHWKELTYLYIQYDEFDNAATTIMNHSPEAWDHMQFKDVIVKVASVELYYRAVHFYLQEHPDLINDVLNVIALRVDHTRVVDIMRKAGHIRLVKPYMVAVQSSNVTAVNEALNEIYIEEEDYDRLRESIDLHDSFDQIGLAQKLEKHELLEMRRVAAYIYKKAGRWKQSIALSKKDNHYKDCMETCSQSGDHELSEELLIYFIEQGKKECFASCLFVCYDLIRPDVALELAWMNNIIDFALPYLLQFIREYTGKVDELVKDKIEAQNEVKAKEKEEKELVAQQNMYAQLLPALPAPPGMGGGYAPPMPPMGGMGMPPMPPFGMPQMGPSY

SEQ ID NO: 9631 - protein, 1086 aa, Zostera marina
MFSHYDRPRIAQLCEKAGLYARALHHYSELPDIKRVIVNTHAIEPQALVEFFGTLSTEWALECMKDLLLVNLRGNLQIIVQTAKEYSEQLGMESCMKLFEQFKSYEGLYFFLGSFLSSSEDPDIHFKYIEAAAKTGQVKEVERVTRESNFYDPEKTKNFLMEAKLPDARPLINVCDRFGFVADLTHYLYTSNMLRYIEGYVQKVNPSNAPVVVGQLLDDECPEDFIKGLILSIRSLLPVEPLVDECEKRNRLRLLTQFLEHLVSEGSQDVHVHNALGKIIIESNNNPEHFLTTNPYYDSRVVGKFCEKRDPTLAVVAYRRGQCDDELISVTNKNSLFKLQARYVVERMEFDLWDKVLLPENEYRRQFIDQVVSTALPESKSPEQVSAAVKAFMTADLPHELIELLEKIVLQNSAFSGNFNLQNLLILTAIKADASRVMDYINRLDNFDGPAVGEVAVEAQLYEEGFAIFKKFNLNVQAVDVLLDKIESIERAVEFAYRVEEDAVWSQVAKAQLREGLVSDAIESFIRADDTTQFLDVIRASEDANVYHDLVKYLLMVRQKTKESRVDGELIYAYAKIDRLADIEEFIIMPNVANLQNVGDRLYDEQLYEAAKIIFAFISNWAKLAVTLVKLMQFQGAVDAARKANSSKTWKEVCFACIDAEEFRLAQICGLNIIVQVDDLEEVSDYYQDRGCFNELISLMESGLGLERAHMGIFTELGVLYARYRPEKLMEHIKLFATRLNIPKLIRACDQQQHWKELTYLYIQYDEFDNAATTIMNHSPDAWDHMQFKDVCVKIANVDLYYKAVHFYLEEHPDLINDLLNVLALRVDHTRVVDIMRKAGYLHIVKPYMVAVQSNNVSAVNEALNGIYVEEEDYERLRESIDMHDNFDQIGLAQKIEKHELLEMRRVAAYIYKKAGRWKQSIALSKKDSIYKDAMETASQSGERELAEELLVYFIDKGKKECFASCLFICYDLIRPDVALELAWMNNMVDFAFPFMLQFIRESTSKVDELVKDKIEAQKEVKAKDSEEKEMVAQQNMYAQLLPLALPAPPGMGGAGMSGSFGQPPPMGSLGMPPMPPYGMPPMGSY

SEQ ID NO: 9632 - protein, 768 aa, Brassica rapa
MAAANAPITMKEVLTLPSVGINQQFITFTNVTMESDKYICVRETAPQNSVVIIDMNMPMQPLRRPITADSALMNPNSRILALKAQVPGTTQDHLQIFNIEAKAKLKSHQMPEQVAFWKWITPKMLGLVTQTSVYHWSIEGDSEPVKMFDRTANLANNQIINYKCSPNEKWLVLIGIAPGSPERPQLVKGNMQLFSVDQQRSQALEAHGASFAQFKVPGNENPSILISFASKSFNAGQITSKLHVIELGAQPGKPSFTKKQADLFFPPDFADDFPVAMQVSHKFNLIYVITKLGLLFVYDLETASAIYRNRISPDPIFLTSEASSVGGFYAINRRGQVLLATVNEATIIPFISGQLNNLELAVNLAKRGNLPGAENLVVQRFQELFAQTKYKEAAELAAESPQGIPRTPDTVAKFQSVPVQAGQTPPLLQYFGALLTRGKINSYESLVLSRLVVNQNKKSLLENWLAEDKLECSEELGDLVKTVDNDLALKIYIKARATPKVVAAFAERREFDKILIYSKQVGYTPDYMFLLQTILRSDPQGAVNFALMMSQMEGGCPVDYNTITDLFLQRNLIREATAFLLDVLKPNLPEHAFLQTKVLEINLVTFPNVAGAILANGMFSHYDLPRVAQLCEKAGLYIQSLKHYSELPDIKRVIVNTHAIEPQALVEFFGTLSSEWAMECMKDLLLVNLRGNLQIIVQACKEYCEQLGVDQCIKLFEQFKSYEGLYFFLGSYLSMSEDPEIHFKYIEAAAKTGQIKEVERVTRESRLL

SEQ ID NO: 9633 - protein, 1706 aa, Phaseolus coccineus
MAANAPIAMREALTLGSVGINPQFITFTHVTMESDKYICVRETAPQNSVVMIDMAMPMQPLRRPITADSALMNPNARILALKAQVPGTTQDHLQVFNIETKAKMKSYQMSQQVVFWKWITPKTLGVVTQSSPVKVFDRTANLANNQIINYRCDPTEKWLVLIGIAPGSSERPQLVKGNMQLFSVDQQRSQALEAHAASFATFRVPGNDKDSTLICFASKSMNAGQVASKMHVIELGAQPGKPSFSKKQADLFFPPDFADDFPVSMQISNKYGLIYVITKLGLLFVYDLETATAVYRNRISPDPIFLTAEASTAGGFYAINRRGQVLLATVNEATIVPFVSGQLNNLELAVSLAKRGNLPGAEELVVKRFQELFAQTKYKEAAELAAQSPQGVLRTPDTVAKFQSVPVQAGQTPPLLQYFGTLLTMGKLNTFESLELSRLVVNQNKKNLLENWLAEDKLECSEELGDLVKTVDNDLALKIYIKARATPKVVAAFAERREFDKILIYSKQVGYTPDYMFLLQTILRTDPQGAVNFALMMSQMEGGCPIDYNTITDLFLQRNLIREATAFLLDVLKPNLPEHGYLQTKVLEINLVTFPNVADAILANGMFSHYDRPRIGQLCEKAGLFIRALQHYSELPDIKRVIVNTHAIEPQALVEFFGTLSREWALECMKDLLLVNLRGNLQIIVQTAKEYSEQLGVEACIKLFEQFKSYEGLYFFLGAYLSSSEDPDIHFKYIEAAAKTGQIKEVERVTRESNFYDAEKTKNFLMEAKLPDARPLINVCDRFGFVPDLTHYLYTSNMLRYIEGYVQKVNPGNAPLVVGQLLDDECPEDFIKGLILSVRSLLPVEPLVEECEKRNRLRLLTQFLEHLVSEGSQDVHVHNALGKIIIDSNNNPEHFLTTNPYYDSRVVGKYCEKRDPTLAVVAYRRGQCDDELVNVTNKNSLFKLQARYVVERMDSDLWEKVLNPENEFRRQLIDQVVSTALPESKSPEQVSAAVKAFMTADLPHELIELLEKIVLQNSAFSGNFNLQNLLILTAIKADPSRVMDYINRLDNFDGPAVGEVAVEAQLYEEAFAIFKKFNLNVQAVNVLLDNLQTIDRAVEFAFRVEEDAVWSQVAKAQLREGLVSDAIESFIRADDSTHFLEVIKASEDADVYHDLVKYLLMVRQKTKEPKVDSELIYAYAKIDRLGEIEEFILMPNVANLPNVGDRLYDETLYEAAKIIFAFISNWAKLAVTLVKLKQFQGAVDAARKANSSKTWKEVCFACVDAEEFRLAQICGLNVIIQVDDLEEVSEFYQNRGCFNELISLMESGLGLERAHMGIFTELGVLYARYREEKLMEHIKLFSTRLNIPKLIRACDEQQHWKELTYLFIQYDEFDNAATTVMNHSPEAWDHMQFKDVIVKVASVELYYKAVHFYLQEHPDVINDMLNVIALRVDHTRVVDIMRKAGHLRLVKPYMVAVQSNNVSAVNEALNEIYVEEEDYDRLRESIDLHDNFDQIGLAQKIEKHELLEMRRVAAYIYKKAGRWKLSIALSKKDNLYKDCMETCSQSGDRELSEDLLIYFIEKGKKECFASCLFVCYDIIRPDVALELAWMNNMIDFAFPYLLQFIREYTSKMDELIKDKIEAQNEEKAKEKEEKNVIAQQNMYAQLLPLALPAPPMPGMGGGYAPSPPPMSGMGGGYAPSPPPPPMGGMGMPPMPPFGMPPMGGGY

SEQ ID NO: 9634 - protein, 1701 aa, Abies balsamea
MAAASAPITMKEVLTLPSLGINPQFITFTHVTMESDKYICVRETSPANSVVIIDMNMPMQPLRRPITADSALMNPNSRILALKAQIPGSTQDHLQIFNIEMKAKMKSYQMPEQVVFWKWITPKMLGLVTQNSVYHWSLEGDAEPARMFDRTGNLTGNQIINYRCDPSEKWLVLIGIAPGAPERPQLVKGNMQLFSVDQQRSQALEAHAAAFASFKVPGNENPSILISFASKTMAAGQLTSKLHVIELGAQPGKPGFSKKQADLFFPPDFADDFPVAMQISNKYSLIYVITKLGLLFVYDLDTATAVYRNRISPDPIFLTTEASSLGGFYAINRRGQVLLATVNEATIVPFVSGQLNNLELAVNLAKRGNLPGAENLVVQRFQELFTQMKYKEAAELAAESPQGILRTPDTVAKFQSVPVQPGQTPPLLQYFGTLLTRGKLNAFESLELSRLVVNQNKKNLLENWLAEDKLECSEELGDLVKTVDNDLALKIYIKARATPKVVAAFAERREFDKILIYSKQVGYTPDYLFLLQTILRSDPQGAVNFALMMSQMEGGCPLDYNTITDLFLQRNMIREATSFLLDVLKPNLPEHGYLQTKVLEINLVTFPNVADAILANGMFSHYDRPRIAQLCEKAGLYMRALQHYTELPDIKRVIVNTHAIEPQALVEFFGTLSREWALECMKDLLLVNLRGNLQIIVQAAKEYSDQLGADSCIKLFEQFKSYEGLYFFLGSYLVSSEDPEIHFKYIEAAAKTGQIKEVERVTRESNFYDAEKTKNFLMEARLPDARPLINVCDRFGFVPDLTHYLYSNNMLRYIEGYVQKVNPSNAPLVVGQLLDDDCPEDFIKGLILSVRSLLPVEPLVEECEKRNRLRLLTQFLEHLVSEGSQDVHVHNALGKIIIDTNNNPEHFLTTNPYYDSRVVGKYCEKRDPTLAVVAYRRGQCDDELIDVTNKNSLFKLQARYVVERMEPDLWEKVLTPENPFRRQLIDQVVSTALPESKNPDQVSATVKAFMTADLPHELIELLEKIVLQNSAFSGNPNLQNLLILTAIKADKSRVMDYINRLDNFDGPAVGEIAVGAELYEEAFAIFKKFNLNVQAVNVLLDNIRSIERAVEFASRVEEDAVWSQVAKAQLRDGLVSDAIESFIRADDATQFLDVIRAAEQASVYHDLVKYLLMVRKKVKEPKVDSELIYAYAKIDRLGEIEEFILSPNVANLQSVGDRLFDEALYEAAKIIFAFISNWAKLASTLVKLTQFQGAVDAARKANSSKTWKEVCFACVDAEEFRLAQICGLNIIVQVDDLEEVSDYYQNRGRFDELISLMESGLGLERAHMGIFTELGILYARYRPDKLMEHIKLFSTRLNIPKLIRVCDEQQHWKELTYLYIQYDEYDNAAATIMNHSPEAWDHMQFKDVVVKVANVELYYKAVHFYLQEHPDLINDLLNVLSLRVDHTRVVDIMRKAGHLHLVKPYMVAVQSNNVAAVNEALNGIYVEEEDYDRLRESIDLHDNFDQIGLAQKVEKHELLEFRRIAAYIYKKAGRWRQSVALSKKDNLYKDAMETSSQSGDRELAEELLVYFVEQGKKECFASCLFTCYDLIRPDVALELAWMNNMIDFSFPYLLQFIREYTTKVDELVKDKLENLQEVKSKEKEEKDLVAQQNMYAQLLPLALPAPPMPGMGGGMGGFQPGMGGMGMPPMPAYGMPPMGGY

SEQ ID NO: 9635 - protein, 1703 aa, Pseudotsuga menziesii
MAAASAPITMKEVLTLPSLGINPQFITFTHVTMESDKYICVRETAPANSVVIIDMNMPMQPLRRPITADSALMNPNSRILALKAQIPSSTQDHLQIFNIEMKAKMKSYQMPEQVVFWKWITPKMLGLVTQTSVYHWSVEGDAEPARMFDRTGNLTGNQIINYRCDPSEKWLVLIGIAPGAPERPQLVKGNMQLFSVDQQRSQALEAHAAAFASFKVPGNENPSILISFASKTMVGGQLTSKLHVIELGAQPGKPGFSKKQADLFFPPDFADDFPVAMQISNKYSLIYVITKLGLLFVYDLDTATAVYRNRISPDPIFLTTEASSVGGFYAINRRGQVLLATVNEATIVPFVSGQLNNLELAVNLAKRGNLPGAENLVVQRFQELFSQMKYKEAAELAAESPQGILRTPDTVAKFQSVPVQPGQTPPLLQYFGTLLTRGKLNAFESLELSRLVVNQNKKNLLENWLAEDKLECSEELGDLVKTVDNDLALKIYIKARATPKVVAAFAERREFDKILIYSKQVGYTPDYLFLLQTILRSDPQGAVNFALMMSQMEGGCPLDYNTITDLFLQRNMIREATSFLLDVLKPNLPEHGYLQTKVLEINLVTFPNVADAILANGMFSHYDRPRIAQLCEKAGLYMRALQHYTELPDIKRVIVNTHAIEPQALVEFFGTLSREWALECMKDLLLVNLRGNLQIIVQAAKEYSDQLGVDSCIKLFEQFKSYEGLYFFLGSYLSSSEDPDIHFKYIEAAAKTGQIKEVERVTRESNFYDAEKTKNFLMEARLPDARPLINVCDRFGFVPDLTHYLYSNNMLRYIEGYVQKVNPSNAPLVVGQLLDDDCPEDFIKGLILSVRSLLPVEPLVEECEKRNRLRLLTQFLEHLVSEGSQDVHVHNALGKIIIDTNNNPEHFLTTNPYYDSRVVGKYCEKRDPTLAVVAYRRGQCDDELIDVTNKNSLFKLQARYVVERMEPELWEKVLTPENPFRRQLIDQVVSTALPESKNPDQVSATVKAFMTADLPHELIELLEKIVLQNSAFSGNPNLQNLLILTAIKADKSRVMDYINRLDNFDGPAVGEIAVGAELFEEAFAIFKKFNLNVQAVNVLLDNIRSIERAVEFASRVEEDAVWSQVAKAQLREGLVSDAIESFIRADDATEFLDVIRAAEQASVYHDLVKYLLMVRKKVKEPKVDSELIYAYAKIDRLGEIEEFILTPNVANLQSVGDRLFDEALYEAAKIIFAFISNWAKLASTLVKLRQFQGAVDAARKANSSKTWKEVCFACVDAEEFRLAQICGLNIIVQVDDLEEVSDYYQNRGRFDELISLMESGLGLERAHMGIFTELGILYARYRPDKLMEHIKLFSTRLNIPKLIRVCDEQQHWKELTYLYIQYDEYDNAAATIMSHSPEAWDHMQFKDVVVKVANVELYYKAVHFYLQEHPDLINDLLNVLSLRVDHTRVVDIMRKAGYLHLVKPYMVAVQSNNVAAVNEALNGIYVEEEDYDRLRESIDLHDNFDQIGLAQKVEKHELLEFRRIAAYIYKKAGRWRQSVALSKKDNLYKDAMETSSQSGDRELAEELLVYFVEQGKKECFASCLFTCYDLIRPDVALELAWMNNMIDFSFPYLLQFIREYTTKVDDLVKDKLENLQEVKSKEKEEKDLVAQQNMYAQLLPLALPAPPMPGMGGGMGMGGFQPGMGGMGMPPMPAYGMPPMGGY

SEQ ID NO: 9636 - protein, 1702 aa, Glycine max
MAANAPIAMRETLTLASVGINPQFITFTHVTMESDKYICVRETAPQNSVVMIDMTMPMQPLRRPITADSALMNPNTRILALKAQVPGSTQDHLQVFNIESKAKMKSYQMSQQVVFWKWITPKTLGIVTQSSVYHWSIEGDGEPVKVFDRTANLANNQIINYRCDPTEKWLVLIGIAPGSSERPQLVKGNMQLFSVDQQRSQALEAHAASFATFRVAGNDKDSTLICFASKSINAGQVTSKMHVIELGAQPGKPSFSKKQADLFFPPDFADDFPVSMQISNKYGLIYVITKLGLLFVYDLETATAVYRNRISPDPVFLTTEASSDGGFYAINRRGQVLLATVNEATIVPFVSGQLNNLELAVSLAKRGNLPGAEELVVKRFQELFAQTKYKEAAELAAQSPQGVLRTPDTVAKFQSVPVQAGQTPPLLQYFGTLLTMGKLNAFESLELSRLVVNQNKKNLLENWLAEDKLECSEELGDLVKTVDNDLALKIYIKARATPKVVAAFAERREFDKILIYSKQVGYTPDYMFLLQTILRTDPQGAVNFALMMAQMEGGCPIDYNTITDLFLQRNLIREATAFLLDVLKPNLPEHGYLQTKVLEINLVTFPNVADAILANGMFSHYDCPRIGQLCEKAGLFIRALQHYTELPDIKRVIVNTHAIEPQALVEFFGTLSREWALECMKDLLLVNLRGNLQIIVQTAKEYSEQLGVDACIKLFEQFKSYEGLYFFLGAYLSSSEDPDIHFKYIEAAAKTGQIKEVERVTRESNFYDAEKTKNFLMEAKLPDARPLINVCDRFGFVPDLTHYLYTSNMLRYIEGYVQKVNPGNAPLVVGQLLDDECPEDFIKGLILSVRSLLPVEPLVEECEKRNRLRLLTQFLEHLVSEGSQDVHVHNALGKIIIDSNNNPEHFLTTNPYYDSRVVGKYCEKRDPTLAVVAYRRGQCDDELVNVTNKNSLFKLQARYVVQRMDSDLWEKVLNPENEFRRQLIDQVVSTALPESKSPDQVSAAVKAFMTADLPHELIELLEKIVLQNSAFSGNFNLQNLLILTAIKADPSRVMDYINRLDNFDGPAVGEVAVEAQLYEEAFSIFKKFNLNVQAVNVLLDNLQTIDRAVEFAFRVEEDAVWSQVAKAQLREGLVSDGIESFIRADDSTHFLEVIKAAEDADVYHDLVKYLLMVRQNTKEPKVDSELIYAYAKIECLGEIEEFILMPNVANLPNVGDRLYDEALYEAAKIIFAFISNWAKLAVTLVKLKQFQGAVDAARKANSSKTWKEVCFACVDAEEFRLAQICGLNVIIQVDDLEEVSEYYQNRGCFNELISLMESGLGLERAHMGIFTELGVLYARYRPEKLMEHIKLFSTRLNIPKLIRACDEQQHWKELTYLYIQYDEFDNTATTIMNHSPEAWDHMQFKDVIVKVASVELYYKAVHFYLKEHPDIINDMLNVIALRVDHTRVVDIMQKAGHLRLVKPYMVAVQSNNVSAVNEALNEIYAEEEDYDRLRESIDLHDNFDQIGLAQKIEKHELLEMRRVAAYIYKKAGRWKQSIALSKKDNLYKDCMETCSQSGDRELSEDLLVYFIEQGKKECFASCLFVCYDIIWPDVALELAWMNNMIDFAFPYLLQFIREYTGKIDELIKDKIEAQNEEKAKEKEEKEVLAQQNMYAQLLPLALPAPPMQGMGGGYAPSPPPPMGGMGMPPMPPFGMPPMGGGY

SEQ ID NO: 9637 - protein, 1702 aa, Solanum lycopersicum
MAAATAPIIMKETLTLPSAGVNQQFINFTNVTMESEKYICVRETSPQNSVVIIDMNMPMQPLRRPITADSAIMNPNSRILALKAQVPGTTQDHLQIFNIEAKQKIKSYQMPEQVVFWKWITPQILGIVTQTSVYHWPIEGDTEPIKMFDRTANLANNQIINYRCDPSEKWLVLIGIAPGSPERPQLVKGNMQLYSVDQQRSQSLEAHAASFASFRVPGSDRDSILISFATKSLNAGQVISKLHVIELGAQPGKPSFTKKQADLFFPPDFADDFPVSMQISHKYSLIYVITKLGLLFVYDLETATAVYRNRISPDPIFLTAEASSIGGFYAINRRGQVLLATVNETTIIPFVSGQLNNLELAVNLAKRGNLPGAETLVVQRFQELFAQTKYKEAAELAAESPQGILRTSDTVAKFQSVPVQAGQTPPLLQYFGTLLTKGKLNAFESLELSRLVVNQNKKNLLENWLAEDKLECSEELGDLVKTVDNDLALKIYIKARATPKVVAAFAERREFDKILIYSKQVGYTPDYLFLLQTILRSDPQGAVNFALMMSQMEGGCPVDYNTITDLFLQRNMIREATAFLLDVLKPNLPEHGFLQTKVLEINLVTFPNVADAILANGMFSHYDRPRIAQLCEKAGLYIRALQHYTELPDIKRVIVNTHAIEPQALVEFFGTVSREWALECMKDLLVINIKGNLQIIVQVAKEYCEQLGVDACIKLFEQFKSYDGLYFFLGSYLSSSEDPEIHFKYVEAAAKTGQIKEVERVTRESNFYDPEKTKNFLMEAKLPDARPLINVCDRFGFVPDLTHYLYTNNMLRYIEGYVQKVNPANAPLVVGQLLDDECPEDFIKGLILSVRSLLPVEPLVDECEKRNRLRLLTQFLEHLVSEGSQDVHVHNALGKIIIDSNNNPEHFLTTNPYYDSRVVGKYCEKRDPTLAVVAYRRGQCDDELINVTNKNSLFKLQSRYVVERMDGDLWEKVLNPENEFRRQLIDQVVSTALPESKSPEQVSATVKAFMTADLPHELIELLEKIVLQNSAFSGNFNLQNLLILTAIKADPARVMDYINRLDNFDGPAVGEVAVEAQLYEEAFAIFKKFNLNVQGVNVLLDNIHDINRAVEFAFRVEEDAVWSQVAKAQLREGLVSDAIESFIRADDTTQFLDVIRAAEDADVYHDLVKYLLMVRQKTKEPKVDSELIYAYAKIDRLSDIEEFILMPNVANLPNVGDRLYDEALYEAAKIIFAFTSNWAKLAITLVKLNQFQGAVDAARKANSSKTWKEVCFACVDAEEFRLAQICGLNIIVQVDDLEEVSEYYQNRGCFNELISLMESGLGLERAHMGIFTELGVLYARYRHEKLMEHIKLFSTRLNIPKLIRACDEQQHWKELTYLYIQYDEFDNAATTVMNHSPDAWDHMQFKDIAVKVANVELYYKAVHFYLQEHPDLINDLLNVLALRVDHTRVVDIMRKAGHLRLVKPYMIAVQSNNVSSVNEALNEIYVEEEDYDRLRESVDLHDNFDQIGLAQKIEKHELLEMRRVAAYIYKRAGRWKQSIALSKKDNLYKDAMETASQSGDRELAEELLVYFIEQGKKECFASCLFVCYDLIRPDVALELAWMNNMIDFAFPYLLQFIREYTGKVDELIKDKIEAQSEAKAKENEEKDVMKQQNMYAQLLPLALPAPPMPGMGGGFGPSQPPPMGGMGMPPMPPFGMPPMGPY

SEQ ID NO: 9638 - protein, 1704 aa, Brassica rapa
MAAANAPITMKEVLTLPSVGINQQFITFTNVTMESDKYICVRETAPQNSVVIIDMSMPMQPLRRPITADSALMNPDSRILALKAQVPGTTQDHLQIFNIEAKAKLKSHQMPEQVAFWKWITLKMLGLVTQNSVYHWSIEGDSEPVKMFDRTANLANNQIINYKCSPNEKWLVLIGIAPGPPERAQLVKGNMQLFSVDQQRSQALEAHAASFAQFKVPGNENPSILISFASKSFNAGQITSKLHVIELGAQPGKPSFTKKQADLFFPPDFADDFPVAMQVSHKFSLIYVITKLGLLFVYDLETASAIYRNRISPDPIFLTSEASSVGGFYAINMRGQVLLATVNEATIIPFISGQLNNLELAVNLAKRGNLPGAEELVVERFKELFAQTKYKEAAELAAESPQGILRTPDTVAKFQSVPVQAGQTPPLLQYFGTLLTKGKLNSYESLELSRLVVNQNKKNLLENWLAEDKLECSEELGDLVKTVDNDLALKIYIKARATPKVVAAFAERKEFDKILIYSKQVGYTPDYMFLLQTILRTDPQGAVNFALMMSQMEGGCPVDFNTITDLFLQRNLIREATAFLLDVLKPNLPEHAFLQTKVLEINLVTFPNVADAILANGMFSHYDRPRVAQLCEKAGLFIQSLKHYSELPDIKRVIVNTHAIEPQALVEFFGTLSSDWAMECMKDLLLVNLRGNLQIIVQACKEYCEQLGVDACIKLFEQFKSYEGLYFFLGSYLSMSEDPEIHFKYIEAAAKTGQIKEVERVTRESNFYDAEKTKNFLMEAKLPDARPLINVCDRFGFVPDLTHYLYTNNMLRYIEGYVQKVNPGNAPLVVGQLLDDECPEDFIKGLILSVRSLLPVEPLVEECEKRNRLRLLTQFLEHLVSEGSQDVHVHNALGKIIIDSNNNPEHFLTTNPYYDSRVVGKYCEKRDPTLAVVAYRRGQCDEELVNVTNKYSLFKLQARYVVERMDGDLWDKVLLEENEYRRQLIDQVVSTALPESQSPEQVSAAVKAFMTADLPHELIELLEKIVLQNSAFSGNFNLQNLLILTAIKADPSRVMDYINRLDNFDGPAVGEVAVEAQLYEEAFAIFKKFNLNVQAVDVLLDNVKSIERSVEFAFRVEEDSVWSQVAKAQLREGLVSDAIESFIRAEDATHFLEVIRATEDANVYDDLVRYLLMVRQKVKEPKVDSELIYAYAKIDRLGEIEEFILMPNVANLPNVGDRLYDEALYEAAKIIYAFISNWGKLAVTLVKLQQFQGAVDAARKANSAKTWKEVCFACVDAEEFRLAQICGLNVIIQVDDLEEVSEFYQNRGCFSELISLMESGLGLERAHMGIFTELGVLYARYRYEKLMEHIKLFSTRLNIPKLIRACDEQQHWQELTYLYIQYDEFDNAATTVMNHSPEAWEHMQFKDIVAKVANVELYYKAVHFYLQEHPDLINDLLNVLALRLDHTRVVDIMRKAGQLRLIKPYMVAVQSNNVSAVNEALNEIYVEEEDYDRLRESIDLHDSFDQIGLAQKIEKHELVEMRRVAAYIYKKAGRWKQSIALSKKDNMYKDCMETASQSGEHDLAEQLLVYFIEQGKKECFATCLFVCYDLIRPDVALELAWIHNMLDFAFPYLLQFIREYSGKVDELIKDKLEAQKEVKAKEQEDKDVMSQQNMYAHLLPLALPAPPMPGMGGGGGYGPPPPMGGGMPGMPPMPPYGMPPMGGY

SEQ ID NO: 9639 - protein, 1700 aa, Distylium racemosum
MAAASAPITMKEALTLPSLGINPQFITFTHVTMESDKYICVRETAPQNSVVIIDVNNPVPVMRRPITADSALMNPNSRILALKAQIPGTTQDHLQIFNIEMKAKVKSHQMPEQVVFWKWITPKMLGLVTQTSVYHWSLEGESEPVRMFERTANLAGNQIINYRCDPTEKWLVLIGIAPGAPERPQLVKGNMQLFSVDQQRSQALEAHAAAFATFKVAGNENPSILISFASKTISGGQLTSKLHVIELGAQPGKPGFSKKQADLFFPPDFADDFPVSMQISHKYSLIYVITKLGLLFVYDLETATAVYRNRISPDPIFLTAEASSIGGFYAVNRRGQVLLATVNEATIVPFVSGQLNNLELAVNLAKRGNLPGAENLVVQRFQELFGQMKYKEAAELAAESPQGILRTPDTVTKFQSVPVQPGQTPPLLQYFGTLLTKGKLNAFESLELSRLVVNQNKKNLLENWLAEDKLECSEELGDLVKTVDNDLALKIYIKARATPKVVAAFAERREFDKILIYSKQVGYTPDYLFLLQTILRSDPQGAVNFALMMSQMEGGCPLDYNTITDLFLQRNMIREATSFLLDVLKPNLPEHAHLQTKVLEINLVTFPNVADAILANGIFSHYDRPRIAQLCEKAGLYMRALQHYTELPDIKRVIVNTHAIEPQALVEFFGTLSREWALECMKDLLLVNLRGNLQIIVQTAKEYSEQLGVDSCIKLFEQFKSYEGLYFFLGSSLSSSEDPEIHFKYIEAAAKTGQIKEVERVTRESNFYDPEKTKNFLMEARLPDARPLINVCDRFGFVPDLTHYLYTNNMLRYIEGYVQKVNPSNAPLVVGQLLDDDCPEDFIKGLILSVRSLLPVEPLVEECEKRNRLRLLTQFLEHLVSEGSQDVHVHNALGKIIIDTNNNPEHFLTTNPYYDSRVVGKYCEKRDPTLAVVAYRRGQCDDELIHVTNKNSLFKLQARYVVERMEPELWEKVLNPENPFRRQLIDQVVSTALPESKNPDQVSATVKAFMTADLPHELIELLEKIVLQNSAFSGNPNLQNLLILTAIKADKSRVMDYINRLDNFDGPAVGEIAVGAELYEEAFAIFKKFNLNVQAVNVLLDNIRSIERAVEFASRVEEDAVWSQVAKAQLREGLVSDAIESFIRADDATEFHDVIRAAEQMEVYNDLVKYLLMVRRKVKEPKVDSELIYAYAKIDRLGEIEEFILTPNVANLQSVGDRLFDEALYEAAKIIFTFISNWAKLASTLVKLKQFQGAVDAARKANSSKTWKEVCFACVDAEEFRLAQICGLNIIVQVDDLEEVSDYYQNRGRFDELISLMESGLGLERAHMGIFTELGVLYARYRPDKLMEHIKLFSTRLNIPKLIRVCDEQQHWKELTYLYIQYDEYDNAATTIMNHSPEAWDHMQFKDVVVKVANVELYYKAVHFYLQEHPDLMNDLLNVLALKVDHTRVVDIMRKAGHLRLVKPYMVAVQSNNVAAVNEALNEIYVEEEDYDRLRESIDLHDNFDQIGLAQKLEKHELLELRRIAAYIYKKAGRWRQSVALSKKDNLYKDAMETASQSGDRELAEELLIFFVEQGKKECFASCLFTCYDLIRPDVALELAWMNNMIDFSFPYLLQFIREYTMKVDELVKDKLEALQEEKSKEKEEKDMVAQQNMYAQLLPLALPAPPMPGMGAPGMGMPPMGGMGMPPMPAYGMPPMGGY

SEQ ID NO: 9640 - protein, 1702 aa, Pinus taeda
MAAASAPITMKEVLTLPSLGINPQFITFTHVTMESDKYICVRETAPANSVVIIDMNMPMQPLRRPITADSALMNPNSRILALKAQIPGSTQDHLQIFNIEMKAKMKSYQMPEQVVFWKWITPKLLGLVTQTSVYHWTLEGDAEPARMFDRTANLTGNQIINYRCDPSEKWLVLIGIAPGAPERPQLVKGNMQLFSVDQQRSQALEAHAAAFASFKVPGNENPSILISFASKTMVGGQLTSKLHVIELGAQPGKPGFSKKQADLFFPPDFADDFPVAMQISNKYSLIYVITKLGLLFVYDLDTATAVYRNRISPDPIFLTTEASSIGGFYAINRRGQVLLATVNEATIVPFVSGQLNNLELAVNLAKRGNLPGAENLVVQRFQELFSQMKYKEAAELAAESPQGILRTPDTVAKFQSVPVQPGQTPPLLQYFGTLLTRGKLNAFESLELSRLVVNQNKKNLLENWLAEDKLECSEDLGDLVKTVDNDLALKIYIKARATPKVVAAFAERREFDKILIYSKQVGYTPDYLFLLQTILRSDPQGAVNFALMMSQMEGGCPLDYNTITDLFLQRNMIREATSFLLDVLKPNLPEHGYLQTKVLEINLVTFPNVADAILANGMFSHYDRPRIAQLCEKAGLYMRALQHYTELPDIKRVIVNTHAIEPQALVEFFGTLSREWALECMKDLLLVNLRGNLQIIVQAAKEYSDQLGVDSCIKLFEQFKSYEGLYFFLGSYLSSSEDPDIHFKYIEAAAKTGQIKEVERVTRESNFYDAEKTKNFLMEARLPDARPLINVCDRFGFVPDLTHYLYSNNMLRYIEGYVQKVNPSNAPLVVGQLLDDDCPEDFIKGLILSVRSLLPVEPLVEECEKRNRLRLLTQFLEHLVSEGSQDVHVHNALGKIIIDTNNNPEHFLTTNPYYDSRVVGKYCEKRDPTLAVVAYKRGQCDDELIDVTNKNSLFKLQARYVVERMEPDLWEKVLTPENPFRRQLIDQVVSTALPESKNPDQVSATVKAFMTADLPHELIELLEKIVLQNSAFSGNPNLQNLLILTAIKADKSRVMDYINRLDNFDGPAVGEIAVGAELFEEAFAIFKKFNLNVQAVNVLLDNIRSIERAVEFASRVEEDAVWSQVAKAQLREGLVSDAIESFIRADDATQFLDVIRAAEIAGVYHDLVKYLLMVRRKVKEPKVDSELIYAYAKIDRLADIEEFILTPNVANLQGVGDRLFDEELYEAAKIIFAFISNWAKLASTLVKLRQFQGAVDAARKANSSKTWKEVCFACVDAEEFRLAQICGLNIIVQVDDLEEVSDYYQNRGRFDELISLMESGLGLERAHMGIFTELGILYARYRPDKLMEHIKLFSTRLNIPKLIRVCDEQQHWKELTYLYIQYDEYDNAAATIMNHSPEAWDHMQFKDVVVKVANVELYYKAVHFYLQEHPDLINDLLNVLSLRVDHTRVVDIMRKAGHLHLVKPYMVAVQSNNVAAVNEALNAIYVEEEDYERLRESIDMHDNFDQIGLAQKVEKHELLEFRRIAAYIYKKAGRWRQSVALSKKDNLYKDAMETSSQSGDRELAEELLVYFVEQGKKECFASCLFTCYDLIRPDVALELAWFNNMIDFSFPYLLQFIREYTTKVDELVKDKLENLQEVKSKEKEEKDMVAQQNMYAQLLPLALPAPPIPGMGGGMGMGGFQPGMAGMGMPPMPAYGMPPMGY

SEQ ID NO: 9641 - protein, 1705 aa, Fragaria vesca
MASAAANAPMTMKEQLTLPSIGINPQFITFTHVTMESDKYICVRETSPQNSVVIIDMSMPMQPLRRPITADSALMNPNSRILALKAQVQGTTQDHLQIFNIELKTKMKSHQMPEQIVFWKWVTPKMLGMVTVTSVYHWLIEGDSEPTKVFERTANLANNQIINYRCDPSEKWLVLIGIAPGSSERPQLVKGNMQLFSVEQQRSQALEAHAASFATIKVAGNENPSTLICFAAKSSNAGQVTSKLHVIELGAQPGKPSYTKKQADLFFPPDFADDFPVSMQISEKYGLIYVITKLGLLFVYDLETATAVYRNRISPDPIFLTAEASSVGGFYAVNRRGQVLLASVNEQTIVPFVSGQLNNLGLAVSLARRGNLPGAEDLVVQRFQELFSQTKYKEAAELAADSPMGVLRTPETVTKFQSVPVQAGQTPPLLQYFGTLLTKGKLNAFESLELSRLVVNQNKKNLLENWLAEDKLECSEELGDLVKTVDNDLALKIYIKARATPKVVAAFAERREFDKILVYSKQVGYTPDYMFLLQTILRTDAQGAVNFALMMSQMEGGCPIDYNTITDLFLQRNLIREATAFLLDVLKPNLPEHGFLQTKVLEINLVTFPNVADAILANGMFSHYDRPRVGQLCEKAGLYLRALQHYTELPDIKRVIVNTHAIDPQALVEFFGTLSIEWALECMKDLLLVNLRGNLQIIVQTAKEYSEQLGVDKCIKLFEQFKSYEGLYFFLGSYLSSSEDPDIHFKYIEAAAKTGQIKEVERVTRESNFYDAEKAKNFLMEAKLPDARPLINVCDRFGFVPDLTHYLYTNNMLRYIEGYVQKVNPGNAPLVVGQLLDDECPEDFIKGLILSVRSLLPVEPLVDECEKRNRLRLLTQFLEHLVSEGSQDVHVHNALGKIIIDSGNNPEHFLTTNPYYDSRVVGKYCEKRDPTLAVVAYRRGQCDDELVNVTNKNSLFKLQARYVVERMDDDLWAKVLDPENEYRRQLIDQVVSTALPESKSPEQVSATVKAFMTADLPHELIELLEKIVLQNSAFSGNFNLQNLLILTAIKADPSRVMDYINRLDNFDGPAVGVMAIEAQLYEEAFAIFKKFNLNVDAVNVLLDNIHSIDRAVEFAFRVEEDAVWSQVAKAQLREGLVSDAIESFIRADDATQFLDVIRAAQDADVYHDLVRYLLMVRQKAKEPKVDSELIYAYAKIDRLGDIEEFILMPNVANLPNVGDRLYDEELYEAAKIIFAFISNWAKLACTLVKLKQFQGAVDAARKANSSKTWKEVCFACVDAEEFRLAQICGLNIIIQVDDLEEVSEFYQNRGCFNELISLMESGLGLERAHMGIFTELGVLYARYRPEKLMEHIKLFSTRLNIPKLIRACDEQQHWKELTYLYIQYDEFDNAATTIMNHSPEAWEHMQFKDVIVKVASVELYYRAVHFYLEEHPDIINDVLNVLALRVDHTRVVDIMRKAGHIRLVKPYMVAVQSNNVTAVNEALNEIYVEEEDYDRLRESIDLHDSFDQIGLAQKLEKHELLEIRRVAAYIYKKAGRWKQSIALSKKDKHYKDAMETCSQSGDHDLSEELLVYFIEQGKKECFASCLFVCYDLIRPDVALELAWMNNIIDFAFPYILQFMREYTGKVDELIKDKIESQKEVKAKEQEEKELVAKQNMYAQLLPALPAPPGMGGGFAPPPMPPMPQMGGMGMPPMPPFGMPQMGPSY

SEQ ID NO: 9642 - protein, 1699 aa, Malus domestica
MAAANAPMTMKEALTLPSIGINPQFITFTHVTMESDKYICVRETSPQNSVVIIDMNMPMQPLRRPITADSALMNPNSRILALKAQVQGTAQDHLQIFNIEMKAKMKSHQMPEQVVFWKWITPKMLGLVTQTSVYHWLIEGDSEPTKVFERTANLANNQIINYRCDPSEKWLVLIGIAPGSAERPQLVKGNMQLFSVEQKRSQALEAHAASFATFKVPGNEHPSILICFASKSSNAGQVTSKMHVIELGAQPGKPSYTKKQADLFFPPDFADDFPVSMQISEKYGLIYVVTKLGLLFVYDLETATAVYRNRISPDPIFLTAEASTVGGFYAINRRGQVLLATINEQTIVPFVSGQLNNLGLAVSLAKRGNLPGAEDLVVQRFQELFSQTKYKEAAELAAESPMGILRTPDTVAKFQSVPVQAGQTPPLLQYFGTLLTKGKLNAYESLELSRLVVNQNKKNLLENWLAEDKLECSEELGDLVKTVDNDLALKIYIKARATPKVVAAFAERREFDKILIYSKQVGYTPDYLFLLQTILRADPQGAVNFALMMSQMEGGCPIDYNTITDLFLQRNLIREATAFLLDVLKPNLPEHGFLQTKVLEINLVTFPNVADAILANGMFSYYDRPRIGQLCEKAGLYLRALQHYTELPDIKRVIVNTHAIDPQALVEFFGTLSVEWALECMKDLLLVNLRGNLQIIVQTAKEYCEQLGVDKCIKLFEQFKSYEGLYFFLGAYLSSSEDPDIHFKYIEAAAKTGQIKEVERVTRESNFYDPEKAKNFLMEAKLPDARPLINVCDRFGFVPDLTHYLYTNNMLRYIEGYVQKVNPGNAPLVVGQLLDDECPEDFIKGLILSVRSLLPVEPLVEECEKRNRLRLLTQFLEHLVSEGSQDVHVHNALGKIIIDSGNNPEHFLTTNPYYDSRVVGKYCEKRDPTLAVVAYRRGQCDDELINVTNKNSLFKLQARYVVERMDDDLWAKVLDPENEYKRQLIDQVVSTALPESKSPEQVSATVKAFMTADLPHELIELLEKIVLQNSAFSGNFNLQNLLILTAIKTDPSRVMDYINRLDNFDGPAVGVMAVEAQLYEEAFAIFKKFNLNVDAVNVLLDNIQSIDRAVEFAFRVEEDAVWSQVAKAQLREGLVSDAIESFIRADDATHFLDVIRASEDADVYHDLVRYLLMVRQKTKEPKVDSELIYAYAKIDRLGDIEEFILMPNVANLQNVGDRLFDEALYEAAKIIFAFISNWGKLACTLVKLNQFQGAVDAARKANSSKTWKFVCFACVDAEEFRLAQICGLNIIIQVDDLEEVCEYYQNRGCFNELISLMESGLGLERAHMGIFTELGVLYARYRPEKLMEHIKLFSTRLNIPKLIRACDEQQHWNELTYLYIQYDEFDNAATTIMNHSPEAWDHMQFKDVIVKVASVELYYRAVHFYLEEHPDVINDVLNVIALRVDHTRVVDIMRKAGHICLIKPYMVAVQSNNVTAVNEALNEIYIEEEDYDRLRESIDLHDSFDQIGLAQKLEKHELLEMRRVAAYIYKKAGRWKQSIALSKKDNHYKDCMETCSQSGDHELSEELLIYFIEQGKKECFAACLFVCYDMIRPDVALELAWMNNIIDFALPYLLQFIREYTGKVDELIKDKIEAQNEVKAKEKEEKELVAQQNMYAQLLPALPAPPGMGGYAPPPMPPMGGMGMPPMPPFGMPQMGPSY

SEQ ID NO: 9643 - protein, 1690 aa, Populus trichocarpa
MAAANAPITMKEALTLPSLGINPQFINFTHVTMESEKYICIRETSPQNSVVIVDMNMPMQPLRRPITADSALMNPNSRILALKAQLPGTTQDHLQIFNIELKAKVKSHQMPEQVVFWKWISPKMLALVTQTSPVKMFDRTANLQGNQIINYRCDPSEKWLVLIGIAQGPPERPQLVKGNMQLFSVDQQRSQALEAHAASFATFKVAGNESPSTLISFASRSFNAGQLTSKLHVIELGAVPGKPSFTKKQADLFFPPDFADDFPVSMQISQKYGLIYAITKQGLLFVYDLETASAIYRNRISPDPIFLTTDASSVGGFYAVNRRGQVLLATVNEATIVPFVSGQLNNLELAVNLAKRGNLPGAENLVVQRFQELFSQSKYKEAAELAAESPQGILRTPDTVAKFQSVPVQAGQTPPLLQYFGTLLTRGKLNAFESLELSRLVVNQNKKNLLENWLAEDKLECTEELGDLVKTVDNDLALKIYIKARATPKVVAAFAERREFDKILIYSKQVGYNPDYLFLLQTILRTDPQAAVNFALMMSQMEGGCPVDYNTITDLFLQRNLIREATAFLLDVLKPNLPEHGYLQTKVLEINLVTFPNVADAILANGMFSHYDRPRIGQLCEKAGLYIRALQHYTELPDIKRVIVNTHAIEPQALVEFFGTLSREWALDCMKDLLLVNLRGNLQIIVQTAKEYCEQLGVDACIKLFEQFKSYEGLYFFLGSYLSSSEDPEIHFKYIEAAAKTGQIKEVERVTRESNFYDAEKTKNFLMEAKLPDARPLINVCDRFGFVPDLTHYLFVNNMLRYIEGYVQKVNPGNAPLVVGQLLDDECAEDFIKGLILSVRSLLPVEPLVEECEKRNRLRLLTQFLEHLVSEGSQDVHVHNALGKIIIESGDNPEHFLTTNPYYDSRVVGKYCEKRDPTLAVVAYRRGQCDDELINVTNKNSLFKLQARYVVERMDGDLWDKALSPDNEYRRQLIDQVVSTALPESKSPDQVSAAVKAFMTADLPHELIELLEKIVLQNSAFSGNFNLQNLLILTAIKADPSRVMDYVNRLDNFDGPAIGEVAVEAQLYEEAFAIFKKFNLNVQAVNVLLDNIHSIDRAVEFAFRVEEEAVWSQVAKAQLREGLVSEAIESFIRADDATQFLEVIKAAEDANVYHDLVKYLLMVRQKSKEPKVDSELIYAYGKIDQLGEIEEFILMPNVANLQNVGDRLYDEALYEAAKIIFRFISNWAKLAVTHVKLKEFQSAVDAARKANSSKTWKEVCFACVDSEEFRLAQICGLNIIIQVDDLEEVSEYYQNRGCFSELISLMESGLGLERAHMGIFTELGVLYARYRPEKLMEHIKLFSTRLNIPKLIRACDEQQHWKELTYLYIQYDEFDNAATTIMNHSPEAWDHMQFKDVVVKVANVELYYKAVHFYLQEHPDLINDLLNVIALRVDHTRVVDIMRKAGQLRLIKPYMVAVQSNNVSAVNEALNEIYIEEEDYDRLHESIELHDNFDQIGLAQKIEKHELLEMRRVASHIYKKAGRWKQSIALSKKDNLYKDCMETCSQSGDRELSEELLVYFIEQGKKECFAAALFVCYDLIRPDVAMELAWMNNMIDFAFPYLLQFIREYTSKVDELIKSKLEALNEAKAKENEEKDMVAQQNMYAQLLPLALPAPPMPGMGGPGMSGGFAPPPMGGMGMPPYGMPPMGPY

SEQ ID NO: 9644 - protein, 1706 aa, Eutrema parvulum
MAAANAPITMKEVLTLSSAGINQQFITFTNVTMESEKYICIRETAPQNSVVIIDMNMPMQPLRRPITADSALMNPNSRILALKAQVPGTTQDHLQIFNIEAKTKLKSHQMPEQVVFWKWITPKMLGLVTQSSVYHWSIEGDSEPVKMFDRTANLANNQIINYKCSPNEKWLILIGIAPGSPERAQLVKGNMQLFSVDQQRSQALEAHAASFAQFKVPGNENPSILISFASKSFNAGQITSKLHVIELGAQPGKPSFTKKQADLFFPPDFADDFPVAMQVSHKFSLIYVITKLGLLFVYDLETASAVYRNRISPDPIFLTSEASSVGGFYAINRRGQVLLATVNEATIIPFISGQLNNLELAVNLAKRGNLPGAENLVVQRFQELFAQTKYQEAAELAAESPQGILRTPDTVAKFQSVPVQAGQAPPLFQYFGTLLNRGKLNSYESLELSRLVVNQNKPKVLEGWLGEDKLECSEELGDLVKTVDSDLALKIYIKAQATPKVVAAFAEKGEFDKILIYAQKVGYTPDYLFLLQTILRTDPQGAVNFALMMSQMEGGCPLDFNTITDLFLQRNLIREATAFLLDVLKPNLPEHAFLQTKVLEINLVTFPNVADAILANGMFSHYDRPRIAQLCEKAGLYIQSLKHYSELPDIKRVIVNTHAIEPQALVEFFGTLSSDWAMECMKDLLLVNLRGNLQIIVQACKEYCEQLGVDACIKLFEQFKSYEGLYFFLGSYLSMSEDPEIHFKYIEAAAKTGQIKEVERVTRESNFYDAEKTKNFLMEAKLPDARPLINVCDRFGFVPDLTHYLYTNNMLRYIEGYVQKVNPGNAPLVVGQLLDDECPEDFIKGLILSVRSLLPVEPLVGECEKRNRLRLLTQFLEHLVSEGSQDVHVHNALGKIIIDSNNNPEHFLTTNPYYDSRVVGMYCEKRDPTVAVVAYRRGQCDEELVNVTNKNSLFKLQARYVVERMDGDLWDKVLDEKNDYRRQLIDQVVSTALPESKSPEEVSAAVKAFMTADLPHELIELLEKIVLQNSAFSGNFNLQNLLILTAIKADPSRVMDYINRLDNFDGPAVGEVAVEAQLYEEAFAIFKKFNLNVQAVNVLLDNVKSIERAVEFSFRVEEDAVWTQVAKAQLREGLVSDAIESFIRADDATHFLEVIRATEDANVYDDLVRYLLMVRQKVKEPKVDSELIYAYAKIDSLVEIEEFILMPNVANLQNVGDRLYDEALYEAAKIIYAFISNWAKLAVTLVKLQQFQGAVDAARKANSAKTWKEVCFACVDAEEFRLAQICGLNIIIQVDDLEEVSEFYQNRGRFNELISLMESGLGLERAHMGIFTELGVLYARYRYEKLMEHIKLFSTRLNIPKLIRACDEQQHWPELTYLYIQYDEFDNAATTVMNHSPQAWEHMQFKDIVAKVANVELYYKAVHFYLQEHPDLINDLLNVLALRLDHTRVVDIMQKAGQLRLIKPYMVAVQSNNVSAVNEALNEIYVEEEDYDRLRESIDLHDSFDQIGLAQKIEKHELVEMRRVAAYIYKKAGRWKQSIALSKKDSMYKDCMETASQSGDHDLAEQLLVYFIEQGKKECFASCLFVCYDLIRPDVALELAWINNMIDFAFPYLLQFIREYTGKVDEIIKDKLEAQKEVKAKEQEEKDVMSQQNMYAQLLPLALPAPPMPGIGGGGGYGPPPPTGGMPGMPGMPPMPPFGMPPMGGY

SEQ ID NO: 9645 - protein, 1712 aa, Eutrema halophilum
MAAANAPINMKEILTLTSVGINPQSINFTSVTMESDKYICVRETAPQNSVVIIDMSMPTQPLRRPITADSALMNPNTRILALKAQLQGTTQDHLQIFNIEAKSKIKSHQMPEQVVFWKWISPKMLGLVTQTSVYHWSIEGDSAPVKLFDRTANLANNQIINYKCDPSEKWLVLIGIAPGAPERPQLVKGNMQLFSVDQQRSQALEAHAASFAQFKVPGNENPSTLISFATKSVNAGQITSKLHVIELGAQPGKPSFSKKQADLFFPPDFQDDFPVAMQVSHKYGLIYVITKLGLLFVYDLETATAVYRNRISPDPIFLTSEAQSVGGFYAINRRGQVLLGTVNDATIVPFVSGQLNNLELAVSLAKRGNLPGAENLVVQRFQELFAQTKYKEAAELAAESPQGILRTPDTVAKFQSVPVQAGQTPPLLQYFGTLLTKGKLNEFESLELARLVVNQNKKNLLENWLAEDKLECSETLGDLVKTVDNDLALKIYIKAKVTPKVVAAFAERREFDKILIYSKQVGYTPDYLFLLQTILRTDPQGAVNFALMMSQMEGGCPVDYNTITDLFLQRNLIREATAFLLDVLKPNLPEHGFLQTKVLEINLVTFPNVADAILANGMFTHYDRPRIAQLCEKAGLFIQSLKHYSELPDIKRVIVNTHAIEPQALVDFFGTLSCEWALECMRDLLLVNLRGNLQIIVQTCKEYCEQLGVDSCIKIFEQFKSYEGLYFFLGSYLSMSEDPEIHFKYIEAAAKTGQIKEVERVTRESNFYDPEKTKNFLMEAKLPDARPLINVCDRFGFVPDLTHYLYTSNMLRYIEGYVQKVNPSNAPLVVGQLLDDECPEDFIKGLILSVRSLLPVEPLVEECEKRNRLRLLTQFLEHLVSEGSQDVHVHNALGKIIIDSNNNPEHFLTTNPYYDSRVVGKYCEKRDPTLAVVAYQRGQCDDELINVTNKNSLFKLQARYVVERMDENLWDKVLISENEYRRQLIDQVVSTALPESKSPEQVSAAVKAFMTADLPHELIELLEKIVLQNSAFSGNSNLQNLLILTAIKADPSRVMDYVNRLDNFDGPAVGEVAVEAQLYEEGFSIFKKFNLNVQAVNVLLDNIRSIERAVEFAFRVEEDTVWSQVAKAQLREGLVSDAIESFIRADDATQFLDVIRAAEDGDVYHDLVRYLLMVRQKVKEPKVDNELIYTYAKIDRLGDIEEFILMPNVANLQTAGDRLYDEAMYEAAKIIYAFISNWAKLAVTLVKLKQFQGAVDAARKANSAKTWKEVCFACVDAEEFRLAQICGLNIIIQVDDLEEVSEYYQNRGCFNELISLMESGLGLERAHMGIFTELGVLYARYRPEKLMEHIKLFSTRLNIPKLIRACDEQQHWKELVYLYIQYDEFDNAATTVMNHSPEAWDHMQFKDIVAKVANVELYYKAVHFYLQEHPDIINDVLNVLALRLDHSRVVDIMRKAGQLLLIKPYMVAVQSNNVSAVNEALNQIYVEEEDYDRLRESTDLHDSFDQIGLAQKIEKHELLEMRRVSAYIYKKAGRWKQSIALSKKDKLYKDCMETASQSGDRELAEELLVYFIEQGKKECFATCLFVCYDLIRPDVALELAWINKMIDFAMPYLLQFMREYTGKVDELIKDKIEAQKEVKAKEQEDKEVMSQQNMYAQLLPLALPAPPVPGVSGSYSAPPPPGMSGGYSEPPPGMVGMPPMPPYGMPPMGGGY

SEQ ID NO: 9646 - protein, 1706 aa, Glycine max
MAANAPITMKETLTLGSVGINQQFITFTHVTMESDKYICVRETGPQNSVVIIDMSMPMQPLRRPITADSALMNPNSRILALKAQVPGTTQDHLQVFNIETKAKMKSHQMKEQVVFWKWITPNTLGIVTQTSVYHWSVEGDGEPMKMFDRTANLANNQIINYRCDPNEKWLVLIGIAPGSAERPQLVKGNMQLFSVDQQRSQALEAHAASFATFRVAGNDKESTLICFASKSLNAGQVTSKMHVIELGAQPGKPSFTKKQADLFFPPDFADDFPVSMQISNKYGLIYVITKLGLLFVYDLETSTAVYRNRISSDPIFLTTEALSVGGFYAINRRGQVLLATINEAAIVPFVSGQLNNLELAVNLAKRGNLPGAEELVVKRFQELFSQTKYKEAAELAAESPRGILRTPDTVAKFQSVPVQAGQTPPLLQYFGTLLTRGKLNSYESLELSRLVVNQNKKNLLENWLAEDKLECSEELGDLVKTVDNDLALKIFIKARATPKVVAAFAERREFDKILIYSKQVGYTPDYMFLLQTILRADAQGAVNFALMMSQMEGGCPVDYNTITDLFLQRNLIREATAFLLDVLKSNLPEHGYLQTKVLEINLVTFPNVADAILANGMFSHYDRPRIAQLCEKAGLFIRALQHYSELPDIKRVIVNTHAIEPQALVEFFGTLSKEWALECMKDLLLVNLRGNLQIIVQTAKEYCEQLGVDACIKLFEQFKSYEGLYFFLGAYLSSSEDPDIHFKYIEAAAKTGQIKEVERVTRESNFYDAEKTKNFLMETKLPDARPLINVCDRFGFVPDLTHYLYTSNMLRYIEGYVQKVNPGNAPLVVGQLLDDECPEDFIKGLILSVRSLLPVEPLVEECEKRNRLRLLTQFLEHLVSEGSQDVHVHNALGKIIIDSNNNPEHFLTTNPYYDSRVVGKYCEKRDPTLAVVAYRRGQCDDELVNVSNKNSLFKLQARYVVERMNADLWEKVLNPENEFRRQLIDQVVSTALPESQSPDQVSAAVKAFMTADLPHELIELLEKIVLQNSAFSGNFNLQNLLILTAIKADPSRVMDYINRLDNFDGPAVGEVAVEANLYEEAFAIFKKFNLNVQAVNVLLDNLRTIDRAVEFAFRVEEDAVWSQVAKAQLREGLVSDAIESFIRADDSTHFLEVIKASEDAEVYHDLVRYLLMVRQNTKEPKVDSELIYAYAKIDRLGEIEEFILMPNVANLPNVGDRLYDEALYEAAKIIFAFISNWAKLAVTLVKLKQFQGAVDAARKANSSKTWKEVCFACVDAEEFRLAQICGLNVIIQVDDLEEVSEFYQNRGCFNELISLMESGLGLERAHMGIFTELGVLYARYRPEKLMEHIKLFSTRLNIPKLIRACDEQQHWMELTYLYIQYDEFDNAATTVMNHSPEAWDHMQFKDIIVKVASVELYYKAVHFYLQEHPDILNDLLNVLALRVDHTRVVDIMRKAGHIRLVKPYLIAVQSNNVSAVNEALNEIYVEEEDYDRLHESIDLHDNFDQIGLAQKIEKHELLEMRRVAAYIYKKAGRWKQSIALSKKDNLYKDCMETCSQSGDRELSEDLLVYFIEQGKKECFASCLFVCYDIIRPDVALELAWMNNMIDFAFPYLLQFIREYTGKVDELIKDKIEAQKEEKAKEKEEKDVIAQQNMYAQLLPLALPAPPMPGMGGGGYAPLTTPPMGGMGMPPMPPFGMPPMGGSSGSY

SEQ ID NO: 9647 - protein, 1427 aa, Podocarpus macrophillus
MQISHKYSLIYVITKLGLLFVYDLETATAVYRNRISPDPIFLTSEATSVGGFYAVNRRGQVLLATVNEATIVPFVSGQLNNLELAVNLAKRGNLPGAENLVVQRFQELFSQMKYKEAAELAAESPQGILRTPETVVKFQSVPVQPGQTPPLLQYFGTLLTKGKLNAFESLELSRLVVNQNKKNLLENWLAEDKLECSEELGDLVKTVDNDLALKIYIKARATPKVVAAFAERREFDKILIYSKQVGYTPDYLFLLQTILRSDPQGAVNFALMMSQMEGGCPVDYNTITDLFLQRNMIREATSFLLDVLKPNLPEHAHLQTKVLEINLVTFPNVADAILANGIFSHYDRPRIAQLCEKAGLYMRALQHYTELPDIKRVIVNTHAIEPQALVEFFGTLSREWALECMKDLLLVNLRGNLQIIVQTAKEYSDQLGADSCIKLFEQFKSYEGLYFFLGSYLSSSEDPEIHFKYIEAAAKTGQIKEVERVTRESNFYDPEKTKNFLMEARLPDARPLINVCDRFGFVPDLTHYLYSNNMLRYIEGYVQKVNPSNAPLVVGQLLDDDCPEDFIKGLILSVRSLLPVEPLVEECEKRNRLRLLTQFLEHLVSEGSQDVHVHNALGKIIIDTNNNPEHFLTTNPYYDSRVVGKYCEKRDPTLAVVAYRRGQCDDELINVTNKNSLFKLQARYVVERMEPELWEKVLNPENPFRRQLIDQVVSTALPESKNPDQVSATVKAFMTADLPHELIELLEKIVLQNSAFSGNPNLQNLLILTAIKADKSRVMDYINRLDNFDGPAVGEIAVGAELYEEAFAIFKKFNLNVQAVNVLLDNIRSIERAVEFASRVEEDAVWSQVAKAQLREGLVSDAIESFIRADDATQFLDVIRAAEQMEVYHDLVKYLLMVRRKVKEPKVDSELIYAYAKIDRLGEIEEFILTPNVANLQSVGDRLFDEALYEAAKIIFTFISNWAKLASTLVKLKQFQGAVDAARKANSSRTWKEVCFACVDAEEFRLAQICGLNIIVQVDDLEEVSDYYQNRGRFDELISLMESGLGLERAHMGIFTELGILYARYRPEKLMEHIKLFSTRLNIPKLIRVCDEQQHWKELTYLYIQYDEFDNAATTIMNHSPEAWDHMQFKDVVVKVANVELYYKAVHFYLQEHPDLINDLLNVLALRVDHARVVDIMRKAGHLLLVKPYMIGVQSNNVAAVNEALNEIYVEEEDYERLRESIDLHDNFDQIGLAQKVEKHELLELRRIAAYIYKKAGRWRQSVALSKKDNLYKDAMETASQSGDRELAEELLVYFVEQGKKECFASCLFTCYDLIRPDVALELAWMNNMIDFAFPYILQFIREYTTKVDELVKDKLEALQEVKSKEKEEKDMVAQQNMYAQLLPLALPAPPMPGMGAGMGTGFQPTAMPGMGMPPMAPYGMPPMGGY

SEQ ID NO: 9648 - protein, 1422 aa, Taxus baccata
MQISHKYSLIYVITKLGLLFVYDLETATAVYRNRISPDPIFLTSEATAAGGFYAVNRRGQVLLATVNEATIVPFVSGQLNNLELAVNLAKRGNLPGAENLVVQRFQELFSQMKYKEAAELAAESPQGILRTPDTVAKFQSVPVQPGQTPPLLQYFGTLLTKGKLNAFESLELSRLVVNQNKKNLLENWLAEDKLECSEELGDLVKTVDNDLALKIYIKARATPKVVAAFAERREFDKILIYSKQVGYTPDYLFLLQTILRSDPQGAVNFALMMSQMEGGCPVDYNVITDLFLQRNMIREATSFLLDVLKPNLPEHAHLQTKVLEINLVTFPNVADAILANGIFSHYDRPRIAQLCEKAGLYMRALQHYTELPDIKRVIVNTHAIEPQALVEFFGTLSREWALECMKDLLLVNLRGNLQIIVQAAKEYSEQLGADSCIKLFEQFKSYEGLYFFLGSYLSSSEDPDIHFKYIEAAAKTGQIKEVERVTRESNFYDAEKTKNFLMEAKLPDARPLINVCDRFGFVPDLTHYLYTNNMLRYIEGYVQKVNPSNAPLVVGQLLDDDCPEDFIKGLILSVRSLLPVEPLVEECEKRNRLRLLTQFLEHLVSEGSQDVHVHNALGKIIIDTNNNPEHFLTTNPYYDSRVVGKYCEKRDPTLAVVAYRRGQCDEELINVTNKNSLFKLQARYVVERMEPELWEIVLNPENPFRRQLIDQVVSTALPESKNPDQVSATVKAFMTADLPHELIELLEKIVLQNSAFSGNPNLQNLLILTAIKADKSRVMDYINRLDNFDGPAVGEIAVGAELYEEAFAIFKKFNLNVQAVNVLLDNIRSIERAVEFASRVDEDAVWSQVAKAQLREGLVSDAIESFIRADDATQFLDVIRAAELSSVYHDLVKYLLMVRSKIKEPKVDSELIYAYAKIDRLGEIEEFILSPNVANLQSVGDRLFDEALYEAAKIIFTFISNWAKLASTLVKLGQFQGAVDAARKANSSKTWKEVCFACVDAEEFRLAQICGLNIIVQVDDLEEVSDYYQNRGRFDELISLMESGLGLERAHMGIFTELGILYARYRPDKLMEHIKLFSTRLNIPKLIRVCDEQQHWKELTYLYIQYDEYDNAATTIMNHSPEAWDHMQFKDVVVKVANVELYYKAVHFYLQEHPDLINDLLNVLALRVDHTRVVDIMRKAGHLHLIKPYMIAVQSNNVAAVNEALNGIYVEEEDYDRLRESIDMHDNFDQIGLAQKVEKHELLEFRRIAAFIYKKAGRWRQSVALSKKDNLYKDAMETSSQSGDRELAEELLVYFVEQGKKECFASCLFTCYDLIRPDVALELAWMNNMIDFAFPYLLQFIREYTTKVDELVKDKLEALQEEKSKEREEKDLVAQQNMYAQLLPLALPAPPMPGMGGGFQPGMGGMGMPPMPAYGMPPMGGY

SEQ ID NO: 9649 - protein, 1711 aa, Populus trichocarpa
MAAANAPITMKEALTLPSLGINPQFINFTHVTMESEKYICIRETAPQNSVVIVDMSMPAQPLRRPITADSALMNPNSRILALKAQLPGTTQDHLQIFNIEMKAKVKSHQMPEQVVFWKWSSANMLALVTQTSVYHWSIEGKHSVSFIFLRYCDSEPVKMFDRTANLQGNQIINYRCDPSEKWLVLIGIAQGPPERPQLVKGNMQLFSVDQQRSQALEAHAASFAAFKVAGNDNASILISFASRSFNAGQLTSKLHVIELGAVPGKPSFTKKQADLFFPPDFADDFPVSMQISQKYGLIYVITKQGLLFVYDLETASAVYRNRISPDPIFLTTDASSVGGFYAVNRRGQVLLATVNEATLVPFVSGQLNNLELAVNLAKRGNLPGAENLVVQRFQELFSQAKYKEAAELAAESPQGILRTPDTVAKFQSVPVQAGQTPPLLQYFGTLLTRGKLNAFESLELSRLVVNQNKKNLLENWLAEDKLECTEELGDLVKTVDNDLALKIYIKARATPKVVAAFAERREFDKILIYSKQVGYNPDYLFLLQTILRTDPQAAVNFALMMSQMEGGCPVDYNTITDLFLQRNLIREATAFLLDVLKPNLPEHGFLQTKVLEINLVTFPNVADAILANGMFSHYDRPRIGQLCEKAGLYIRALQHYTELPDIKRVIVNTHVIEPQALVEFFGTLSREWALECMKDLLLVNLRGNLQIIVQTAKEYCEQLGVDACIKLFEQFKSYEGLYFFLGSYLSSSEDPEIHFKYIEAAAKTGQIKEVERVTRESNFYDPEKTKNFLMEAKLPDARPLINVCDRFGFVPDLTHYLYVNNMLRYIEGYVQKVNPGNAPLVVGQLLDDECAEDFIKGLILSVRSLLPVEPLVEECEKRNRLRLLTQFLEHLVSEGSQDVHVHNALGKIIIDSGDNPEHFLTTNPYYDSRVVGKYCEKRDPTLAVVAYRRGQCDDELINVTNKNSLFKLQARYVVERMDGDLWEKVLSPDNEYRRQLIDQVVSTALPESKSPDQVSATVKAFMTADLPHELIELLEKIVLQNSAFSGNFNLQNLLILTAIKADPSRVMDYINRLDNFDGPAIGEVAVEAQLYEEAFAIFKKFNLNFSAVNVLLDNIRSIDRAVEFAFRVEEEAVWSQVAKAQLREGLVSEAIESFIRADDATQFLEVIKAAEDADVYHDLVRYLLMVRQKSKEPKVDSELIYAYAKIDQLGEIEEFILMPNVANLQNVGDRLYDEALYEAAKIIFRFISNWAKLAVTHVKLNEFQSAVDAARKANSSKTWKEVCFACVDAEEFRLAQICGLNIIIQVDDLEEVSEYYQNRGCFSELISLMESGLGLERAHMGIFTELGVLYARYRPEKLMEHIKLFSTRLNIPKVIRACDEQQHWKELTYLYIQYDEFDNAATTIMNHSPEAWDHMQFKDVVVKVANVELYYKAVHFYLQEHPDLINDLLNVIALRVDHTRVVDIMRKAGQLRLVKPYMVAVQSNNVSAVNEALNGIYIEEEDYDRLRESIELHDNFDQIGLAQKIEKHELLEMRRVAAYIYKKAGRWKQSIALSKKDNLYKDCMETCSQSGERELSEELLVYFIEQGKKECFAACLFVCYDMIRPDVALELAWMNNMIDFAFPYLLQFIREYTSKVDELIKEKLEALSEVKAKEKEEKDMVAQQNMYAQLLPLALPAPPMPGMGGGFAPPPMGGMGMPPMPPYGMPSMAPY

SEQ ID NO: 9650 - protein, 1710 aa, Zostera marina
MAAASAPIAMKEAITLTSLGINPQFVTFTHVTMESEKYICVRETSPQNSVVIIDMNMPMQPMRRPITADSALMNPNSRILALKAQLSGTTQDHLQIFNIEQKSKVKSHQMPEQIIFWKWITPKMLGLVTHISVYHWSIEGDSEPVKMFDRTANLSNNQIINYRCDPNEKWLVLIGIAPGAPERPQLVKGNMQLFSVDQQRSQALEAHAASFASFKVTGNENPSTLICFASKTTNSGQVTSKMHVIELGAQPGKSGYTKKQADLFFPPDFADDFPVAMQISNKYSLIYVITKLGLLFVYDLQTASAVYRNRISSDPIFLTSESSSDGGFYAVNRRGQVLHATVNEATIIPFISGQLNNLELAVNLAKRGNLPGAENLVVQRFQELFSQTKYKEAAELAAESPQGILRTRETVAKFQSVPVQSGQTPPLLQYFGTLLTRGKLNAFESLELSRLVVNQNKKNLLENWLAEDKLECSEELGDLVKTVDNDLALKIYIKARATPKVVAAFAERREFDKILIYSKQVGYAPDYLFLLQTILRSDPQGAVNFALMMSQMEGGCPIDYNVITDLFLQRNLIREATAFLLDVLKPNLPEHGFLQSKVLEINLVTYPNVADAILANGMFSHYDRPRIAQLCEKAGLYMRALQHYSELPDIKRVIVNTHAIEPQSLVEFFGTLSKEWALECMKDLLLVNLRGNLQIIVQAAKEYSEQLGMEACIKLFEQFRSYEGLYFFLGSYLSSSEDPDIHFKYIEAAAKTGQIKEVERVTRESNFYDAEKTKNFLMEVKLPDARPLINVCDRFGFVPDLTHYLYSNNMLRYIEGYVQKVNPSNAPLVIGQLLDDECPGDFIKGLILSVRSLLPVEQLVDECEKRNRLSLLTQFLEHLVSEGSQDVHVHNALGKIIIESNNNPEHFLTTNPYYDSRVVGKYCEKRDPTLAVIAYRRGQCDTELINVTNKNSLFKLQARYVVERMDADLWEKVLVPDNDYRRQFIDQVVSTALPESKSPEQVSSAVKAFMAADLPQELIELLEKIVLQNSAFSGNFNLQNLLILTAIKADPSRVMDYVNRLDNFDGHGVGEVAVEAQLYEEAFAIFKKFNLNVQAVNVLVDHIQSIERSVEFAFRVEEDAVWSQVAKAQLREGLVSEAIESFILADDTTQFLDVIRASEDANVYPDLVKYLLMVRQKTKEPKVDSELIYAYAKTDRIGDIEEFILMPNVANLQNVGDRLYDEALYEAAKIIFAFISNWARLACTLVKLMQFQGAVDAARKANSARTWKEVCFACVDAEEFRLAQICGLNIIVQVDDLEEVSDYYQNRGCFAELISLMESGLGLERAHMGIFTELGVLYARYRPEKLMEHIKLFATSLNIPKLIRACTEQQHWKELTHLYIQYDEFDNAAATIMNHSPDAWDHMQFKDVAVKVASVELYYKAVHFYLQEHPDLINDLLYVLSLRVDHTRVVDIVRKAGHIYLVKPYMVSVQSNNVAAVNEALNAIYVDEEDYDRLRESTDMHDNFDQIGLAQKVEKHELLEMRRISAYIYKKAGRWKQSIALSKKDNLYRDAMETASQSGQRELAEELLVYFIEKEKKECFASCLFICYDQIRPDFALELAWMNNMIDFSVPYLLQYIRELTSKVDELMKDKIEAQIEVKSKETEEKNMVAQQNMYAQLLPLALPAPPGMGGAGLSGSFGSTPPMSGMMGMPGGMGMPPMPAYGMPPMGSY

SEQ ID NO: 9651 - protein, 599 aa, Valeriana officinalis
MAAANAPITMKEVLTLPGIGVNPQFITFTHVTMESDKYICVRETSPQNSVVIVDMNMPNQPLRRPITADSALMNPNSKILALKAQVPGTTQDHLQIFNIELKTRVKSHQMSEQIVFWKWITHKMLGLVTQTSVYHWSLEDDSEPQRMFERTANLANNQIINYRCDPSEKWLVLIGIAPGPQERPQLVKGSMQLFSVDQQRSQALEAHAASFASFKVTGNENPSILICFASKTINAGQISSKLHVIELGAQPGKPAFTKKQADLFFPPDFADDFPVAMQISHKYSLIYVITKLGLLFVYDLETATAVYRNRISPDPIFLTSEASSVGGFYAVNRRGQVLLATVNEATIVPFVSGQLNNLELAVSLAKRGNLPGAENLVVQRFQELFAQTKYKEAAELAADSPQGILRTSDTVAKFQSVPVQAGQTPPLLQYFGTLLTKGKLNAFESLELSRLVVNQNKKNLLENWLAEDKLECSEELGDLVKTVDNDLALKVYIKARATPKVVAAFAERREFDKILIYSKQVGYTPDYLSLLQTILRVDAQGAVNFALMMSQMEGGSPVDYNTITDLFLQRNLIREATAFLLDVLKPDLPEHGFLQTKVL

SEQ ID NO: 9652 - protein, 1715 aa, Cajanus cajan
WPNCEVSTFLDFYILICDLVFFLQLGSVGINPQFITFTHVTMESDKYICVRETSPQNSVVIIDMSMPMQPLRRPITADSALMNPNSRILALKAQVPGTTQDHLQVFNIEMKAKMKSYQMKEQVVFWKWITPNTLGIVTQTSVYHWSVEGDSEPTKMFDRTANLSNNQIINYRCDPNEKWLVLIGIAPGSPERPQLVKGNMQLFSMDQQRSQALEAHAACFATFRVAGNDKDSTLICFASKSMNAGQVTSKMHVIELGAQPGKPSFTKKQADLFFPPDFADDFPVSMQISNKYGFIYVITKLGLLFVYDLETATAVYRNRISPDPIFLTTEAPSVGGFYAINRRGQVLLATINEASIVPFVSGQLNNLELAVNLAKRGNLPGAEELVVKRFQELFAQTKYKEAAELAAESPQGILRTPETVAKFQTVPVQAGQTPPLLQYFGTLLTRGKLNAFESLELSRLVVNQNKKNLLENWLAEDKLECSEELGDLVKTVDNDLALKIYIKARATPKVVAAFAERREFDKILIYSKQVGYTPDYLFLLQTILRADAQGAVNFALMMSQMEGGCPLDYNTITDLFLQRNLIREATAFLLDVLKPNLLEHGYLQTKVLEINLVTFPNVADAILANGMFSHYDRPRIAQLCEKAGLFIRALQHYTELPDIKRVIVNTHAIEPQALVEFFGTLSKEWALECMKDLLLVNLRGNLQIIVQTAKEYCEQLGVDACIKLFEQFKSYEGLYFFLGAYLSSSEDPDIHFKYIEAAAKTGQIKEVERVTRESNFYDAEKTKNFLMEAKLPDARPLINVCDRFGFVPDLTHYLYTSNMLRYIEGYVQKVNPGNAPLVVGQLLDDECPEDFIKGLILSVRSLLPVEPLVEECEKRNRLRLLTQFLEHLVSEGSQDVHVHNALGKIIIDSNNNPEHFLTTNPYYDSRVVGKYCEKRDPTLAVVAYRRGQCDDELVNVTNKNSLFKLQARYVVERMDSDLWEKVLNPENEFRRQLIDQVVSTALPESQSPEQVSAAVKAFMTADLPHELIELLEKIVLQNSAFSGNFNLQNLLVLTAIKADPTRVMDYINRLDNFDGPAVGEVAVEAQLYEEAFAIFKKFNLNVQAVNVLLDNLRTIDRAVEFAFRVEEDAVWSQVAKAQLREGLVSDAIESFIRAEDSTQFLEVIKAAEDAEVYHDLVRYLLMVRQNNKEPKVDSELIYAYAKIDRLGEIEEFILMPNVANLPNVGDRLYDDALYEAAKIIFAFISNWAKLAVTLVKLKQFQGAVDAARKANSSKTWKEVCFACVEAEEFRLAQICGLNVIIQVDDLEEVSEFYQNRGCFNELISLMESGLGLERAHMGIFTELGVLYARYRYEKLMEHIKLFSTRLNIPKLIRACDEQQHWKELTYLYIQYDEFDNAATTIMNHSPEAWDHMQFKDVIVKVASVELYYKAVHFYLQEHPDMINDVLNVLALRVDHTRVVDIMRKAGHIRLVKPYMVAVQSNNVSAVNEALNEIYVEEEDYDRLHESIDLHDNFDQIGLAQKIEKHELLEMRRVAAYIYKKAGRWKQSIALSKKDNLYKDCMETCSQSGDRELSEDLLVFFIEQGKKECFASCLFVCYDIIRPDVALELAWMNNMIDFAFPYLLQFIREYTGKVDELIKHKIETQNEEKAKEKEEKEVIAQQNMYAQLLPLALPAPPMPGMGGGGYAPPTTPPMGGMGMPPMPPFGMPPMGGSGSY

SEQ ID NO: 9653 - protein, 1569 aa, Triticum aestivum
MFDRTANLANNQIINYRCDPAEKWLVLIGIAPGAPERPQLVKGNMQLFSVDQQRSQALEAHAASFATFKVPGNENPSTLICFASKATNAGQITSKLHVIELGAQPGKPGFSKKQADLFFPPDFQDDFPVAMQISQKYGLVYVITKLGLLFVYDLETAAAVYRNRISPDPIFLTAESSTTGGFYAINRRGQVLHATVNDATVVPFVSGQLNNLELAVNLAKRANLPGAENLVVQRFQELFSQTKYKEAAELAAESPQGLLRTPETVAKFQSVPVQAGQTPPLLQYFGTLLTRGKLNAYESLELSRLVVNQNKKNLLENWLAEDKLECSEELGDLVKTVDNDLALKIYIKARATPKVVAAFAERREFDKILIYSKQVGYTPDYLFLLQTILRTDPQGAVNFALMMSQMEGGCPLDYNTITDLFLQRNMIREATAFLLDVLKPNLEEHAFLQTKVLEINLVTYPNVADAILANGMFSHYDRPRIAQLCEKAGLYLRALQHYAELPDIKRVIVNTHAIEPQALVEFFGTLSKEWALECMKDLLLVNLRGNLQIVVQAAKEYSEQLGVDGCIKLFEQFKSYEGLYFFLGSYLSSSEDPDIHFKYIESAARTGQIKEVERVTRESNFYDAEKTKNFLMEAKLPDARPLINVCDRFGFVPDLTHYLYTNNMLRYIEGYVQKVNPGNAPLVVGQLLDDECPEDFIKGLILSVRSLLPVEPLVDECEKRNRLRLLTQFLEHLVSEGSQDVHVHNALGKIIIDSNNNPEHFLTTNPFYDSRVVGKYCEKRDPTLAVVAYRRGQCDDELISVTNKNSLFKLQARYVVERMDGDLWDKVLLPENEYRRQFIDQVVSTALPESKSPEQVSAAVKAFMEADLPHELIELLEKIVLQNSAFSGNFNLQNLLILTAIKADPSRVMDYVNRLDNFDGPAVGEVAVEAQLYEEAFAIFKKFNLNVQAVDVLLDNIRSIERAEEFAFRVEEDAVWSQVAKAQLREGLVSEAIESFIRADDATHFLDVIRAAEEADVYHDLVKYLLMVRQKAREPKVDGELIFAYAKIDRLSDIEEFILMPNVANLQNVGDRLYDEELYEAAKIIYAFISNWAKLAVTLVKLKQFQGAVDAARKANSAKTWKEVCFACVDAEEFRLAQICGLNIIIQVDDLEEVSEYYQNRGCFNELISLMESGLGLERAHMGIFTELGVLYARYRPEKLMEHIKLFSTRLNIPKLIRACDEQQHWKELTYLYIQYDEFDNAATTIMNHSPDAWDHMQFKDVAVKVANVEIYYKAVHFYLQEHPDLINDLLNVLALRLDHTRVVDIMRKAGQLHLVKPYMVAVQSNNVSAVNEALNELYVEEEDYERLRESVDMHDNFDQIGLAQKLEKHELLEMRRIAAYIYKKAGRWKQSIALSKKDNMYKDCMETCSQSGDRELSEDLLVYFIEQGKKECFASCLFICYDLIRADVALELAWTNNMLDFAFPYLLQFIREYTSKVDDLVKDRIESQKEEKAKEQEEKDVVAQQNMYAQLLPLALPAPPGMGGPPPMGGMGMPPMGGMGMPPMGGMGMPPMGPGPMPAYGMPPMGNY

SEQ ID NO: 9654 - protein, 1411 aa, Chelidonium majus
MTWKQLQQFTETELVQILYFLTTEATSVGGFYAVNRRGQVLLATVNEATIVPFVSGQLNNLELAVNLAKRGNLPGAENLVVQRFQELFSQTKYKEAAELAAESPQGILRTPDTVAKFQSVPVQAGQTPPLLQYFGTLLTRGKLNAFESLELSRLVVNQNKKNLLENWLAEDKLECSEELGDLVKTVDNDLALKIYIKARATPKVVAAFAERREFDKILIYSKQVGYSPDYLFLLQTILRSDPQGAVNFALMMSQMEGGCPVDYNTITDLFLQRNMIREATAFLLDVLKPNLPEHAHLQTKVLEINLVTFPNVADAILANGMFSHYDRPRIAQLCEKAGLYVRALQHYAELPDIKRVIVNTHAIEPQSLVEFFGTLSKEWALECMKDLLLVNLRGNLQIIVQTAKEYSEQLGVEACIKLFEQFKSYEGLYFFLGSYLSSSEDPDIHFKYIEAAAKTGQIKEVERVTRESNFYDAEKTKNFLMEAKLPDARPLINVCDRFGFVPDLTHYLYTNNMLRYIEGYVQKVNPGNAPLVVGQLLDDECPEDFIKGLILSVRSLLPVEPLVDECEKRNRLRLLTQFLEHLVSEGSQDVHVHNALGKIIIDSNNNPEHFLTTNPYYDSRVVGKYCEKRDPTLAVVAYRRGQCDDELVNVTNKNSLFKLQARYVVERMDSDLWEKVLNPENEYRRQLIDQVVSTALPESKSPEQVSATVKAFMTADLPHELIELLEKIVLQNSAFSGNFNLQNLLILTAIKADASRVMDYIGRLDNFDGPAVGEVAVEAQLFEEAFAIFKKFNLNVQAVNVLLDNIQSIERAVEFAFRVEEDAVWSQVAKAQLREGQVSEAIESFIRADDASQFLDVIRAAGDANVYHDLVRYLLMVRQKSKEPKVDSELIYAYAKIDRLGDIEEFILMPNVANLPNVGDRLFDEALYEAAKIIFAFISNWAKLACTLVKLGQFQGAVDAARKANSSKTWKEVCFACVDAEEFRLAQICGLNIIVQVDDLADVSNYYQNRGCFNELISLMESGLGLERAHMGIFTELGVLYARYRPEKLMEHIKLFSTRLNIPQLIRACDEQQHWKELTYLYIQYDEFDNAATTIMNHSPEAWDHMQFKDVAVKVASVELYYKAVHFYLQEHPDLINDLLNVLALRVDHTRVVDIMRKAGHLRLVKPYMVAVQSNNVSAVNEALNEIYVEEEDYDRLRESIDMHDNFDQIGLAQKIEKHELLEMRRVAAYIYKKAGRWKQSIALSKKDNHYKDAMETCSQSGERELAEELLVYFIEQGKKECFTSCLFVCYDVIRPDVALELAWMNNMLDFAFPYLLQFIREYTGKVDELVKDRIEAQSEVKAKEKEEKDMVAQQNMYAQLLPLALPAPPMPGMGGSMGGGMAGGYGPPPPMGGMGMPPMPPFGMPQMGSY

SEQ ID NO: 9655 - protein, 1743 aa, Musa acuminata
MASANAPIAMREVLTLPSLGINPQFVTFTHVTMESDKYICVRETAPQNSLVIIDMSMPMQPLRRPITADSALMNPNAKILALKAQLQGSTQDHLQIFNIDQKTKIKSHQMPEQHLQVVFWKWINPKMLGIVTQTSVYHWSIEGEGEPVKMFDRAANLTNNQIINYRCDPSEKWLVLIGIAPGAPERPQLVKGHMQLFSVEQQRSQALEAHAASFASFKAAGKENPSTLVCFASKTTNAGQIASKLHVIELGAQPGKPGFTKKQADLFFPPDFADDFPVAMQISQKYSLIYVITKLGLLFVYDLETATAVYRNRISPDPIFLTSEASTVGGFYAINRRGQVLLATVNEATIVPFVSGQLNNLELAVSLAKRGNLPGAENLVVQRFHELFSQTKYKEAAELAAESPKGILRTPETVAKFQSVPVQSGQTPPLLQYFGTLLTRGKLNAFESLELSRLVVNQNKKNLLENWLAEDKLECSEELGDLVKTVDNDLALKIYIKARCTPKVVAAFAERREFDKILIYSKQVGYTPDYLFLLQTILRSDPQGAVNFALMMSQMEGGCPVDYNTITDLFLQRNMIREATAFLLDVLKPNLPEHAFLQTKVLEINLVTYPNVADAILANGMFSHYDRPRIAQLCEKAGLYIRALQHYTELPDIKRVIVNTHAIEPQALVEFFGTLSSEWALECMKDLLLVNLRGNLQIIVQTAKEYSEQLGVDACIQLFEQFKSYEGLYFFLGSYLSSSEDPDIHFKYIEAAAKTGQIKEVERVTRESNFYDPEKTKNFLMEAKLPDARPLINVCDRFGFVPDLTHFLYTNNMLRYIEGYVQKVNPGNAPMVVGQLLDDECPEDFIKGLILSVRSLLPVEPLVAECEKRNRLRLLTQFLEHLVSEGSQDVHVHNALGMIIIDSNNNPEHFLTTNPYYDSRVVGKYCEKRDPTLAVVAYRRGQCDDELINVTNKNSLFKLQARYVVERMDADLWEKVLVPENDYRRQLIDQVVSTALPESKSPEQVSAAVKAFMTADLPHELIELLEKIVLQNSAFSGNFNLQNLLILTAIKADPSRVMDYVNRLDNFDGPAVGEVAVEAQLYEEAFAIFKKFNLNVQAVNVLLDNIQSIERAVEFAFRVEEDDVWSQVAKAQLREGLVSDAVESFIRADDATQFLDVIRAAEDANIYHDLVKYLLMVRQKIKEPKVDSELIYAYAKIDRLGEIEEFILMPNVANLQNVGDRLFDDALYEAAKIIFTFISNWAKLASTLVKLRQFQGAVDAARKANSSKTWKEVCFACVDAEEFRLAQICGLNIIIQVDDLEEVSDYYQNRGCFNELISLMESGLGLERVHMGIFTELGVLYARYRPDKLMEHIKLFSTQLNIPKLIRVCDEQQHWKELTYLYIQYDEFDNAATTIMNHSPDAWDHMQFKDVVVKVANVELYYKAVHFYLQEHPDLINDLLHVLALRVDHTRVVDIMRKAGHLHLVKPYMVAVQSNNVAAVNEALNKIYVEEEDYDRLRESVDMHDNFDQIGLAQRIEKHELLEMRRIAAYIYKKAGRWKQSIALSKKDNLYKDAMETCSQSGDRELSEELLVYFIEQGKKECFASCLFICYDLIRPDVAVELAWTNNMLDFAFPYLLQFIREYTSKVDELIKDKIEAQNEVKVKENEEKDLVAQQACWTHSFLTILFFLFFQVSFCCLTMTLISFCRICMLSCYPWRCQLHQCLVWEVQAWVDLFHLRHPWLVWGCPRCRHLECLLWQRTEMI

SEQ ID NO: 9656 - protein, 1732 aa, Glycine max
STFFVFLFFDLRFGVLLQLGSVGINQQFITFTHVTMESDKYICVRETGPQNSVVIIDMSMPMQPLRRPITADSALMNPNSRILALKVNDLDNCSLCKYVFCMSHEYEVLYAAQVPGTTQDHLQVFNIETKAKMNSHQMKEQVVFWKWITPNTLGIVTQMSVYHWSVEGNGEPMKMFDRTANLANNQIISYRCDPNEKWLVLIGIAPGSAERPQLVKGNMQLFSVDQQRSQALEAHAASFASFRVAGNDKDSTLICFASKSMNAGQVTSKMHVIELGAQPGKPSFTKKQADLFFPPDFADDFPVSMQISNKYGLIYVITKLGLLFVYDLETSTAVYRNRISPDPIFLTTEAPSVGGFYAINRRGQVLLATINEAAIVPFVSGQLNNLELAVNLAKRGNLPGAEELVVKRFQELFAQTKYKEAAELAAESPQGILRTPDTVAKFQSVPVQAGQTPPLLQYFGTLLTRGKLNSYESLELSRLVVNQNKKNLLENWLAEDKLECSEELGDLVKTVDNDLALKIFIKARATPKVVAAFAERREFDKILIYSKQVGYTPDYMFLLQTILRADAQGAVNFALMMSQMEGGCPVDYNTITDLFLQRNLIREATAFLLDVLKPNLPEHGYLQTKVLEINLVTFPNVADAILANGMFSHYDRPRIAQLCEKAGLFIRALQHYSELPDIKRVIVNTHAIEPQALVEFFGTLSKEWALECMKDLLLVNLRGNLQIIVQTAKEYCEQLGVDACIKLFEQFKSYEGLYFFLGAYLSSSEDPDIHFKYIEAAAKTGQIKEVERVTRESNFYDAEKTKNFLMETKLPDARPLINVCDRFGFVPDLTHYLYTSNMLRYIEGYVQKVNPGNAPLVVGQLLDDECPEDFIKGLILSVRSLLPVEPLVEECEKRNRLRLLTQFLEHLVSEGSQDVHVHNALGKIIIDSNNNPEHFLTTNPYYDSRVVGKYCEKRDPTLAVVAYRRGQCDDELVNVTNKNSLFKLQARYVVERMDADLWEKVLNPENEFRRQLIDQVVSTALPESQSPDQVSAAVKAFMTADLPHELIELLEKIVLQNSAFSGNFNLQNLLILTAIKADPSRVMDYINRLDNFDGPAVGEVAVEANLYEEAFAIFKKFNLNVQAVNVLLDNLRTIDRAVEFAFRVEEEAVWSQVAKAQLREGLVSDAIESFIRADDSTHFLEVIKASEDAEVYHDLVRYLLMVRQNTKEPKVDSELIYAYAKIDQLGEIEEFILMPNVANLPNVGDRLYDEALYEAAKIIFAFISNWAKLAVTLVKLKQFQGAVDAARKANSSKTWKEVCFACVDAEEFRLAQICGLNVIIQVDDLEEVSEFYQNRGCFNELISLMESGLGLERAHMGIFTELGVLYARYRPEKLMEHIKLFSTRLNIPKLIRACDEQQHWMELTYLYIQYDEFDNAATTVMNHSPEAWDHMQFKDIIVKVASVELYYKAVHFYLQEHPDIINDLLNVLALRVDHTRVVDIMRKAGHIRLVKPYLVAVQSNNVSAVNEALNEIYVEEEDYDRLHESIDLHDNFDQIGLAQKIEKHELLEMRRVAAYIYKKAGRWKQSIALSKKDNLYKDCMETCSQSGDRELSEDLLVYFIEQEKKECFASCLFVCYDIIRPDVALELAWMNNMIDFAFPYLLQFIREYTGKVDELIKDKIEAQKVEKAKEKEEKEVLAQQNMYAQLLPLALPAPPSMGGGGYAPPTPPIGGMGMPPMPPFGMPPMGGGSGSY

SEQ ID NO: 9657 - protein, 330 aa, Papaver somniferum
MAAASAPIAMKETLTLPSIGINPQHITFTHVTMESDKYICVRETSPQNSVVIIDMSMPNQPLRRPITADSALMNPNSRILALKAQLPGTTQDHLQIFNIEMKAKMKSHQMPEQIVFWKWITPKMLGLVTQTSVYHWAIEGESQPVKMFERTANLANNQIINYRSDPSEKWLVLIGIAPGSPERPQLVKGNMQLYSVDQQRSQALEAHAASFATFKVPGNETPSTLISFASKTTNAGQVTSKLHVIELGAQPGKPAFTKKQADLFFPPDFADDFPVAMQISHKYGLIYVITKLDFYLFMIWRQLPRFIETELVQILYFDGRSYISRRVLCC

SEQ ID NO: 9658 - protein, 1630 aa, Musa acuminata
LWGYAAQIQGTMQDHLQIFNIEQKTKIKSHQMPEQVVFWKWINPKMLGLVTQASVYHWSIEGDSEPVKVFDRAANLTNNQIINYRCDPSEKWLVLIGIAPGAPERPQLVKGNMQLFSVEQQRSQALEAHAASFATFKVVGKENPSTLICFASKTTNAGQITSKLHVIELGAQPGKPGFTKKQADLFFPPDFADDFPVAMQISHKYSLIYVITKLGLLFVYDLETATAVYRNRISPDPIFLTAEASTIGGFYAINRRGQVLLAAVNEATIVPFVSSQLNNLELAVSLAKRGNLPGAENLVVQRFQELFSQTKYKEAAELAAESPQDILRTPETVAKFQSVPVQAGQTPPLLQYFGTLLTRGKLNAFESLELSRLVVNQNKKNLLENWLAEDKLECSEELGDLVKTVDNDLALKIYIKARATPKVVAAFAERREFDKILIYSKQVGYVPDYLFLLQTILRSDPQGAVNFALMMSQMEGGCPVDYNTITDIFLQRNMIREATAFLLDVLKPNLPEHAFLQTKVLEINLVTYPNVADAILANGMFTHYDRPQIAQLCEKAGLYMRALQHYTELIDIKRVIVNTHAIEPQALVEFFGTLSREWALECMKDLLLVNLRANLQIIVQTAKEYSEQLGVDACIKLFEQFKSYEGLYFFLGSYLSSSEDPDIHFKYIEAAAKTGQIKEVERVTRESNFYNPEKTKNFLMEAKLPDARPLINVCDRFGFVPDLTHFLYTNNMLRYIEGYVQKVNPGNAPLVVGQLLDDECPEDFIKGLILSVRSLLPVESLVVECEKRNRLRLLTQFLEHLVSEGSQDAHVHNALGMIIIDSNNNPEHFLTTNPYYDSRVVGKYCEKRDPTLAVVAYRRGQCDDELINVTNKNSLFKLQARYVVERMDADLWEKVLVPENEYRRQFIDQVVSTALPESKNPEQVSAAVKAFMTADLPHELIELLEKIVLQNSAFSGNFNLQNLLILTSIKADPSRVMDYINRLDNFDGPAVGEVAIEAQLFEEAFAIFKKFNLNVQAVNVLLDNIQSIERAVEFAFHVEEDSVWSQVGKAQLREGLVSEAIESFIRADDATQFLDVIRAAEDSNIYHDLVKYLLMVRQTVKEPKVDSELIYAYAKIDRLGEIEEFILMPNVANLQNVGDRLFDDALYEAAKIIFTFISNWAKLASTLVKLRQFQGAVDAARKANSSKTWKEVCFACVDAEEFRLAQICGLNIIIQVDDLEEVSDYYQNRGCFNELISLMESGLGLERAHMGIFTELGVLYARYRPEKLMEHIKLFSTRLNIPKLIRVCDEQQHWQELTYLYIQYDEFDNAATTIMNHSPDAWDHMQFKDVVIKVANVELYYKAVHFYLQEHPDLINDLLHVLALRVDHTRVVDIMRKAGHLHLVKPYMVAVQSNNVAAVNEALNEIYVEEEDYDRLRESVDTHDNFDQIGLAQRIEKHELLEMRRIAAYIYKKAGRWKQSIALSKKDNLYKDAMETCSQSGDRELSEELLVYFIEKGKKECFSSCLFICYDLIRPDVALELAWMNNMLDFAFPYLLQFIREYTSKVDELIKDKIEAQNEVKVKEKEEKDLVTQQACLNMYAQLLPLALPAPPIPGVGATGMGGPYPAPPPMAGMGMPPVPPFGMPPMGTY

SEQ ID NO: 9659 - protein, 1618 aa, Lotus japonicus
MAAAANAPIAMKEVLTLPTLGINTQFINFTHVTMESDKYICVRETAPQSSVVIVDMSMPNQPLRRPITADSALMNPNSRILALKAQLQGTTQDHLQIFNIELKAKMKSYQMPEQVVFWKWISPKTLGLVTLTSVYHWSIEGDSEPIKMFERTANLANNQIINYRSDPTEKWLVLIGIAPGSPERPQLVKGNMQLFSVDQQRSQALEAHAASFAQYKVPGNENPSTLISFSTKTLNAGQIVSKLHVIELGAQPGKPSFTKKQADLFFPPDFADDFPVAMQISHKYSLIYVITKLGLLFVYDLETATAVYRNRISPDPIFLTSEATTVGGFYAINRRGQVLLATVNEQTIVNFVSGQLNNLELAVSLAKRGNLPGAEKLVVERFHELFAQTKYKEAAELAAESPQGILRTPDTVAKFQSVPVQSGQTPPLLQYFGTLLTRGKLNAFESLELSRLVVNQNKKNLLENWLAEDKLECSEELGDLVKTVDNDLALKIYIKARATPKVVAAFAERREFDKILIYSKQVGYTPDYLFLLQTILRTDPQGAVNFALMMSQMEGGSPVDYNTITDLFLQRNLIREATAFLLDVLKPNLPEHGFLQTKVLEINLVTFPNVADAILANGMFSHYDRPRIAQLCEKAGLYVRALQHYTELPDIKRVIVNTHAIEPQSLVEFFGTLSQEWALECMKDLLLANLRGNLQIIVQVAKEYCEQLGVDACIKLFEQFRSYEGLYFFLGSYLSSSEDPDIHFKYIEAAAKTGQIKEVERVTRESNFYDAEKAKNFLMEAKLPDARPLINVCDRFGFVPDLTHYLYTNNMLRYIEGYVQKVNPGNAPLVVGQLLDDECPEDFIKGLILSVRSLLPVEPLVEECEKRNRLRLLTQFLEHLVSEGSQDVHVHNALGKIIIESNNNPEHFLTTNPYYDSRVVGKYCEKRDPTLAVVAYRRGQCDDELINVTSKNSLFKLQARYVVERMDGDLWAKVLTPDNEYRRQLIDQVVSTALPESSSPEQVSAAVKAFMTADLPHELIELLEKIVLQNSAFSGNFNLQNLLILTAIKADPSRVMDYINRLDNFDGPAVGEMAVEGQLYEEAFAIFKKFNLNVQAVDVLLENIHSIDRAVEFAFRVEEDAVWSQVAKAQLREGLVSDAIESFIRAEDATQFLDVISAAGNANVYHDLVKYLLMVRQKAKEPKVDSELIYAYAKIDRLSDIEEFILMPNVANLQNVGDRLYDEALYEAAKIIFAFISNWAKLAITLVKLKQFQGAVDAARKANSSKTWKEVCFACVDEEEFRLAQICGLNIIIQVDDLEEVSEYYQNRGHFNELISLMESGLGLERAHMGIFTELGVLFARYRPEKLMEHIKLFSTRLNIPKLIRACDEQQHWTELTYLYIQYDEFDNAATTIMNHSPEAWDHMQFKDVIVKVGNVELYYKAVHFYLEEHPDLINDVLNVLALRVDHARVVDIMRKAGHLRLVKPYMVAVQSNNVSAVNEALNEIYVEEEDYDRLRESIDLHDNFDQIGLAQKIEKHELLEMRRVAAYIYKKAGRWKQSIALSKKDNLYKDAMETASQSGERELAEELLVYFIDQGKKECFASCLFVCYDLIRADIALELAWMHNMIDFAFPYLLQVC

SEQ ID NO: 9660 - protein, 691 aa, Catharanthus roseus
MNLLSFLRRLCLQNSAFSGNFNLQNLLILTAIKADPTRVMDYVNRLDNFDGPAVGEVAVEAQLYEEAFAIFKKFNLNVQAVNVLLDNIRDINRAVEFAFRVEEDAVWSQVAKAQLREGLVSDAIESFIRADDATEFLEVIKAAEDAEVYHDLVKYLLMVRQKTKEPKVDSEIIYAYAKIDRLGDIEEFILMPNVANLPNVGDRLYDEALYEAAKIIFAFTSNWAKLAVTLVKLKQFQGAVDAARKANSSKTWKEVCFACVDAEEFRLAQICGLNIIVQVDDLEEVSEYYQNRGCFNELISLMESGLGLERAHMGIFTELGVLYARYRHEKLMEHIKLFSTRLNIPKLIRACDEQQHWKELTYLYIQYDEFDNAATTVMNHSPDAWDHMQFKDIIVKVANVELYYKAVHFYLQEHPDLINDVLNVLALRVDHTRVVDIMRKAGHLRLVKPYMVAVQSNNVSAVNEALNEIYVEEEDYDRLRESIDLHDNFDQIGLAQKIEKHELLEMRRVAAYIYKKAGRWKQSIALSKKDNLYKDAMETASQSGDRELAEELLVYFIEQGKKECFASCLFVCYDLIRADVALELAWMNNMIDFAFPYLLQFIREYTGKVDELIKDKIEALKEVKAKENEEKDVIKQQNMYAQLLPLALPAPPMPGMGGGMGGGFVPPPPPPMGGMGMPPMSQFGMPPMGSY

SEQ ID NO: 9661 - protein, 1155 aa, Gossypium hirsutum
MMSQMEGGCPVDYNTITDLFLQRNLIREATAFLLDVLKPNLPEHAFLQTKVLEINLVTFPNVADAILANGMFSHYDRPRIAQLCEKAGLYVRALQHYTELPDIKRVIVNTHAIEPQSLVEFFGTLSREWALECMKDLLLVNLRGNLQIIVQVAKEYCEQLGVDACIKLFEQFKSYEGLYFFLGSYLSSSEDPDIHFKYIEAAAKTGQIKEVERVTRESNFYDAEKTKNFLMEAKLPDARPLINVCDRFGFVPDLTHYLYTNNMLRYIEGYVQKVNPGNAPLVVGQLLDDECPEDFIKGLILSVRSLLPVEPLVEECEKRNRLRLLTQFLEHLVSEGSQDTHVHNALGKIIIDSNNNPEHFLTTNPYYDSRVVGKYCEKRDPTLAVVAYRRGQCDDQLINVTNKNSLFKLQARYVVERMDGDLWEKVLNPENEYRRQLIDQVVSTALPESKSPEQVSAAVKAFMTADLPHELIELLEKIVLQNSAFSGNFNLQNLLILTAIKADPSRVMDYINRLDNFDGPAVGEVAVEAQLYEEAFAIFKKFNLNVQAVNVLLDNIRSIDRAVEFAFRVEEDAVWSQVAKAQLREGLVSDAIESFIRADDATQFLDVIRASEDADVYPDLVRYLLMVRQKVKEPKVDGELIYAYAKTDRLGEIEEFILMPNVANLQNVGDRLFDEALYEAAKIIFAFISNWAKLAVTLVRLKQFQGAVDAARKANSAKTWKEVCFACVDAEEFRLAQICGLNIIIQVDDLEEVSEYYQNRGCFNELISLMESGLGLERVHMGIFTELGVLYARYRYEKLMEHIKLFSTRLNIPKLIRACDEQQHWKELTYLYIQYDEFDNAATTVMNHSPEAWDHMQFKDIIVKVASVELYYKAVHFYLQEHPDLINDMLNVLALRVDHTRVVDIMRKAGHLRLVKPYMVAVQSNNVSAVNEALNEIYVEEEDYDRLRESIDLHDNFDQIGLALKIEKHELLEMRRVAAYIYKKAGRWKQSIALSKKDNHYRDAMETASQSGERELAEELLVYFIEQGKKECFASCLFVCYDLVRPDVALELAWINNMIDFAFPYLLQFIREYTGKVDELIKDKIEAQKEVKAKEQEEKDVIAQQNMYAQLLPLALPAPPMPGMGGFAPSPPPPPMGGMGMPPMPAFGMPPMGSY

SEQ ID NO: 9662 - protein, 543 aa, Sequoia sempervirens
MMSQMEGGCPVDYNVITDLFLQRNMIREATSFLLDVLKPNLPEHAHLQTKVLEINLVTFPNVADAILANGIFSHYDRPRIAQLCEKAGLYMRALQHYTELPDIKRVIVNTHAIEPQALVEFFGTLSREWALECMKDLLLVNLRGNLQIIVQAAKEYSEQLGADSCIKLFEQFKSYEGLYFFLGAYLSSSEDPDIHFKYIEAAAKTGQIKEVERVTRESNFYDAEKTKNFLMEARLPDARPLINVCDRFGFVPDLTHYLYSNNMLRYIEGYVQKVNPSNAPLVVGQLLDDDCPEDFIKGLILSVRSLLPVEPLVEECEKRNRLRLLTQFLEHLVSEGSQDVHVHNALGKIIIDTNNNPEHFLTTNPYYDSRVVGKYCEKRDPTLAVVAYRRGQCDEELINVTNKNSLFKLQARYVVERMEPDLWEKVLNPDNPFRRQLIDQVVSTALPESKNPDQVSATVKAFMTADLPHELIELLEKIVLQNSAFSGNPNLQNLLILTAIKADKSRVMDYINRLDNFDGPAVGEIAVGAELYEEAFAIFKSLI

SEQ ID NO: 9663 - protein, 310 aa, Fagus grandifolia
LGLVTQTSVYHWSIEGDSEPLKMFDRTANLANNQIINYRCDPSEKWLVLIGIAPGAPERPQLVKGNMQLFSIDQQRSQALEAHAASFAQFKVPGNENPSVLISFATKTLNAGQITSKLHIIELGAQPGKPSFTKKQADLFFPPDFADDFPVAMQISQKYNLIYVITKLGLLFVYDMETATAVYRNRISPDPIFLTAEASSLGGFYAVNRRGQVLLATVNEQTIVPFVSGQLNNLELAVNLAKRGNLPGAEQLVVNVSKNCLPKRSTKKLRSLLLSLHKESSVHLTQLQNFRVFLFKLGKHHLCCSILGHY

SEQ ID NO: 9664 - protein, 1559 aa, Vitis vinifera
MFERTANLVNNQIINYRCDPSEKWLVLIGIAPGSPERPQLVKGNMQLFSVDQQRSQALEAHAASFASFKVLGNENPSTLICFASKTTNAGQITSKLHVIELGAQPGKPGFTKKQADLFFPPDFADDFPVSMQVSQKYGLIYVITKLGLLFVYDLETASAVYRNRISPDPIFLTAEASSIGGFYAINRRGQVLLATVNEATIVPFVSGQLNNLELAVNLAKRGNLPGAENLVVQRFQELFAQTKYKEAAELAAESPQGLLRTPDTVAKFQSVPVQSGQTPPLLQYFGTLLTRGKLNAFESLELSRLVVNQNKKNLLENWLAEDKLECSEELGDLVKTVDNDLALKIYIKARATPKVVAAFAERREFDKILIYSKQVGYTPDYLFLLQTILRSDPQGAVNFALMMSQMEGGCPVDYNTITDLFLQRNLIREATAFLLDVLKPNLPEHGFLQSKVLEINLVTFPNVADAILANGMFSHYDRPRIAQLCEKAGLYVRALQHYTELPDIKRVIVNTHAIEPQALVEFFGTLSREWALECMKDLLLVNLRANLQIIVQTAKEYSEQLGVEACIKLFEQFKSYEGLYFFLGSYLSSSEDPDIHFKYIEAAAKTGQIKEVERVTRESNFYDAEKTKNFLMETKLPDARPLINVCDRFGFVPDLTHYLYTNNMLRYIEGYVQKVNPGNAPLVVGQLLDDECPEDFIKGLILSVRSLLPVEPLVEECEKRNRLRLLTQFLEHLVSEGSQDVHVHNALGKIIIDSNNNPEHFLTTNPYYDSRVVGKYCEKRDPTLAVVAYRRGQCDDELINVTNKNSLFKLQARYVVERMDADLWEKVLSPDNEYRRQLIDQVVSTALPESKSPEQVSAAVKAFMTADLPHELIELLEKIVLQNSAFSGNFNLQNLLILTAIKADPSRVMDYINRLDNFDGPAVGDVAVEAQLYEEAFAIFKKFNLNVQAVNVLLDNIQSIERAVEFAFRVEEDAVWSQVAKAQLKEGLVSDAIESFIRADDATQFLDVIRAAENANVYHDLVRYLLMVRQKTKEPKVDSELIYAYAKIDRLGDIEEFILMPNVANLQNVGDRLYDEALYEAAKIIFAFISNWAKLACTLVKLRQFQGAVDAARKANSSKTWKEVCFACVDAEEFRLAQICGLNIIIQVDDLEEVSDYYQNRGCFNELISLMESGLGLERAHMGIFTELGVLYARYRPEKLMEHIKLFSTRLNIPKLIRACDEQQHWKELTYLYIQYDEFDNAATTIMNHSPEAWDHMQFKDVAVKVANVELYYKAVHFYLQEHPDLINDLLNVLALRVDHTRVVDIMRKAGHLHLVKPYMVAVQSTNVAAVNEALNGIHVEEEDYDRLRESIDMHDNFDQIGLAQKVEKHELLEMRRIAAYIYKKAGRWKQSIALSKKDNLYKDAMETCSQSGDRELAEELLVYFIEQKKKECFASCLFVCYDLIRPDVVLELAWMNNMIDFAFPYLLQFIREYTGKVDDLVKDRIEALKETKAKEEEEKDVVKQQNMYAQLLPLALPAPPMPGMGGAGMGGGFAAPPPMGGMGMPPMPPFGMPPMGSY

SEQ ID NO: 9665 - protein, 1559 aa, Musa acuminata
MFDRAANLTNNQIINYKCDPTEKWLVLIGIAPGVPERPQLVKGNMQLFSVEQQRSQALEAHAASFASFKVVGNEKPSILICFASKTSNAGQISSKLHIIELGAQPGKPGFTKKQADLFFPPDFADDFPVAMQISQKYSLIYVITKLGLLFVYDLDTATAVYRNRISPDPIFLTTEASNVGGFYAVNRRGQVLLATVNEATIVPFVSGQLNNLELAVNLAKRGNLPGAENLVVQRFQELFSQTKYKEAAELAAESPQGILRTPETVAKFQSVPVQAGQTPPLLQYFGTLLTKGKLNAFESLELSRLVVNQNKKNLLENWLAEDKLECSEELGDLVKTVDNDLALKIYIKARATPKVVAAFAERREFDKILIYSNQVGYTPDYLFLLQTILRSDPQAAVNFALMMSQMEGGCPVDYNTITDLFLQRNMIREATRFLLDVLKPNLPEHAFLQTKVLEINLVTYPNVADAILANGMFSHYDRPRIAQLCEKAGLYVRALQHYTELPDIKRVIVNTQAIEPQALVEFFGTLSKEWALECMKDLLLVNLRGNLQIIVQTAKEYSEQLGVDACIKLFEQFKSYEGLYFFLGSYLSSSEDSDIHFKYIEAAAKTGQLKEVERVTRESNFYDPEKTKNFLMEAKLPDARPLINVCDRFGFVPDLTHYLYTNNMLRYIEGYVQKVNPGNAPLVVGQLLDDECPEDFIKGLILSVRSLLPVEPLVAECEKRNRLRLLTQFLEHLVSEGSQDVHVHNALGKIIIDSNNNPEHFLTTNPYYDSRVVGKYCEKRDPTLAVVAYRRGQCDDELINVTNKNSLFKLQARYVVERMDADLWEKVLQPENEYRRQLIDQVVSTALPESKSPEQVSAAVKAFMTADLPHELIELLEKIVLQNSAFSGNFNLQNLLILTAIKADPPRVMDYINRLDNFDGPAVGEVAVEAQLYEEAFAIFKKFNLNVQAVNVLLDNIQSIERAVEFAFRVEEDAVWSQVAKAQLREGLVSDAIESFIRADDETQFHDVIRAAEDANVYHDLVKYLLMVRQKVKEPKVDGELIFAYAKIDRLGEIEEFILMPNVANLQNVGDRLFDDALYEAAKIIFAFISNWAKLACTLVKLKQFQGAVDAARKANSSKTWKEVCFACVDAEEFRLAQICGLNIIIQVDDLEEVSDYYQNRGCFNELISLMESGLGLERAHMGIFTELGVLYARYRPEKLMEHIKLFSTRLNIPKLIRVCDEQHHWKELTYLYIQYDEFDNAATTIMNHSPDAWDHMQFKDVIVKVANVELYYKAVHFYLQEHPDLINDVLHVLALRVDHTRVVDIMRKAGYLHIVKPYMVAVQSNNVAAVNEALNEIYVEEEDYDRLRESVDLHDNFDQIGLAQRIEKHELLEMRRIAAYIYKKAGRWKQSIALSKKDNLYKDAMETCSQSGDRELSEELLVYFIEQGKKECFASCLFICYDLIRPDVALELAWMNNMIDFAFPYLLQFIREYTSKVDDLVKDKIEAQNEVKSKEKEEKDLVAQQNMYAQLLPLALPAPPMPGMGAPSMGGSYPVPPPMPGMGMPPMPPFGMPPMGSY

SEQ ID NO: 9666 - protein, 1704 aa, Ceratodon purpureus
MAAANAPIAMKEALTLTSLGINQQFVTFTHVTMESDKFICVRETSPQNSVVIIDMSMPNQPLRRPITADSALMNPTSRVLALKALIPGTTQDHLQIFNIELKAKMKSYQMPEQVVFWKWITPKLLGLVTQTSVYHWSIEGETEPVKMFDRTANLTGNQIINYRCDPSEKWLVLIGIAPGAPERPQLVKGNMQLFSVDQQRSQALEAHAASFASFKVPGNDSPSLLIAFSTKTITAGQLTSKLHVIELGAQPGRPGFAKKAADLFFPPDFADDFPVAMQISSKYNLIYVITKLGLLFVYDLETATAVYRNRISPDPIFLTADAPTVGGFYAVNRRGQVLLATVNEATIVPFVSNQLNNLELAVNLARRGNLPGAEGLVVQRFHELFSQMKYKEAADLAAESPQGILRTPDTVAKFQSVPVQPGQTSPLLQYFGTLLTKGKLNLFESLELSRLVVNQNKKNLLENWLAEDKLECSEELGDLVKTVDNDMALKIYIKARATPKVVAAFAERGEFDKILIYSKQVGYTPDYLFLLQTILRSDPQAAVNFALMMSQLEGGCPVDYNVITDLFLQRNMIREATAFLLDVLKPNLPEHALLQTKVLEINLVTFPNVADAILANGMFSHYDRPRIAQLCEKAGLYMRALQHYTELNDIKRVVVNTHAIEPQSLVEFFGTLSKEWALDCMKELLQVNMRGNLQIIVQVAKEYGEQLGVDQCVKLFESFKSYEGLYFFLGAFLSTSEDPEIHYKYIEAAAKTGQIKEVERVTRESNFYPPERTKNFLMEAKLPDARPLINVCDRHGYVPDLTHYLYVNNMLRYIEGYVQKVNPQNAPLVVGQLLDDDCPEDFIKGLILSVRSLLPVEPLVDECEKRNRLRLLTQFLEHLVSEGSQDVHVHNALGKIIIDTNNNPEHFLTTNPYYDSKVVGKYCEKRDPTLAVVAYRRGLCDDELVNVTNKNSLFKLQARYVVERMEPDLWLKVLDPENPCRRQLIDQVVSTALPESKNPEQVSATVKAFMTADLPHELIELLEKIVLQNSAFSGNPNLQNLLILTAIKADTSRVMDYIHRLDNFDGPAVGEIAVGAELYEEAFAIFKKFDLNVQAVNVLLDNMRSIDRAVEFAARVEEDEVWSQVGKAQLREGLVSDAIESFIKANDASQYNEVIDVASGVRAYEDLVRYLNMVRKKVKEAKVDSELIFAYAKLNRLDDIEEFIVTPNLANLQTVGDRLFDEELYEAAKIIFTHISNWARLASTLVKLHQFQAAVDAARKANSARTWKEVCFACVDAEEFRLAQICGLNVIVQVDDLEEVSEYYQNRGRFDELISLMESGLGLERAHMGIFTELGTLYAKYRPEKLMEHLKLFVTRINIPRLIRVCDEQQHWKELTYLYVQYDEFDNAAATMMSHSPEAWDHMQFKDVAVKVANVELYYKAAHFYLQEHPELINDFLNVLAARVDHTRVVDIMKKAGQLPLVKPYMVAVQSANNAAVNEALNGLYIEDEDYDRLRESIDMYDNFDQISMAQRIEKHELLEMRRVAAYIYKRAGRWKQSVALSKKDNLYKDAMETCSQSGDRDLAEELLTFFVDKGKKECFAACLYTCYDLIRADVAVELAWMHGMMDFVVPYMLQFMREYTTKVDDLVKDKIEATEEKRSKESEDKDVVAQQNMYAQLLPLALPAPPVAGMGSMPGMGGMPAMGAGMPYGGMPGGYGMPSMSTF

SEQ ID NO: 9667 - protein, 1712 aa, Physcomitrella patens
MAAASAPITMKEALTLTSLGINQQFVTFTHVTMESDKYICVRETSPQNSVVIIDMSMPNQPLRRPITADSALMNPSSRVLALKALIPGSTQDHLQIFNIELKAKMKSYQMPEQVVFWKWITPRLLGLVTQTSVYHWTIEGESEPVKMFERTANLSGNQIINYRCDPSEKWLVLIGIAPGAPERPQLVKGNMQLFSVDQQRSQALEAHAASFASHQVAGNDSPSLLIAFTTKTISAGQLTSKLHIIELGATSGRPGFSKKAADLFFPPDFADDFPVSMQISAKYGLIYVITKLGLLFVYDLETATAVYRNRISPDPIFLTADAPTVGGFYAVNRRGQVLLATVNEATIIPFVSNQLSNLELAVNLARRGNLPGAEGLVVQRFQELFSQMKYKEAADLAAESPQGILRTPDTVAKFQSVPVQPGQTSPLLQYFGTLLTKGKLNVFESLELSRLVVNQNKKNLLENWLAEDKLECSEELGDLVKTVDNDMALKIYIKARATPKVVAAFAERREFDKILIYSKQVGYTPDYLFLLQTILRADPQGAVNFALMMSQLEGGCPVDYNTITDLFLQRNMIREATAFLLDVLKPNLPEHALLQTKVLEINLVTFPNVADAILANGMFSHYDRPRVAQLCEKAGLYMRALQHYTELNDIKRVVINTHAIEPQGLVEFFGTLSKEWALDCMKELLQVNMRGNLQIIVQVAKEYGEQLGVDACVKLFESFKSFEGLYFFLGAYLSTSEEPEIHYKYIEAAAKTGQIKEVERVTRESNFYPAERTKNFLMESKLPDARPLINVCDRHGFVPDLTHYLYVNNMLRYIEGYVQKVNPQNAPLVVGQLLDDDCPEDFIKGLILSVRSLLPVEPLVDECEKRNRLRLLTQFLEHLVSEGSQDVHVHNALGKIIIDTNNNPEHFLTTNPYYDSKVVGKYCEKRDPTLAVVAYKRGLCDDELVNVTNKNSLFKLQARYVVERMEPDLWLKVLNPENSCRRQLIDQVVSTALPESKNPEQVSATVKAFMTADLPHELIELLEKIVLQNSAFSGNPNLQNLLILTAIKADTTRVMDYINRLDNFDGPAVGEIAVGAELFEEAFAIFKKFNLNVQAVNVLLDNIRNIDRAVEFAARVEEDDVWSQVGKAQLREGLVSDAIESFIKANDASQYNEVIDVASGVRAYDDLVKYLNMVRKKVKEAKVDSELIFAYAKLNRLDDIEEFIVTPNLANLQTVGDRLFDEELYEAAKIIFTHISNWARLASTLVKLHQFQAAVDAARKANSARTWKEVCFACVDAEEFRLAQICGLNVIVQVDDLEEVSEYYQNRGRFDELISLMESGLGLERAHMGIFTELGTLYARYRPDKLMEHLKLFVTRINIPKLIRVCDEQQHWKELTYLYIQYDEYDNAAATMMSHSPEAWEHMQFKDVAVKVANVELYYKAVYFYLEEYPELINDLLNVLAARVDHTRVVDIMRKAGHLPLVKPYMVAVQSANNAAVNEALNNLYIEEEDYERLRESIDMYDNFDQISMAQRIEKHELLEMRRVGAYIYKRAGRWKQSVALSKKDNLYKDAMETCSQSGDRELAEELLTFFVDKGKKECFAACLYTCYDLIRADVAVELAWMHGMMDFAVPYLLQFLREYSSKVDDLIKDKLEATEEKKSKEQQEKDVVAESNMYAQLLPLALPAPPVAGMPGLGGGMPVPGMGGGMPMPGMPGMPGMPGMSGYGMPSMSAF

SEQ ID NO: 9668 - protein, 1706 aa, Physcomitrella patens
MAAASAPITMKEALTLTSLGINQQFVTFTHVTMESDKYICVRETSPQNSVVIIDMSMPNQPLRRPITADSALMNPNSRVLALKALIPGSTQDHLQIFNIELKAKMKSYQMPEQVVFWKWISPRLLGLVTQTSVYHWTIEGESEPVKMFERTANLSGNQIINYRCDPAEKWLVLIGIAPGAPERPQLVKGNMQLFSVDQQRSQALEAHAASFASHQVAGNDSPSLLIAFTTKTLTAGQLTSKLHIIELGATPGKPGFSKKAADLFFPPDFADDFPVSMQISSKYGLIYVITKLGLLFVYDLETATAVYRNRISPDPIFLTADAPTVGGFYAVNRRGQVLLATVNEATIIPFVSNQLSNLELAVNLARRGNLPGAEGLVVQRFQELFSQMKYKEAADLAAESPQGILRTPDTVAKFQSVPVQPGQTSPLLQYFGTLLTKGKLNVFESLELSRLVVNQNKKNLLENWLAEDKLECSEELGDLVKTVDNDMALKIYIKARATPKVVAAFAERREFDKILIYSKQVGYTPDYLFLLQTILRADPQGAVNFALMMSQLEGGCPVDYNTVTDLFLQRNMIREATAFLLDVLKPNLPEHALLQTKVLEINLVTFPNVADAILANGMFSHYDRPRVAQLCEKAGLYMRALQHYTELNDIKRVVINTHAIEPQGLVEFFGTLSKEWALDCMKELLQVNMRGNLQIIVQVAKEYGEQLGVDACVKLFESFKSFEGLYFFLGAYLSTSEEPEIHYKYIEAAAKTGQIKEVERVTRESNFYPPERTKNFLMESKLPDARPLINVCDRHGFVPDLTHYLYVNNMLRYIEGYVQKVNPQNAPLVVGQLLDDDCPEDFIKGLILSVRSLLPVEPLVDECEKRNRLRLLTQFLEHLVSEGSQDVHVHNALGKIIIDTNNNPEHFLTTNPYYDSKVVGKYCEKRDPTLAVVAYKRGNCDDELVNVTNKNSLFKLQARYVVERMEPDLWLKVLNPENPCRRQLIDQVVSTALPESKNPEQVSATVKAFMTADLPHELIELLEKIVLQNSAFSGNPNLQNLLILTAIKADTTRVMDYINRLDNFDGPAVGEIAVGAELYEEAFAIFKKFNLNVQAVNVLLDNIRNIDRAVEFAARVEEDDVWSQVGKAQLREGLVSDAIESFIKANDASQYNEVIDVASGVRAYEDLVRYLNMVRKKVKEAKVDSELIFAYAKLNRLDDIEEFIVNPNLANLQTVGDRLFDGELYEAAKIIFTHISNWARLASTLVKLHQFQAAVDAARKANSARTWKEVCFACVDAEEFRLAQICGLNVIVQVDDLEEVSEYYQNRGRFDELISLMESGLGLERAHMGIFTELGTLYARYRPDKLMEHLKLFITRINIPKLIRVCDEQQHWKELTYLYIAYDEYDNAAATMMSHSPEAWEHMQFKDVAVKVANVELYYKAVYFYLEEYPELINDLLNVLSARVDHTRVVDIMKKAGYLPLVKPYMVAVQSANNAAVNEALNNLYIEEEDYERLRESIDMYDNFDQISMAQRIEKHELLEMRRVGAYIYKRAGRWKQSVALSKKDNLYKDAMETCSQSGDRELAEELLTFFVDKGKKECFAACLYTCYDLIRADVAVELAWMHGMMDFAVPYLLQFLREYSTKVDDLIKDKLEATEEKKSKEQQEKDVVAESNMYAQLLPLALPAPPVAGMTGMPGMGGGMPMPGMSGMPGMPGMSGYGMPSMSAF

SEQ ID NO: 9669 - protein, 1709 aa, Ceratodon purpureus
MAAASAPIAMKEALTLTSLGINQQFVTFTHVTMESDKYICVRETSPQNSVVIVDMAMPNQPLRRPITADSALMNPSSRVLALKALIPGTTQDHLQIFNIELKAKMKSYQMPEQVVFWKWISPRLLGLVTQTSVYHWSIEGESEPMKMFDRTANLSGNQIINYRCDPSEKWLVLIGIAPGAPERPQLVKGNMQLFSVDQQRSQALEAHAASFASHQVAGNDSPSLLIAFSTKSITAGQLTSKLHVIELGAQPGKPGFSKKSADLFFPPDFADDFPVAMQISAKYGLIYVITKLGLLFVYDLESATAVYRNRISPDPIFLTADAPTVGGFYAVNRRGQVLLATVNEATIVPFVSNQLNNLELAVNLARRGNLPGAEGLVVQRFQELFSQMKYKEAADLAAESPQGILRTPDTIAKFQSVPVQPGQTSPLLQYFGTLLTKGKLNAFESLELSRLVVNQNKKNLLENWLAEDKLECSEELGDLVKTVDNDMALKIYIKARATPKVVAAFAERGEFDKILIYSKQVGYTPDYLFLLQSILRADPQGAVNFALMMSQLEGGCPVDYNTITDLFLQRNMIREATAFLLDVLKPNLPEHALLQTKVLEINLVTFPNVADAILANGMFSHYDRPRVAQLCEKAGLYMRALQHYTELNDIKRIVVNTHAIEPQSLVEFFGTLSKEWALDCMKELLQVNMRGNLQIIVQVAKEYAEQLGVDSCVKLFETFKTFEGLYFFLGAYLSSSEDPEIHYKYIEAAAKTGQIKEVERVTRESNFYPPERTKNFLMESKLPDARPLINVCDRHGFVPDLTHYLYVNNMLRYIEGYVQKVNPQNAPAVVGQLLDDDCPEDFIKGLILSVRSLLPVEPLVDECEKRNRLRLLTQFLEHLVSEGSQDVHVHNALGKIIIDTNNNPEHFLTTNPYYDSKVVGKYCEKRDPTLAVVAYRRGLCDDELVEVTNKNSLFKLQARYVVERMEPDLWLKVLDPENPCRRQLIDQVVSTALPESKNPEQVSATVKAFMTADLPHELIELLEKIVLQNSAFSGNPNLQNLLILTAIKADTTRVMDYIHRLDNFDGPAVGEIAVGAELFEEAFAIFKKFDLNVQAVNVLLDNIRNIDRAVEFAARVEEDDVWSQVGKAQLRDGLISDAIESFIKANDATQYNEVIDVASGVRAYEDLVRYLNMVRKKVKEAKVDSELIFAYAKLNRLDDIEEFIVTPNLANLQIVGDRLFDEALYEAAKIIFTHISNWARLASTLVKLQQFQAAVDAARKANSSRTWKEVCFACVDAEEFRLAQICGLNVIVQVDDLEEVSEYYQNRGRFDELISLMESGLGLERAHMGIFTELGTLYARYRSEKLMEHLKLFVTRINIPKLIRVCDEQQHWKELTYLYIAYDEYDNAASTMMSHSPEAWDHMQFKDVAVKVANVELYYKAVYFYLEEYPELINDLLNVLSARVDHTRVVDIMRKAGHLPLVKPYMVAVQSANNAAVNEALNNLYIEEEDYERLRESIDMYDNFDQIAMAQRIEKHELLEMRRVGAYIYKRAGRWKQSVALSKKDNLYKDAMETCSQSGDRELAEELLTFFVDKGKKECFAACLYTCYDLIRADVAVELAWMHGMMDFAVPYLLQFLREYSTKVDDLIKDKLEATEEKKSKEQEEKEVVANSNMYAQLLPLALPAPPVAGMSGLGGGMPDMGGGMPMPGMAGYGGMPNMSGYGMPSMSY

SEQ ID NO: 9670 - protein, 1553 aa, Arnica chamissonis
KIFDRTANLSNNQIINYKCDPSEKWLVLIGIAPGSPERPQLVKGNMQLFSVDQQRSQALEAHAASFASLKVPGNENPSILISFATKSHNAGQVTSKLHVIELGAQPGKPSFTKKQADLFFPPDFADDFPVAMQISNKYGLIYVITKLGLLFVYDLETATAVYRNRISPDPIFLTSEASSVGGFYAVNRRGQVLLATVNEATIVPFVSGQLNNLELAVSLAKRGNLPGAENLVVQRFQELFAQTKYKEAAELAAESPQGILRTPDTVAKFQSVPVQAGQTPPLLQYFGTLLTKGKLNAFESLELSRLVVNQNKKNLLENWLAEDKLECSEELGDLVKTVDNDLALKIYIKARATPKVVAAFAERREFDKILIYSKQVGYSPDYLFLLQTILRTDPQGAVNFALMMSQMEGGCPVDYNTITDLFLQRNLIREATAFLLDVLKPNLPEHAQLQTKVLEINLVTFPNVADAILANGMFSHYDRPRIAQLCEKAGLYVRALQHYSELPDIKRVIVNTHAIEPQSLVEFFGTLSKEWALECMKDLLLVNLRGNLQIIVQVAKEYCEQLGVESCIKLFEQFKSYEGLYFFLGSYLSSSEDPDIHFKYIEAAAKTGQIKEVERVTRESNFYDAEKTKNFLMEAKLPDARPLINVCDRFGFVPDLTHYLYTNNMLRYIEGYVQKVNPGNAPQVVGQLLDDECPEDFIKGLILSVRSLLPVEPLVDECEKRNRLRLLTQFLEHLVSEGSQDVHVHNALGKIIIDSNNNPEHFLTTNPYYDSRVVGKYCEKRDPTLAVVAYRRGQCDDELINVTNKNSLFKLQARYVVERMDGDLWEKALNPENEYRRQLIDQVVSTALPESKSPEQVSAAVKAFMTADLPHELIELLEKIVLQNSAFSGNFNLQNLLILTAIKADPSRVMDYINRLDNFDGPAVGEVAVEAQLYEEAFAIFKKFNLNVQAVDVLLDNIQSIPRAVEFAYRVEEDAVWSQVAKAQLREGLVSDAIESFIRADDATQFLDVIRASEDTECYHDLVKYLLMVRDKIKEPKVDSELIYAYAKIDRLSDIEEFILLPNVANLHNVGDRLFDEALYEAAKIIYAFISNWAKLAVTLVRLQQFQGAVDAARKANSAKTWKEVCFACVDAEEFRLAQICGLNIIVQVDDLEEVSEYYQSRGCFNELISLMESGLGLERAHMGIFTELGVLYARYRHDKLMEHIKLFSTRLNIPKLIRACDEQQHWKELTYLYIQYDEFDNAATTVMNHSPDAWDHMQFKDIAVKVSNVELYYKAVHFYLEEHPDLINDVLNVLALRVDHTRVVDIMRKAGQLPLVKPYMVAVQSNNVSAVNEALNEIYVEEEDYDRLRESIDLHDNFDQIGLAQKIEKHELLEMRRVAAYIYKKAGRWKQSIALSKKDKVYKDAMETASQSGDRELAEELLVYFIEQGKKECFASCLFVCYDLIRPDVALELAWLNNMIDFAFPYLLQFIREYTGKVDELIKDKIEAVKENKAKENEEQDIVKQQNMYAQLLPLALPAPPGMGGGFAPPPPMGGMGMPPMPPFGMPPMGSY

SEQ ID NO: 9671 - protein, 1726 aa, Ceratodon purpureus
MAAANAPITMKEALTLTSLGINQQFVTFTHVTMESDKYICVRETSPQNSVVIIDMSMPNQPLRRPITADSALMNPNSKVLALKALIPGTTQDHLQIFNIELKAKMKSYQMPEQVVFWKWITPRLLGLVTQTSVYHWTIEGDSEPVKMFERTANLSGNQIINYRCDPAEKWLVLIGIAPGAPERPQLVKGNMQLFSVDQQRSQALEAHAASFASHQVAGNDSPSLLIAFSTKTITAGQLTSKLHVIELGAQPGKPGFSKKAADLFFPPDFADDFPVAMQISAKYGLIYVITKLGLLFVYDLETATAVYRNRISPDPIFLTADAPTVGGFYAVNRRGQVLLATVNESTIVPFVSNQLNNLELAVNLARRGNLPGAEGLVVQRFHELFSQMKYKEAADLAAESPQGILRTPDTIAKFQSVPVQPGQTSPLLQYFGTLLTKGKLNVFESLELSRLVVNQNKKNLLENWLAEDKLECSEELGDLVKTVDNDMALKIYIKARATPKVVAAFAERGEFDKILIYSKQVGYTPDYLFLLQSILRADPQGAVNFALMMSQLEGGCPVDYNTITDLFLQRNMIREATAFLLDVLKPNLPEHALLQTKVLEINLVTFPNVADAILANGMFSHYDRPRVAQLCEKAGLYMRALQHYTELNDIKRVVVNTHAIEPQSLVEFFGQLSKEWALDCMKELLQVNMRGNLQIIVQVAKEYAEQLGVDSCVKLFETFKSFEGLYFFLGAYLTSTEEPEIHYKYIEAAAKTGQIKEVERVTRESNFYPPERTKNFLMESKLPDARPLINVCDRHGFVPDLTHYLYVNNMLRYIEGYVQKVNPQNAPLVVGQLLDDDCPEDFIKGLILSVRSLLPVEPLVDECEKRNRLRLLTQFLEHLVSEGSQDVHVHNALGKIIIDTNNNPEHFLTTNPYYDSKVVGKYCEKRDPTLAVVAYRRGLCDEELVNVTNKNSLFKLQARYVVERMEPDLWLKVLDPENPCRRQLIDQVVSTALPESKNPEQVSATVKAFMTADLPHELIELLEKIVLQNSAFSGNPNLQNLLILTAIKADTTRVMDYINRLDNFDGPAVGEIAVGAELFEEAFAIFKKFNLNVQAVNVLLDNIRDIDRAVEFAARVEEDEVWSQVGKAQLRDGLVSDAIESFIKANDATQYNEVIDVASGVRAYEDLVRYLNMVRKKVKEAKVDSELIFAYAKLNRLDDIEEFIVTPNLANLQTVGDRLFDEELYEAAKIIFTHISNWARLASTLVKLQQFQAAVDAARKANSARTWKEVCFACVDAEEFRLAQICGLNVIVQVDDLEEVSEYYQNRGRFDELISLMESGLGLERAHMGIFTELGTLYARYRPDKLMEHLKLFVTRINIPKLIRVCDEQQHWKELTYLYIAYDEYDNAASTMMSHSPEAWEHMQFKDVAVKVANVELYYKAVYFYLEEYPELINDLLNVLASRVDHTRVVDIMRKAGHLPLVKPYMVAVQSANNAAVNEALNNLYIEEEDYERLRESIDMYDNFDQISMAQRIEKHELLEMRRVGAYIYKRAGRWKQSVALSKKDNLYKDAMETCSQSGDRDLAEELLTFFVDKGKKECFAACLYTCYDLIRADVAVELAWMHGMMDFAVPYLLQFLREYSTKVDDLIKDKLEANEEKKSKEQEEKDVVSNSNMYAQLLPLALPAPPVAGMPGMGGGMPGMGGGMPMPGMAGYGGMPGMSNGGMPGMSNGGMPGMSGYGMPSMSGF

SEQ ID NO: 9672 - protein, 1580 aa, Brassica napus
MKEVLTLPSVGINQQFITFTNVTMESDKYICVRETAPQNSVVIIDMSMPMQPLRRPITADSALMNPDSRILALKAQVPGTTQDHLQIFNIEAKAKLKSHQMPEQVAFWKWITLKMLGLVTQNSVYHWSIEGDSEPVKMFDRTANLANNQIINYKCSPNEKWLVLIGIAPGPPERAQLVKGNMQLFSVDQQRSQALEAHAASFAQFKVPGNENPSILISFASKSFNAGQITSKLHVIELGAQPGKPSFTKKQADLFFPPDFADDFPVAMQVSHKFSLIYVITKLGLLFVYDLETASAIYRNRISPDPIFLTSEASSVGGFYAINRRGQVLLATVNEATIIPFISGQLNNLELAVNLAKRGNLPGAEELVVERFKELFAQTKYKEAAELAAESPQGILRTPDTVAKFQSVPVQAGQTPPLLQYFGTLLTKGKLNSYESLELSRLVVNQNKKNLLENWLAEDKLECSEELGDLVKTVDNDLALKIYIKARATPKVVAAFAERKEFDKILIYSKQVGYTPDYMFLLQTILRTDPQGAVNFALMMSQMEGGCPVDFNTITDLFLQRNLIREATAFLLDVLKPNLPEHAFLQTKVLEINLVTFPNVADAILANGMFSHYDRPRVAQLCEKAGLFIQSLKHYSELPDIKRVIVNTHAIEPQALVEFFGTLSSDWAMECMKDLLLVNLRGNLQIIVQACKEYCEQLGVDACIKLFEQFKSYEGLYFFLGSYLSMSEDPEIHFKYIEAAAKTGQIKEVERVTRESNFYDAEKTKNFLMEAKLPDARPLINVCDRFGFVPDLTHYLYTNNMLRYIEGYVQKVNPGNAPLVVGQLLDDECPEDFIKGLILSVRSLLPVEPLVDECEKRNRLRLLTQFLEHLVSEGSQDVHVHNALGKIIIDSNNNPEHFLTTNPYYDSRVVGKYCEKRDPTLAVVAYRRGQCDEELVNVTNKNSLFKLQARYVVERMDGDLWDKVLMEENEYRRQLIDQVVSTALPESQSPEQVSAAVKAFMTADLPHELIELLEKIVLQNSAFSGNFNLQNLLILTAIKADPSRVMDYINRLDNFDGPAVGEVAVEAQLYEEAFAIFKKFNLNVQAVDVLLDNVKSIERAVEFAFRVEEDSVWSQVAKAQLREGLVSDAIESFIRAEDATHFLEVIRATEDANVYDDLVRYLLMVRQKVKEPKVDSELIYAYAKIDRLGEIEEFILMPNVAILPNVGDRLYDEALYEAAKIIYAFISNWGKLAVTLVKLQQFQGAVDAARKANSAKTWKEVCFACVDAEEFRLAQICGLNVIIQVDDLEEVSEFYQNRGCFNELISLMESGLGLERAHMGIFTELGVLYARYRYEKLMEHIKLFSTRLNIPKLIRACDEQQHWQELTYLYIQYDEFDNTATTVMNHSPEAWEHMQFKDIVAKVANVELYYKAVHFYLQEHPDLINDLLNVLALRLDHTRVVDILRKAGQLRLIKPYMVAVQSNNVSAVNEALNEIYVEEEDYDRLRESIDLHDSFDQIGLAQKIEKHELVEMRRVAAYIYKKAGRWKQSIALSKKDNMYKDCMETASQSGEHDLAEQLLVYFIEQGKRNALLHVSLYVMI

SEQ ID NO: 9673 - protein, 1557 aa, Theobroma cacao
MFERTANLANNQIINYKCDSNEKWLVLIGIAPGSSERPQLVKGNMQLFSVDQQRSQALEAHAASFATFKVPGNENPSTLISFATKTFNAGQITSKLHVIELGAQPGKPSFTKKQADLFFPPDFADDFPVSMQISQKYGLIYVITKQGLLFVYDLETATAVYRNRISPDPIFLTTEASSIGGFYAINRRGQVLLATVNEATIIPFISGQLNNLELAVNLAKRGNLPGAENLVVQRFQELFSQTKYKEAAELAAESPQGILRTPDTVAKFQSVPVQAGQTPPLLQYFGTLLTRGKLNAFESLELSRLVVNQNKKNLLENWLAEDKLECSEELGDLVKTVDNDLALKIYIKARATPKVVAAFAERKEFDKILIYSKQVGYTPDYLFLLQTILRTDPQGAVNFALMMSQMEGGCPVDYNTITDLFLQRNLIREATAFLLDVLKPNVPEHGYLQTKVLEINLVTFPNVADAILANGMFSHYDRPRIGQLCEKAGLYIRALQHYTELPDIKRVIVNTHAIEPQSLVEFFGTLSREWALECMKDLLMVNLRANLQIIVQTAKEYCEQLGVDACIKLFEQFKSYEGLYFFLGSYLSSSEDPDIHFKYIEAAAKTGQIKEVERVTRESNFYDAEKTKNFLMEAKLPDARPLINVCDRFGFVPDLTHYLYTNNMLRYIEGYVQKVNPGNAPLVVGQLLDDECPEDFIKGLILSVRSLLPVEPLVDECEKRNCLRLLTQFLEHLVSEGSQDVHVHNALGKIIIESNNNPEHFLTTNPYYDSRVVGKYCEKRDPTLAVVAYRRGQCDDELVNVTNKNSLFKLQARYVVERMDADLWEKVLNPDNEYRRQLIDQVVSTALPESKSPEQVSAAVKAFMTADLPHELIELLEKIVLQNSAFSGNFNLQNLLILTAIKADPSRVMDYINRLDNFDGPAVGEVAVEAQLYEEAFAIFKKFNLNVQAVNVLLDNLNSIDRAVEFAFRVEEDAVWSQVAKAQLRVGDVSEAIESFIRADDATQFLDVIKAAEDANVYQDLVRYLLMVRQKTKEPKVDSELIYAYAKIGGLGEIEEFILMPNVANLQNVGDRLYDEALYEAAKIIFAFISNWAKLAITLVKLQQFQGAVDAARKANSSKTWKEVCFACVDAEEFRLAQICGLNIIIQVDDLEEVSEYYQNRGCFSELISLMESGLGLERAHMGIFTELGVLYARYRPEKLMEHIKLFSTRLNIPKLIRACDEQQHWKELTYLYVQYDEFDNAATTIMNHSPEAWDHMQFKDIVVKVANVELYYKAVHFYLEEHPDLINDVLNVLALRVDHARVVDIMRKAGHLRLVKPYMVAVQSNNVAAVNEALNEIYVEEEDYDRLRESIDLHDNFDQIGFAQKIEKHELLEMRRVAAYIYKKAGRWKQSIALSKKDNHYRDAMETCSQSGDRELAEELLVYFIEQRKKECFAACLFVCYDVIRPDVALELAWINNMIDFAFPYLLQFIREYTGKVDELVKDKIEAMNQLKAKEEEEKDVVAQQNMYAQLLPLALPAPPMPGMGGSFAPPPPPPPMSGMGMPPMAPYGMPPMGSY

SEQ ID NO: 9674 - protein, 1489 aa, Triticum aestivum
FSVDQQRSQALEAHAASFATFKVPGNENPSTLICFASKATNAGQITSKLHVIELGAQPGKPGFSKKQADLFFPPDFQDDFPVAMQISQKYGLVYVITKLGLLFVYDLETAAAVYRNRISPDPIFLTAESSTTGGFYAINRRGQVLHATVNDATVVPFVSGQLNNLELAVNLAKRANPSPGRRTWLCKDSRNCSHRTKYKEAAELAAESPQGLLRTPETVAKFQSVPVQAGQTPPLLQYFGTLLTRGKLNAYESLELSRLVVNQNKKNLLENWLAEDKLECSEELGDLVKTVDNDLALKIYIKARATPKVVAAFAERREFDKILIYSKQVGYTPDYLFLLQTILRTDPQGAVNFALMMSQMEGGCPLDYNTITDLFLQRNMIREATAFLLDVLKPNLEEHAFLQTKVLEINLVTYPNVADAILANGMFSHYDRPRIAQLCEKAGLYLRALQHYAELPDIKRVIVNTHAIEPQALVEFFGTLSKEWALECMKDLLLVNLRGNLQIVVQAAKEYSEQLGVDGCIKLFEQFKSYEGLYFFLGSYLSSSEDPDIHFKYIESAARTGQIKEVERVTRESNFYDAEKTKNFLMEAKLPDARPLINVCDRFGFVPDLTHYLYTNNMLRYIEGYVQKVNPGNAPLVVGQLLDDECPEDFIKGLILSVRSLLPVEPLVDECEKRNRLRLLTQFLEHLVSEGSQDVHVHNALGKIIIDSNNNPEHFLTTNPFYDSRVVGKYCEKRDPTLAVVAYRRGQCDDELINVTNKNSLFKLQARYVVERMDGDLWDKVLLPENEYRRQFIDQVVSTALPESKSPEQVSAAVKAFMEADLPHELIELLEKIVLQNSAFSGNFNLQNLLILTAIKADPSRVMDYVNRLDNFDGPAVGEVAVEAQLYEEAFAIFKKFNLNVQAVDVLLDNIQSIERAEEFAFRVEEDAVWSHVAKAQLREGLVSEAIESFIRADDATHFLDVIRAAEEADVYHDLVKYLLMVRQKAREPKVDGELIFAYAKIDRLSDIEEFILMPNVANLQNVGDRLYDEELCEAAKIIYAFISNWAKLAVTLVKLKQFQGAVDAARKANSAKTWKEVCFACVDAEEFRLAQICGLNIIIQVDDLEEVSEYYQNRGCFNELISLMESGLGLERAHMGIFTELGVLYARYRPEKLMEHIKLFSTRLNIPKLIRACDEQQHWKELTYLYIQYDEFDNAATTIMNHSPDAWDHMQFKDVAVKVANVEIYYKAVHFYLQEHPDLINDLLNVLALRLDHTRVVDIMRKAGQLHLVKPYMVAVQSNNVSAVNEALNELYVEEEDYERLRESVDMHDNFDQIGLAQKLEKHELLEMRRIAAYIYKKAGRWKQSIALSKKDNMYKDCMETCSQSGDRELSEDLLVYFIEQGKKECFASCLFICYDLIRADVALELAWTNNMLDFAFPYLLQFIREYTSKVDDLVKDRIELQKEEKAKEQEEKDVVAQQNMYAQLLPLALPARLVWGVHLRWAGWVCL

SEQ ID NO: 9675 - protein, 1715 aa, Physcomitrella patens
MAAANAPIAMREALTLTSLGINQQFVTFTHVTMESDKYICVRETSPQNSVVIIDMSMPNQPLRRPITADSALMNPTSRVLALKALIPGSTQDHLQIFNIELKAKMKSHQMPEQVVFWKWISSKLLGLVTQTSVYHWSIEGESTPQKMFDRTANLTGNQIINYRCDPSEKWLVLIGIAPGAPERPQLVKGNMQLFSVDQQRSQALEAHAASFATFKVAGNDSPSLLIAFSTKTITAGQLTSKLHIIELGPQPSRPGFAKKAADLFFPPDFADDFPVAMQISSKYNLIYVITKLGLLFVYDLETATAVYRNRISPDPIFLTVDAPTTGGFYAVNRRGQVLLATVNESTIVPFVSNQLNNLELAVNLARRGNLPGAEGLVVQRFHELFSQMKYKEAADLAAESPKGILRTPDTVAKFQASHPSVPVQPGQTSPLLQYFGTLLTKGKLNVFESLELSRLVVNQNKKNLLENWLAEDKLECSEELGDLVKTVDSDMALKIYIKARATPKVVAAFAERREFDKILIYSKQVGYTPDYLFLLQTILLSDPQGAVNFALMMSQLERGCPVDYNVITDLFLQRNMIREATAFLLDILKPNLPEHALLQTKVLEINLVTFPNVADAILANGMFSHYDRPRIAQLCEKAGLYMRALQHYTELNDIKRVVINTHAIEPQALVEFFGTLSREWALDCMKELLQVNMRGNLQIIVQVSKEYGEQLGVDSCVKLFESFKSYEGLYFFLGAYLSTSEDPEIHYKYIEAAAKTGQIKEVERVTRESNFYPPERTKNFLMEAKLPDARPLINVCDRHGFVPDLTHFLYVNNMLRYIEGYVQKVNPQNAPQVVGQLLDDDCPEDFIKGLILSVRSLLAVEPLVTECEKRNRLRLLTQFLEHLVSEGSQDVHVHNALGKIIIDTNNNPEHFLTTNPYYDSKVVGKYCEKRDPTLAVVAYKRGLCDDELINVTNKNSMFKPQARYVVERMDPELWLKVLDPENPFRRQLIDQVVSTALPESKNPEQVSATVKAFMTADLPHELIELLEKIVLQNSAFSGNPNLQNLLILTAIKADKSRVMDYINRLDNFDGPAVGEIAVGAELYEEAFAIFKKFNLNVQAVNVLLDHLRDIDRAVEFAARVEEDEVWSQVGMAQLREGLVSDAIQSFIKANDATQYNEVINVASNVKAYEDLVKYLHMVRKKVKEQRVDSELIYSYARLDRLGDIEDFIISPNLANLQTVGDRLFDDSLYEAAKIIFTHISNWARLASTLVKIHQYQAAVDAARKANNSRTWKEVCFACVDAEEFRLAQICGLNVIVQVDDLEEVSQYYQNRGCFVELISLMESGLGLERAHMGIFTELGTLYAKYRPEKLMEHLKLFVTRINIPKLIRVCDEQQHWQELTFLYIQYDEYDNAAATMMSHSPEAWDHMQFKDVAVKVANVELYYKATHFYLQEHPEYISDLLNVLATRIDHTRVVDIMRKAGQLSLVKPYMVAVQSANNAAVNEALNGLYIEDEDYERLRESIDMYDNFDQMSMAQRIEKHELLEMRRVAAYVYKRAGRWKQSVALSKKDNLYKDAMETASQSGDRDLAEELLTFFVDKGKKECFAACLYTCYDLIRADVAVELAWMHGMMDFCVPYLLPVFIREYTTKVDDLVKDKIEATEEKRSKESEEKEVVAQQNMYAQLLPLALPPPPVPGVNGFAPGMGMPTMSGMPPMGGGYGMPPLSGGYGMPSMSSI

SEQ ID NO: 9676 - protein, 1520 aa, Citrus sinensis
MAAANAPISMKEVLTLPSVGINPQFITFTNVTMESDKYICVRETAPQNSVVIIDMNQPMQPLRRPITADSALMNPNSRILALKAQLPGTTQDHLQIFNIELKAKIKSHQMSEQVVFWKWISPKMLGVVTQTSVYHWSIEGDSEPVKMFDRTANLTNNQIINYKCDPTEKWLVLIGIAPGSAERPQLVKGNMQLFSVDQQRSQALEAHAASFAQFKVPGNENPSVLISFATKSFNAGQVTSKLHVIELGAQPGKPSFTKKQADLFFPPDFADDFPVAMQISHKYGLIYVITKLGLLFVYDLETAAAVYRNRISPDPIFLTSEASSLGGFYAINRRGQVLLATVNEATIVPFVSGQLNNLELAVNLAKRGNLPGAENLVVQRFQELFAQTKYKEAAELAAESPQGLLRTPDTVAKFQSVPVQAGQTPPLLQYFGTLLTRGKLNAFESLELSRLVVNQNKKNLLENWLAEDKLECSEELGDLVKTVDNDLALKIYIKARATPKVVAAFAERREFDKILIYSKQVGYTPDYLFLLQTILRTDPQGAVNFALMMSQMEGGCPVDYNTITDLFLQRNLIREATAFLLDVLKPNLPEHGFLQTKVLEINLVTFPNVADAILANGMFSHYDRPRIAQLCEKAGLYMRALQHYTELPDIKRVIVNTHAIEPQSLVEFFGTLSREWALECMKDLLLVNLRGNLQIIVQTAKEYCEQLGVEACIKLFEQFKSYEGLYFFLGSYLSSSEDPDIHFKYIEAAAKTGQIKEVERVTRESNFYDPEKTKNFLMEAKLPDARPLINVCDRFGFVPDLTHYLYTNNMLRYIEGYVQKVNPGNAPLVVGQLLDDECPEDFIKGLILSVRSLLPVEPLVEECEKRNRLRLLTQFLEHLVSEGSQDVHVHNALGKIIIDSNNNPEHFLTTNPYYDSRVVGKYCEKRDPTLAVVAYRRGQCDDELINVTNKNSLFKLQARYVVERMDADLWEKVLTPENEYRRQLIDQVVSTALPESKSPEQVSAAVKAFMTADLPHELIELLEKIVLQNSAFSGNFNLQNLLILTAIKADPSRVMDYVNRLDNFDGPAVGEVAVEAQLYEEAFAIFKKFNLNVQAVNVLLDNIRSIERAVEFAFRVEEDAVWSQVAKAQLREGLVSDAIESFIRADDATQFLDVIRAAEDADVYHDLVRYLLMVRQKVKEPKVDSELIYAYAKIDRLGDIEEFILMPNVANLQNVGDRLYDDTLYEAAKIIYAFISNWAKLAVTLVKLKQFQGAVDAARKANSAKTWKEVCFACVDAEEFRLAQICGLNIIVQVDDLEEVSEYYQNRGYFNELISLMESGLGLERAHMGIFTELGVLYARYRYEKLMEHIKLFSTRLNIPKLIRACDEQQHWKELTYLYIQYDEFDNAATTIMNHSPEAWDHMQFKDVAVKVANVELYYKAVHFYLQEHPDLINDLLNVLALRVDHTRVVDIMRKAGHLLLVKPYMVAVQSNNVSAVNEALNEIYVEEEDYERLRESIDMHDNFDQIGLARRLRNMSFWK

SEQ ID NO: 9677 - protein, 475 aa, Brassica rapa
MAVANAPITLKEVLTLPSVGINQQFITFTNVTMESDKYICVRETSPQNSVVIIDMNMPMQPLRRPITADSALMNPNSRILALKAQVPGTTQDYLQMFNIEAKAKLKSHQMPDQVEFWKWITPKMLGLVTQYSVYHWSIEGDSEPVKMFDRATKLENNQIINYKCSPNEKWLVLIGITPGPPERPQLVKGNMQLFSVDQQQTQSLDAHAASFAQFKVPGNENPSTLISFATKSFNAGQITSNVHVIELGALPGKASFAKKKADLSFLPDFADDFPVAMQISNKFSLIYVITKLGLLFVYDLETASPIYRNRISTDPIFLTSEASSVGGFYAINRRGQVLLATVNEATIIPFISGPLKNLELAVNLAKRGNLPGADDLVVKRFKELFDQTKYKEAAELAAESPQGILRTPDTVSKFQSVPVQAGQTPPLLQYFGTLLTKGKLNSYESLELSRLVVNQNKKNLLKNWLEYIYIILLSV

SEQ ID NO: 9678 - protein, 917 aa, Papaver somniferum
MSVIVLVSLLYLTHYLYTNNMLRYIEGYVQKVNPGNAPLVVGQLLDDECPEDFIKGLILSVRSLLPVEPLVDECEKRNRLRLLTQFLEHLVSEGSQDVHVHNALGKIIIDSNNNPEHFLTTNPYYDSRVVGKYCEKRDPTLAVVAYRRGQCDSELINVTNKNSLFKLQARYVVERMDSDLWDLVLNPENEYRRQLIDQVVSTALPESKSPEQVSAAVKAFMTADLPHELIELLEKIVLQNSAFSGNFNLQNLLILTAIKADASRVMDYINRLDNFDGPAVGEVAVEAQLFEEAFAIFKKFNLNVQAVNVLLDNIQSIERAEEFAFRVEEDAVWSQVAKAQLREGLVSEAIESFIRADDATHFLDVIKASEDANVYHDLVKYLLMVRQKSKEPKVDSELIYAYAKIDRLGDIEEFILMPNVANLQSVGDRLYDEELYEAAKIIFAFISNWAKLAVCLVKLRQFQGAVDAARKANSAKTWKEICFACVDAEEFRLAQICGLNIIIQVDDLEEVSQFYQNRGCFNELISLMESGLGLERAHMGIFTELGVLYARYRPEKLMEHIKLFSTRLNIPKLIRACDEQQHWKELVYLYIQYDEFDNAATTIMNHSPEAWDHMQFKDVAVKVANVELYYKAVHFYLQEHPDLINDMLNVLALRVDHTRVVDIMRKAGHLLLVKPYMVAVQSNNVSAVNEALNQIYVEEEDYDRLRESIDMHDNFDQIGLAQKVEKHELLEMRRIAAYIYKKAGRWRQSIALSKKDNLYKDAMETCSQSGDRELSEELLVYFIEQGKKECFASCLFVCYDLIRPDVALELAWMNNMIDFAFPYLLQFIREYTGKVDELVKDRIAAQSEVKVKEQEEKDMVAQQNMYAQLLPLALPAPPMPGMGGGGGMGGGYGPPPPMGGMGMPPMPAYGMPPMGYQ

SEQ ID NO: 9679 - protein, 1539 aa, Vinca minor
MVGLVGIAPGSPERPQLVKGSMQLYSVEQQRSQALEAHAASFASFRVPGNDKDSILISFATKSTNAGQVTSKLHVIELGAQPGKPSFTKKQADLFFPPDFADDFPVAMQISHKYSLIYVITKLGLLFVYDLDTATAVYRNRISPDPIFLTSEASSVGGFYAINRRGQVLLATVNEATIVPFVSGQLNNLELAVNLAKRGNLPGAENLVVQRFQELFAQTKYKEAAELAAESPQGILRTPDTVAKFQSVPVQAGQTPPLLQYFGTLLTRGKLNAFESLELSRLVVNQNKKNLLENWLAEDKLECSEELGDLVKTVDNDLALKIYIKARATPKVVAAFAERREFDKILIYSKQVGYTPDYLFLLQTILRSDPQGAVNFALMMSQMEGGCPVDYNTVTDLFLQRNLIREATAFLLDVLKPNLPEHAFLQTKVLEINLVTFPNVADAILANGMFSHYDRPRIAQLCEKAGLYMRALQHYSELPDIKRVIVNTHAIEPQSLVEFFGTLSREWALECMKDLLLVNLRGNLQIIVQVAKEYCEQMGVDACIKIFEQFKSYEGLYFFLGSYLSSSEDSDIHFKYIEAAAKTGQIKEVERVTRESNFYDAEKTKNFLMEAKLPDARPLINVCDRFGFVPDLTHYLYTNNMLRYIEGYVQKVNPGNAPLVVGQLLDDECPEDFIKGLILSVRSLLPVEPLVDECEKRNRLRLLTQFLEHLVSEGSQDVHVHNALGKIIIDSNNNPEHFLTTNPYYDSRVVGKYCEKRDPTLAVVAYRRGQCDEELINVTNKNSLFKLQARYVVERMDGDLWEKVLNPENESRRQLIDQVVSTALPESKSPEQVSAAVKAFMTADLPHELIELLEKIVLQNSAFSGNFNLQNLLILTAIKADPSRVMDYVNRLDNFDGPAVGEVAVEAQLYEEAFAIFKKFNLNVQAVNVLLDNIRDINRAVEFAFRVEEDAVWSQVAKAQLREGLVSDAIESFIRADDATQFLEVIKAAEDAEVYHDLVKYLLMVRQKNKEPKVDSEIIYAYAKIDRLSDIEEFILMPNVANLPNVGDRLYDEALYEAAKIIYAFISNWAKLAVTLVKLKQFQGAVDAARKANSSKTWKEVCFACVDAEEFRLAQICGLNIIVQVDDLEEVSEYYQNRGCFNELISLMESGLGLERAHMGIFTELGVLYARYRYEKLMEHIKLFSTRLNIPKLIRACDEQQHWKELTYLYIQYDEFDNAATTVMNHSPDAWDHMQFKDIIVKVANVELYYKAVHFYLQEHPDLINDVLNVLALRVDHTRVVDIMRKAGHLRLVKPYMVAVQNNNVSAVNEALNEIYVEEEDYDRLRESIDLHDSFDQIGLAQKIEKHELLEMRRVAAYIYKKAGRWKQSIALSKKDNLYKDAMETASQSGDRELAEELLVYFIEQGKKECFASCLFVCYDLIRADVALELAWMNNMIDFAFPYLLQFIREYTGKVDELIKDKLEAMKEVKAKENEEKDVIMQQNMYAQLLPLALPAPPGMGGGFSQPPPPPMGGMGMPPQGMGMGMPPMPQYGMPPMGY

SEQ ID NO: 9680 - protein, 1545 aa, Brassica napus
APQNSVVIIDMNMPMQPLRRPITADSALMNPNSRILALKAQVPGTTQDHLQIFNIEAKAKLKSHQMPEQVAFWKWITPKMLGLVTQTSVYHWSIEGDSEPVKMFDRTANLANNQIINYKCSPNEKWLVLIGIAPGSPERPQLVKGNMQLFSVDQQRSQALEAHGASFAQFKVPGNENPSILISFASKSFNAGQITSKLHVIELGAQPGKPSFTKKQADLFFPPDFADDFPVAMQVSHKFNLIYVITKLGLLFVYDLETASAIYRNRISPDPIFLTSEASSVGGFYAINRRGQVLLATVNEATIIPFISGQLNNLELAVNLAKRGNLPGAENLVVQRFQELFAQTKYKEAAELAAESPQGILRTPDTVAKFQSVPVQAGQTPPLLQYFGTLLTRGKLNSYESLELSRLVVNQNKKNLLENWLAEDKLECSEELGDLVKTVDNDLALKIYIKARATPKVVAAFAERREFDKILIYSKQVGYTPDYMFLLQTILRSDPQGAVNFALMMSQMEGGCPVDYNTITDLFLQRNLIREATAFLLDVLKPNLPEHAFLQTKVLEINLVTFPNVADAILANGMFSHYDRPRVAQLCEKAGLYIQSLKHYSELPDIKRVIVNTHAIEPQALVEFFGTLSSEWAMECMKDLLLVNLRGNLQIIVQACKEYCEQLGVDQCIKLFEQFKSYEGLYFFLGSYLSMSEDPEIHFKYIEAAAKTGQIKEVERVTRESNFYDAEKTKNFLMEAKLPDARPLINVCDRFGFVPDLTHYLYTNNMLRYIEGYVQKVNPGNAPLVVGQLLDDECPEDFIKGLILSVRSLLPVEPLVEECEKRNRLRLLTQFLEHLVSEGSQDVHVHNALGKIIIDSNNNPEHFLTTNPYYDSKVVGKYCEKRDPTLAVVAYRRGQCDEELINVTNKNSLFKLQARYVVERMDGDLWDKVLVEENEYRRQLIDQVVSTALPESKSPEQVSAAVKAFMTADLPHELIELLEKIVLQNSAFSGNFNLQNLLILTAIKADPSRVMDYINRLDNFDGPAVGEVAVDAQLYEEAFAIFKKFNLNVQAVNVLLDHVGSIERAVEFAFRVEEDSVWTQVAKAQLRDGLVSDAIESFIRADDATHFLEVIRACEDTDVYDDLVRYLLMVRQKVKEPKVDSELIYAYAKIERLGEIEEFILMPNVANLPNVGDRLYDEALYEAAKIIYAFTSNWAKLAVTLVKLQQFQSAVDAARKANSAKTWKEVCFACVDAEEFRLAQICGLNVIIQVDDLEEVSEYYQNRGCFSELISLMESGLGLERAHMGIFTELGVLYARYRYEKLMEHIKLFSTRLNIPKLIRACDEQQHWQELTYLYIQYDEFDNAATTVMNHSPEAWEHMQFKDIVAKVANVELYYKAVHFYLQEHPDIINDLLNVLALRLDHTRVVDIMRKAGQLRLIKPYMVAVQSNNVSAVNEALNEIYVEEEDYDRLRESTDLHDSFDQIGLAQKIEKHELVEMRRVAAYIYKKAGRWKQSIALSKKDNMYKDCMETASQSGDHDLAEQLLVYFIEQGKRNALLHVSLCVMT

SEQ ID NO: 9681 - protein, 1515 aa, Manihot esculenta
MQLYSVDQQRSQALEAHAAAFAQFKVPGNENPSILISFATKSFNAGQITSKLHVIELGAQPGKPSFTKKQADLFFPPDFADDFPVAMQISHKYSLIYVITKLGLLFVYDLDTASAVYRNRISPDPIFLTAEASSVGGFYAINRRGQVLLATVNEATIVPFVSSQLNNLELAVNLAKRGNLPGAENLVVQRFQELFAQTKYKEAAELAAESPQGLLRTPDTVAKFQSVPVQAGQTPPLLQYFGTLLTRGKLNAFESLELSRLVVNQNKKNLLENWLAEDKLECSEELGDLVKTVDNDLALKIYIKARATPKVVAAFAERREFDKILIYSKQVGYTPDYLFLLQTILRSDPQGAVNFALMMSQMEGGCPVDYNTITDLFLQRNLIREATAFLLDVLKPNLPEHGFLQTKVLEINLVTFPNVADAILANGMFSHYDRPRIAQLCEKAGLYIRALQHYAELPDIKRVIVNTHAIEPQALVEFFGTLSREWALECMKDLLLVNLRGNLQIIVQTAKEYCEQLGIDACIKLFEQFKSYEGLYFFLGSYLSSSEDPDIHFKYIEAAAKTGQIKEVERVTRESNFYDAEKTKNFLMEAKLPDARPLINVCDRFGFVADLTHYLYTNNMLRYIEGYVQKVNPGNAPLVVGQLLDDECPEDFIKGLILSVRSLLPVEPLVEECEKRNRLRLLTQFLEHLVSEGSQDVHVHNALGKIIIDSNNNPEHFLTTNPYYDSRVVGKYCEKRDPTLAVVAYRRGQCDDELINVTNKNSLFKLQARYVVERMDADLWEKVLNPENEYRRQLIDQVVSTALPESKSPEQVSAAVKAFMTADLPHELIELLEKIVLQNSAFSGNFNLQNLLILTAIKADPSRVMDYINRLDNFDGPAVGEVAVEAQLYEEAFAIFKKFNLNVQAVNVLLDNIQSIDRAVEFAFRVEEDAVWSQVAKAQLRVGLVSDAIESFIRADDATQFLDVIHAAEDANVYHDLVRYLLMVRQKTKEPKVDSELIFAYAKIDRLSDIEEFILMPNVANLQNVGDRLFDGALYEAAKIIFAFISNWAKLACTLVKLKQFQGAVDAARKANSAKTWKEVCFACVDAEEFRLAQICGLNIIIQVDDLEEVSEYYQNRGYFNELISLMESGLGLERAHMGIFTELGVLYARYRPEKLMEHIKLFSTRLNIPKLIRACDEQQHWKELTYLYIQYDEFDNAATTIMNHSPEAWDHMQFKDVSVKVANVELYYKAVHFYLQEHPDLINDLLNVLALRVDHTRVVDIMRKAGHLLLVKPYMIAVQSNNVSAVNEALNQIYVEEEDYERLRESIDMHDNFDQIGLAQKIEKHELLEMRRVAAYIYKKAGRWKQSIALSKKDNHYKDAMETASQSGERELAEELLVYFIEQGKKECFASCLFVCYDLIRADVALELAWIHNMVDFAFPYLLQFIREYVGKVDELVKDKLEAQKEVKAKEQEEKDVIAQQNMYAQLLPLALPAPPMPGMGGPTMGGGFSAPPPMAGMGMPPMPPFGMPPMGSY

SEQ ID NO: 9682 - protein, 744 aa, Avena sativa
MDGDLWDKVLQPENEYRRQFIDQVVSTALPESKSPEQVSAAVKAFMTADLPHELIELLEKIVLQNSAFSGNFNLQNLLILTAIKADSSRVMDYVNRLDNFDGPAVGEVAVEAQLYEEAFAIFKKFNLNVQAVNVLLDNIQSIERAEEFAFRVEEDAVWSQVAKAQLREGLVSEAIESFIRADDVTHFLDVIRAAEEANVYHDLVKYLLMVRQKAREPKVDGELIFAYAKIDRLSDIEEFILMPNVANLQNVGDRLYDEELYEAAKIIYAFISNWAKLAVTLVKLKQFQGAVDAARKANSAKTWKEVCFACVDAEEFRLAQICGLNIIVQVDDLEEVSEYYQNRGCFGELISLMESGLGLERAHMGIFTELGVLYARYRPEKLMEHIKLFSTRLNIPKLIRACDEQQHWKELTYLYIQYDEFDNAATTIMNHSPDAWEHMQFKDVCVKIANVEIYYKAVHFYLQEHPDLINDLLNVLALRLDHTRVVDIMRKAGQLHLVKPYMVAVQSNNVSAVNEALNELYVEEEDYERLRESVDMHDNFDQIGLAQKLEKHELLEMRRIAAYIYKKAGRWKQSIALSKKDNMYKDCMETCSQSGDRELSEDLLVYFIEQGKKECFASCLFICYDLIRADVALELAWTNNMLDFAFPYLLQFIREYTSKVDDLVKDRIESQKEEKAKESEEKELVAQQNMYAQLLPLALPAPPGMMGGPPPMGGMGMPPMGGMGMPPMGPGPMPAYGMPPMGSY

SEQ ID NO: 9683 - protein, 1449 aa, Triticum aestivum
PDFQDDFPVAMQISQKYGLVYVITKLGLLFVYDLETAAAVYRNRISPDPIFLTAESSTTGGFYAINRRGQVLHATVNDATVVPFVSGQLNNLELAVNLARRANLPGAENLVVQRFQELFSQTKYKEAAELAAESPQGLLRTPETVAKFQSVPVQAGQTPPLLQYFGTLLTRGKLNAYESLELSRLVVNQNKKNLLENWLAEDKLECSEELGDLVKTVDNDLALKIYIKARATPKVVAAFAERREFDKILIYSKQVGYTPDYLFLLQTILRTDPQGAVNFALMMSQMEGGCPLDYNTITDLFLQRNMIREATAFLLDVLKPNLEEHAFLQTKVLEINLVTYPNVADAILANGMFSHYDRPRIAQLCEKAGLYLRALQHYAELHDIKRVIVNTHAIEPQALVEFFGTLSKEWALECMKDLLLVNLRGNLQIVVQAAKEYSEQLGVDGCIKLFEQFKSYEGLYFFLGSYLSSSEDPDIHFKYIESAARTGQIKEVERVTRESNFYDAEKTKNFLMEAKLPDARPLINVCDRFGFVPDLTHYLYTNNMLRYIEGYVQKVNPGNAPLVVGQLLDDECPEDFIKGLILSVRSLLPVEPLVDECEKRNRLRLLTQFLEHLVSEGSQDVHVHNALGKIIIDSNNNPEHFLTTNPFYDSRVVGKYCEKRDPTLAVVAYRRGQCDDELINVTNKNSLFKLQARYVVERMDGDLWDKVLLPENEYRRQFIDQVVSTALPESKSPEQVSAAVKAFMEADLPHELIELLEKIVLQNSAFSGNFNLQNLLILTAIKADPSRVMDYVNRLDNFDGPAVGEVAVEAQLYEEAFAIFKKFNLNVQAVDVLLDNIQSIERAEEFAFRVEEDAVWSHVAKAQLREGLVSEAIESFIRADDATHFLDVIRAAEEADVYHDLVKYLLMVRQKAREPKVDGELIFAYAKIDRLSDIEEFILMPNVANLQNVGDRLYDEELYEAAKIIYAFISNWAKLAVTLVKLKQFQGAVDAARKANSAKTWKEVCFACVDAEEFRLAQICGLNIIIQVDDLEEVSEYYQNRGCFNELISLMESGLGLERAHMGIFTELGVLYARYRPEKLMEHIKLFSTRLNIPKLIRACDEQQHWKELTYLYIQYDEFDNAATTIMNHSPDAWDHMQFKDVAVKVANVEIYYKAVHFYLQEHPDLINDLLNVLALRLDHTRVVDIMRKAGQLHLVKPYMVAVQSNNVSAVNEALNELYVEEEDYERLRESVDMHDNFDQIGLAQKLEKHELLEMRRIAAYIYKKAGRWKQSIALSKKDNMYKDCMETCSQSGDRELSEDLLVYFIEQGKKECFASCLFICYDLIRADVALELAWTNNMLDFAFPYLLQFIREYTSKVDDLVKDRIESQKEEKAKEQEEKDVVAQQNMYAQLLPLALPAPPGMGGPPPMGGMGMPPMGGMGMPPMGGMGMPPMGPGPMPAYGMPPMGNY

SEQ ID NO: 9684 - protein, 1430 aa, Triticum aestivum
ISQKYGLVYVITKLGLLFVYDLETAAAVYRNRISPDPIFLTAESSTTGGFYAINRRGQVLHATVNDATVVPFVSGQLNNLELAVNLAKRANLPGAENLVVQRFQELFAQTKYKEAAELAAESPQGLLRTPETVAKFQSVPVQAGQTPPLLQYFGTLLTRGKLNAYESLELSRLVVNQNKKNLLENWLAEDKLECSEELGDLVKTVDNDLALKIYIKARATPKVVAAFAERREFDKILIYSKQVGYTPDYLFLLQTILRTDPQGAVNFALMMSQMEGGCPLDYNTITDLFLQRNMIREATAFLLDVLKPNLEEHAFLQTKVLEINLVTYPNVADAILANGMFSHYDRPRIAQLCEKAGLYLRALQHYAELPDIKRVIVNTHAIEPQALVEFFGTLSKEWALECMKDLLLVNLRGNLQIVVQAAKEYCEQLGVDACIKLFEQFKSYEGLYFFLGSYLSSSEDPDIHFKYIESAARTGQIKEVERVTRESNFYDAEKTKNFLMEAKLPDARPLINVCDRFGFVPDLTHYLYTNNMLRYIEGYVQKVNPGNAPLVVGQLLDDECPEDFIKGLILSVRSLLPVEPLVDECEKRNRLRLLTQFLEHLVSEGSQDVHVHNALGKIIIDSNNNPEHFLTTNPFYDSRVVGKYCEKRDPTLAVVAYRRGQCDEELINVTNKNSLFKLQARYVVERMDGDLWDKVLQPDNEYRRQFIDQVVSTALPESKSPEQVSAAVKAFMTADLPHELIELLEKIVLQNSAFSGNFNLQNLLILTAIKADSSRVMDYVNRLDNFDGPAVGEVAVEAQLYEEAFAIFKKFNLNVQAVDVLLDNIRSIERAEEFAFRVEEDAVWSQVAKAQLREGLVSEAIESFIRADDVTHFLDVIRAAEEANVYHDLVKYLLMVRQKAREPKVDSELIFAYAKIDRLSDIEEFILMPNVANLQNVGDRLYDEELYEAAKIIYAFISNWAKLAVTLVKLKQFQGAVDAARKANSAKTWKEVCFACVDAEEFRLAQICGLNIIVQVDDLEEVSEYYQNRGCFSELISLMESGLGLERAHMGIFTELGVLYARYRPEKLMEHIKLFSTRLNIPKLIRACDEQQHWKELTYLYIQYDEFDNAATTIMNHSPDAWDHMQFKDVCVKVANVEIYYKAVHFYLQEHPDLINDLLNVLALRLDHTRVVDIMRKAGQLHLVKPYMVAVQSNNVSAVNEALNELYVEEEDYERLRESVDMHDNFDQIGLAQKLEKHELLEMRRIAAYIYKKAGRWKQSIALSKKDNMYKDCMETCSQSGDRELSEDLLVYFIEQGKKECFASCLFICYDLIRADVALELAWTNNMLDFAFPYLLQFIREYTNKVDDLVKDRIESQKEEKAKENEEKELVAQQNMYAQLLPLALPAPPGMMGGPPPMGGMGMPPMGGMGMPPMGPGPMPAYGMPPMGSY

SEQ ID NO: 9685 - protein, 1439 aa, Secale cereale
MQISQKYGLVYVITKLGLLFVYDLETAAAVYRNRISPDPIFLTAESSTTGGFYAINRRGQVLHATVNDATVVPFVSGQLNNLELAVNLAKRANLPGAENLVVQRFQELFSQTKYKEAAELAAESPQGLLRTPETVAKFQSVPVQAGQTPPLLQYFGTLLTRGKLNAYESLELSRLVVNQNKKNLLENWLAEDKLECSEELGDLVKTVDNDLALKIYIKARATPKVVAAFAERREFDKILIYSKQVGYTPDYLFLLQTILRTDPQGAVNFALMMSQMEGGCPLDYNTITDLFLQRNMIREATAFLLDVLKPNLEEHAFLQTKVLEINLVTYPNVADAILANGMFSHYDRPRIAQLCEKAGLYLRALQHYAELPDIKRVIVNTHAIEPQALVEFFGTLSKEWALECMKDLLLVNLRGNLQIVVQAAKEYSEQLGVDGCIKLFEQFKSYEGLYFFLGSYLSSSEDPDIHFKYIESAARTGQIKEVERVTRESNFYDAEKTKNFLMEAKLPDARPLINVCDRFGFVPDLTHYLYTNNMLRYIEGYVQKVNPGNAPLVVGQLLDDECPEDFIKGLILSVRSLLPVEPLVDECEKRNRLRLLTQFLEHLVSEGSQDVHVHNALGKIIIDSNNNPEHFLTTNPFYDSRVVGKYCEKRDPTLAVVAYRRGQCDDELISVTNKNSLFKLQARYVVERMDGDLWDKVLLPENEYRRQFIDQVVSTALPESKSPEQVSAAVKAFMEADLPHELIELLEKIVLQNSAFSGNFNLQNLLILTAIKADPSRVMDYVNRLDNFDGPAVGEVAVEAQLYEEAFAIFKKFNLNVQAVDVLLDNIRSIERAEEFAFRVEEDAVWSQVAKAQLREGLVSEAIESFIRADDATHFLDVIRAAEEADVYHDLVKYLLMVRQKAREPKVDGELIFAYAKIDRLSDIEEFILMPNVANLQNVGDRLYDEELYEAAKIIYAFISNWAKLAVTLVKLKQFQGAVDAARKANSAKTWKEVCFACVDAEEFRLAQICGLNIIIQVDDLEEVSEYYQNRGCFNELISLMESGLGLERAHMGIFTELGVLYARYRPEKLMEHIKLFSTRLNIPKLIRACDEQQHWKELTYLYIQYDEFDNAATTIMNHSPDAWDHMQFKDVAVKVANVEIYYKAVHFYLQEHPDLINDLLNVLALRLDHTRVVDIMRKAGQLHLVKPYMVAVQSNNVSAVNEALNELYVEEEDYERLRESVDMHDNFDQIGLAQKLEKHELLEMRRIAAYIYKKAGRWKQSIALSKKDNMYKDCMETCSQSGDRELSEDLLVYFIEQGKKECFASCLFICYDLIRADVALELAWTNNMLDFAFPYLLQFIREYTSKVDDLVKDRIESQKEEKAKEQEEKDVVAQQNMYAQLLPLALPAPPGMGGPPPMGGMGMPPMGGMGMPPMGGMGMPPMGPGPMPAYGMPPMGNY

SEQ ID NO: 9686 - protein, 384 aa, Zea mays
MPTPVKSVLPVVLLGCGGVGRYLLRHIVSCRPLHANQGVAIRVVGVADSSSLLVAEDVHSTGLDDALLTQLCAAKSAGSPLSSLLGRGHCQLFKNPEARGKVIDAATTLGRTTGLVLVDCSATYDTVSLLKDAVDHGCCVVLANKKPLTGAYEDFQKLVSNFRRIRFESTVGAGLPVIASVTRIIASGDPITRIVGSLSGTLGYVMSELEDGKKFSEVVKTAKSLGYTEPDPRDDLGGMDVARKALILARLLGQQISMESINVESLYPSELGPDAVSTKDFLESGLVQLDKSMEERIRAASSRGNVLRYVCEIESAGCQVGLKELPKDSALGRLRGSDNVVEIYSRCYQSSPLVIQGAGAGNDTTAAGVLADIIDLQDLFQTMA

SEQ ID NO: 9687 - protein, 384 aa, Setaria italica
MPAPVKSVLPVVLLGCGGVGRYLLRHIVSCRPLHANQGVAIRVVGVADSSSLLVADDVHSSGLDDALLTQLCAAKAAGSPLSALLGQGHCQLFQNPEARSKVIDAATMLGRTTGLVLVDCSATYDTVSLLKDAVDHGCCIVLANKKPLTGAYEDFQKLVSNFRRIRFESTVGAGLPVIASATRIIASGDPVSCIVGSLSGTLGYVMSELEDGKKFSEVVKKAKSLGYTEPDPRDDLGGMDVARKALILARLLGQQISMDNINVESLYPSELGPDAVSTEDFLESGLVQLDKSMEERVKAASSRGNVLRYVCEIGSTGCQVGLKEVPKDSALGRLRGSDNVVEIYSRCYESSPLVIQGAGAGNDTTAAGVLADIIDLQDLFRKTA

SEQ ID NO: 9688 - protein, 384 aa, Panicum virgatum
MPTPVKSVLPVVLLGCGGVGRYLLRHIVSCRPLHANQGVAIRVVGVADSSSLLVADDVSSSGLDDALLTHLCAAKSAGSPLSSLLGQGNYQLFRNPEARSKVIDAATTLGRTTGLVLVDCSATYDTVSLMKDAVDHGCCIVLANKKPLTGAYEDFQILVSNFRRIRFESTVGAGLPVIASVTRIIASGDPVSRIVGSLSGTLGYVMSELEDGKRFSEVVKTAKSLGFTEPDPRDDLGGMDVARKALILARLLGQQISMDNIDVESLYPSKLGPDAVSTEDFLENGLVQLDKGMEERVKAASSRGNVLRYVCEIGSTRCQVGLKELPKDSALGRLRGSDNVVEIYSRCYESSPLVIQGAGAGNDTTAAGVLADIMDLQDLFQKPA

SEQ ID NO: 9689 - protein, 384 aa, Cenchrus ciliaris
  misc_feature (225)..(225): Xaa can be any naturally occurring amino acid
  misc_feature (241)..(241): Xaa can be any naturally occurring amino acid
  misc_feature (260)..(260): Xaa can be any naturally occurring amino acid
  misc_feature (282)..(282): Xaa can be any naturally occurring amino acid
  misc_feature (284)..(284): Xaa can be any naturally occurring amino acid
  misc_feature (301)..(301): Xaa can be any naturally occurring amino acid
  misc_feature (307)..(307): Xaa can be any naturally occurring amino acid
  misc_feature (347)..(347): Xaa can be any naturally occurring amino acid
  misc_feature (355)..(355): Xaa can be any naturally occurring amino acid
  misc_feature (370)..(370): Xaa can be any naturally occurring amino acid
  misc_feature (383)..(383): Xaa can be any naturally occurring amino acid
MPTPVKSVLPVVLLGCGGVGRYVLRHIVSCRPLHANQGVAIRVVGVADSSSLLVADDVHSSGLDDALLTNLCAAKAAGSPLSSLLGQGHCQLFHNPEARSKVIDAATTLGRTTGLVLVDCSATYDTVSLLKDAVDHGCCIVLANKKPLTGAYEDFQKLISNFRQIRFESTVGAGLPVIASATRIIASGDPVSRIVGSLSGTLGYVMSELEDGKRFSEVVKTAKSXGYTEPDPRDDLGGMDXARKALILARLLGQQISMEXINVESLYPSELGPDAVSTEDFXEXGLVQVDRSMEERVKAAXSRGNVXRYVCEIGSTGCQVGLKEVPKDSALGRLRGSDNVVEIYSRXYERSPLVXQGAGAGNDTTAAGVXADIIDLQDLFRKXA

SEQ ID NO: 9690 - protein, 384 aa, Oryza sativa
MAAPVRSVLPVVLLGCGGVGRHLLRHIVSCRPLHANQGVAIRVLGVADSSSLLVADDLHSNGFDDALLADLCAAKSAGSPLSSLLARGQCQLFNNTEARRKVIDTASVLGKTTGLVLVDCSATYDTVGMLKDAVDCGCCVVLANKKPLTCAYEDFEKLVSNFRRIRFESTVGASLPVIASVTRIIASGDPVSRIVGSLSGTLGYVMSELEDGKKFSEVVKTAKSLGYTEPDPRDDLSGMDVARKALILARLLGQQISMENINVESLYPSELGPDAMSTKDFLESGLVQLDKSIEERVKAASLKGNVLRYVCKIESTGCQVGLEELPKNSALGRLRGSDNVVEIYSRCYESAPLVIQGAGAGNDTTAAGVLADILDLQDLFHKTA

SEQ ID NO: 9691 - protein, 384 aa, Oryza sativa
MAAPVRSVLPVVLLGCGGVGRHLLRHILSCRPLHANQGVAIRVLGVADSSSLLVADDLHSNGFDDALLADLCAAKSAGSPLSSLLSRGQCQLFNNPEARRKVIDTASVLGKTTGLVLVDCSATYDTVGMLKDAVDRGCCVVLANKKPLTCAYEDFEKLVSNFRRMRFESTVGAGLPVIASVTRIIASGDPVSRIVGSLSGTLGYVMSELEDGKRFSEVVKTAKSLGYTEPDPRDDLSGMDVARKALILARLLGQRISMENINVESLYPSEFGPDAMSTKDFLESGLVQLDKSIEERVKAASLKGNVLRYVCKIESTGCQVGLEELPKNSALGRLRGSDNVVEIYSRCYESAPLVIQGAGAGNDTTAAGVLADILDLQDLFHKTA

SEQ ID NO: 9692 - protein, 153 aa, Cynodon dactylon
MPAPAKSVVPVVLLGCGGVGRHLLQHIVSCRPLHARQGVAVEVVGVADSSSLLLVADDVHAGGFNDALLTDICSAKAAGSPLSSLLGQGRCQLFKNPEAGAKVIDAAATLGRSTGLVLVDCSATYDTVGLLKDAVNHGCCIALANKKPLTGGL

SEQ ID NO: 9693 - protein, 385 aa, Hordeum vulgare
MPQAQARSVLPVVLLGCGGVGRHLLRHIVSCRPLHANQGVAIRVVGVGDSSSLLVADDVRANGLDDALLNDLCSAKSAGSPLSSLLARGHCQVFNKPEAMGKVIDAATMLGRTTGLVIVDCSATYDTVGVLKDAVDHGCCVVLANKKPLTCAYEDFKKLTSHFRQIRFESTVGAGLPVIASVTRIIASGDPVSRIVGSLSGTLGYVMSELEDGKKFSEVVKTAKALGYTEPDPRDDLSGMDVARKALILARLLGQQISMENIIVESLYPSELGPEVMSTTNFLESGLTKLDETIEERVKAASLRGNVLRYVCVIGNTGCQVGLQEVPKDSALGRLRGSDNVVEIYSRCYESSPLVIQGAGAGNDTTAAGVLADIIDLQDLFQTRA

SEQ ID NO: 9694 - protein, 385 aa, Pseudoroegneria spicata
  misc_feature (215)..(216): Xaa can be any naturally occurring amino acid
MPQAQARSVLPVVLLGCGGVGRHLLRHIVSCRPLHANQGVAIRVVGVADSSSLLVADDVRSSGLDDALLNDLCSAKSAGSPLSSLLARGHCQVFNKPEAMGKVIDAATMLGRTTGLVIVDCSATYDTVGVLKDAVDHGCCVVLANKKPLTCAYEDFKKLASHFRQIRFESTVGAGLPVIASVTRIIASGDPVSRIVGSLSGTLGYVMSELEDGKXXSEVVKTAKALGYTEPDPRDDLSGMDVARKALILARLLGQQISMENINVESLYPSELGPEVMSTTDFLESGLAKLDETIEERVKAASLRGNVLRYVCVIGNTGCQVGLQEVPKDSALGRLRGSDNVVEIYSRCYESSPLVIQGAGAGNDTTAAGVLADIIDLQDLFLTRA

SEQ ID NO: 9695 - protein, 385 aa, Secale cereale
MPQAQARAVLPVVLLGCGGVGRHLLRHIVSCRPLHANQGVAIRVVGVADSSSLLVADDVRASGLDDALLNDLCSAKSAGSPLSSLLARGHCQVFNKPEAMGKVIDAATMLGRTTGLVIVDCSATYDTVGVLKNAVDHGCCVVLANKKPLTCAYEDFKKLTTHFRQIRFESTVGAGLPVIASVTRIIASGDPVSRIVGSLSGTLGYVMSELEDGKKFSEVVKTAKALGYTEPDPRDDLSGMDVARKALILARLLGQQIGMENINVESLYPSELGPEVMSTMDFLESGLAQLDEAIEERVKAASLRGNVLRYVCVIGNTGCQVGLQEVPKDSALGRLRGSDNVVEIYSRCYESSPLVIQGAGAGNDTTAAGVLADIIDLQDLFQTRA

SEQ ID NO: 9696 - protein, 385 aa, Hordeum vulgare
MPQAQARSVLPVVLLGCGGVGRHLLRHIVSCRPLHANQGVAIRVVGVGDSTSLLVADDVRANGLDDALLNDLCSAKSAGSPLSSLLARGHCQVFNKPEAMGKVIDAATMLGRTTGLVIVDCSATYDTVGVLKDAVDHGCCVVLANKKPLTCAYEDFKKLTSHFRQIRFESTVGAGLPVIASVTRIIASGDPVSRIVGSLSGTLGYVMSELEDGKKFSEVVKTAKALGYTEPDPRDDLSGMDVARKALILARLLGQQISMENIIVESLYPSELGPEVMSTTNFLESGLTKLDETIEERVKAASLRGNVLRYVCVIGNTGCQVGLQEVPKDSALGRLRGSDNVVEIYSRCYESSPLVIQGAGAGNDTTAAGVLADIIDLQDLFQTRA

SEQ ID NO: 9697 - protein, 385 aa, Triticum aestivum
MPQAQARAVLPVVLLGCGGVGRHLLRHIVSCRPLHANQGVAIRVVGVADSSSLLVADDVRASGLDDALLNDLCSAKSAGSPLSSLLARGHCQVFNKPEAMGKVIDAATMLGRTTGLVIVDCSATYDTVGVLKDAVDHGCCVVLANKKPLTCAYEDFKKLTSHFRQIRFESTVGAGLPVIASVTRIIASGDPVSRIVGSLSGTLGYVMSELEDGKFFSEVVKTAKALGYTEPDPRDDLSGMDVARKALILARLLGQQISMENINVESLYPSELGPEVMSTTDFLESGLAKLDETIEEKVKAASLRGNVLRYVCVIGNTGCQVGLQEVPKDSALGRLRGSDNVVEIYSRCYESSPLVIQGAGAGNDTTAAGVLADIIDLQDLFQTRA

SEQ ID NO: 9698 - protein, 385 aa, Triticum aestivum
MPQAQARAVLPVVLLGCGGVGRHLLRHIVSCRSLHANQGVAIRVVGVADSSSLLVADDVRASGLDDALLNDLCSAKSAGSPLSSLLARGHCQVFNKPEAMGKVIDAATMLGRTTGLVIVDCSATYDTVGVLKDAVDHGCCVVLANKKPLTCAYEDFKKLTSHFRQIRFESTVGAGLPVIASVTRIIASGDPVSRIVGSLSGTLGYVMSELEDGKFFSEVVKTAKALGYTEPDPRDDLSGMDVARKALILARLLGQQISMENINVESLYPSELGPEVMSTTDFLESGLAKLDETIEEKVKAASLRGNVLRYVCVIGNTGCQVGLQEVPKDSALGRLRGSDNVVEIYSRCYESSPLVIQGAGAGNDTTAAGVLADIIDLQDLFQTRA

SEQ ID NO: 9699 - protein, 388 aa, Brachypodium distachyon
MPPQAQAKSVLPVVLLGCGGVGRHLLRHIVSCRPLHANQGVSIRVVGVSDSSSLLLAADDLRAGAGLDDALLGDLCAAKSAGSPLSSLLARGQCQLFNKPEAMSKVIDAATMLGRTTGLVLVDCSATYDTIGVLKDAVDQGCCVVLANKKPLTSSYEDFQKLTSNFRQIRFESTVGAGLPVIASVTRIIASGDPISRIVGSLSGTLGYVMSELEDGKRFSEVVKTAKSLGYTEPDPRDDLSGMDVARKALILARLLGRQISMEDINVESLYPSELGPEVISTNDFLESGLAQLDESIEERVKAASLRGNVLRYVGVIESTGCQVGLQEVPKDSALGRLMGSDNVVEIYSRCYENSPLVIQGAGAGNDTTAAGVLADIVDLQDLFQKRV

SEQ ID NO: 9700 - protein, 354 aa, Pennisetum glaucum
LHANQGVAIRVVGVADSSSLLLAGDVQSGGLDDALLTHLCAAKAAGSPLSSLLGQGHCQLFQNPEARSKVIDAATTLGRTTGLVLVDCSATYDTVSLLRDAVDHGCCIVLANKKPLTGAYEDFQKLVSNFRRIRFESTVGAGLPVIASVTRIIASGDPVSRIVGSLSGTLGYVMSELEDGKRFSEVVKTAKFLGYTEPDPRDDLGGMDVARKALILARLLGQQISMDNINVESLYPRELGPDAVSTENFLESGLIQLDRSMEERVRAASSRGNVLRYVCEIGSTGCHVGLKELPKDSALGRLRGSDNVVEIYSRCYESSPLVIQGAGAGNDTTAAGVLADIIDLQDLFQKTQAA

SEQ ID NO: 9701 - protein, 176 aa, Secale cereale
MPQAQARAVLPVVLLGCGGVGRHLLRHIVSCRPLHANQGVAIRVVGVADSSSLLVADDVRASGLDDALLNDLCSAKSAGSPLSSLLARGHCQVFNKPEAMGKVIDAATMLGRTTGLVIVDCSATYDTVGVLKDAVDHGCCVVLANKKPLTCAYEDFIKLTTHFRQIRFESTVCTCY

SEQ ID NO: 9702 - protein, 479 aa, Zea mays
MQAATRSVSCIGAQPSVLIRCGGGALSASPGGLGGGGCRVRVVAVLRCCAQEKRPPRVRKSKEERREMVESFINSYRASNEGKFPSVNLTHKEVGGSYYIVREIVRDIIQENRVLGPGGLDAMVLNFEDFADSSGSSMKHELGQDNIEILDTSGSEVSKGYVPEISNTDGSFLLQDNAISNQTLLGSSNILEAGILNSVVQNGSAADAIFMETNLEKQDEVPSGESIEFDLNSSEEQAHLFAQVSDSDENIALDSQADAQDVMASSATNRAILPLEASAVYDAALLRDHETLPNDNHDASTDSSVDDASHVETTNGVQAKQASLHEHDASTGNVSIENAQSLDGQFSNISTDPINGAKLEAEVATKTVEASKVHRLQDGFEQPLADASCDGQENSDSPVSHPALDTKGLLHTEDQQSVVQVDESEFKNSTSGITKEDFKHEQGISTATVISRHALCLLTLRCMLTVYNFLHTSQRAAVY

SEQ ID NO: 9703 - protein, 87 aa, Saccharum officinarum
MSSQRPGRHQRRASQSVFVLPENLASLDVDAAGEVGAKAGGPEGAGASAEQQARPPAGRHRRAMSVAVATRDLELIKEDLGSYKLGA

SEQ ID NO: 9704 - protein, 85 aa, Setaria italica
MSSQRPGRHQRRASQSVFVLPENLATLDVDAAAEAGGKAGSDGAGAEQQAARPPAGRHRRAMSVAVASRDLELIKEDLGSYKLGA

SEQ ID NO: 9705 - protein, 86 aa, Panicum virgatum
MSSQRPGRHQRRASQSVFVLPENLATLDVDAAAEAGGNKVGPDGASAEQQARPPAGRHHRRAMSVAVASRDLELIKEDLGSYKIGA

SEQ ID NO: 9706 - protein, 80 aa, Panicum virgatum
MSSQRPGRHQRRASQSVFVLPENLATLDVDAVAEAGGNKAGAEQQARPPAGRHRRAMSVAVASRDLELIKEDLGSYKIGA

SEQ ID NO: 9707 - protein, 92 aa, Zea mays
MSSQRPGRHQRRASQSVFVLPENLASLDVDAAADAGAKAGGPEGAGAGAEQQARPPAGRHHRRAMSVAAAVASRELELIKEDLGSYNYKVGA

SEQ ID NO: 9708 - protein, 480 aa, Setaria italica
MASAAAPPTSLSLAARAATRAAAAAAATPLRRGGLAAGCQPARSLAFAAGDARLAVHVASRCRQASSARGTRAVATMAKKSVGDLTEADLEGKRVFVRADLNVPLDENQNITDDTRVRAAVPTIQYLIGKGAKVILSSHLGRPKGVTPKFSLAPIVPRLSELLGIQVQKADDVIGPEVEKLVSALPNGGVLLLENVRFYKEEEKNDPEFAQKLASLADLYVNDAFGTAHRAHASTEGVTKFLKPSVAGFLLQKELDYLVGAVSSPKRPFAAIVGGSKVSSKIGVIESLLEKCDILLLGGGMIFTFYKAQGLSVGASLVEEDKLELATSLLAKAKEKGVSLMLPTDVVIADKFAPDANSQIVPASAIPDGWMGLDIGPDSVASFNAALDTTQTVIWNGPMGVFEFDKFAVGTEAVAKKLAELSGKGVTTIIGGGDSVAAVEKVGVADVMSHISTGGGASLELLEGKELPGVIALDEAVVTV

SEQ ID NO: 9709 - protein, 480 aa, Zea mays
MASAAAPPTSLSLAARAATRAAAAAAAPLRRGGLATACQPARSLAFAAGDARLAVHVASRCRQAFSGRGTRAMATMAKKSVGELTEADLEGKRVFVRADLNVPLDENQNITDDTRIRAAIPTIQYILSKGAKVILSSHLGRPKGFTPKFSLAPLVGRLSELLGIQVQKADDVIGPEVEKLVAALPNGGVLLLENVRFYKEEEKNDPEFAQKLASLADLYVNDAFGTAHRAHASTEGVTKFLQPSVAGFLLQKELDYLVGAVSSPKRPFAAIVGGSKVSSKIGVIESLLEKCDILLLGGGMIFTFYKAQGLPVGASLVEEDKLELATSLLAKAKEKGVSLMLPTDVVIADKFAPDANSQIVPASAIPDGWMGLDIGPDSVASFNAALDTTKTVIWNGPMGVFEFDKFAVGTEAVAKKLAELSGKGVTTIIGGGDSVAAVEKVGVADVMSHISTGGGASLELLEGKELPGVVALNEAATVTV

SEQ ID NO: 9710 - protein, 480 aa, Panicum virgatum
PAAHPTSLSIAARAATRAAAAAAAAATPLRRGGLAAACQPARSLAFTAADARLAVHVASRCRQASSARGTRAVATMAKKSVGDLTEADLEGKRVFVRADLNVPLDENQNITDDTRIRAAVPTIQYLIGKGAKVILSSHLGRPKGVTPKFSLAPIVPRLSELLGIQVQKADDCIGPEVEKLVSALPNGGVCLLENVRFYKEEEKNDPEFAQKLASLADLYVNDAFGTAHRAHASTEGVTKFLKPSAAGFLLQKELDYLVGAVSSPKRPFAAIVGGSKVSSKIGVIESLLEKCDILLLGGGMIFTFYKAQGLSVGSSLVEEDKLELATSLLAKAKEKGVSLMLPTDVVIADKFAPDANSQIVPASSIPDGWMGLDIGPDSIASFNAALDTTQTIIWNGPMGVFEFDKFAVGTEAVAKKLAELSGKGVTTIIGGGDSVAAVEKVGVADVMSHISTGGGASLELLEGKELPGVVALDEAVPVTV

SEQ ID NO: 9711 - protein, 477 aa, Zea mays
MASAAAPPTSLSLAARAASRAAAAPLRRGGLAAARQPARSLAFAAGDARLAVHVASRCRQASSARGTRAMATMAKKSVGDLTEADLKGKRVFVRADLNVPLDENQNITDDTRIRAAIPTIQYLLGKGAKVILSSHLGRPKGFTPKFSLAPLVARLSELLGIQVQKADDVIGPEVEKLVAALPNGGVLLLENVRFYKEEEKNDPEFAQKLASVADLYVNDAFGTAHRAHASTEGVTKFLKPSVAGFLLQKELDYLVGAVSSPTRPFAAIVGGSKVSSKIGVIESLLEKCDILLLGGGMIFTFYKAQGLSVGASLVEEDKLDLATSLLAKAKEKGVSLMLPTDVVIADKFAPDANSQIVPASAIPDGWMGLDIGPDSIAAFNAALETTQTVIWNGPMGVFEYDKFAIGTEAVAKKLAELSRKGVTTIIGGGDSVAAVEKVGVADVMSHISTGGGASLELLEGKELPGVTALDEAATVTV

SEQ ID NO: 9712 - protein, 484 aa, Oryza sativa
MASAAAPTTSSLSLAARRAAAVGPAAASPLRRGGLAAGCQPARSLAFAAAADPRLATHVASRCRQAASSSSRGTRAVATMAKKSVGDLTAADLEGKRVFVRADLNVPLDDNQNITDDTRVRAAIPTIQYLIKNGAKVILSSHLGRPKGVTPKFSLAPLVPRLSELLGIQVTKAEDVIGPDVEKLVSELPNGSVLLLENVRFYKEEEKNDPEFAKKLASLADLYVNDAFGTAHRAHASTEGVTKFLKPSVAGFLLQKELDYLVGAVSSPKRPFAAIVGGSKVSSKIGVIESLLEKCDILLLGGGMIFTFYKAQGLSVGSSLVEEDKLELATSLLAKAKEKGVSLLLPSDVIIADKFAPDANSQVVPASAIPDGWMGLDIGPDSVASFSSTLETTQTVIWNGPMGVFEFDKFAVGTEAIAKKLADLSGKGVTTIIGGGDSVAAVEKVGVADVMSHISTGGGASLELLEGKELPGVIALDEAVTVAV

SEQ ID NO: 9713 - protein, 482 aa, Leymus cinereus x Leymus triticoides
MASTAAPPAALVVRRAASASAAAAAPLRRAGLAAGCQPARSLAFAAGADPRLAVHVASRCRAASSTRGTRAVATMAKKSVGDLTAADLEGKRVLVRADLNVPLDDNQNITDDTRIRAAIPTIKYLLSNGAKVILTSHLGRPKGVTPKFSLAPLVPRLSELLGIEVKKAEDVIGPEVEKLVADLANGAVLLLENVRFYKEEEKNEPEFAKKLASLADLFVNDAFGTAHRAHASTEGVTKFLKPSVAGFLLQKELDYLDGAVSNPKRPFAAIVGGSKVSSKIGVIESLLEKCDILLLGGGMIFTFYKAQGLSVGSSLVEEDKLELATSLLAKAKAKGVSLLLPSDVVIADKFAPDANSQTVPASAIPDGWMGLDIGPDSVKTFNDALDTTQTIIWNGPMGVFEFDKFAVGTEAVAKKLAELSKKGVTTIIGGGDSVAAVEKVGVADVMSHISTGGGASLELLEGKQLPGVVALDEGVMTRSVTV

SEQ ID NO: 9714 - protein, 481 aa, Triticum aestivum
MASTAAPPAAIVARRAASASVAAAPLRRAGLAAGCQPARSLAFAAGADPRLAVHVASRCRAASAARGTRAVATMAKKSVGDLTAADLEGKRVLVRADLNVPLDDNQNITDDTRIRAAIPTIKYLLSNGAKVILTSHLGRPKGVTPKFSLAPLVPRLSELLGIEVKKAEDVIGPEVEKLVADLANGAVLLLENVRFYKEEEKNDPEFAKKLASLADLFVNDAFGTAHRAHASTEGVTKFLKPSVAGFLLQKELDYLDGAVSNPKRPFAAIVGGSKVSSKIGVIESLLEKCDILLLGGGMIFTFYKAQGLSVGSSLVEEDKLELATSLLAKAKAKGVSLLLPSDVIIADKFAPDANSQTVPASAIPDGWMGLDIGPDSVKTFNDALDTTQTIIWNGPMGVFEFDKFAVGTESIAKKLAELSKKGVTTIIGGGDSVAAVEKVGVADVMSHISTGGGASLELLEGKELPGVVALDEGVMTRSVSV

SEQ ID NO: 9715 - protein, 486 aa, Leymus cinereus x Leymus triticoides
MASTAAPPAALVARRAASASAASASAAAAPLRRAGLAAGCQPARSLAFAAGADPRLAVHVASRCRAASTARGTRAVATMAKKSVGDLTAADLEGKRVLVRADLNVPLDDNQNITDDTRIRAAIPTIKYLLSNGAKVILTSHLGRPKGVTPKFSLAPLVPRLSELLGIEVKKADDVIGPEVEKLVADLANGAVLLLENVRFYKEEEKNEPEFAKKLASLADLFVNDAFGTAHRAHASTEGVTKFLKPSVAGFLLQKELDYLDGAVSNPKRPFAAIVGGSKVSSKIGVIESLLEKCDILLLGGGMIFTFYKAQGLSVGSSLVEEDKLELATSLLAKAKAKGVSLLLPSDVVIADKFAPDANSQTVAASAIPDGWMGLDIGPDSVKTFNDALDTTQTIIWNGPMGVFEFDKFAVGTEAVAKKLAELSKKGVTTIIGGGDSVAAVEKVGVADVMSHISTGGGASLELLEGKQLPGVVALDEGVMTRSVTV

SEQ ID NO: 9716 - protein, 480 aa, Triticum aestivum
MASTAAPPAALVARRAASASVAAPLRGAGLAAGCQPARSLAFAAGADPRLAVHVASRCRAASAARGTRAVATMAKKSVGDLTAADLEGKRVLVRADLNVPLDDNQNITDDTRIRAAIPTIKYLLSNGAKVILTSHLGRPKGVTPKFSLAPLVPRLSELLGIEVKKAEDVIGPEVEKLVADLANGAVLLLENVRFYKEEEKNDPEFAKKLASLADLFVNDAFGTAHRAHASTEGVTKFLKPSVAGFLLQKELDYLDGAVSNPKRPFAAIVGGSKVSSKIGVIESLLEKCDILLLGGGMIFTFYKAQGLSVGSSLVEEDKLELATSLLAKAKAKGVSLLLPSDVIIADKFAPDANSQTVPASAIPDGWMGLDIGPDSVKTFNDALDTTQTIIWNGPMGVFEFDKFAVGTESIAKKLAELSKKGVTTIIGGGDSVAAVEKVGVADVMSHISTGGGASLELLEGKELPGVVALDEGVMTRSVTV

SEQ ID NO: 9717 - protein, 482 aa, Brachypodium distachyon
MASTAASPAALVAARRAASSAASPLRRAGLAAGCQPARSLAFAAGGGADPRLAIHVASRCRAASSARGTRAVATMAKKSVGDLGPADLEGKRVLVRADLNVPLDDSQNITDDTRIRAAIPTIKYLLSNGAKVILTSHLGRPKGVTPKFSLAPLVPRLSELLGIQVQKADDVIGPEVEKLVAALPNGAVLLLENVRFYKEEEKNEPEFAKKLAALADLYVNDAFGTAHRAHASTEGVTNFLKPSVAGFLLQKELDYLDGAVSNPKRPFAAIVGGSKVSSKIGVIESLLEKCDILLLGGGMIFTFYKAQGLSVGSSLVEEDKLELATSLLAKAKEKGVSLLLPSDVVIADKFAPDANSQTVAASAIPDGWMGLDIGPDSVATFNAALETTQTIIWNGPMGVFEFDKFAVGTEAVAKKLAELSKKGVTTIIGGGDSVAAVEKVGVADVMSHISTGGGASLELLEGKQLPGVVALDEAVTVGSVTV

SEQ ID NO: 9718 - protein, 479 aa, Avena sativa
MASTAAPPAALVARRAASTAAPLRRAGLAAGCQPARSLAFAASGAAGADPRLAIHVASRCRAASSARGTRAVATMAKKSVGDLGAAELEGKRVLVRADLNVPLDDAQNITDDTRIRAAIPTIKYLLEKGAKVILSSHLGRPKGVTPKFSLAPLVPRLSELLGITVTKADDVIGPEVEKLVAALPNGSVLLLENVRFYKEEEKNEPEFAKKLAALADLYVNDAFGTAHRAHASTEGVTKFLKPSVAGFLLQKELDYLDGAVSNPKRPFAAIVGGSKVSSKIGVIESLLEKCDILLLGGGMIFTFYKAQGLSVGSSLVEEDKLELATSLLAKAKAKGVSLLLPSDVVIADKFAPDANSQTVAASAIPDGWMGLDIGPDSVKTFNDALETTQTVIWNGPMGVFEFDKFAVGTEAVAKKLAELSKKGVTTIIGGGDSVAAVEKVGVADVMSHISTGGGASLELLEGKQLPGVVALDEAVAVTV

SEQ ID NO: 9719 - protein, 296 aa, Triticum aestivum
MASTAAPPAALVARRAASASVAAPLRGAGLAAGCQPARSLAFAAGADPRLAVHVASRCRAASAARGTRAVATMAKKSVGDLTAADLEGKRVLVRADLNVPLDDNQNITDDTRIRAAIPTIKYLLSNGAKVILTSHLGRPKGVTPKFSLAPLVPRLSELLGIEVKKAEDVIGPEVEKLVADLANGAVLLLENVRFYKEEEKNDPEFAKKLASLADLFVNDAFGTAHRAHASTEGVTKFLKPSVAGFLLQKELDYLDGAVSNPKRPFAAIVGGSKVSSKIGVIESLLEKCDILLWLVV

SEQ ID NO: 9720 - protein, 478 aa, Hordeum vulgare
MASTAAQPAALVARRVASAAAPLRRAGLAAGCQPARSLAFAAGADPRLAVHVASRCRAASAARGARAVATMAKKSVGDLTAADLEGKRVLVRADLNVPLDDNQNITDDTRIRAAIPTIKYLLTNGAKVILTSHLGRPKGVTPKFSLAPLVPRLSELLGIEVKKADDVIGPEVEKLVADLANGAVLLLENVRFYKEEEKNDPEFAKKLASLADLFVNDAFGTAHRAHASTEGVTKFLKPSVAGFLLQKELDYLDGAVSNPKRPFAAIVGGSKVSSKIGVIESLLEKCDILLLGGGMIFTFYKAQGLSVGSSLVEEDKLELATSLLAKAKAKGVSLLLPSDVVIADKFAPDANSQTVAASAIPDGWMGLDIGPDSVKTFNDALDTTQTIIWNGPMGVFEFDKFAVGTEAVAKKLAELSKKGVTTIIGGGDSVAAVEKVGVADVMSHISTGGGASLELLEGKQLPGVVALDEGVVTSSVAV

SEQ ID NO: 9721 - protein, 469 aa, Triticum aestivum
VARRAASASVAAPLRGAGLAAGCQPARSLAFAAGADPRLAVHVASRCRAASAARGTRAVATMAKKSVGDLTAADLEGKRVLVRADLNVPLDDNQNITDDTRIRAAIPTIKYLLSNGAKVILTSHLGRPKGVTPKFSLAPLVPRLSELLGIAVKKAEDVIGPEVEKLVADLENGAVLLLENVRFYKEEEKNDPEFAKKLASLADLFVNDAFGTAHRAHASTEGVTKFLKPSVAGFLLQKELDYLDGAVSNPKRPFAAIVGGSKVSSKIGVIESLLEKCDILLLGGGMIFTFYKAQGLSVGSSLVEEDKLELATSLLAKAKAKGVSLLLPSDVIIADKFAPDANSQTVPASAIPDGWMGLDIGPDSVKTFNDALDTTQTIIWNGPMGVFEFDKFAVGTESIAKKLAELSKKGVTTIIGGGDSVAAVEKVGVADVMSHISTGGGASLELLEGKELPGVVALDEGVMTRSVTV

SEQ ID NO: 9722 - protein, 467 aa, Triticum aestivum
RRAASASVAAPLRGAGLAAGCQPARSLAFAAGADPRLAVHVASRCRAASAARGTRAVATMAKKSVGDLTAADLEGKRVLVRADLNVPLDDNQNITDDTRIRAAIPTIKYLLSNGAKVILTSHLGRPKGVTPKFSLAPLVPRLSELLGIAVKKAEDVIGPEVEKLVADLENGAVLLLENVRFYKEEEKNDPEFAKKLASLADLFVNDAFGTAHRAHASTEGVTKFLKPSVAGFLLQKELDYLDGAVSNPKRPFAAIVGGSKVSSKIGVIESLLEKCDILLLGGGMIFTFYKAQGLSVGSSLVEEDKLELATSLLAKAKAKGVSLLLPSDVIIADKFAPDANSQTVPASAIPDGWMGLDIGPDSVKTFNDALDTTQTIIWNGPMGVFEFDKFAVGTESIAKKLAELSKKGVTTIIGGGDSVAAVEKVGVADVMSHISTGGGASLELLEGKELPGVVALDEGVMTRSVTV

SEQ ID NO: 9723 - protein, 431 aa, Pennisetum glaucum
DARLAVHVASRCRQEASARGTRAVATMAKKSVGDLTEADLEGKRVFVRADLNVPLDENQNITDDTRIRAAVPTIQYLISKGAKVILSSHLGRPKGVTPKFSLAPIVPRLSELLGIQVQKADDVIGPEVEKLVSSLPNGSVALLENVRFYKEEEKNDPEFAQKLASLADLYVNDAFGTAHRAHASTEGVTKFLKPAVAGFLLQKELDYLVGAVSSPKRPFAAIVGGSKVSSKIGVIESLLEKCDILLLGGGMIFTFYKAQGLSVGASLVEEDKLELAASLLAKAKEKGVSLMLPTDVVIADKFAPDANSQIVPASAIPDGWMGLDIGPDSVASFNAALDTTQTAIWNGPMGVFEFDKFAVGTEAVAKKLAELSGKGVTTIIGGGDSVAAVEKVGVADVMSHISTGGGASLELLEGKELPGVVALDEAVVTVS

SEQ ID NO: 9724 - protein, 458 aa, Triticum aestivum
APLRRAGLAAGCQPARSLAFAAGADPRLAVHVASRCRAASAARGTRAVATMAKKSVGDLTAADLEGKRVLVRADLNVPLDDNQNITDDTRIRAAIPTIKYLLSNGAKVILTSHLGRPKGVTPKFSLAPLVPRLSELLGIAVKKAEDVIGPEVEKLVADLENGAVLLLENVRFYKEEEKNDPEFAKKLASLADLFVNDAFGTAHRAHASTEGVTKFLKPSVAGFLLQKELDYLDGAVSNPKRPFAAIVGGSKVSSKIGVIESLLEKCDILLLGGGMIFTFYKAQGLSVGSSLVEEDKLELATSLLAKAKAKGVSLLLPSDVIIADKFAPDANSQTVPASAIPDGWMGLDIGPDSVKTFNDALDTTQTIIWNGPMGVFEFDKFAVGTESIAKKLAELSKKGVTTIIGGGDSVAAVEKVGVADVMSHISTGGGASLELLEGKELPGVVALDEGVMTRSVTV

SEQ ID NO: 9725 - protein, 460 aa, Pseudoroegneria spicata
  misc_feature (4)..(4): Xaa can be any naturally occurring amino acid
AAAXFRRAGLAAGCQPARSLAFAAGADPRLAVHVASRCRAASSVRGTRAVATMAKKSVGDLTAADLEGKRVLVRADLNVPLDDNQNITDDTRIRAAIPTIKYLLSNGAKVILTSHLGRPKGVTPKFSLAPLVPRLSELLGIEVKKADDVIGPEVEKLVAELANGAVLLLENVRFYKEEEKNEPEFAKKLASLADLFVNDAFGTAHRAHASTEGVTKFLKPSVAGFLLQKELDYLDGAVSNPKRPFAAIVGGSKVSSKIGVIESLLEKCDILLLGGGMIFTFYKAQGLSVGSSLVEEDKLELATSLLAKAKEKGVSLLLPSDVVIADKFAPDANSQTVPASAIPDGWMGLDIGPDSVKTFNDALDTTQTIIWNGPMGVFEFDKFAVGTEAIAKKLAELSKKGVTTIIGGGDSVAAVEKVGVADVMSHISTGGGASLELLEGKQLPGVVALDEGAMMRSVTV

SEQ ID NO: 9726 - protein, 408 aa, Saccharum officinarum
MATMAKKSVGDLTEADLEGKRVFVRADLNVPLDENQNITDDTRIRAAVPTIQYLLSKGAKVILSSHLGRPKGFTPKFSLGPIVGRLSELLGIQVQKADDVIGPEVEKLVSALPNGGVLLLENVRFYKEEEKNDPEFAQKLASLADLYVNDAFGTAHRAHASTEGVTKFLKPSVAGFLLQKELDYLVGAVSSPKRPFAAIVGGSKVSSKIGVIESLLEKCDILLLGGGMIFTFYKAQGLSVGASLVEEDKLDLATSLLAKAKEKGVSLLLPADVVIADKFAPDANSQIVPASAIPDGWMGLDIGPDAVTSFNAALDTCQTVIWNGPMGVFEFDKFAVGTEAVAKKLAELSTKGVTTIIGGGDSVAAVEKVGVADVMSHISTGGGASLELLEGKELPGVVALDEAVPVAV

SEQ ID NO: 9727 - protein, 408 aa, Panicum virgatum
MATMAKKSVGDLTEADLEGKRVFVRADLNVPLDENQNITDDTRIRAAVPTIQYLIGKGAKVILSSHLGRPKGVTPKFSLAPIVPRLSELLGIQVQKADDVIGPEVEKLVSAMPNGSVTLLENVRFYKEEEKNDPEFAQKLASLADLYVNDAFGTAHRAHASTEGVTKFLKPSVAGFLLQKELDYLVGAVSSPKRPFAAIVGGSKVSSKIGVIESLLEKCDILLLGGGMIFTFYKAQGLSVGSSLVEEDKLELATSLLAKAKEKGVSLMLPTDVVIADKFAPDANSQTVPASSIPDGWMGLDIGPDSIASFNAALDTTQTIIWNGPMGVFEFDKFAVGTEAVAKKLAELSGKGVTTIIGGGDSVAAVEKVGVADVMSHISTGGGASLELLEGKELPGVVALDEATTVTV

SEQ ID NO: 9728 - protein, 199 aa, Oryza sativa
MASAAAPTTSSLSLAARRAAAVGPAAASPLRRGGLAAGCQPARSLAFAAAADPRLATHVASRCRQAASSSARGTRAVATMAKKSVGDLTAADLEGKRVFVRADLNVPLDDNQNITDDTRVRAAIPTIQYLIKNGAKVILSSHLGRPKGVTPKFSLAPLVPRLSELLGIQVSALLLFLIESLRANLITLIKPYLYSQTGD

SEQ ID NO: 9729 - protein, 482 aa, Setaria italica
MASAAAPASFSLARPAVRRALASAATATVKFRRAGLAAACPPARSLGSFSLGDGADRRLPIHVPPRCRSESSAGREARAAATMAKKSVGDLAAADLEGKRVLVRADLNVPLDDRQNITDDTRVRAAIPTIKHLVTNGAKVILCSHLGRPKGVTAKFSLAPLVPRLSELLGIQVQKADDVIGPEVEKLVSELPNGSILLLENVRFYKEEEKNDPEFAKKLASLADLYVNDAFGTAHRAHASTEGVTKFLKPSVAGFLLQKELDYLVGAVSNPKPPFAAIVGGSKVSSKIGVIESLLAKCDILLLGGGMIFTFYKAQGFSVGSSLVEADKLELATSLLSKAKEKGVSLMLPTDVVVADKFAPDARSQVVPASAIPDGWMGLDIGPDSISAFSSALETTQTVIWNGPMGVFEFKKFAVGTEAIAKKLAELSGKGVTTIIGGGDSVAAVEKVGVADVMSHISTGGGASLELLEGRELPGVVALDEA

SEQ ID NO: 9730 - protein, 479 aa, Ricinus communis
MASATAPTTLSLLKTTASSSSTTRARASLLPVSGLRPTTLRRLGFAAADPAFSHHVASKIRSFGSGKASRAVVSMAKKSVGDLTAADLKGKKVFVRADLNVPLDDNQKITDDTRIRAAIPTVKHLIQNGAKVILSSHLGRPKGVTPKFSLAPLVPRLSELLGIQVVKADDCIGPEVEKLVASLPEGGVLLLENVRFYKEEEKNEPEFAKKLASLADLYVNDAFGTAHRAHASTEGVTKFLKPSVAGFLLQKELDYLVGAVSSPKRPFAAIVGGSKVSSKIGVIESLLEKCDILLLGGGMIFTFYKAQGLSVGSSLVEEDKLDLATSLLAKAKLKGVSLLLPTDVVIADKFAPDANSKVVAASAIPDGWMGLDVGPESVKTFNEALETTKTVIWNGPMGVFEFDKFAVGTEAIAKKLAELSGKGVTTIIGGGDSVAAVEKVGVAEVMSHISTGGGASLELLEGKELPGVLALDEATPVAV

SEQ ID NO: 9731 - protein, 483 aa, Cleome gynandra
MASAAASTALSLLKSSGGVASSAATRARASLLPVPSSALAASSSRRLGFSAVVDSRFSAHVASKVRSVRGKGTRGVVSMAKKSVGDLTSADLKGKKVFVRADLNVPLDDNQNITDDTRIRAAIPTIKYLIENGAKVILSSHLGRPKGVTPKYSLTPLVPRLSELLGIQVVKADDCIGPEVESLVASLPEGGVLLLENVRFYKEEEKNEPEFAKKLASLADLYVNDAFGTAHRAHASTEGVAKFLKPSVAGFLLQKELDYLDGAVSAPKRPFAAIVGGSKVSSKIGVIESLLEKCDILLLGGGMIFTFYKAQGLSVGASLVEEDKLDLATSLLEKAKAKGVSLLLPTDVVVADKFAPDANSKIVAASAIPDGWMGLDIGPDSVKTFNHALDSTQTIIWNGPMGVFEFDKFAVGTEAVAKKLAELSGKGVTTIIGGGDSVAAVEKVGVAGVMSHISTGGGASLELLEGKELPGVNALEEATPVAV

SEQ ID NO: 9732 - protein, 510 aa, Festuca arundinacea
GTRHKAAFFTTPTPSPTSSPLYPSPIPAPMASTAAPPAALVARRAAAASTAAPLRRAGLAAGCQPARSLAFAASGAAGADPRLAIHVASRCRAASSARGTRAVATMAKKSVGDLGAAELEGKRVLVRADLNVPLDDNQNITDDTRIRAAIPTIKYLLEKGAKVILSSHLGRPKGVTPKFSLAPLVPRLSELLGITVTKADDVIGPEVEKLVAALPNGAVLLLENVRFYKEEEKNEPEFAKKLAALADLYVNDAFGTAHRAHASTEGVTKFLKPSVAGFLLQKELDYLDGAVSNPKRPFAAIVGGSKVSSKIGVIESLLEKCDILLLGGGMIFTFYKAQGLSVGSSLVEEDKLELATTLLAKAKAKGVSLLLPSDVVIADKFAPDANSQTVAASAIPDGWMGLDIGPDSVKTFNDALDTTQTIIWNGPMGVFEFDKFAVGTEAVAKKLAELSKKGVTTIIGGGDSVAAVEKVGVADVMSHISTGGGASLELLEGKQLPGVVALDEAVTVTV

SEQ ID NO: 9733 - protein, 474 aa, Citrus sinensis
MASATAPTTLSLVKTAASSSLSSPRASFLRMPTSASRRLGFSAADPLLTCHVASRLSSIKTKGTRAVVSMAKKSVGELSGADLKGKKVFVRADLNVPLDDNQNITDDTRIRAAVPTIKHLIQNGAKVILSSHLGRPKGVTPKFSLAPLVPRLSELLGIQVVKADDCIGPEVEKLVASLPEGGVLLLENVRFYKEEEKNDPEFAKKLASLADLYVNDAFGTAHRAHASTEGVTKYLKPSVAGFLLQKELDYLVGAVSSPKRPFAAIVGGSKVSSKIGVIESLLETCDILLLGGGMIFTFYKAQGISVGSSLVEEDKLDLATTLLAKAKAKGVNLLLPSDVVIADKFAPDANSKVVPATAIPDGWMGLDIGPDSVKTFNEALDTTKTVIWNGPMGVFEFDKFAVGTEAIAKKLADLSGKGVTTIIGGGDSVAAVEKVGVAGVMSHISTGGGASLELLEGKELPGVVALDEATPVAV

SEQ ID NO: 9734 - protein, 481 aa, Populus trichocarpa
MASATAPTTLSLLKTAAASTSTSARASLLPVSTSGLRTTSLRGLGFSAADPLFSSHVVSKIRSFKSNGRAPRAVVSMAKKSVGDLTAADLKGKKVFVRADLNVPLDENQKITDDTRIRAAVPTIKYLISKGAKVILSSHLGRPKGVTPKFSLAPLVPRLSELLGIQVVKADDCIGPEVEKLVASLPEGGVLLLENVRFYKEEEKNEPEFAKKLASMADLYVNDAFGTAHRAHASTEGVTKFLKPSVAGFLLQKELDYLVGAVSNPKRPFAAIVGGSKVSSKIGVIESLLEKCDILLLGGGMIFTFYKAQGLAVGSSLVEEDKLDLATTLLEKAKAKGVSLLLPSDVVIADKFAPDANSKTVPASAIPDGWMGLDIGPESVKTFSEALGTTQTVIWNGPMGVFEFEKFANGTEAIAKKLAELSGKGVTTIIGGGDSVAAVEKVGVADVMSHISTGGGASLELLEGKELPGVLALDEVERVAV

SEQ ID NO: 9735 - protein, 484 aa, Eucalyptus grandis
MASAAAPTAFSLLSSSASASSSSSSSSTSGSALLHLRSSGLRSSGLRRLGFAAADPFLAAHVASKLRSLRGKGSRGVVSMAKKSVGDLTGPALKGKKVFVRADLNVPLDDNQNITDDTRVRAAVPTIKYLIQNGARVILSSHLGRPKGVTPKYSLAPLVPRLSELLGIQVVKADDCIGPEVEKLVASLPEGGVLLLENVRFYKEEEKNEPEFAKKLASLADLYVNDAFGTAHRAHASTEGVTKFLKPSVAGFLLQKELDYLVGAVSTPKRPFAAIVGGSKVSSKIGVIESLLEKCDILLLGGGMIFTFYKAQGLSVGSSLVEEDKLDLATSLLKKAKAKGVSLLLPTDVVIADKFAPDANSKIVPASAIPDGWMGLDIGPDSIKTFNDALGTTKTVIWNGPMGVFEFDKFAAGTEAVAKKLAELSAAGVTTIIGGGDSVAAVEKVGVADVMSHISTGGGASLELLEGKELPGVVALDEATPVPV

SEQ ID NO: 9736 - protein, 474 aa, Unknown
  Sequence found in Organisms: Citrus sinensis, Citrus clementina
MASATAPTTFSLVKTAASSSLSSPRASFLRMPTSASRRLGFSAADPLLTCHVASRLSSIKTKGTRAVVSMAKKSVGELSGADLKGKKVFVRADLNVPLDDNQNITDDTRIRAAVPTIKHLIQNGAKVILSSHLGRPKGVTPKFSLAPLVPRLSELLGIQVVKADDCIGPEVEKLVASLPEGGVLLLENVRFYKEEEKNDPEFAKKLASLADLYVNDAFGTAHRAHASTEGVTKYLKPSVAGFLLQKELDYLVGAVSSPKRPFAAIVGGSKVSSKIGVIESLLETCDILLLGGGMIFTFYKAQGISVGSSLVEEDKLDLATTLLAKAKAKGVNLLLPSDVVIADKFAPDANSKVVPATAIPDGWMGLDIGPDSVKTFNEALDTTKTVIWNGPMGVFEFDKFAVGTEAIAKKLADLSGKGVTTIIGGGDSVAAVEKVGVAGVMSHISTGGGASLELLEGKELPGVVALDEATPVAV

SEQ ID NO: 9737 - protein, 478 aa, Vitis vinifera
MASAAASPSSLSLLHSTSAARSSPRLPSASLRLPTLPLRRLGFAGAAADSLLTLHVASRTRSFRGKASRGVVSMAKKSVGDLTGADLKGKKVFVRVDLNVPLDDNQKITDDTRVRAAIPTIKYLIDNGAKVILSSHLGRPKGVTPKFSLAPLVPRLSELLGIQIVKADDCIGPEVEKLVTALPDGGVLLLENVRFYKEEEKNEPEFAKKLASIADLYVNDAFGTAHRAHASTEGVTKFLKPSVAGFLLQKELDYLVGAVSSPKRPFAAIVGGSKVSSKIGVIESLLEKCDILLLGGGMIFTFYKAQGLSVGSSLVEEDKLSLATSLLEKAKAKGVSLLLPTDVVIADKFAPDANSKIVPASAIPDGWMGLDIGPDSIKIFNEALETTKTVIWNGPMGVFEFDKFAEGTVAVAKKLAELSGKDVTTIIGGGDSVAAVEKVGVADVMSHISTGGGASLELLEGKELPGVVALDEATPVPV

SEQ ID NO: 9738 - protein, 483 aa, Glycine max
MASAAAPTTFSLLHSTTPASSSSATSASPSRVQLSSSLRSRPLARRLGFAAADPLLAANVAARVAAVRGGKGARGVVSMAKKSVGELSAADLKGKKVFVRADLNVPLDDNQNITDDTRIRAAIPTIKHLIQNGAKVILSSHLGRPKGVTPKYSLAPLVPRLSELIGIQVVKAEDSIGPEVEKLVASLPDGGVLLLENVRFYKEEEKNDPEHAKKLASLADLFVNDAFGTAHRAHASTEGVTKYLKPSVAGFLLQKELDYLVGAVSSPKRPFAAIVGGSKVSSKIGVIESLLEKVDILLLGGGMIFTFYKAQGLSVGSSLVEEDKLDLATSLLAKAKEKGVSLLLPSDVVIADKFAPDANSKVVPASAIPDGWMGLDIGPDSVKSFSEALDTTQTIIWNGPMGVFEFDKFAVGTEAIAKKLADLSGKGVTTIIGGGDSVAAVEKVGVASVMSHISTGGGASLELLEGKELPGVLALDEAVPVAV

SEQ ID NO: 9739 - protein, 480 aa, Catharanthus roseus
MASAAAPHTLCGIRTASSSNARATLSAPTTRFLLKTPLRRLGFSGAAADPIFTHHVATKLRSLKASGKPVRGVASMAKKSVGDLSAADLKGKKVFVRADLNVPLDDNQNITDDTRIRAAVPTIKHLISNGAKVILSSHLGRPKGVTPKFSLAPLVPRLSELLGIQVVKADDCIGPEVEKLVASLPDGGVLLLENVRFYKEEEKNEPEFAKKLASLADLYVNDAFGTAHRAHASTEGVTKFLKPSVAGFLLQKELDYLVGAVSSPKRPFAAIVGGSKVSSKIGVIESLLEKCDILLLGGGMIFTFYKAQGLSVGSSLVEEDKLELATSLLAKAKAKGVSLLLPSDVVVADKFAPDAESKVVPASAIPDGWMGLDIGPDSVKTFNDALDTTKTVIWNGPMGVFEFDKFAVGTESIAKKLAELSGKGVTTIIGGGDSVAAVEKVGVAGVMSHISTGGGASLELLEGKELPGVIALEEAATVAV

SEQ ID NO: 9740 - protein, 477 aa, Phaseolus coccineus
MASAAAPTTFSLLHSATPAASSSSRVQLSSSLRVRPLTRRLGFTAADPLLAANVAARVAAVKVGRGRRGVVSMAKKSVGDLSAADLKGKKVFVRADLNVPLDDNQNITDDTRIRAAIPTIKYLIQNGAKVILSSHLGRPKGVTPKYSLGPLVPRLSELIGFPVVKAEDSIGPEVEKLVASLPDGGVLLLENVRFYKEEEKNDPEHAKKLASLADLFVNDAFGTAHRAHASTEGVTKFLKPSVAGFLLQKELDYLVGAVSSPKRPFAAIVGGSKVSSKIGVIESLLEKVDILLLGGGMIFTFYKAQGLSVGSSLVEEDKLDLATTLLAKAKEKGVSLLLPSDVVIADKFAPDANSKVVPASAIPDGWMGLDIGPDSVKSFNEALDTTKTIIWNGPMGVFEFDKFAVGTEAIAKKLADLSEKGVTTIIGGGDSVAAVEKVGVANVMSHISTGGGASLELLEGKELPGVVALDEATPVPV

SEQ ID NO: 9741 - protein, 481 aa, Populus trichocarpa
MASATAPTTLSLLKTAASSTSTSVRASLLPVSTSGLRTTSLRGLGFSAADTLFSSHVVSKIRSFKSNGKAPRAVVSMAKKSVGDLTAADLKGKKVFVRADLNVPLDDNQNITDDTRIRAAIPTIKYLISNGAKVILSSHLGRPKGVTPKFSLAPLVPRLSELLGIQVVKADDCIGPEVEKLVASLPDGGVLLLENVRFYKEEEKNEPEFAKKLASLADLYVNDAFGTAHRAHASTEGVTKFLKPSVSGFLLQKELDYLVGAVSTPKRPFAAIVGGSKVSSKIGVIESLLEKCDILLLGGGMIFTFYKAQGLPVGSSLVEEDKLGLATSLLEKAKAKGVSLLLPSDVIIADKFAPDANSKIVPASAIPDGWMGLDIGPESVKTFSEALGTTQTVIWNGPMGVFEFDKFAVGTEAIAKKLAELSGKGVTTIIGGGDSVAAVEKVGVADVMSHISTGGGASLELLEGKELPGVLALDEVERVAV

SEQ ID NO: 9742 - protein, 479 aa, Musa acuminata
MASTAATSFSLLPTSSSRRRVAAVVAPSRLTLRSPSRRLGFAGVAADSLLAAHVAAKIRTVAGRSGKGPRGVAVMAKKSVGDLTAADLKGKKVFVRADLNVPLDEDRNITDDTRIRAAVPTIKHLISNGAKVILSSHLGRPKGVTPKFSLSPLVPRLSELLGIKVEKADDCIGPEVEKLVNALPEGGVLLLENVRFYKEEEKNEPEFAKKLAALADLYVNDAFGTAHRAHASTEGVTKFLKPSVAGFLLQKELDYLVGAVSNPKRPFAAIVGGSKVSSKIGVIESLLEKCDILLLGGGMIFTFYKAQGFPVGSSLVEDDKLELATSLLAKAKAKGVSLLLPTDVVIADKFAPDAQSKVVPASEIPDGWMGLDVGPDSVKTFNDALDTTKTIIWNGPMGVFEFDKFATGTEAIAKKLAELSGKGVTTIIGGGDSVAAVEKVGVADVMSHISTGGGASLELLEGKELPGVVALDEAVVVAV

SEQ ID NO: 9743 - protein, 480 aa, Musa acuminata
MASTAATSFSLLPTSSRRRSTTAAALLSGAVALRSPLRRLGFAGAAADPLLAAHVAAKIRSVAGRSGKGSRGVASMAKKSVGDLTAADLKGKKVFVRADLNVPLDENRNITDDTRIRAAVPTIKHLISNGAKVILSSHLGRPKGVTPKFSLNPIVPRLSELLGIKVEKADDCIGPEVEKLVNALPEGGVLLLENVRFYKEEEKNDPEFAKKLGALADLYVNDAFGTAHRAHASTEGVTKFLKPSVAGFLLQKELDYLVGAVSTPKRPFAAIVGGSKVSSKIGVIESLLEKCDILLLGGGMIFTFYKAQGFSVGSSLVEDDKLELASSLLAKAKAKGVSLLLPTDVIIADKFAADAESKVVPASEIPDGWMGLDIGPDSVKTFSDALDTTKTIIWNGPMGVFEFDKFAVGTESIAKKLAELSGKGVTTIIGGGDSVAAVEKVGVADVMSHISTGGGASLELLEGKELPGVVALDEAVAVAV

SEQ ID NO: 9744 - protein, 481 aa, Nicotiana benthamiana
MASATASHSLCGIPATSSSTTNKSIAPSSARFLAKTPPRGLGFAGAAADSLFTNHVATKLRSLKSSSKPVRGVASMAKKSVGDLTAAELKGKNVFVRADLNVPLDDNQNITDDTRIRAAVPTIKHLMANGAKVILSTHLGRPKGVTPKYSLAPLVPRLSELLGIQVVKAEDCIGPEVEKLVASLPEGGVLLLENVRFYKEEEKNEPEFAKKLASLADLYVNDAFGTAHRAHASTEGVTKFLKPSVAGFLLQKELDYLVGAVSNPKRPFAAIVGGSKVSSKIGVIESLLEKCDILLLGGGMIFTFYKAQGLSVGSSLVEEDKLELATSLLEKAKAKGVSLLLPSDVVIADKFAPDANSKIVPASAIPDGWMGLDIGPDSVKTFNDALDTTKTVIWNGPMGVFEFDKFAVGTEAIAKKLADLSGKGVTTIIGGGDSVAAVEKVGVASVMSHISTGGGASLELLEGKVLPGVVALDEADAPVAV

SEQ ID NO: 9745 - protein, 490 aa, Elaeis guineensis
MASAASPTSLSLRLSCSASTSPSSSRRQVAAVSFPASRGAVALRSAVHRLGFAGAAADPLLAIHVAAKIRAVTGQSGRGPRGVAAMAKKSVGDLTAADLKGKRVFVRADLNVPLDENQNITDDTRIRAAVPTIKHLMGKGAKVILSSHLGRPKGVTPKYSLSPLVPRLSELLGIKVEKADDCIGPEVEKMVAALPEGGVLLLENVRFYKEEEKNEPEFAKKLASLADLYVNDAFGTAHRAHASTEGVTKFLKPSVAGFLLQKELDYLVGAIANPKRPFAAIVGGSKVSSKIGVIESLLEKCDILLLGGGMIFTFYKAQGLSVGSSLVEEDKLELATSLLKKAKSKGVSLMLPTDVVIADKFAADANSKVVPSTAIPDGWMGLDIGPDSVKSFSDALETTKTVIWNGPMGVFEFEKFAVGTEAIAKKLAELSGKGVTTIIGGGDSVAAVEKVGVADVMSHISTGGGASLELLEGKELPGVVALDEAVPVAV

SEQ ID NO: 9746 - protein, 481 aa, Nicotiana tabacum
MASATASHTLCGIPATSSSTTNKAIAPSSARFLAKTPLRRLGFAGAAADSLFTNHVATKLRSLKSSSKPIRGVASMAKKSVGDLTAAELKGKKVFVRADLNVPLDDNQNITDDTRIRAAVPTIKHLMANGAKVILSSHLGRPKGVTPKYSLAPLVPRLSELLGIQVVKAEDCIGPEVEKLVASLPEGGVLLLENVRFYKEEEKNEPEFAKKLASLADLYVNDAFGTAHRAHASTEGVTKFLKPSVAGFLLQKELDYLVGAVSNPKRPFAAIVGGSKVSSKIGVIESLLEKCDILLLGGGMIFTFYKAQGLSVGSSLVEEDKLELATSLLEKAKAKGVSLLLPSDVVIADKFAPDANSKIVPASAIPDGWMGLDIGPDSVKTFNDALDTTKTVIWNGPMGVFEFDKFAVGTEAIAKKLADLSGKGVTTIIGGGDSVAAVEKVGVASVMSHISTGGGASLELLEGKVLPGVIALDEADAPVAV

SEQ ID NO: 9747 - protein, 481 aa, Manihot esculenta
MASAAAPTTFSLLKTTASSSSTIRARASLLPVSSTGLRSTGLRRLGFSAADPVFGHHVASKIHSFGSGKASRAVVSMAKKSVGDLTAADLKGKKVFVRADLNVPLDDNQKITDDTRVRAAIPTIKHLIQNGAKVILSSHLGRPKGVTPKFSLAPLVPRLSELLGIQVVKADDCIGPEVEKLLASLPEGGVLLLENVRFYKEEEKNEPEFAKKLASLADLYVNDAFGTAHRAHASTEGVTKFLKPSVAGFLLQKELDYLVGAVSNPKRPFAAIVGGSKVSSKIGVIESLLEKCDILLLGGGMIFTFYKAQGLSVGSSLVEEDKLELATSLLEKAKSKGVSLLLPTDVIIADKFAPDANSKVVPASAIPDGWMGLDIGPESVKTFNDALETTKTVIWNGPMGVFEFDKFAVGTEAIAKKLAELSGKGVTTIIGGGDSVAAVEKVGVADVMSHISTGGGASLELLEGKELPGVLALDEATPVAV

SEQ ID NO: 9748 - protein, 482 aa, Manihot esculenta
MASAAAPTTLSLLKTTSSSSSSSTRARPSLLPVSSAGLRSTSLRRLGFAAADPILTRHVASKIQSFGSGKASRAVVLMAKKSVGDLTAADLKGKKVFVRADLNVPLDDNQNITDDTRVRAAIPTIKHLIQKGAKVILSSHLGRPKGVTPKFSLAPLVPRLSELLGIQVVKADDCIGPEVEKLVASLPEGGVLLLENVRFYKEEEKNEPEFAKKLASLADLYVNDAFGTAHRAHASTEGVTKFLKPSVAGFLLQKELDYLVGAVSNPKRPFAAIVGGSKVSSKIGVIESLLEKCDILLLGGGMIFTFYKAQGLSVGSSLVEEDKLGLATSLLEKAKSKGVSLLLPSDVVIADKFSPDANSKVVPSSAIPDGWMGLDIGPESVKTFSGALETTKTVIWNGPMGVFEFDKFAVGTEAIAKKLAQLSGKGVTTIIGGGDSVAAVEKVGVADVMSHISTGGGASLELLEGKELPGVLALDEAIPVAV

SEQ ID NO: 9749 - protein, 479 aa, Euphorbia peplus
MASATAPTSLSLLKTTSSSSSSSSRSRSLLPVSGLRSTTLRGLGFAAADPLFSHHVASKIRSFGSGKASRAVVSMAKKSVGDLSAAELKGKRVFVRADLNVPLDDAQNITDDTRIRAAIPTIKHLIQNGAKVILSSHLGRPKGVTPKFSLAPLVPRLSELLGIQVVKADDCIGPEVEKLVASLPEGGVLLLENVRFYKEEEKNEPEFAKKLAALADLYVNDAFGTAHRAHASTEGVTKYLKPSVAGFLLQKELDYLVGAVSTPKRPFAAIVGGSKVSSKIGVIESLLEKCDILLLGGGMIFTFYKAQGLSVGSSLVEEDKLGLATELLAKAKAKGVSLLLPTDVVIADKFAPDANSKVVPASAIPDGWMGLDIGPDSVKTFNDALETTKTVIWNGPMGVFEFDKFAFGTESVAKKLAELSGKGVTTIIGGGDSVAAVEKVGVADVMSHISTGGGASLELLEGKELPGVLALDEATPVAV

SEQ ID NO: 9750 - protein, 485 aa, Glycine max
MASAASPTTFSLLHSATPSSSSTATSASPSPSRVQLTSSLRARPLRRLGFAAADPLLAASVAARVAAVRGGGKGARGVVSMAKKSVGDLSAADLKGKKVFVRADLNVPLDDNQNITDDTRIRAAIPTIKHLIQNGAKVILSSHLGRPKGVTPKYSLAPLVPRLSELIGIQIVKAEDSIGPEVEKLVASLPDGGVLLLENVRFYKEEEKNDPEHAKKLASLADLYVNDAFGTAHRAHASTEGVTKYLKPSVAGFLLQKELDYLVGAVSNPKRPFAAIVGGSKVSSKIGVIESLLEKVDILLLGGGMIFTFYKAQGLSVGSSLVEEDKLDLATSLLAKAKEKGVSLLLPSDVVIADKFAPDANSKVVPASAIPDGWMGLDIGPDSVKSFSEALDTTQTIIWNGPMGVFEFDKFAVGTEAIAKKLADLSGKGVTTIIGGGDSVAAVEKVGVASVMSHISTGGGASLELLEGKELPGVLALDEAVPVAV

SEQ ID NO: 9751 - protein, 480 aa, Tabernaemontana elegans
MASAAAPHTFCAIRTASSSTTRATLNAPTTRFLLKTPLRSLGFAGAAADSIFIHHVATKLRSLKASGKPVRGVASMAKKSVGDLTAADLKGKRVLLRADLNVPLDDNQNITDDTRIRAAIPTIKYLISNGAKVILSSHLGRPKGVTPKFSLAPLVPRLSELLGIQVVKADDCIGPEVEKLVASLPEGGVLLLENVRFYKEEEKNEPEFAKKLASLADLYVNDAFGTAHRAHASTEGVTKFLKPSVAGFLLQKELDYLVGAVSNPTRPFAAIVGGSKVSSKIGVIESLLEKCDILLLGGGMIFTFYKAQGLSVGSSLVEDDKLELATSLLEKAKAKGVSLLLPTDVVVADKFAPDAESKVVPASGIPDGWMGLDIGPESVKTFSDALGTTKTVIWNGPMGVFEFDKFAVGTEAVAKKLAELSGKGVTTIIGGGDSVAAVEKVGVANVMSHISTGGGASLELLEGKQLPGVIALDEAIPVAV

SEQ ID NO: 9752 - protein, 488 aa, Gossypium raimondii
MASATTSTTFSLLKTTASTTSSSASRSSASLIRLPSTRRHLKSSSLIHSLGFSSAASGDSLLSLHVSSKVRSFKGKGSRGVVSMAKKSVGDLTAADLKGKKVFVRADLNVPLDDSQNITDDTRIRAAIPTIKHLIQNGAKVILSSHLGRPKGVTPKFSLAPLVPRLSELLGIQVVKADDCIGPEVEKLVAALPEGGVLLLENVRFYKEEEKNEPEFAKKLASLADLFVNDAFGTAHRAHASTEGVTKFLKPSVAGFLLQKELDYLVGAVSSPKRPFAAIVGGSKVSSKIGVIESLLEKCDILLLGGGMIFTFYKAQGLSVGSSLVEEDKLELATSLLAKAKAKGVSLLLPTDVVIADKFAPDANSKIVPASAIPDGWMGLDIGPDSVKTFNEALDTTQTIIWNGPMGVFEFEKFAVGTEAIAKKLAELSGKGVTTIIGGGDSVAAVEKVGVADVMSHISTGGGASLELLEGKELPGVIALDEAVPVAV

SEQ ID NO: 9753 - protein, 479 aa, Trifolium pratense
MASATAPTTLSLLPTTKSSSGQSVAPSPSRVQLSSFLGARPLRRLGFASADPLLAVQVASKVRSVSGRGMRVVSMAKKSVGDLSAAELKGKKVFVRADLNVPLDDNQNITDDTRIRAAIPTIKHLIQNGAKVILSSHLGRPKGVTPKYSLAPLVPRLSELIGIEVIKAEDSIGPEVEKLVASLPDGGVLLLENVRFYKEEEKNDPEHAKKLAALADLYVNDAFGTAHRAHASTEGVTKYLKPSVAGFLLQKELDYLVGAVSTPKRPFAAIVGGSKVSSKIGVIESLLEKVDILLLGGGMIFTFYKAQGLSVGSSLVEEDKLELATTLIAKAKAKGVSLLLPSDVVIADKFAPDANSQIVPASAIPDGWMGLDIGPDSIKTFNDALDTTKTVIWNGPMGVFEFDKFAVGTEAIAKKLADLSGKGVTTIIGGGDSVAAVEKVGVADVMSHISTGGGASLELLEGKELPGVLALDEAVPVAV

SEQ ID NO: 9754 - protein, 488 aa, Gossypium hirsutum
MASATTSTTLSLLKTTASTTSSSASRSSASLIRLPSTRRHLKSSPLIHSLGFSSAASGDSLLSLHVSSKVRSFKGKGSRGVVSMAKKSVGDLTAADLKGKKVFVRADLNVPLDDSQNITDDTRIRAAIPTIKHLIQNGAKVILSSHLGRPKGVTPKFSLAPLVPRLSELLGIQVVKADDCIGPEVEKLVAALPEGGVLLLENVRFYKEEEKNEPEFAKKLASLADLFVNDAFGTAHRAHASTEGVTKFLKPSVAGFLLQKELDYLVGAVSSPKRPFAAIVGGSKVSSKIGVIESLLEKCDILLLGGGMIFTFYKAQGLSVGSSLVEEDKLELATSLLVKAKAKGVSLLLPTDVVIADKFAPDANSKIVPASAIPDGWMGLDIGPDSVKTFNEALDTTQTIIWNGPMGVFEFDKFAVGTEAIAKKLAELSGKGVTTIIGGGDSVAAVEKVGVADVMSHISTGGGASLELLEGKELPGVIALDEAVPVAV

SEQ ID NO: 9755 - protein, 479 aa, Vinca minor
MASAAAPHTFCGGIRAASSSTTSRASLTTFRFLLKNAPIRRLGFSGAAADPIFTLHLATKLRSLSGKPVRGVASMAKKSVGDLSAADLKGKKVFVRADLNVPLDDNQNITDDTRIRAAIPTIKYLISNGAKVILSSHLGRPKGVTPKYSLAPLVPRLSELLGIQVVKADDCIGPEVEKLVASLPEGGVLLLENVRFYKEEEKNEPEFAKKLASLADIFVNDAFGTAHRAHASTEGVTKFLKPSVAGFLLQKELDYLDGAVSNPKRPFAAIVGGSKVSSKIGVIESLLEKCDILLLGGGMIFTFYKAQGLSVGSSLVEEDKLELATTLLAKAKAKGVSLLLPTDVVVADKFAPDAESKVVPASGIPDGWMGLDIGPDSVKTFNDALDTTKTVIWNGPMGVFEFDKFAVGTEAIAKKLAELSGKGVTTIIGGGDSVAAVEKVGVANVMSHISTGGGASLELLEGKELPGVVALDEAIPVAV

SEQ ID NO: 9756 - protein, 481 aa, Nicotiana benthamiana
MASATASHTLCAIPATSSSTTNKAIAPSSARFLSKTPLRRLGFAGAAADSLFTNHVATKLRSIKSSSKPVRGVASMAKKSVGDLTAAELKGKKVFVRADLNVPLDDSQNITDDTRIRAAVPTIKHLMANGAKVILSSHLGRPKGVTPKYSLAPLVPRLSELLGIQVVKAEDCIGPEVEKLVASLPEGGVLLLENVRFYKEEEKNEPEFAKKLASLADLYVNDAFGTAHRAHASTEGVTKFLKPSVAGFLLQKELDYLVGAVSNPKRPFAAIVGGSKVSSKIGVIESLLEKCDILLLGGGMIFTFYKAQGLSVGSSLVEEDKLELATSLLEKAKEKGVSLLLPSDVVIADKFAPDANSKIVPSSAIPDGWMGLDIGPDSVKTFNDALDTTKTVIWNGPMGVFEFDKFAVGTEAIAKKLADLSGEGVTTIIGGGDSVAAVEKVGVASVMSHISTGGGASLELLEGKVLPGVIALDEADAPVAV

SEQ ID NO: 9757 - protein, 278 aa, Musa acuminata
MASTAATSFSLLPTSSSRRRVAAVVAPSRLTLRSPSRRLGFAGVAADSLLAAHVAAKIRTVAGRSGKGPRGVAVMAKKSVGDLTAADLKGKKVFVRADLNVPLDEDRNITDDTRIRAAVPTIKHLISNGAKVILSSHLGRPKGVTPKFSLSPLVPRLSELLGIKVEKADDCIGPEVEKLVNALPEGGVLLLENVRFYKEEEKNEPEFAKKLAALADLYVNDAFGTAHRAHASTEGVTKFLKPSVAGFLLQKELDYLVGAVSNPKRPFAANCWWLKGVI

SEQ ID NO: 9758 - protein, 479 aa, Medicago truncatula
MASATAPTTISLLPTTKSSSPSTTPCPSRIHLSSFLGARPLRRLGFAAADPLLAVQVASKVRTVSGRGVRGVVSMAKKSVGDLSGAELKGKKVFVRADLNVPLDDNQNITDDTRIRAAIPTIKYLIQNGAKVILSSHLGRPKGVTPKYSLAPLVPRLSELIGIEVIKAEDSIGPEVEKLVASLPDGGVLLLENVRFYKEEEKNDPEHAKKLAALADLYVNDAFGTAHRAHASTEGVTKYLKPSVAGFLLQKELDYLVGAVSSPKRPFAAIVGGSKVSSKIGVIESLLEKVDILLLGGGMIFTFYKAQGLAVGSSLVEEDKLELATTLIAKAKAKGVSLLLPSDVVIADKFAPDANSQIVPASAIPDGWMGLDIGPDSIKTFNEALDTTQTIIWNGPMGVFEFDKFAVGTESIAKKLADLSGKGVTTIIGGGDSVAAVEKVGVADVMSHISTGGGASLELLEGKELPGVLALDEATPVAV

SEQ ID NO: 9759 - protein, 488 aa, Gossypium hirsutum
MASATTSTTLSLLKTTASTTSSSASRSSASLIRLPSTRRHLKSSPLIHSLGFSSAASGDSLLSLHVSSKVRSFKGKGSRGVVSMAKKSVGDLTAADLKGKKVFVRADLNVPLDDSQNITDDTRIRAAIPTIKHLIQNGAKVILSSHLGRPKGVTPKFSLAPLVPRLSELLGIQVVKADDCIGPEVEKLVAALPEGGVLLLENVRFYKEEEKNEPEFAKKLASLADLFVNDAFGTAHRAHASTEGVTKFLKPSVAGFLLQKELDYLVGAVSIPKRPFAAIVGGSKVSSKIGVIESLLEKCDILLLGGGMIFTFYKAQGLSVGSSLVEEDKLELATSLLAKAKAKGVSLLLPTDVVIADKFAPDANSKIVPASAIPDGWMGLDIGPDSVKTFNEALDTTQTIIWNGPMGVFEFEKFAVGTEAIAKKLAELSGKGVTTIIGGGDSVAAVEKVGVADVMSHISTGGGASLELLEGKELPGVIALDEAVPVAV

SEQ ID NO: 9760 - protein, 484 aa, Cajanus cajan
MASAAAPTTFSLLHSAAAGSSASSSSSAAARVQLSSSSLRVRPLSRRLGFAAADPLLAANVAARVAAVRGGSAARGVVSMAKKSVGDLSASDLKGKKVFVRADLNVPLDDNQNITDDTRIRAAVPTIKHLIQNGAKVILSSHLGRPKGVTPKYSLAPLVPRLSELIGIQVVKADDSIGPEVEKLVDALPDGGVLLLENVRFYKEEEKNDPEHAKKLASLADLFVNDAFGTAHRAHASTEGVTKYLKPSVAGFLLQKELDYLVGAVSSPKRPFAAIVGGSKVSSKIGVIESLLEKVDILLLGGGMIFTFYKAQGLSVGSSLVEEDKLELATSLLAKAKAKGVSLLLPSDVVIADKFAPDANSKVVPASAIPDGWMGLDIGPDSVKSFSEALDTTKTIIWNGPMGVFEFDKFAVGTEAIAKKLADLSGKGVTTIIGGGDSVAAVEKVGVASVMSHISTGGGASLELLEGKELPGVLALDEATPVPV

SEQ ID NO: 9761 - protein, 479 aa, Cicer arietinum
MASATAPTTLSLLPTTKSSSPSASPSSSRVHLSSFLGARPLRRLGFAAADPLLAVQVASKLRTVSGRGARGVVSMAKKSVGDLSAAELKGKKVFVRADLNVPLDDNQNITDDTRIRAAIPTIKHLIQNGAKVILSSHLGRPKGVTPKYSLAPLVPRLSELIGIQVIKADDSIGPEVEKLVASLPEGGVLLLENVRFYKEEEKNDPEHAKKLASLADLYVNDAFGTAHRAHASTEGVTKYLKPSVAGFLLQKELDYLVGAVSSPKRPFAAIVGGSKVSSKIGVIESLLENVDILLLGGGMIFTFYKAQGLSVGSSLVEEDKLELATTLLAKAKAKGVSLLLPSDVVIADKFAPDANSQVVPASAIPDGWMGLDIGPDSIKTFNEALDTTKTIIWNGPMGVFEFDKFAVGTEAIAKKLADLSGKGVTTIIGGGDSVAAVEKVGVASVMSHISTGGGASLELLEGKELPGVLALDEATPVAV

SEQ ID NO: 9762 - protein, 478 aa, Trigonella foenum-graecum
MASATAPTTLSLLPTTKSSATSAPSSSSRVQLSSFLGRPLRRLGFAAADPLLAVQVASKVRTVTGKGVRGVVSMAKKSVGDLSGAELKGKKVFVRADLNVPLDDNQNITDDTRIRAAIPTIKYLIQNGAKVILSSHLGRPKGVTPKYSLAPLVPRLSELIGIEVIKAEDSIGPEVEKLVASLPDGGVLLLENVRFYKEEEKNDPEHAKKLAALADLYVNDAFGTAHRAHASTEGVTKYLKPSVAGFLLQKELDYLVGAVSTPKRPFAAIVGGSKVSSKIGVIESLLEKVDILLLGGGMIFTFYKAQGLSVGSSLVEEDKLELATTLIAKAKAKGVSLLLPSDVVIADKFAPDANSQIVPASAIPDGWMGLDIGPDSIKTFNEALDTTKTIIWNGPMGVFEFDKFAVGTEAIAKKLADLSGKGVTTIIGGGDSVAAVEKVGVADVMSHISTGGGASLELLEGKELPGVLALDEATPVAV

SEQ ID NO: 9763 - protein, 111 aa, Cucurbita pepo
MGLDIGPDSVKTFNDALDTTQTIIWNGPMGVFEFDKFAVGTEAIAKKLAELSGKGVTTIIGGGDSVAAVEKVGVASVMSHISTGGGASLELLEGKELPGVLALDEAVPVAV

SEQ ID NO: 9764 - protein, 480 aa, Malus domestica
MASTTAPTTFSLLHSATASTSRTRASLSHVSLPSSLKPTALRRLGFSAADPLLALQVASKVRSFGSGKGVRGVVAMAKKSVGDLSAAELKGKKVFVRADLNVPLDDSQNITDDTRIRAAIPTIKHLIENGAKVILSSHLGRPKGVTPKFSLAPLVPRLSELLGIQVVKAEDSIGPEVEKLVASLPEGGVLLLENVRFYKEEEKNDPEHAKKLAALADLYVNDAFGTAHRAHASTEGVTKFLRPSVAGFLLQKELDYLVGAVSSPKRPFAAIVGGSKVSSKIGVIESLLEKVDILLLGGGMIFTFYKAQGLSVGSSLVEEDKLELATSLMAKAKAKGVSLLLPTDVVIADKFAPDANSKIVPASSIPDGWMGLDIGPDSIKTFNDALDTTKTIIWNGPMGVFEFDKFAEGTESVAKKLAELSGKGVTTIIGGGDSVAAVEKVGVASVMSHISTGGGASLELLEGKELPGVLALDEAILVPV

SEQ ID NO: 9765 - protein, 480 aa, Malus domestica
MASTTAPTTFSLLHSATTSTSRTRASLSHVSLPSSLKPTALRRLGFSAADPLLALQVASKVRSFGSGKGVRGVVAMAKKSVGDLTAAELKGKKVFVRADLNVPLDDSQNITDDTRIRAAIPTIKHLIEKGAKVILSSHLGRPKGVTPKFSLAPLVPRLSELLGIQVVKAEDSIGPEVEKLVASLPEGGVLLLENVRFYKEEEKNDPEHAKKLAALADLYVNDAFGTAHRAHASTEGVTKFLRPSVAGFLLQKELDYLVGAVSSPKRPFAAIVGGSKVSSKIGVIESLLEKVDILLLGGGMIFTFYKAQGLSVGSSLVEEDKLELATSLMAKANAKGVSLLLPTDVVIADKFAPDANSKIVPASSIPDGWMGLDIGPDSIKTFNDALDTTKTIIWNGPMGVFEFDKFAEGTESVAKKLAELSGKGVTTIIGGGDSVAAVEKVGVASVMSHISTGGGASLELLEGKELPGVLALDEATPVPV

SEQ ID NO: 9766 - protein, 478 aa, Arabidopsis lyrata
MASTAATAALSIIKSTGGAAVTRSSRASFLPIPSTAVSARRLGFSAFVDSRFSVHVASKVQSVRGKGTRGVITMAKKSVGDLTSADLKGKKVFVRADLNVPLDDNQNITDDTRIRAAIPTIKFLIENGAKVILSTHLGRPKGVTPKFSLAPLVPRLSELLGIEVVKADDCIGPQVESLVASLPEGGVLLLENVRFYKEEEKNEPEFAKKLASLADLYVNDAFGTAHRAHASTEGVTKFLKPSVAGFLLQKELDYLVGAVSNPKRPFAAIVGGSKVSSKIGVIESLLEKCDILLLGGGMIFTFYKAQGLSVGSSLVEEDKLELATSLLAKAKARGVSLLLPTDVVIADKFAPDANSKIVPASAIPDGWMGLDIGPDSVKTFNEALDTTQTVIWNGPMGVFEFEKFAQGTEAVANKLAELSKKGVTTIIGGGDSVAAVEKVGVAGVMSHISTGGGASLELLEGKVLPGVVVLDEATPVTV

SEQ ID NO: 9767 - protein, 483 aa, Aristolochia fimbriata
MAAATSSTSLSLLPSSSRQRASAHAAPNCLNVAGLRSRAPFARRLGFAGVAVDPLVAHVAARISNVASAGKGPRGVVSMAKKSVGDLSASDLKGKKVFVRADLNVPLDDNQNITDDTRVRAAIPTIKHLINNGAKVILSSHLGRPKGVTPKFSLKPLVPRLSELLGITVQKADDCIGEEVEKMVASLPEGGVLLLENVRFYKEEEKNDPEFAKKLASLADLYVNDAFGTAHRAHASTEGVTKYLKPSVAGFLLQKELDYLVGAIANPKRPFAAIVGGSKVSSKIGVIESLLEKCDILLLGGGMIFTFYKAQGLSVGSSLVEEDKLDLATSLLAKAKAKGVSLLLPSDVVIADKFAPDANSKVVPSSAIPDGWMGLDIGPDSVKTFSDALGTTKTVIWNGPMGVFEFDKFAVGTEAIAKKLAELSKSGVTTIIGGGDSVAAVEKVGVADVMSHISTGGGASLELLEGKELPGVLALDEATPVAV

SEQ ID NO: 9768 - protein, 488 aa, Gossypium hirsutum
MASATTSTTFSLLKTTASTTSSSASRSSASLIRLPSTRRHLKSSSLIHSLGFSSAASGDSLLSLHVSSKVRSFKGKGSRGVVSMAKKSVGDLTAADLKGKKVFVRADLNVPLDDSQNITDDTRIRAAIPTIKHLIQNGAKVILSSHLGRPKGVTPKFSLAPLVPRLSELIGIQVVKADDCIGPEVEKLVAALPEGGVLLLENVRFYKEEEKNEPEFAKKLASLADLFVNDAFGTAHRAHASTEGVTKFLNPSVAGFLLQKELDYLVGAVSSPKRPFAAIVGGSKVSSKIGVIESLLEKCDILLLGGGMIFTFYKAQGLSVGSSLVEEDKLELATSLLAKAKAKGVSLLLPTDVVIADKFAPDANSKIVPASAIPDGWMGLDIGPDSVKTFNEALDTTQTIIWNGPMGVFEFEKFAVGTEAIAKKLAELSGKGVTTIIGGGDSVAAVEKVGVADVMSHISTGGGASLELLEGKELPGVIALDEAVPVAV

SEQ ID NO: 9769 - protein, 191 aa, Zingiber officinale
  misc_feature (62)..(62): Xaa can be any naturally occurring amino acid
STAAASLSLLPTSSYRRRVVAASASAAACLRPGLRRMGFAFAAGDRLLTAHVADRILAVAGXSGRGIRGVVSMAKKSVGDLTVADLKGKKVFVRADLNVPLDEDRNITDDTRIRAAVPTIQHLISKGAKVILSSHLGRPKGVTPKFSLAPIVPRLSELLGIKVEKADDCIGPEVEKLVNALPEGGVLFLKM

SEQ ID NO: 9770 - protein, 483 aa, Tripterygium wilfordii
MASAAAPTTLSLLKIATSVSGTRARSSLLPVPSSTLLRGTPLPRLGFAAADPIFAHHVASKVQSMKASKPSRGVVSMAKKSVGDLTASDLKGKKVFVRADLNVPLDDSQNITDDTRIRAAIPTIKHLIQNGAKVILSSHLGRPKGVTPKFSLAPLVPRLSELLGIQVVKADDCIGPEVEKLVASLPDGGVLLLENVRFYKEEEKNEPEFAKKLASLADLYVNDAFGTAHRAHASTEGVTKFLQPSVAGFLLQKELDYLVGAVSSPKRPFAAIVGGSKVSSKIGVIESLLEKCDILLLGGGMIFTFYKAQGLSVGSSLVEEDKLDLATTLLEKAKSRGVSLLLPADVVIADKFAPDANSKIVPASEIPDGWMGLDIGPESIKTFNEALDTTQTVIWNGPMGVFEFDKFAVGTEAIAKKLAELSGKGVTTIIGGGDSVAAVEKVGVAEKMSHISTGGGASLELLEGKELPGVLALDEAIPVPVSA

SEQ ID NO: 9771 - protein, 377 aa, Zea mays
MKEEGGGGDAGFVRADQIDLKSLDEQLERHLTRAWTMEKRKEEASAGAGAGARQHQQSRRPRREDWEIDPAKLVVKGVIARGTFGTVHRGIYDAHDVAVKLLDWGEDGHRSEQDIAALRAAFSQEVSVWHKLDHPNVTKFIGAIMGARDLNIQTENGHIGMPTNICCVVVEYLPGGALKSFLIKNRRKKLAFKVVVQIALDLARGLSYLHSKKIVHRDVKTENMLLDKTRTVKIADFGVARLEASNPSDMTGETGTLGYMAPEVLNGNPYNRKCDVYSFGICLWEIYCCDMPYPDLSFSEVTSAVVRQNLRPEIPRCCPSSLSNVMKRCWDANPDKRPEMAEAVSMLEAIDTSKGGGMIPVDQRPGCLACFRQYRGP

SEQ ID NO: 9772 - protein, 391 aa, Setaria italica
MKEGAGGGGGGGGGGVVGGEDGGFVRADQIDLKSLDEQLERHLSRAWTMEKRKEEASAGANQRGGAAGRQHSLRPRREDWEIDPAKLVVKGVIARGTFGTVHRGIYDGHDVAVKLLDWGEDGHRSEQDIAALRAAFSQEVSVWHKLDHPNVTKFIGAIMGARDLNIQTENGHIGMPTNICCVVVEYLAGGALKSFLIKNRRRKLAFKVVVQIALDLARGLSYLHSKKIVHRDVKTENMLLDKTRTVKIADFGVARLEASNPSDMTGETGTLGYMAPEVLNGNPYNRKCDVYSFGICLWEIYCCDMPYPDLSFSEVTSAVVRQNLRPEIPRCCPSSLANVMKRCWDANPDKRPEMAEVVSMMEAIDTSKGGGMIPVDQRPGCLSCFRQYRGP

SEQ ID NO: 9773 - protein, 381 aa, Oryza sativa
MKEGGGDGGFVRADQIDLKSLDEQLERHLSRAWTMEKRKEEAAADQRGSKPPALAAAHYSQNRRQRREEWEIDPAKLVVRGVIARGTFGTVHRGVYDGHDVAVKLLDWGEDGHRSEQDIAALRAAFSQEVSVWHKLDHPNVTKFIGAIMGARDLDIQTESGHLAMPSNICCVVVEYLAGGSLKGFLIKNRRKKLAFKVVVQIALDLARGLSYLHSKKIVHRDVKTENMLLDKTRTVKIADFGVARLEASNPSDMTGETGTLGYMAPEVLNGSPYNRKCDVYSFGICLWEIYCCDMPYPDLSFSEVTSAVVRQNLRPEMPRCCPSSLANVMKRCWDANPDKRPEMAEVVSMLEAIDTSKGGGMIPVDQRQGCLSCFRQYRGP

SEQ ID NO: 9774 - protein, 379 aa, Brachypodium distachyon
MKEAGGDGGGEGAAAGPGFVRADQIDLKSLDEQLERHLSRAWTMEKRKEEGDKDAKQQQQQPRRREGWEADPARLVVRGVIARGTFGTVHRGVYDGHDVAVKLLDWGEDGHRSEQEVTAVRAAFSQEVTVWHKLDHPNVTKFIGAIMGARDLNIQTENGNIGMPTNVCCVVVEYLPGGALKTFLIKNRRRKLAFKVVVQIALDLARGLSYLHSKKIVHRDVKTENMLLDKTRTVKIADFGVARHEAANPSDMTGETGTLGYMAPEVLNGNPYNRKCDVYSYGICLWEVYCCDMPYADLSFSEVTSAVVRQNLRPEIPRCCPSSFANVMKRCWDANPDKRPEMAEVVSMLEAIDTSKGGGMIPVDQPTGCFSCFRQRRGP

SEQ ID NO: 9775 - protein, 383 aa, Sorghum bicolor
MRQPTSAGGDAGFVRADQIDLKSLDEQLERHLGRPAERGVGLASGTGSRRGESARLQGPEELTPLRRCREDWEIDPAKLVIKGVIARGTFGTVHRGVYDGQDVAVKMLDWGEDGHRSEQEIAALRAAFAQEVAVWHKLDHPNVTKFIGAIMGARDLNIQTENGHLGMPSNICCVVVEYLPGGALKNFLIKNRRRKLAFKVVVQIALDLARGLCYLHSKKIVHRDVKTENMLLDKTRTVKIADFGVARVEASNPSDMTGETGTLGYMAPEVLNGHAYNRKCDVYSFGICLWEIYCCDMPYPDLSFSEVTSAVVRQNLRPEIPRCCPSSLANVMKRCWDANPDKRPEMAEVVSMLEAIDTSKGGGMIPKDQSQGCLSCFRRHRGP

SEQ ID NO: 9776 - protein, 214 aa, Panicum virgatum
MKEGGGGGGGGGGGGDGGFVRADQIDLKSLDEQLERHLSRAWTMEKRKEEASAGANQRGGGGRQHSLRPRREDWEIDPAKLVVKGVIARGTFGTVHRGIYDGHDVAVKLLDWGEDGHRSEQDIAALRAAFSQEVSVWHKLDHPNVTKFIGAIMGARDLNIQTENGHIGMPTNICCVVVEYLAGGALKSFLIKNRRRKLAFKVVVQIALDLARGF

SEQ ID NO: 9777 - protein, 381 aa, Gossypium raimondii
MKEQKSESGGGYVRADQIDLKSLDEQLQRHLSRAWTMEKNKNRKEEGEDGGGGGGGEQLRSSSNTVRRQEWEIDPSKLIIKSVIARGTFGTVHRGIYDGQDVAVKLLDWGEEGHRSAAEIASLRAAFTQEVAVWHKLDHPNVTKFIGATMGSSDLNIQTENGQIGMPSNMCCVVVEYCPGGALKSYLIKNRRRKLAFKVVVQLALDLARGLSYLHSKKIVHRDVKTENMLLDKTRTVKIADFGVARLEASNPNDMTGETGTLGYMAPEVLNGNPYNRKCDVYSFGICLWEIYCCDMPYPDLSFSEVTSAVVRQNLRPEIPRCCPSSLANVMKRCWDANPDKRPEMDEVVSMIEAIDTSKGGGMIPHDQAQGCLCFRRYRGP

SEQ ID NO: 9778 - protein, 382 aa, Setaria italica
MRQPTSAGGDAGFVRADQIDLKSLDEQLERHLGRPAERGVGPASGTGSRRGESARLGPEELTPLRRCREDWEIDPAKLVIKGVIARGTFGTVHRGVYDGQDVAVKLLDWGEDGHRSEQEIAALRSAFAQEVAVWHKLDHPNVTKFIGAIMGARDLNVQTEHGHLGMPSNICCVVVEYLAGGALKNFLIKNRRRKLAFKVVVQIALDLARGLCYLHSKKIVHRDVKTENMLLDKTRTVKIADFGVARVEASNPGDMTGETGTLGYMAPEVLNGHPYNRKCDVYSFGICLWEIYCCDMPYPDLSFSEVTSAVVRQNLRPEIPRCCPSSLANVMKRCWDANPDKRPEMAEVVSMLEAIDTSKGGGMIPTDQTQGCFSCLRRTRGP

SEQ ID NO: 9779 - protein, 379 aa, Gossypium hirsutum
MKEQKSESGGGYVRADQIDLKSLDEQLQRHLSRAWTMEKNKNRKEEGEDGGGGGEQLRSSSNTVRRQEWEIDPSKLIIKSVIARGTFGTVHRGIYDGQDVAVKLLDWGEEGHRSVAEISSLRAAFTQEVAVWHKLDHPNVTKFIGATMGSSDLNIQTENGQIGMPSNMCCVVVEYCPGGALKSYLIKNRRRKLAFKVVVQLALDLARGLSYLHSKKIVHRDVKTENMLLDKTRTVKIADFGVARLEASNPNDMTGETGTLGYMAPEVLNGNPYNRKCDVYSFGICLWEIYCCDMPYPDLSFSEVTSAVVRQNLRPEIPRCCPSSLANVMKRCWDANPDKRPEMDEVVSMIEAIDTSKGGGMIPYDQAQGCLCFRRYRGP

SEQ ID NO: 9780 - protein, 379 aa, Gossypium hirsutum
MKEQKSESGGGFVRADQIDLKSLDEQLQRHLSRAWTMEKNKNRKEEGEDGGGGGEQLRSSSNTVRRQEWEIDPSKLIIKSVIARGTFGTVHRGIYDGQDVAVKLLDWGEEGHRSAAEIASLRAAFTQEVAVWHKLDHPNVTKFIGATMGSSDLNIQTENGQIGMPSNMCCVVVEYCPGGALKSYLIKNRRRKLAFKVVVQLALDLARGLSYLHSKKIVHRDVKTENMLLDKTQTVKIADFGVARLEASNPNDMTGETGTLGYMAPEVLNGNPYNRKCDVYSFGICLWEIYCCDMPYPDLSFSEVTSAVVRQNLRPEIPRCCPSSLANVMKRCWDANPDKRPEMDEVVSMMEAIDTSKGGGMIPHDQAQGCLCFRRYRGP

SEQ ID NO: 9781 - protein, 378 aa, Theobroma cacao
MKEKSESGGGGYVRADQIDLKSLDEQLQRHLSRAWTMEKNKNRKEEGEEGGGGGEQLRPSNTMRRQEWEIDPSKLIIRGVIARGTFGTVHRGIYDGQDVAVKLLDWGEEGHRSEAEIASLRAAFTQEVAVWHKLDHPNVTKFIGATMGSSELNIQTENGHIGMPSNVCCVVVEYCPGGALKSYLIKNRRRKLAFKVVIQLALDLARGLSYIHSKKIVHRDVKTENMLLDKTRTVKIADFGVARLEASNPHDMTGETGTLGYMAPEVLNGNPYNRKCDVYSFGICLWEIYCCDMPYPDLSFSEVTSAVVRQNLRPEIPRCCPSSLANVMKRCWDANPDRRPEMDEVVSMIEAIDTSKGGGMIPHDQPQGCLCFRRYRGP

SEQ ID NO: 9782 - protein, 382 aa, Zea mays
MRQPTSAGGDAGFVRADQIDLKSLDEQLERHLGRRAERGVGLPSGTGSRGGESARLGPEELTPLRRCREDWEIDPTKLVIKGVIARGTFGTVHRGVYDGQDVAVKLLDWGEDGHRSEQEIAALRAAFAQEVVVWHKLEHPNVTKFIGAIMGARDLNIQTEHGHLGMPSNICCVVVEYLPGGALKSFLIKNRRRKLAFKVVVQIALDIARGLCYLHSEKIVHRDVKTENMLLDKTRTVKIADFGVARVEASNPSDMTGETGTLGYMAPEVLNGHAYNRKCDVYSFGICLWEVYCCDMPYPDLSFSEVTSAVVRQNLRPEIPRCCPSSLANVMKRCWDANPDKRPEMAEVVSMLEVIDTSKGGGMIPKDQTQGWLSCFRRYRGP

SEQ ID NO: 9783 - protein, 382 aa, Zea mays
MRQPTSAGGDAGFLRADQIDLKSLDEQLERHLGHPAERVVGPVSGTGSRRGETAKLGPEELTPLQRCREDWEIDPTKLIIKGVIARGTFGTVHRGVYDGQDVAVKLLDWGEDGHRSEQEIGALRAAFAQEVAVWHKLEHPNVTKFIGAIMGARDLNIQTEHGQLGMPSNICCVVVEYLAGGALKNFLIKNRRRKLAFKVVVQIALDLARGLCYLHSKKIVHRDVKTENMLLDKTRTVKIADFGVARVEASNPSDMTGETGTLGYMAPEVLNGHAYNRKCDVYSFGICLWEIYCCDMPYPDLSFSEVTSAVVRQNLRPEIPRCCPSSLANVMKRCWDANPDKRPEMAEVVSMLEAIDTSKGGGMIPKDQTQGCLSCFRQYRGP

SEQ ID NO: 9784 - protein, 374 aa, Gossypium raimondii
MKEKSESGGGGYVRADQIDLKSLDEQLQRHLSRAWTMEKNKNNREDKGEEGGGQLRPSNTGRRQEWEIDPSKLIIKSVIARGTFGTVHRGMYDGQDVAVKLLDWGEEGHRSEAEIASLRAAFTQEVAVWHKLNHPNVTKFIGATMGSSDLNIQTENGQIGMPICCVIVEYCPGGALKSYLIKNRRRKLAFKVVIQLALDLARGLSYLHSQKIVHRDVKTENMLLDKTRTVKIADFGVARLEASNPNDMTGETGTLGYMAPEVLNGNPYNRKCDVYSFGICLWEIYCCDMPYPDLSFSEVTSAVVRQNLRPEIPRCCPSSLANVMKRCWDANPDKRPEMDEVVSMLEAIDTSKGGGMIPHDQTQGCLCFRRYRGP

SEQ ID NO: 9785 - protein, 255 aa, Secale cereale
MRLPGAGGGGSGDAGFVRADQIDLKSLDEQLERHLSRQERDALVPAQPGSRRGGSARLGEPQPPPQQRRRREDWEVDPAKLVIKGVIARGTFGTVHRGVYDGQDVAVKLLDWGEDGHRSEQEITALRSAFAQEVAVWHKLDHPNVTKFIGAIMGARDLNVQTEHGHLGMPSNICCVVVEYLAGGALKNFLIKNRRRKLAFKVVVQLALDLARGLSYLHSEKIVHRDVKTENMLLDKTRTVKIAVFWGCSSRGFKP

SEQ ID NO: 9786 - protein, 374 aa, Gossypium hirsutum
MKEKSESGGGGYVRADQIDLKSLDEQLQRHLSRAWTMEKNKNNRKDEGEEGGGQLRPSNTGRRQEWEIDPFKLIIKSVIARGTFGTVHRGMYDGQDVAVKLLDWGEEGHRSEAEIASLRAAFTQEVAVWHKLNHPNVTKFIGATMGSSDLNIQTENGQIGMPICCVIVEYCPGGALKSYLIKNRRRKLAFKVVIQLALDLARGLSYLHSQKIVHRDVKTENMLLDKTRTVKIADFGVARLEASNPNDMTGETGTLGYMAPEVLNGNPYNRKCDVYSFGICLWEIYCCDMPYPDLSFSEVTSAVVRQNLRPEIPRCCPSSLANVMKRCWDANPDKRPEMDEVVSMLEAIDTSKGGGMIPHDQTQGCLCFRRYRGP

SEQ ID NO: 9787 - protein, 375 aa, Manihot esculenta
MKEKSETGGGYVRADQIDLKSLDEQLQRHLSRAWTMEKNKSKKDGEEGEAALQRPLNDTITRQEWEIDPSKLIIKGVIARGTFGTVHRGVYDGQDVAVKLLDWGEEGHRSDAEIASLRAAFTQEVAVWHKLDHPNVTKFIGATMGSSELNIQTENAHIGMPSNVCCVVVEYCPGGALKSYLIKNRRRKLAFKVVVQLALDLARGLSYLHSQKIVHRDVKTENMLLDKTRTVKIADFGVARLEASNPNDMTGETGTLGYMAPEVLNGNPYNRKCDVYSFGICLWEIYCCDMPYPDLSFSEVTSAVVRQNLRPEIPRCCPSSLANVMKRCWDATPDKRPEMEEVVSMLEAIDTSKGGGMIPLDQPQGCLCFRRYRGP

SEQ ID NO: 9788 - protein, 359 aa, Elaeis guineensis
MGFVRADQIDLKSLDEQLERHLSRAWTMEKKKEEERGGGRGERQREDWEIDPSKLVIKGAIARGTFGTIHRGVYDGQDVAVKLLDWGEEGNRTEAEIAALRAAFSQEVSVWHKLDHPNVTKFIGATIGGRDLNIQTENGHLGIPSNVCCVVVEYLPGGALKTFLIKNRRRKLAFKVVVPMALDLARGLSYLHSKKIVHRDVKTENMLLDKTRTVKIADFGVARVEAQNPNDMTGETGTLGYMAPEVLNGDPYNRKCDVYSFGICLWEIYCCDMPYPDLSFSEVTSAVVRQNLRPEIPRCCPSSLANVMKRCWDANPDKRPEMDAVVAMLEAIDTSKGGGMIPLDQPQGCLSCFRKNRGP

SEQ ID NO: 9789 - protein, 366 aa, Cajanus cajan
MKKSESGGYVRADQIDLKSLDEQLQRHLSRAWTMEKNKEKEEDEVEGRSTRSRQEWEIDPSKLIIKTVIARGTFGTVHRGIYDGQDVAVKLLDWGEEGHRSEAEIASLRAAFTQEVAVWHKLDHPNVTKFIGATMGTSELQIQTENGHIGMPSNVCCVVVEYCPGGALKSYLIKNRRRKLAFKVVVQLALDLARGLSYLHMKKIVHRDVKTENMLLDKTRTLKIADFGVARIEASNPHDMTGETGTLGYMAPEVLNGNPYNRKCDVYSFGICLWEIYCCDMPYPDLSFSEVTSAVVRQNLRPEIPRCCPSSLANVMKRCWDANPDKRPEMDEVVSMLEAIDTSKGGGMIPHDQPQGCLCFRRYRGP

SEQ ID NO: 9790 - protein, 356 aa, Aristolochia fimbriata
MKETSDGFVRADQIDLKSLDDQLERHLTRAWTMEKKKEERVARQEWEIDPSKLIIKSVIARGTFGTVHRGIYDGQDVAVKLLDWGEEGHRTEAEIASLRSAFTQEVAVWHKLDHPNVTKFIGATMGSSDLNIQTENGHIGMPSNICCVVVEYLAGGALKSYLIKNRRRKLAFKVVVQLALDLARGLSYLHSEKIVHRDVKTENMLLDKTRTVKIADFGVARVEAQNPNDMTGETGTLGYMAPEVLNGNPYNRKCDVYSFGICLWEIYCCDMPYPDLSFSEVTSAVVRQNLRPEIPRCCPSSLANVMKRCWDANPDKRPEMDEVVTMLEAIDTSKGGGMIPLDQQQGCLCFRRYRGP

SEQ ID NO: 9791 - protein, 374 aa, Gossypium hirsutum
MKEKSESGGGGYVRADQIDLKSLDEQLQRHLSRAWTMEKNKNNREDKGEEGGGQLRPSNTGRRQEWEIDPSQLIIKSVIARGTFGTVHRGMYDGQDVAVKLLDWGEEGHRSEAEIASLRAAFTQEVAVWHKLNHPNVTKFIGATMGSSDLNIQMENGQIGMPICCVIVEYCPGGALKSYLIKNRRRKLAFKVVIQLAVDLARGLSYLHSQKIVHRDVKTENMLLDKTRTVKIADFGVARLEASNPNDMTGETGTLGYMAPEVLNGNPYNRKCDVYSFGICLWEIYCCDMPYPDLSFSEVTSAVVRQNLRPEIPRCCPSSLANVMKRCWDANPDKRPEMDEVVSMLEAIDTSKGGGMIPHDQTQGCLCFRRYRGP

SEQ ID NO: 9792 - protein, 372 aa, Quercus alba
MKEKSESGGGYVRADQIDLKSLDEQLQRHLSRAWTMEKNKKREEDQQEQEAARSTVTRRQEWEIDPSKLIIKAVIARGTFGTVHRGIYDGQDVAVKLLDWGEEGHRSDAEIASLRAAFTQEVAVWHKLEHPNVTKFIGATMGSSELNIQTDNGHIGMPSNICCVVVEYCPGGALKSYLIKNRRRKLAFKVVVQLALDLARGMSYLHSQKIVHRDVKTENMLLDKTRTVKIADFGVARIEASNPNDMTGETGTLGYMAPEVLNGNPYNRKCDVYSFGICLWEIYCCDMPYPDLSFSEVTSAVVRQNLRPEIPRCCPSSLANVMKRCWDANPDKRPEMDEVVTMLEAIDTSKGGGMIPNDQAQGCLCFRRYRGP

SEQ ID NO: 9793 - protein, 387 aa, Brachypodium distachyon
MRFPSAGGGGSGDAGFVRADQIDLKSLDEQLERHLSRHERTEPPPPQPGSRRGESTRPGDAQPAPAQQPRRRREDWEVDPAKLVIKGVIARGTFGTVHRGVYDGQDVAVKLLDWGEDGHRSEQEITALRSAFAQEVAVWHKLDHPNVTKFIGAIMGARDLNVQTEHGHLGMPSNICCVVVEYLAGGALKNFLIKNRRRKLAFKVVVQLALDLARGLSYLHSEKIVHRDVKTENMLLDKTRTVKIADFGVARVEASNPSDMTGETGTLGYMAPEVLNGHPYNRKCDVYSFGICLWEIYCCDMPYPDLSFSEVTSAVVRQNLRPEIPRCCPSALANVMKRCWDANPDKRPEMAEVVSLIEAIDTSKGGGMVPIDQSQGCFNCFRQHRGP

SEQ ID NO: 9794 - protein, 374 aa, Secale cereale
MKEAAVGGGGDGDGAGGFVRADQIDLKSLDEQLDRHLARARTMDNPKPKRNQDQPQPRHDWEADPARLVVRGVIARGTFGTVHRGVYDGLDVAVKLLDWGRDGHRSEQEITAIRSAFSQEVSVWHKLDHPNVTKFIGAIMGAGDLNIQTEDGNIGMPSNVCCVIVEYLAGGALKTFLIKNRRRKLAFKVVVQIALDLARGLSYLHSKKIVHRDVKTENMLLDKTRTVKIADFGVARHEAANPSDMTGETGTLGYMAPEVLNGNAYNRKCDVYSYGICLWEVYCCDMPYADLSFSEVTSAVVRQNLRPEIPRCCPSAFANVMKRCWDANPDKRPEMAEVVTMLEAIDTSKGGGMIPVDQARGIGCLSCLRPRRGP

SEQ ID NO: 9795 - protein, 366 aa, Phaseolus coccineus
MKKSESGGYVRADQIDLKSLDEQLQRHLSRAWTMEKNKEKEEEEVEGRSTRSRQEWEIDPSKLVIKTVIARGTFGTVHRGIYDGQDVAVKLLDWGEEGHRSDAEIASLRAAFTQEVAVWHKLDHPNVTRFLGATMGTSELQIQTENGHIGMPSNVCCVVVEYCPGGALKTYLIKNRRRKLAFKVVVQLALDLARGLSYLHTKKIVHRDVKTENMLLDKTRTLKIADFGVARIEASNPHDMTGETGTLGYMAPEVLNGNPYNRKCDVYSFGICLWEIYCCDMPYPDLSFSEVTSAVVRQNLRPEIPRCCPSSLANVMKRCWDANPDKRPEMDEVVSMLEAIDTSKGGGMIPVDQPQGCLCFRSYRGP

SEQ ID NO: 9796 - protein, 371 aa, Secale cereale
MKEAAVGGGGDGAGGFVRADQIDLKSLDEQLDRHLARARTMDNPKPKRQPQPQPRHDWEADPARLVVRGVIARGTFGTVHRGVYDGLDVAVKLLDWGEDGHRSEQEITAIRSAFSQEVSVWHKLDHPNVTKFIGAIMGAGDLNIQTEDGNIGMPSNVCCVIVEYLAGGALKTFLIKNRRRKLAFKVVVQIALDLARGLSYLHSKKIVHRDVKTENMLLDKTRTVKIADFGVARHEAANPSDMTGETGTLGYMAPEVLNGNAYNRKCDVYSYGICLWEVYCCDMPYADLSFSEVTSAVVRQNLRPEIPRCCPSAFANVMKRCWDANPDKRPEMAEVVTMLEAIDTSKGGGMIPVDQARGIGCLSCLRPRRGP

SEQ ID NO: 9797 - protein, 360 aa, Vitis vinifera
MKEKSDGFVRADQIDLKSLDEQLQRHLSRAWTMEQKKEQQEERPNTREEWEIDPSKLVIKSVIARGTFGTVHRGVYDGQDVAVKLLDWGEEGHRTEAEIASLRAAFTQEVVVWHKLDHPNVTKFIGATIGSSELNIQTENGHIGMPSTVCCVVVEYLPGGALKSYLIKNHRRKLAFKVVVQLALDLARGLSYLHSKKIVHRDVKTENMLLDKTRTLKIADFGVARMEASNPNDMTGETGTLGYMAPEVLNGNPYNRKCDVYSFGICLWEIYCCDMPYPDLSFSEVTSAVVRQNLRPEIPRCCPSSLANVMKRCWDANPDKRPEMDEVVSMLEGIDTSKGGGMIPLDQPQGCFCFGKYRGP

SEQ ID NO: 9798 - protein, 379 aa, Arachis hypogaea
MKKNESGGYVRADQIDLKSLDEQLQRHLSRAWTMEKNKEKQQQEDDAAMAAAAAAAEGARSSSRTRQEWEIDPSKLLIKSVIARGTFGTVHRGVYDGQDVAVKLLDWGEEGHRSEAEIASLRAAFTQEVAVWHKLDHPNVTKFIGATMGTSDLQIQTENGHIGMPSNLCCVVVEYCPGGALKSYLIKNRRRKLAFKVVVQLALDLARGLSYLHMKKIVHRDVKTENMLLDKTRTLKIADFGVARIEASNPHDMTGETGTLGYMAPEVLNGNPYNRKCDVYSFGICLWEIYCCDMPYPDLSFSEVTSAVVRQNLRPEIPRCCPSSLANVMKRCWDANPDKRPEMDEVVSMLEAIDTSKGGGMIPLDQPQGCLCFRRYRGP

SEQ ID NO: 9799 - protein, 366 aa, Glycine max
MKKSESGGYVRADQIDLKSLDEQLQRHLSRAWTMEKNKEKEEEEVEGRSTRSRQEWEIDPSKLVIKTVIARGTFGTVHRGIYDGQDVAVKLLDWGEEGHRSDAEIASLRAAFTQEVAVWHKLEHPNVTKFIGATMGTSELQIQTENGHIGMPSNVCCVVVEYCPGGALKSYLIKNRRRKLAFKVVVQLALDLARGLSYLHTKKIVHRDVKTENMLLDKTRTLKIADFGVARIEASNPHDMTGETGTLGYMAPEVLNGNPYNRKCDVYSFGICLWEIYCCDMPYPDLSFSEVTSAVVRQNLRPEIPRCCPSALANVMKRCWDANPDKRPEMDEVVTMLEAIDTSKGGGMIPHDQPQGCLCFRSYRGP

SEQ ID NO: 9800 - protein, 367 aa, Glycine max
MKKSESGGYVRADQIDLKSLDEQLQRHLSRAWTMEKNKEKEEEEEVEGRSTRSRQEWEIDPSKLVIKTVIARGTFGTVHRGIYDGQDVAVKLLDWGEEGHRSDAEIASLRAAFTQEVAVWHKLEHPNVTKFIGATMGTSELQIQTENGHIGMPSNVCCVVVEYCPGGALKSYLIKNRRRKLAFKVVVQLALDLARGLSYLHTKKIVHRDVKTENMLLDKTRTLKIADFGVARIEASNPHDMTGETGTLGYMAPEVLNGNPYNRKCDVYSFGICLWEIYCCDMPYPDLSFSEVTSAVVRQNLRPEIPRCCPSALANVMKRCWDANPDKRPEMDEVVTMLEAIDTSKGGGMIPHDQPQGCLCFRSYRGP

SEQ ID NO: 9801 - protein, 370 aa, Euonymus alatus
MKEKSEGGGYVRADQIDLKSLDEQLQRHLSRAWTMEKSKDKREEGEAEQRPTNAATREEWEIDPAKLIIQAVIARGTFGTVHRGVYDGQDVAVKLLDWGEEGHRSEAEVASLRAAFTQEVVVWHKLDHPNVTKFIGATMGSSDLHIQTENGHVGMPNNVCCVVVEYCPGGALKSYLIKNRRKKLAFKVVVQLALDLARGLSYLHSKKIVHRDVKTENMLLDKQRTVKIADFGVARLEASNPHDMTGETGTLGYMAPEVLNGNPYNRKCDVYSFGICLWEIYCCDMPYPDLSFSEVTSAVVRQNLRPEIPRCCPSSLAYVMKRCWDASPDKRPEMDEVVSLLEAIDTSKGGGMIPGDQPQGCFCFRRHRGP

SEQ ID NO: 9802 - protein, 388 aa, Oryza sativa
MRHPGAGGGSGDAGFVRADQIDLKSLDEQLERHLGRPAERAASQHGGSGSRRGESARLGLGEEPPQAPHHQRRREDWEIDPAKLVIRGVIARGTFGTVHRGVYDGQDVAVKMLDWGEDGHRSEREISSLRAAFAQEVAVWHKLDHPNVTKFIGAIMGARDLNIQTEHGHFGMPSNICCVVVEYLAGGALKNFLIKNRRRKLAYKVVVQLALDLARGLSYLHSKKIVHRDVKTENMLLDKSRTVKIADFGVARIEASNPSDMTGETGTLGYMAPEVLNGHPYNRKCDVYSFGICLWEIYCCDMPYPDLSFSEVTSAVVRQNLRPEIPRCCPSSLANVMKRCWDANPDKRPAMAEVVSMLEAIDTSKGGGMIPTDQPQGCFSCFGRHRGP

SEQ ID NO: 9803 - protein, 153 aa, Cucumis melo
MLLDKTRTVKIADFGVARVEASNPNDMTGETGTLGYMAPEVLNGNPYNRKCDVYSFGICLWEIYCCDMPYPDLSFSEVTSAVVRQNLRPEIPRCCPSSLANVMKRCWDATPDKRPEMDEVVSMLEAIDTSKGGGMIPVDQAQGCLCFRKYRGP

SEQ ID NO: 9804 - protein, 363 aa, Aquilegia formosa
MKETSDGFVRADQIDLKSLDEQLERHLSRAWTMEKKREEGSGGKDKERVREEWEIDPTKLIIKTVIARGTFGTVHRGIYDGLDVAVKLLDWGEEGHRTEAEIASLRTAFTQEVAVWHKLDHPNVTKFIGATMGNAELNIQTDTGHIGMPSNICCVVVEYLPGGALKSYLIKNRRRKLAFKVVNQLALDLARGLSYLHSQKIVHRDVKTENMLLDKSRTVKIADFGVARVEAQNPNDMTGETGTLGYMAPEVLNGNAYNRKCDVYSFGICLWEIYCCDMPYPDLSFSEITSAVVRQNLRPEMPRCCPSSLSNVMKRCWDANPDKRPEMDEVVSMLEAIDTSKGGGMIPVDQSQGCMCFRSKRGP

SEQ ID NO: 9805 - protein, 380 aa, Citrullus lanatus
MKEKSESGGGYVRADQIDLKSLDEQLQRHLSKAWTMEKNKKREDEEGVGVGGGGGGGVGGGRPAITRQEWEIDPSKLIIKAVIARGTFGTVHRGIYDGQDVAVKLLDWGEEGHRSEAEIASLRAAFTQEVAVWHKLDHPNVTKFIGATIGSSDLHVQTENGQIGMPSNICCVVVEYCPGGALKSYLIKNRRKKLAFKVVVQLALDLARGLSYLHSQKIVHRDVKTENMLLDKTRTVKIADFGVARVEASNPNDMTGETGTLGYMAPEVLNGNPYNRKCDVYSFGICLWEIYCCDMPYPDLSFSEVTSAVVRQNLRPEIPRCCPSSLANVMKRCWDANPDKRPEMDEVVTMLEAIDTSKGGGMIPLDQSQGCFCFRRYRGP

SEQ ID NO: 9806 - protein, 373 aa, Manihot esculenta
MKEKSENGGGYVRADQIDLKSLDEQLQRHLSRAWTMEKNKKDGEEGEAAVQRQLNDTVTRQEWEICPSKLIIKGVIARGTFGTVHRGIYDGQDVAVKLLDWGEEGHSSAAEIASLIAAFTQEVAVWHKLDHPNVTKFIGATMGSSELNIQTENGHINMPSNVCCVVVEYCPGGALKSYLIKNRRRKLAFKVVIQLALDLARGLSYLHSKKIVHRDVKTENMLLDKTRTVKIADFGVARLEASNPNDMTGETGTLGYMAPEVLNGSPYNRKCDVYSFGICLWEIYCCDMPYPDLSFSEVTSAVVRQNLRPEIPRCCPSSLANVMKRCWDANPDKRPEMEEVVSMLAAINTSKGGGMIPVDEAQGCLCFRRHRGP

SEQ ID NO: 9807 - protein, 379 aa, Cucumis sativus
MKENNDGFVRADQIDLKSLDEQLERHLSRALTMEKNKKKDEDTGNSFLTSAPIARSRSTKVAAKDRQEWEIDPSKLIIKSVIARGTFGTVHRGVYDGLDVAVKLLDWGEEGHRTEAEIASLRAAFKQEVAVWHKLEHPNVTKFIGATMGSAELQIQTENGLIGMPSNICCVVVEYLAGGALKSYLIKNRRRKLAFKVVVQLALDLARGLSYLHSQKIVHRDVKTENMLLDKTRTVKIADFGVARVEASNPNDMTGETGTLGYMAPEVLNGNPYNRKCDVYSFGICLWEIYCCDMPYPDLSFSEVTSAVVRQNLRPEIPRCCPSSLANVMKRCWDATPDKRPEMDEVVSMLEAIDTSKGGGMIPVDQAQGCLCFRKYRGP

SEQ ID NO: 9808 - protein, 379 aa, Citrullus lanatus
MKENNDGFVRADQIDLKSLDEQLERHLSRALTMEKNKKKDEDGGNSFLTSAPIARSRSTKVAAKDRQEWEIDPSKLIIKSVIARGTFGTVHRGVYDGLDVAVKLLDWGEEGHRTEAEIASLRAAFKQEVAVWHKLEHPNVTKFIGATMGSAELQIQTENGLIGMPSNICCVVVEYLAGGALKSYLIKNRRRKLAFKVVVQLALDLARGLSYLHSQKIVHRDVKTENMLLDKTRTVKIADFGVARVEASNPNDMTGETGTLGYMAPEVLNGNPYNRKCDVYSFGICLWEIYCCDMPYPDLSFSEVTSAVVRQNLRPEIPRCCPSSLANVMKRCWDATPDKRPEMDEVVSMLEAIDTSKGGGMIPVDQAQGCLCFRKYRGP

SEQ ID NO: 9809 - protein, 385 aa, Ricinus communis
MKEKSESGGGYVRADQIDLKRLDEQLQRHLSRAWTMEKNKNKKDTGEEGEAATAAAAAAAAQRPLKNNTITRQEWEIDPSKLIIKGVIARGTFGTVHRGIYDGQDVAVKLLDWGEEGHRSDAEIASLRAAFTQEVAVWHKLDHPNVTKFIGATMGSSDLHIQTENGHIGMPSNICCVVVEYCPGGALKSYLIKNRRRKLAFKVVIQLALDLARGLSYLHSQKIVHRDVKTENMLLDKTRTVKIADFGVARMEASNPNDMTGETGTLGYMAPEVLNGNPYNRKCDVYSFGICLWEIYCCDMPYPDLSFSEVTSAVVRQNLRPDIPRCCPSSLANVMKRCWDANPDKRPEMDEVVSMLEAIDTSKGGGMIPGDQPQGCLCFRRYRGP

SEQ ID NO: 9810 - protein, 364 aa, Aquilegia formosa
MKESGDGFVRADQIDLKSLDEQLERHLNRVRTMEMEKKREEGERNKERVKREEWEIDPSKLIIKSVIARGTFGTVHRGVYDGLDVAVKLLDWGEEGHRSEAEIAALRAAFTQEVVVWHKLDHPNVTKFIGATMGSSELKIQTENGRVGMPSNFCCVVVEYLPGGALKTYLIKNRRRKLAFKVVVQLALDLARGLSYLHSQKIVHRDVKTENMLLDKTRAVKIADFGVARVEAQNPNDMTGETGTLGYMAPEVLNGNPYNRKCDVYSFGICLWEIYCCDMPYPDLSFSEVTSAVVRQNLRPDIPRCCPSSLANVMKRCWDANPDKRPEMDEVVSLLEAIDTSKGGGMIPVDQSQGCFCFRKKRGP

SEQ ID NO: 9811 - protein, 370 aa, Euonymus alatus
MKEKSEGGGYVRADQIDLKSLDEQLQRHLSRAWTMEKSKDKKGEGEAEQRPTNAATREEWEIDPAKLIIQTVIARGTFGTVHRGVYDGQDVAVKLLDWGEEGHRSEAEVASLRAAFTQEVVVWHKLDHPNVTKFIGATMGSSDLHIQTENGHVGMPNNVCCVVVEYCPGGALKSYLIKNRRKKLAFKVVVQLALDLARGMSYLHSKKIVHRDVKTENMLLDKQRTVKIADFGVARLEASNPHDMTGETGTLGYMAPEVLNGNPYNRKCDVYSFGICLWEIYCCDMPYPDLSFSEVTSAVVRQNLRPEIPRCCPSSIAYVMKRCWDASPDKRPEMDEVVSLLEAIDTSKGGGMIPGDQPQGCFCFRRHRGP

SEQ ID NO: 9812 - protein, 221 aa, Eschscholzia californica
MKENNDGFVRADQIDLKSLDEQLEKHLSRAWTMEKKRDETVGGGEGTPKDKDRQEWEIDPTKLIIKTVIARGTFGTVHRGIYDGIDVAVKMLDWGEEGHRTEAEIAALRSAFTQEVVVWHKLDHPNVTKFIGATMGNSGLSIQTDNGFIGMPSNICCVVVEYLPGGALKSYLIKNRRRKLAFKVVHQIALDLARGLSYLHSKKIVHRDVKTEICFWIRPAL

SEQ ID NO: 9813 - protein, 385 aa, Cucumis sativus
MKEKSETGGGYVRADQIDLKSLDEQLQRHLSKAWTMEKNKRREDEEGVGIGGGGGGGGGGGGVGGGRPAITRQEWEIDPSKLIIKAVIARGTFGTVHRGVYDGQDVAVKLLDWGEEGHRSEAEIASLRAAFTQEVAVWHKLDHPNVTKFIGATIGSSDLHIQTENGQIGMPSNICCVVVEYCPGGALKSYLIKNRRKKLAFKVVVQLALDLARGLSYLHSQKIVHRDVKTENMLLDKTRTVKIADFGVARVEASNPNDMTGETGTLGYMAPEVLNGNPYNRKCDVYSFGICLWEIYCCDMPYPDLSFSEVTSAVVRQNLRPEIPRCCPSSLANVMKRCWDANPDKRPEMDEVVTMLEAIDTSKGGGMIPLDQSQGCFCFRRYRGP

SEQ ID NO: 9814 - protein, 365 aa, Hordeum vulgare
QIDLKSLDEQLERHLSRQERDAPAPAQPGSRRSGSARLGEPQPPPPQRRRREDWEVDPAKLVIKGVIARGTFGTVHRGVYDGQDVAVKLLDWGEDGHRSEQEITALRSAFAQEVAVWHKLDHPNVTKFIGAIMGARDLNVQTEHGHLGMPSNICCVVVEYLAGGALKNFLIKNRRRKLAFKVVVQLALDLARGLSYLHSEKIVHRDVKTENMLLDKTRTVKIADFGVARVEASNPSDMTGETGTLGYMAPEVLNGHPYNRKCDVYSFGICLWEIYCCDMPYPDLSFSEVTSAVVRQNLRPEIPRCCPSALANVMKRCWDANPDKRPEMAEVVAMIEAIDTSKGGGMIPIDHSQGCFACFRQYRGP

SEQ ID NO: 9815 - protein, 173 aa, Secale cereale
MKEAAVGGGGDGAGGFVRADQIDLKSLDEQLDRHLARARTMDNPKPKRQPQPQPRHDWEADPARLVVRGVIARGTFGTVHRGVYDGLDVAVKLLDWGEDGHRSEQEITAIRSAFSQEVSVWHKLDHPNVTKFIGAIMGAGDLNIQTEDGNIGMPSNVCCVIVEYLAGGALKHF

SEQ ID NO: 9816 - protein, 384 aa, Eucalyptus grandis
MKEKGESGGGYVRADQIDLKSLDEQLQRHLSRAWTMEKNKNADTNGDGKQENDALARRPAYGGGGSRLPTRQEWEIDPSKLVIKSVIARGTFGTVHRGIYDGQDVAVKLLDWGEEGHRSEAEIASLRAAFTQEVAVWHKLEHPNVTKFIGATMGTSDLHIQSENGHIGMPSNICCVVVEYCPGGALKSYLIKNRRKKLAFKVVIQLALDLARGLSYLHSKKIVHRDVKTENMLLDKTRTLKIADFGVARIEASNPHDMTGETGTLGYMAPEVLNGSAYDRKCDVYSFGICLWEIYCCDMPYPDLSFSEVTSAVVRQNLRPEIPRCCPSSLANVMKRCWDGNPDKRPKMDEVVAMLEAIDTSKGGGMIPLDQSQGCFCFRKHRGP

SEQ ID NO: 9817 - protein, 355 aa, Amborella trichopoda
MKESGDGFVRADQIDLKNLDEQLERHLSRAWTMEKNGNRRVREDWEIDPSKLVVRNVLARGTFGTVHRGVYDGQDVAVKLLDWGEEENRTEAELASLRAAFTQEVAVWHKLDHPNVTKFIGATMGGSELKIQSEDGEFGMPSNVCCVVVEYLQGGALKSYLIKNRRRKLAFKVVVQLALDLARGLSYLHSKKIVHRDVKTENMLLDKSRTVKIADFGVARVEAQNPNDMTGETGTLGYMAPEVLNGNPYNRKCDVYSFGICLWEIYCCDMPYPDLSFSEVTSAVVRQNLRPEIPRCCPSSLANVMKKCWDANPDKRPEMDEVVSMLEAIDTSKGGGMIPLDQQKGCLCFRKYRGP

SEQ ID NO: 9818 - protein, 379 aa, Manihot esculenta
MKENSDGFVRADQIDLKSLDEQLERHLNKVWTMDKNKRPDDSNIAPLPTAAVNATKTSAATFKKDRQEWEIDPSKLIIKSVIARGTFGTVHRGIYDGQDVAVKLLDWGEEGHRTEAEIASLRAAFSQEVAVWHKLDHPNVTKFIGATMGSSELQIQTENGHIGMPSNICCVVVEYLAGGALKSYLIKNRRRKLAFKVVVELALDLARGLSYLHSQKIVHRDVKTENMLLDKTRTVKIADFGVARVEASNPNDMTGETGTLGYMAPEVLNGNPYNRKCDVYSFGICLWEIYCCDMPYPDLSFSEVTSAVVRQNLRPEIPRCCPSSLANVMKRCWDANPDKRPEMDEVVSMLEAVDISKGGGMIPPDQQGGCLCFRRYRGP

SEQ ID NO: 9819 - protein, 367 aa, Vaccinium corymbosum
GFVRADQIDLKRLDEQLERHLNRAWTLEKKQQQHQQQLDSESFAAAAAAVKRPREDWEIDPTKLIIKGVLARGTFGTVHRGIYDGQDVAVKLLDWGEEGHRTEAEIASLRAAFTQEVAVWHKLDHPNVTKFIGATMGASGLSIQTENGQMGMPSNLCCVVVEYLPGGALKSYLIKNRRKKLAFKVVVQMALDLARGLSYLHSQKIVHRDVKTENMLLDKTRTVKIADFGVARVEASNPNDMTGETGTLGYMAPEVLNGNPYNRKCDVYSFGICLWEIYCCDMPYPDLSFSEVTSAVVRQNLRPEIPRCCPSSLANVMKRCWDANPDKRPEMDEVVSLLEAIDTTKGGGMIPHDQAQSCLCFRKHRGP

SEQ ID NO: 9820 - protein, 375 aa, Malus domestica
MKEKSDGGGGGGGYLRADQIDLKSLDEQLQRHLSRACTMEKNKKPEEDEEAVAASRSNTPRRQEWEIDPSKLVVKGAIARGTFGAVHRGMYDGQDVAVKLLDWGEEGHRSDAEIASLRAAFTQEVAVWHKLEHPNVTKFIGATMGSSELHIQTDNGQVGMPSNVCCVVVEYCPGGALKSYLIKNRRRKLAFKLVVQLALDLARGLCYLHSKKIVHRDVKTENMLLDKTRTVKIADFGVARVEASNPNEMTGETGTLGYMAPEVLNGHPYNRKCDVYSFGICLWEIYCCDMPYPDLSFSEVTSAVVRQNLRPEIPRCCPSALANVMKRCWDASPDKRPEMDEVVAMLEAIDTSKGGGMIPGDQPQGCFCFLKYRGP

SEQ ID NO: 9821 - protein, 316 aa, Pennisetum glaucum
RREDWEIDPAKLVVKGVIARGTFGTVHRGIYDGHDVAVKLLDWGEDGHRSEQDIAALRAAFSTEVSVWHKLDHPNVTKFLGAIMGARDLNIQTENGHIGMPTNICCVVVEYLAGGALKSFLIKNRRRKLAFKVVVQIALDLARGLSYLHSKKIVHRDVKTENMLLDKTRTVKIADFGVARLEAANPSDMTGETGTLGYMAPEVLNGNPYNRKCDVYSFGICLWEIYCCDMPYPDLSFSEVTSAVVRQNLRPEIPRCCPSSLANVMKRCWDANPDKRPEMAEVVSMMEAIDTSKGGGMLPVDQRPGCLSCFRQYRGP

SEQ ID NO: 9822 - protein, 383 aa, Populus trichocarpa
MKDQKSESDGGYVRADQIDLKSLDEQLQRHLSRAWTMEKNKNNKDGDQGEGDIEETPRLANNNNSTTIARQEWEIDPSKLIIKSVIARGTFGTVHRGIYDGQDVAVKLLDWGEEGHRSDAEIASLRAAFTQEVVVWHKLDHPNVTKFIGATIGSSELNIQTENGHIGMPSNICCVVVEYCPGGALKSYLIKNWRRKLAFKVVIQMALDLARGLSYLHSKKIVHRDVKTENMLLDKTRTVKIADFGVARLEASNPNEMTGETGTLGYMAPEVLNGNPYNRKCDVYSFSICLWEIYCCDMPYPDLSFSEVTSAVVRQNLRPEIPRCCPSALGNVMKRCWDANPDKRPEMEEVVSMLEAIDTSKGGGMIPSDQPQGCLCFRRYRGP

SEQ ID NO: 9823 - protein, 374 aa, Prunus persica
MKEKSESGGGYVRADQIDLKSLDEQLQRHLNRAWTMEKNKTREEEEEEEEEAASRQTAATRQDWEIDPSKLTVKGAIARGSFGTVHRGIYDGQDVAVKLLDWGEEGHRSDAEIASLRAAFTQEVAVWHKLDHPNVTKFIGATMGTSELHIQTDNGQVGMPSNVCCVVVEYCPGGALKSYLIKNRRKKLAFKLVVQLALDLARGLCYLHSKKIVHRDVKTENMLLDKTRTVKIADFGVARVEASNPNDMTGETGTLGYMAPEVLNGNPYNRKCDVYSFGICLWEIYCCDMPYPDLSFSEVTSAVVRQNLRPEMPRCCPSSLANVMKRCWDANPDKRPEMDEVVAMLEAIDTSKGGGMIPGDQPQGCFCFRRYRGP

SEQ ID NO: 9824 - protein, 379 aa, Manihot esculenta
MKENSDGFVRADQIDLKSLDEQLERHLNKVRTMDKSKRPDDAHLPLVASAAADSTKTSIPTFKKDRQEWEIDPSKLIIKTVIARGTFGTVHRGIYDGQDVAVKLLDWGEEGHRTEAEIASLRAAFSQEVAVWHKLDHLNVTKFIGATMGSAELQIQTENGQIGMPSNICCVVVEYLPGGALKSYLIKNRRRKLAFKVVVELALDLARGLSYLHSEKIVHRDVKTENMLLDKTRTVKIADFGVARVEASNPNDMTGETGTLGYMAPEVLNGNPYNRKCDVYSFGICLWEIYCCDMPYPDLSFSEVTSAVVRQNLRPEVPRCCPSSLANVMKRCWDANPDKRPEMDEVVSMLEAIDISKGGGMIPLDQQGGCLCFRRYRGP

SEQ ID NO: 9825 - protein, 382 aa, Populus trichocarpa
MKDQKSESGGGYVRADQIDLKSLDEQLQRHLSRAWTVEKNKSKNDGDQGEGEGETQRLTQNNNSTTITSHEWEIDPSKLIIKSVIARGTFGTVHRGIYDGQDVAVKLLDWGEEGHRSEAEVASLRAAFTQEVAVWHKLDHPNVTKFIGAAIGSSELNIQTENGHIGMPSNICCVVVEYCPGGALKSYLIKNRRRKLAFKVVVQLALDLARGLSYLHSKKIVHRDVKTENMLLDKTRTVKLADFGVARIEASNPNDMTGETGTLGYMAPEVLNGNPYNRKCDVYSFGICLWEIYCCDMPYPDLSFSEVTSAVVRQNLRPEIPRCCPSSLANIMKRCWDANPDRRPEMEVVVFMLEAIDTSMGGGMIPLDQPQGCLCFRRYRGP

SEQ ID NO: 9826 - protein, 384 aa, Fragaria vesca
MKEKNDTGGGGGGGAYVRADQIDLKSLDEQLQKHLGRAWTMEKNKNREEQEQEQERETEAARRVTVGPTRRQEWEIDPSKLTVKGAIARGTFGTVHRGIYDGLDVAVKLLDWGEEGHRSDAEIASLRAAFTQEVAVWHKLDHPNVTKFIGATMGTSELNIQTDNGQVGMPSNVCCVVVEYCPGGALKSYLIKNRRKKLAFKVVVQLALDLARGLGYLHSQKIVHRDVKTENMLLDKTRTVKIADFGVARVEASNPNDMTGETGTLGYMAPEVLNGNPYNRKCDVYSFGICLWEIYCCDMPYPDLSFSEVTSAVVRQNLRPEIPRCCPSALANVMKRCWDANPDKRPEMDEVVVMLEAVDTTKGGGMLPHDHPQGCLCFRRYRGP

SEQ ID NO: 9827 - protein, 372 aa, Cicer arietinum
MKKSESGGYVRADQIDLKSLDEQLQRHLSRAWTMEKKNKEKEDESEVEGRCSNTTTNHRQEWEIDPSKLLIKTVIARGTFGTVHRGVYDGQDVAVKLLDWGEEGHRSDAEIASLRAAFTQEVAVWHKLDHPNVTKFIGATMGTSDLQIQTETGHIGMPSNLCCVVVEYCPGGALKSYLIKNRRRKLAFKVVVQLALDLARGLSYLHMKKIVHRDVKTENMLLDKTRTLKIADFGVARIEASNPHDMTGETGTLGYMAPEVLNGSAYNRKCDVYSFGICLWEIYCCDMPYPDLSFSEVTSAVVRQNLRPEIPRCCPSSLANVMKRCWDANPDKRPEMDEVVTMLEAIDTSKGGGMIPLDQPQSCLCFRRYRGP

SEQ ID NO: 9828 - protein, 366 aa, Phalaenopsis aphrodite
MKEGGDGGGGFVRADQIDLRSLDEQLERHMSRALTMEKKMKGEEDVKRRREREEWEIDPAKLLIKGLIARGTFGTVHRGVYDGQDVAVKLLDWGEEGSRTEAEIASLRAAFTQEVSVWHKLDHPNVTKFIGATLGEADLNIQTENGQIGMSTNICCVVVEYLPGGPLKTYLIKNHRRKLAFKVVVQISLDLARGLSYLHSKKIVHRDVKTENMLLDRTRALKIADFGVARVEAQNPNDMTGETGTLGYMAPEVLNGNPYNRKCDVYSFGICLWEIYCCDMPYPDLTFSEITSAVVRQNLRPEIPRCCPNSLANVMKRCWDANPDRRPEMDDVVVMLEAIDTSKGGGMIPIGQQQGCLPCFGSYKGP

SEQ ID NO: 9829 - protein, 380 aa, Mimulus guttatus
MEKSSSNGFVRADQIDLKSLDEQLERHLSRTWTLEKNKINKDPNDSSAAAVAAATPAAAAVVPRRQRQEWEIDPSKLIVKGVLARGTFGTVHRGVYDGQDVAVKLLDYGEDGHRTESEIASLRAAFTQEVAVWHKLDHPNVTKFIGATMGSSGLNIQTETGHIGMPTNICCVIVEYLPGGALKSYLIKNRRRKLAFKVVVQMALDLARGLSYLHSEKIVHRDVKTENMLLDKTRTVKIADFGVARVEASNPHDMTGETGTLGYMAPEVLNGNAYNRKCDVYSFGICLWEIYCCDMPYPDLSFSEVTSAVVRQNLRPEIPRCCPSALANVMKRCWDASPDKRPEMDEVVSLIEAIDTSKGGGMIPVDQQQGCLCFRKTRGP

SEQ ID NO: 9830 - protein, 378 aa, Ambrosia trifida
NNSNNNDGFVRADQIDLKSLDEQLERHLNRVWTMENNKKKQPGNDVTTTITTALRLSPKPLAIKRQDWEIDPSKLIIKGVLARGTFGTVHRGIYDGVDVAVKLLDWGEEGHRSEAEIQSLRAAFTQEVVVWHKLDHPNVTKFIGATMGSSELQVQTENGQIGLPSNICCVVVEYLAGGALKSYLIKNRRKKLPFKVVVQIALDLARGLSYLHSQKIVHRDVKTENMLLDKTRTVKIADFGVARVEASNPNDMTGETGTLGYMAPEVLNGNPYNRKCDVYSFGICLWEIYCCDMPYPDLSFSEVTSAVVRQNLRPEIPRCCPSSLANVMKQCWDANPDKRPEMDEVVTMLEAIDTTKGGGMIPGDQAQGCLCFRRYRGP

SEQ ID NO: 9831 - protein, 381 aa, Vitis vinifera
MKESSDGFVRADQIDLKSLDEQLEKHLNRVWTMDKNKKKEDDSSSAAAAIPTLAPSTTASTTAPTTARQDWEIDPSKLIIKTVIARGTFGTVHRGVYDGQDVAVKLLDWGEEGHRTEAEIASLRAAFTQEVAVWHKLDHPNVTKFIGATMGSAELNIQTENGHIGMPSNICCVVVEYLPGGALKSYLIKNRRRKLAFKVVIQLALDLARGLSYLHSQKIVHRDVKTENMLLDKTRTVKIADFGVARVEASNPNDMTGETGTLGYMAPEVLNGSPYNRKCDVYSFGICLWEIYCCDMPYPDLSFSEVTSAVVRQNLRPEIPRCCPNSLANVMKRCWDANPDKRPEMDEVVAMIEAIDTSRGGGMLPVDQPQGCFCFRKYRGP

SEQ ID NO: 9832 - protein, 389 aa, Arnica chamissonis
MKENNNNSSSNNDGFVRADQIDLKSLDEQLERHLSRVWTMENSKKKQPDTQASAAATATSTATFRPLSSKSPATKRQEWEIDPSNLIIKSVLARGTFGTVHRGIYDGIDVAVKLLDWGEEGHRSEAEIQSLRAAFTQEVVVWHKLDHPNVTKFIGATMGSSDLHIQTENGQIGMPSNTCCVVVEYLPGGTLKSYLIKNRRKKLPFKVVVQIALDLARGLSYLHSQKIVHRDVKTENMLLDKTRTVKIADFGVARVEASNPNDMTGETGTLGYMAPEVLNGNPYNRKCDVYSFGICLWEIYCCDMPYPDLSFSEVTSAVVRQNLRPDIPRCCPSSLSNVMKQCWDANPDKRPEMDEVVTMLEAIDTTRGGGMIPGDQAQGCLCFRTYRGP

SEQ ID NO: 9833 - protein, 154 aa, Ambrosia trifida
MDHGKEQNKTPDSAATTTTTVRPPKRQEWEIDPSKLIIKSVLARGTFGTVHRGLYDGLDVAVKLLDWGEEGHRSEAEIQALRAAFTQEVVVWHKLDHPNVTKFIGATMGSSDLQIQTENGQIGMPSNICCVVVEYLPGGALKSYLIKTAEKASF

SEQ ID NO: 9834 - protein, 380 aa, Triphysaria pusilla
MEKISDGFVRADQIDLKSLDDQLERHLSRAWTMEKNRKKGLDDDDDSISAAAVAPVSAAANTIRRQKQDWEIDPSKLVIKGVIARGTFGTVHRGVYDGQDVAVKLLDWGEEGHRTEAEISSLRAAFTQEVVVWHKLDHPNVTKFIGATMGSAELNIQSENGPIGMPSNICCVVVEYLPGGALKNYLIKNRRKKLAFKVVMQMALDLARGLSYLHSQKIVHRDVKTENMLLDKSRTVKIADFGVARVEASNPHDMTGETGTLGYMAPEVLNGNAYNRKCDVYSFGICLWEIYCCDMPYPDLSFSEVTSAVVRQNLRPELPRCCPSSLANVMKRCWDANHDKRPEMDEVVTMLEAIDTSKGGGMIPNDQQQGCLCFRKHRGP

SEQ ID NO: 9835 - protein, 385 aa, Lactuca sativa
MKENNNNDGFVRADQIDLKSLDEQLERHLNRAWTMEKNKKKQPDFEDSATAASAASAVTLPSKATATSKRERQEWEIDPSKLLIKGILARGTFGTVHRGVYDGIDVAVKLLDWGEEGHRTEAEIQSLRAAFTQEVAVWHKLDHPNVTKFIGATMGSSELNVQTENGQIGMPSNICCVVVEYLPGGALKNYLIKNRRKKLAFKVVVQMALDLARGLSYLHSQKIVHRDVKTENMLLDKSRTIKIADFGVARVEASNPNDMTGETGTLGYMAPEVLNGNPYNRKCDVYSFGICLWEIYCCDMPYPDLSFSEVTSAVVRQNLRPEIPRCCPSSLSNVMKRCWDANPDKRPEMDEVVTMLEAIDTSKGGGMIPGDQPQGCLCFRKHRGP

SEQ ID NO: 9836 - protein, 351 aa, Cichorium intybus
MEKNKKKQPDFEDSATAASAASAVTLPSKATATSKRERQEWEIDPSKLLIKGILARGTFGTVHRGVYDGIDVAVKLLDWGEEGHRTEAEIQSLRAAFTQEVAVWHKLDHPNVTKFIGATMGSSELNVQTENGQIGMPSNICCVVVEYLPGGALKNYLIKNRRKKLAFKVVVQMALDLARGLSYLHSQKIVHRDVKTENMLLDKSRTIKIADFGVARVEASNPNDMTGETGTLGYMAPEVLNGNPYNRKCDVYSFGICLWEIYCCDMPYPDLSFSEVTSAVVRQNLRPEIPRCCPSSLANVMKRCWDANPDKRPEMDEVVVMLEAIDTTKGGGMIPGDQPQGCLCFRKHRGP

SEQ ID NO: 9837 - protein, 363 aa, Papaver somniferum
MKENNDGFVRADQIDLKSLDEQLERHLSRAWTMEKQRDGTATGGNDRAGREEWEIDPAKLIIKTVIARGTFGTVHRGIYDGLDVAVKLLDWGEEGHRTESEIASLRTAFTQEVVVWHKLDHPNVTKFIGATMGNSGLSIQSDSGFIGMPSNICCVVVEYLPGGALKSYLIKNRRKKLPFKVVVQLALDLARGLSYLHSKKIVHRDVKTENMLLDKQRTVKIADFGVARVEAQNPHDMTGETGTLGYMAPEVLNGNPYNRKCDVYSFGICLWEIYCCDMPYPDLSFSEVTSAVVRQNLRPEVPRCCPSALSNVMKKCWDANPDKRPEMDEVVTLIEAIDTTKGGGMIPADQAQGCLCFRKTRGP

SEQ ID NO: 9838 - protein, 330 aa, Zea mays
MAAADPDTEVQAEFPPLVRQYKSGRVERFFNLAPLPAGTDPATGVVSKDVVVDPATGLWARLFLPAGSHGKKLPVVVYYHGGAYVIGSAADPMTHGYLNALVAKAGVLAVALEYRLAPEHPLPAAYEDSWEGLKWVATHASASAAAGGGPAAEPWLTEHGDFSRVFLAGASAGATIAHFVAVRAGEQHKSGGLGMRIRGLLIVHPYFSGAADIGDEGTTGKARKARADAFWRFLCPGTPGLDDPLSNPFSEAAGGSAARVAAERVLVCVAEKDDLRDRGVWYYESLKASGYPGEVELLESMGEGHVFYCMNPRCDRAREMEERVLGFLRK

SEQ ID NO: 9839 - protein, 325 aa, Setaria italica
MAAAADPDTEVQADFFPMVRQYRSGRVERFMNMPPLPAGTDPATGVASKDVVLDPATGVWARLFLPPGVPKGKKLPVVVYYHGGAYVVGSAADPFTHSYLNALVAEAGVLAVAPEYRLAPEHPLPAAYDDSWEALRWVASHAAGGTGPEPWLAEHGDFSRVFLAGASAGGTIAHVVAARAGGHGAGGLGMRVRGLLIVHPYFSGAADIGDEGAAGKERKARADAFWRFLYPGSPGLDDPLSNPFSEAAGGSAARVAAERVLVCVAEEDDLRDRGVWYYENLKASGYPGEVELLESTGEGHVFYCINPRCDKAREMQERVLSFLRK

SEQ ID NO: 9840 - protein, 140 aa, Saccharum officinarum
MTVEKVDAALADFDAHFDRLFASPDAASDGKVKLLLFLADREPDSSLTWCPDCNVAEPVIYERLEEALQGRDAVLLRAYVGDKPTWRDPAHPWRVDPRFGLKGVPTLIRWEDGAAAARLGDDEAHLKDKVDALLCAAGGN

SEQ ID NO: 9841 - protein, 138 aa, Zea mays
MTVEKVDAGLSDFDAHFDRLFASPDAASDGKVKLLLFLADRKPGSSLSWCPDCNVAEPVIYERLEALEGKDAVLLRAYVGDKPTWRDPAHPWRVDPRFGLKGVPTLIRWEDGAAAARLGDDEAHLKDKVDALLCAGGN

SEQ ID NO: 9842 - protein, 138 aa, Pennisetum glaucum
MTVEKVDATLADFAAHFDRLFASPDAASDGKLKLLLFLADREPGSSRSWCPDCNVAEPVIYERLEALQGRDAVLLRAYVGDKPTWRDPAHPWRVDPRFALKGVPTLIRWEGGTAAARLGDEEAHLKDKVDALLGAGGN

SEQ ID NO: 9843 - protein, 138 aa, Setaria italica
MTVQKVDATLADFSAHFDRLIASPAAASDGKLKLLLFLADREPGSSLTWCPDCNVAEPVIYERLEALQGRDAVLLRAYVGDKPTWRDPAHPWREDPKFGIKGVPTLIRWENGGAAARLGDEEAHLKDKVDALLGVGGN

SEQ ID NO: 9844 - protein, 351 aa, Zea mays
MASSSSSPAPALAGEALRQKRILSSKLYLEVPSSKAPVVYSPAYDISFLGLEKLHPFESAKWGRICRYLTREGYLDKKQMVEPLEACKEDLLVVHTEAYLNSLKCSFRVSSIVEVPPVSLVPNWIVHRKLLHPFRKQVGGSILSAKLAFERGWAINVGGGFHHCSADEGGGFCAYADISLCIQFAFVRLNISSVLIIDLDAHQGNGHEKDFANDGRVYILDMYNAGIYPFDFTAKQYIDQKVELVSGSKTDEYLEQLDKALEICNSRFEPQLIVYNAGTDILDGDPLGRLKVSPEGVVTRDEKVFRFAKDRNIPLLMLTSGGYMKSSARVIADSIINLSNKNLIGLGSQLG

SEQ ID NO: 9845 - protein, 351 aa, Setaria italica
MASSSASPAPAPAGESLRQKRILSSKLYLEVPSSKAPVVYSPAYDISFLGLEKLHPFDSAKWGRICRYLTREGHLEKKQVVEPLEACKEDLLVVHTEAYLNSLKCSFRVASIVEVPPVSLVPNWIVQKKLLYPFRKQVGGSILSAKLALERGWAINVGGGFHHCSAEEGGGFCAYADISLCIQFAFVRLNISRLLIIDLDAHQGNGHEKDFANDGRVYILDMYNAGIYPFDFTAKQYIDQKVELASGTKTDEYLELLDKALEVCKSRFQPQLIVYNAGTDILDGDPLGRLKISPEGVITRDEKVFRFAKDQNIPLLMLTSGGYMKSSARVIADSIINLANKNLIELGSQLG

SEQ ID NO: 9846 - protein, 352 aa, Panicum virgatum
MAASSSSSPAPAPAGEPLRQKRILSSKLYLDVPSSKAPVVYSPAYDISFLGLEKLHPFESAKWGRICRYLTREGHLEKKKLVEPLEACKEDLLVVHTEAYLNSLKSSYRVASIVEVPPVSLVPNWIVHKKLLYPFRKQVGGSILSAKLALERGWSINVGGGFHHCSAEEGGGFCVYADISLCIQFAFVRLNISSVLIIDLDAHQGNGHEKDFANDGRVYILDMYNAGIYPFDFTAKQYIDQKVELVSGTKTDEYLELLDNALEVSKSRFQPQLIVYNAGTDILDGDPLGKLEISPEGVVARDEKVFRFAKDQNIPLLMLTSGGYMKSSARVIADSIINLSNKNLIELGNQLG

SEQ ID NO: 9847 - protein, 322 aa, Pennisetum glaucum
EVPSPKAPVVYSPAYDVSFLGLEKLHPFDSAKWGRICRYLTREGHLEKKRVVEPLEACKEDLLVVHTEAYLKSLKCSFRVASIVEVPPVSLVPNWIVQRKLLYPFRKQVGGSILSAKLALERGWAINVGGGFHHCSAEEGGGFCAYADISLCIQFAFVRLNISSVLIIDLDAHQGNGHEKDFANDGRVYILDMYNAGIYPFDFTAKQYIDQKVELASGTKTDEYLELLDKDLEVCKSRFQPQLIVYNAGTDILDGDPLGRLKISPEGVATRDEKVFRFAKDQNIPLLMLTSGGYMKSSARVIADSIINLSNKNLIELGSQLG

SEQ ID NO: 9848 - protein, 352 aa, Oryza sativa
MASSAPSAAAGATPPDPLRRDRILSSKLYLDVPGSKAPVVYSPAYDIAFLGIEKLHPFDSSKWGRICKFLTKEGHLEKNRVVEPLEATKDDLLVVHSESYLNSLKSSLKVASIVELPPVAFIPNWLVQQKLLYPFRKQVGGSILSAKLALERGWAINVGGGFHHCSAEQGGGFCAYADISLCIQFAFVRLNISRVMIIDLDAHQGNGHEKDFANDGRVYTLDMYNAGIYPYDHVAKRYIDQKVELVSGTKTEDYLDQLDKALKVAESRFQPQLIVYNAGTDILDGDPLGRLKISPQGVVIRDEKVFRFAKDQSIPLLMLTSGGYMKSSARVIADSIINLSNKNLIELGSQLG

SEQ ID NO: 9849 - protein, 352 aa, Brachypodium distachyon
MSSPSASSASGPSPADLLRHNRILSSKLYLDVPPSKVPVIYSVAYDIAFLGIEKLHPFDSAKWGRICKFLTKEGHLEKNRVVEPLEASKEDLLVVHTQSYLNSLKTSFRVATIMEVPPVSLIPNWLVQQKLLFPFRKQVGGSILSAKLALERGWAINVGGGFHHCSAEEGGGFCAYADISLCIQFAFDRLNISRVMIIDLDAHQGNGHEKDFADDGRVYILDMYNAGIYPFDHAAKRYIDQKVELVSGTKTDDYLDQLDQALEVAQTRFQPQLIVYNAGTDILDGDPLGRLEISPEGVVNRDEKVFRFAVDQNIPLLMLTSGGYMKSSARVIADSIINLSQKELIQLSSQLD

SEQ ID NO: 9850 - protein, 353 aa, Secale cereale
MSSSSAAASVPGATPADALRRNRILSSKLYFDVPGSKAPVVYSTAYDIAFLGIEKMHPFDSSKWGRICRFLTREGHLENKRVVEPLEASKEDLLVVHTEAYLNSLKSSFRVAAIVEVPPLTLMPNWLVQQKLLYPFRKQVGGSILSAKLALERGWAINVGGGFHHCSAEEGGGFCAYADITLCIQFAFVRLNISRVMIIDLDAHQGNGHEKDFANDGRVYILDMYNAGIYPLDHAAKRYIDQKVELVSGTETDDYLDQLDKALKVAQTRFQPHLIIYNAGTDILDGDPLGNLKISPEGVVIRDEKVFRFAKDQNIPLVMMTSGGYMKSSARVIADSITNLSQKDLIQLGSQPD

SEQ ID NO: 9851 - protein, 353 aa, Triticum aestivum
MSSSSAAASVPGATPADALRRNRIISSKLYFDVPGSKAPVVYSTAYDIAFLGIEKMHPFDSSKWGRICRFLTKEGHLEKKRVVEPLEASKEDLLVVHTEAYLNSLKSSFRVAAIVEVPPLTLMPNWLVQQRLLYPFRKQVGGSILSAKLALERGWAINVGGGFHHCSAEEGGGFCAYADISLCIQFAFVRLDISRVMIIDLDAHQGNGHEKDFANDGRVYILDMYNAGIYPFDHAAKRYIDQKVELVSGTETDDYLDQLDKALKVAQTRFQPQLIIYNAGTDILDGDPLGNLKISPEGVVIRDEKVFRFAKDQNIPLVMMTSGGYMKSSARVIADSITNLSQKDLIQLGSQPD

SEQ ID NO: 9852 - protein, 361 aa, Zea mays
MAAARRGRGDGANGVVRPRPRDRGIGGGSMAGRVAVLAFCVAGIWSAYIYQGVLQETLSTKRFGPDARRFEHLAFLNFAQNVICFVWSFIMIKLWSGGSSSNGSAPIWKYWGVSVTNTIGPTMGIEALKYISYPAQVLAKSSKMIPVMLMGTLLYGVKYTLPEYLCTFLVAGGVSSFALLKTSSKTIKKLANPNAPLGYTLCFLNLAFDGYTNSTQDLIKSRYPKTNPWDIMLGMNLWGTIYNAVIMFVAPLLFSNWPYANGFEALRFCQENPEVAWDIFLFCLCGAVGQNFIFLTISRFGSLTNTTITTTRKFMSIVVSSVISGNPLSLKQWGSVVMVFLGLSIQIYLKWKRKKGREHKE

SEQ ID NO: 9853 - protein, 365 aa, Setaria italica
MASARRGRGGGGANGVIRPRPRDRGDAAGGGGSMAGRVAVLAFCVAGIWSAYIYQGVLQETLSTKRFGPEARRFEHLAFLNFAQNVMCFVWSFIMIKLWSGGSSSTGRAPLWKYWGVSVTNTIGPTMGIEALKYISYPAQVLAKSSKMIPVMLMGTLLYGVKYTFPEYLCTFLVAGGVSSFALLKTSSKTIKKLANPNAPLGYALCFLNLAFDGYTNSTQDLIKSRFPKTNPWDIMLGMNLWGTIYNALIMFVAPLLFSNWPYANGFEAVKFCQENPEVAWDIFLFCLCGAVGQNFIFLTISRFGSLTNTTITTTRKFMSIVVSSVISGNPLSLKQWGSVVMVFSGLSIQIFLKWKKKKGREHKE

SEQ ID NO: 9854 - protein, 357 aa, Brachypodium distachyon
MVSVRKGRGGGGGVRSRPRVDGGGSLASRVAVLAFCVAGIWSAYITQGVLQETLSTKRFGPEARRFDHLAFLNFAQNVVCFVWSFIMIKLWSGGSNPAGRAPLSKYWGVSITNTIGPTMGIEALKYISYPAQVLAKSSKMIPVMLMGTLLYGVKYTLPEYFCTFLVAGGVSSFALLKTSSKTIKKLANPNAPLGYTLCFLNLAFDGYTNSTQDLIKSRYPKTNPWDIMLGMNLWGTIYNTVIMFVAPLLFSNWPYANGFEAVRFCQQNPEVAWDIIMFCLCGAVGQNFIFLTISRFGSLTNTTITTTRKFMSIVISSVISGNPLSLEQWGSVVMVFSGLSLQIYLKWQRKKGRDHKE

SEQ ID NO: 9855 - protein, 360 aa, Secale cereale
MVSARKGQGRGGGVRSRPRVDGAGGSGSLASRVAVLAFCVGGIWSSYITQGILQETLSTKRFGPEERRFDHLAFLNFAQNVVCFVWSFIMIKLWSGGSSPAGRAPLLKYWGVSITNTIGPTMGIEALKYISYPAQVLAKSSKMIPVMLMGTLLYGVKYTLPEYFCTFLVAGGVSSFALLKTSSKTIKKLANPNAPLGYGLCFLNLAFDGYTNSTQDLIKSRYPKTNPWDIMLGMNLWGTIYNTVIMFVAPLLFSNWPYANGFEAVSFCRENPEVAWDILMFCLCGAVGQNFIFLTISRFGSLTNTTITTTRKFMSIVISSVISGNPLSMEQWGSVVMVFSGLSLQIYLKWKRKKGRDHKE

SEQ ID NO: 9856 - protein, 358 aa, Oryza sativa
MVTARKGRGGRGPPRPRVVDGGGGSMVSRVAVLAFCVAGIWSAYITQGVLQETLSTKRFGPEARRFDHLAFLNFAQNVVCFVWSFIMIKLWSSGGSSSAGRAPLRKYWGVSITNTVGPAMGIEALKFISYPAQVLAKSSKMIPVMLMGTILYGVKYTFPEYICTFLVAGGVSSFALLKTSSKTIKKLANPNAPLGYTLCFLNLAFDGYTNSTQDLIKSRYPKTNPWDIMLGMNLWGTIYNAVIMFVAPLLFSNWPYANGFEAVRFCQENPEVAWDILLFCLCGAVGQNFIFLTISRFGSLTNTTITTTRKFMSIVISSVISGNPLSLKQWGSVVMVFSGLSLQIFLKWKRKKVRDHKE

SEQ ID NO: 9857 - protein, 332 aa, Panicum virgatum
MAGRVAVLAFCVAGIWSAYIYQGVLQETLSTKRFGPEARRFEHLAFLNFAQNVVCFVWSFIMIKLWSGGSSSAGRAPLWKYWGVSVTNTIGPTMGIEALKYISYPAQVLAKSSKMIPVMLMGTLLYGVKYTFPEYLCTFLVAGGVSSFALLKTSSKTIKKLANPNAPLGYALCFLNLAFDGYTNSTQDLIKSRYPKTNPWDIMLGMNLWGTIYNAVIMFVAPLLFSNWPYANGFEAVRFCQENPEVAWDIFLFCLCGAVGQNFIFLTISRFGSLTNTTITTTRKFMSIVVSSVISGNPLSPKQWGSVVMVFSGLSIQIYLKWKKKKGREHKE

SEQ ID NO: 9858 - protein, 357 aa, Leymus cinereus x Leymus triticoides
MASARKGQGRGGGVRSRPRVDGGGSLASRVAVLAFCVGGIWSSYITQGILQETLSTKRFGPEARRFDHLAFLNFAQNVVCFVWSFIMIKLWSGGSSPAGRAPLLKYWGVSITNTIGPTMGIEALKYISYPAQVLAKSSKMIPVMLMGTLLYGVKYTLPEYFCTFLVAGGVSSFALLKTSSKTIKKLANPNAPLGYGLCFLNLAFDGYTNSTQDLIKSRYPKTNPWDIMLGMNLWGTIYNTVIMFVAPLLFSNWPYANGFEAVSFCRENPEVAWDILMFCLCGAVGQNFIFLTISRFGSLTNTTITTTRKFMSIVVSSVIGGNPLSMEQWGSVVMVFSGLSLQIYLKWKRKKGRDHKE

SEQ ID NO: 9859 - protein, 358 aa, Triticum aestivum
MVSARKGQGRGGGVRGPPRVDGGGGSLASRVAVLAFCVAGIWSSYITQGILQETLSTKRFGPEERRFDHLAFLNFAQNVVCFVWSFIMIKLWSGGSSPAGRAPLLKYWGVSITNTIGPTMGIEALKYISYPAQVLAKSSKMIPVMLMGTLLYGVKYTLPEYFCTFLVAGGVSSFALLKTSSKTIKKLANPNAPLGYGLCFLNLAFDGYTNSTQDLIKSRYPKTNPWDIMLGMNLWGTIYNTVIMFVAPLLFSNWPYANGFEAVSFCRENPEVAWDILMFCLCGAVGQNFIFLTISRFGSLTNTTITTTRKFMSIVISSVISGNPLSMEQWGSVVMVFSGLSLQIYLKWKRKKGRDHKE

SEQ ID NO: 9860 - protein, 357 aa, Hordeum vulgare
MVSARKGQGRGGGVRSRPRVDGGGSLASRVAVLAFCVGGIWSSYITQGILQETLSTKRFGPEERRFDHLAFLNFAQNVVCFVWSFIMIKLWSGGSSPAGRAPLLKYWGVSITNTIGPTMGIEALKYISYPAQVLAKSSKMIPVMLMGTLLYGVKYTLPEYFCTFLVAGGVSSFALLKTSSKTIKKLANPNAPLGYGLCFLNLAFDGYTNSTQDLIKSRYPKTNPWDIMLGMNLWGTIYNTVIMFVAPLLFSNWPYANGFEAVSFCRENPEVAWDILMFCLCGAVGQNFIFLTISRFGSLTNTTITTTRKFMSIVISSVISGNPLSMEQWGSVVMVFSGLSLQIYLKWKRKKGRDHKE

SEQ ID NO: 9861 - protein, 359 aa, Avena sativa
MVSARKGRGGGGVGGGRSRPRVDGGGSLASRVAVLAFCVAGICSSYITQGVLQETLSTKRFGPEARRFDHLAFLNFAQNVVCFVWSFIMIKLWSGGSSPAGRAPLSKYWGVSITNTIGPTMGIEALKYISYPAQVLAKSSKMIPVMLMGTLLYGVKYTLPEYFCTFLVAGGVSSFALLKTSSKTIKKLANPNAPLGYALCFLNLAFDGYTNSTQDLIKSRYPKTNPWDIMLGMNLWGTIYNTVIMFVAPLLLSNWPYANGFEAVKFCQENPEVAWDILMFCLCGAVGQNFIFLTISRFGSLTNTTITTTRKFMSIVISSVISGNPLSLEQWGSVVMVFSGLSLQIYLKWKRKKGREHKE

SEQ ID NO: 9862 - protein, 354 aa, Brachypodium distachyon
MVSVRKGRGGVRSRPRVDGGGSLASRVAVLAFCVAGIWSAYITQGVLQETLSTKRFGPEARRFDHLAFLNFAQNVVCFVWSFIMIKLWSSGSNPAGRVPLSKFWGVSITNTIGPTMGIEALKYISYPAQVLAKSSKMIPVMLMGTLLYGVKYTLPEYFCTFLVAGGVSSFALLKTSSKTIKKLANPNAPLGYALCFLNLAFDGYTNSTQDLLKSRYPKTNPWDIMLGMNLWGTIYNTVIMFVAPLLLSNWPYANGFEAVRFCQQNPEVAWDILMFCLCGAMGQNFIFLTISRFGSLTNTTITTTRKFMSIVISSVISGNPLSLEQWGSVVMVFSGLSLQIYLKWQRKKGRDHKE

SEQ ID NO: 9863 - protein, 360 aa, Triticum aestivum
MVSARKGQGRGGGARGPPRVDGGGGGGSLASRVAVLAFCVAGIWSSYITQGILQETLSTKRFGPEERRFDHLAFLNFAQNVVCFVWSFIMIKLWSGGSSPAGRAPLLKYWGVSITNTIGPTMGIEALKYISYPAQVLAKSSKMIPVMLMGTLLYGVKYTIPEYFCTFLVAGGVSSFALLKTSSKTIKKLANPNAPLGYGLCFLNLAFDGYTNSTQDLIKSRFPKTNPWDIMLGMNLWGTIYNTLIMFVAPLLFSNWPYANGFEAVSFCRENPEVAWDILMFCLCGAVGQNFIFLTISRFGSLTNTTITTTRKFMSIVISSVISGNPLSMEQWGSVVMVFSGLSLQIYLKWKRKKGRDHKE

SEQ ID NO: 9864 - protein, 332 aa, Pennisetum glaucum
MAGRVAVLAFCVAGIWSAYIYQGVLQETLSTKRFGPAARRFEHLAFLNFAQNVMCFVWSFIMIKLWSGGSSSAGRAPLCKYWGVSVTNTIGPTMGIEALKYISYPAQVLAKSSKMIPVMLMGTLLYGVKYTFPEYLCTFLVAGGVSSFALLKTSSKTIKKLANPNAPLGYALCFLNLAFDGYTNSTQDLIKSRFPKTNPWDIMLGMNLWGTIYNAVIMFVAPLLFSSWPYANGFEAVKFCQENPEVAWDIFLFCLCGAVGQNFIFLTISRFGSLTNTTITTTRKFMSIVVSSVISGNPLSLKQWGSVVMVFSGLSIQIFLKWKKKKGREHKE

SEQ ID NO: 9865 - protein, 358 aa, Pseudoroegneria spicata
  misc_feature (4)..(4): Xaa can be any naturally occurring amino acid
  misc_feature (245)..(245): Xaa can be any naturally occurring amino acid
  misc_feature (285)..(285): Xaa can be any naturally occurring amino acid
MVSXRKGQGRGGGVRSRPRVDSGGGSLASRVAVLAFCVGGIWSSYITQGILQETLSTKRFGPEERRFDHLAFLNFAQNVVCFVWSFIMIKLWSGGSSPAGRAPLLKYWGVSITNTIGPTMGIEALKYISYPAQVLAKSSKMIPVMLMGTLLYGVKYTIPEYFCTFLVAGGVSSFALLKTSSKTIKKLANPNAPLGYGLCFLNLAFDGYTNSTQDLIKSRYPKTNPWDIMLGMNLWGTIYNTVIMXVAPLLFSNWPYANGFEAVSFCRENPEVAWDILMFCLCGAXGQNFIFLTISRFGSLTNTTITTTRKFMSIVISSVISGNPLSMEQWGSVVMVFSGLSLQIYLKWKRKKGRDHKE

SEQ ID NO: 9866 - protein, 311 aa, Saccharum officinarum
QGVLQETLSTKRFGPEARRFEHLAFLNFAQNVICFVWSFIMIKLWSSGSSSDGRAPLWKYWGVSITNTIGPTMGIEALKYISYPAQVLAKSSKMIPVMLMGTLLYGVKYTLPEYFCTFLVAGGVSSFALLKTSSKTIKKLANPNAPLGYTLCFLNLAFDGYTNSTQDLIKSRYPKTNPWDIMLGMNLWGTIYNAVIMFVAPLLFSNWPYANGFEALRFCQENPEVAWDIFLFCLCGAVGQNFIFLTISRFGSLTNTTITTTRKFMSIVVSSVISGNPLSLKQWGSVVMVFLGLSIQIYLKWKRKKGRDHKE

SEQ ID NO: 9867 - protein, 394 aa, Zea mays
MATSSTALLHLVIPASRRRRHLVPRAAHSESAPPAASVDRRRFIAHTAAAAAVSPLVLPRWTPAARADEAPALSEWERIFLPIDSGVVLLDIAFVPDDPSHGFLLGTRQTILETKDGGNTWFPRSIPSAEDEDFNYRFNSVSFKGREGWIIGKPAILLHTSDAGESWERIPLSAQLPGNMVYIKATGEQSAEMVTDEGAIYVTSNRGYNWKAAVQETVSATLNRTVSSGISGASYYTGTFNTVNRSADGRYVAVSSRGNFYLTWEPGQPFWQPHNRAVARRIQNMGWRADGGLWLLVRGGGLFLSRGTGITEDFEEVQVQSRGFGILDVGYRSQEEAWAAGGSGVLLKTTNGGKSWMRDKAADNIAANLYSVKFLDDRKGFVLGNDGVLLRYLG

SEQ ID NO: 9868 - protein, 395 aa, Setaria italica
MATSSAATASLHLLLPASRRRRLLVPRATTHSNSDPTAVDRRRFIAHTAAAAAVAPLVLPRWTPTARADDAPALSEWERVFLPIDPGVVLLDIAFVPDDPSHGFLLGTRQTILETKDGGNTWFPRSIPSAEDEDFNYRFNSVSFKGKEGWIIGKPAILLHTSNAGESWERIPLSAQLPGNMVYIKATGEQSAEMVTDEGAIYVTSNRGYNWKAAVQETVSATLNRTVSSGISGASYYTGTFNTVNRSPDGRYVAVSSRGNFYLTWEPGQPFWQPHNRAVARRIQNMGWRADGGLWLLVRGGGLFLSKGTGITEDFEEVQVQSRGFGILDVGYRSQDEAWAAGGSGVLLKTTNGGKNWVRDKAADNIAANLYSVKFLDDRKGFVLGNDGVLLRYLG

SEQ ID NO: 9869 - protein, 390 aa, Panicum virgatum
MATSSTATASLHLLLPTSRRRRLLVPRADCTVDRRRFIAHTAAAVAPLVSLSPPVWTPPAARADEAPALSQWERVYLPIDPGVVLLDIAFVPDDPSHGFLLGTRQTILETKDGGNTWFPRSIPSAEDEDFNYRFNSVSFKGKEGWIIGKPAILLHTSDAGESWERIPLSAQLPGNMVYIKATGEQSAEMVTDEGAIYVTSNRGYNWKAAVQETVSATLNRTVSSGISGASYYTGTFNTVNRSPDGRYVAVSSRGNFYLTWEPGQPFWQPHNRAVARRIQNMGWRADGGLWLLVRGGGLFLSKGTGITEDFEEVQVQSRGFGILDVGYRSQDEAWAAGGSGVLLKTTNGGKSWVRDKAADNIAANLYSVKFLDDSKGFVLGNDGVLLRYLS

SEQ ID NO: 9870 - protein, 394 aa, Oryza sativa
MATTASLHLHLHLLLSSSRRRCRLLVPRAHTDSISTGRRRFIADTATASAAAAVGPLVLPRTPLARADQPPSLSEWERVLLPIDPGVVLLDIAFVPDDPSHGFLLGTRQTILETKNGGNTWFPRSIPSAEDEDFNYRFNSVSFMGKEGWIIGKPAILLHTSDAGDSWERIPLSAQLPGNMVYIKATGEQSAEMVTDEGAIYVTSNRGYNWKAAVQETVSATLNRTVSSGISGASYYTGTFNTVNRSPDGRYVAVSSRGNFYLTWEPGQPFWQPHNRAVARRIQNMGWRADGGLWLLVRGGGLFLSKGSGITEDFEEASVQSRGFGILDVGYRSKDEAWAAGGSGVLLKTTNGGKTWVRDKAADNIAANLYSVKFLGDNKGYVLGNDGVLLRYVG

SEQ ID NO: 9871 - protein, 389 aa, Brachypodium distachyon
MATAAAALHLLLPNSSRRRCRLLVPRASSSSSSSPTRRGLIADTATAAAAMAAAPLLPWTPAARAEDLSEWQRVKLPIDPGVVLLDIAFVPDDPSHGFLLGTRQTILETKDGGNSWFPRSIPSAEDEDFNYRFNSVSFMGKEGWIVGKPAILLHTKDAGESWERIPLSAQLPGDMVYIQATGEQSAEMVTDEGAIYVTSNRGYNWKAAVQETVSATLNRTVSSGISGASYYTGTFNTVNRSPDGRYVAVSSRGNFYLTWEPGQLYWQPHNRAVARRIQNMGWRADGGLWLLVRGGGLFLSKGTGITEEFEEASVQSRGFGILDVGYRSKDEAWAAGGSGVLLKTMNGGKSWVRDKAADNIPGNLYSVKFVGDNQGFVLGNDGVLLRYVG

SEQ ID NO: 9872 - protein, 389 aa, Hordeum vulgare
MATATAALHLLLPTRRRGRLLVPRACQADSSTTTSRRGLIADAATAAVAAAAAPLLLPRIPAARAEDLSEWERVGLPIDPGVVLLDIAFVPDDPSHGFLLGTRQTILETKDGGRTWFPRSIPSAEDEDFNYRFNSVSFSGKEGWIVGKPAILLHTKDAGDSWERIPLSAQLPGDMVYIQATGEQSAEMVTDEGAIYVTSNRGYNWKAAVQETVSATLNRTVSSGISGASYYTGTFNTVNRSPDGSYVAVSSRGNFFLTWEPGQLYWQPHNRAVARRIQNMGWRADGGLWLLVRGGGLFLSKGTGIVEDFEEASVQSRGFGILDVGYRSKDEAWAAGGSGVLLKTTNGGKTWVRDRAADNIPGNLYSVKFIGDNQGFVLGNDGVLLRYVG

SEQ ID NO: 9873 - protein, 389 aa, Triticum aestivum
MATATAALHLLLPTRRRGRLLVPRACQADSSATTSRRGLIADTATAAVVAAAAPLLLPRLPAARAEDLSEWERVGLPIDPGVVLLDIAFVPDDPSHGFLLGTRQTILETKDGGRTWFPRSIPSAEDEDFNYRFNSVSFSGKEGWIVGKPAILLHTKDAGDSWERIPLSAQLPGDMVYIQATGEQSAEMVTDEGAIYVTSNRGYNWKAAVQETVSATLNRTVSSGISGASYYTGTFNTVNRSPDGSYVAVSSRGNFFLTWEPGQLYWQPHNRAVARRIQNMGWRADGGLWLLVRGGGLFLSKGTGIVEDFEEASVQSRGFGILDVGYRSKDEAWAAGGSGVLLKTTNGGKTWVRDRAADNIPGNLYSVKFIGDNQGFVLGNDGVLLRYVG

SEQ ID NO: 9874 - protein, 387 aa, Leymus cinereus x Leymus triticoides
MATATAALHLLLPTRHRGRLLAPRACQADNTTSRRGLIADTATATVAAAAAPLLLPRIPAARAEDLSEWERVGLPIDPGVVLLDIAFVPDDPSHGFLLGTRQTILETKDGGRTWFPRSIPSAEDEDFNYRFNSVSFSGKEGWIVGKPAILLHTKDAGDSWERIPLSAQLPGDMVYIQATGEQSAEMVTDEGAIYVTSNRGYNWKAAVQETVSATLNRTVSSGISGASYYTGTFNTVNRSPDGSYVAVSSRGNFFLTWEPGQLYWQPHNRAVARRIQNMGWRADGGLWLLVRGGGLFLSKGTGIVEDFEEASVQSRGFGILDVGYRSKDEAWAAGGSGVLLKTTNGGKTWVRDRAADNIPGNLYSVKFIGDNQGFVLGNDGVLLRYVG

SEQ ID NO: 9875 - protein, 395 aa, Leymus cinereus x Leymus triticoides
MATAIAALRLLLPSSSSSRRRGHLLVPHACQADSSSSSTTSRRGLIADTATAAVAAAAAPLLLPRLPAARAEDLSEWERVGLPIDPGVVLLDIAFVPDDPSHGFLLGTRQTILETKDGGRTWFPRSIPSAEDEDFNYRFNSVSFSGKEGWIVGKPAILLHTKDAGDSWERIPLSAQLPGDMVYIQATGEQSAEMVTDEGAIYVTSNRGYNWKAAVQETVSATLNRTVSSGISGASYYTGTFNTVNRSPDGSYVAVSSRGNFFLTWEPGQLYWQPHNRAVARRIQNMGWRADGGLWLLVRGGGLFLSKGTGIVEDFEEASVQSRGFGILDVGYRSKDEAWAAGGSGVLLKTTNGGKTWVRDRAADNIPGNLYSVKFIGDNQGFVLGNDGVLLRYVG

SEQ ID NO: 9876 - protein, 372 aa, Avena sativa
PTRRLRLLVPRACSSSSPTRRGLIATSAVAAAAAPLLLPGRTPAALAAEPLSEWERVGLPIDPGVVLLDIAFVPDDPSHGFLLGTRQTILETKDGGSSWFPRSIPSAEDEDFNYRFNSVSFSGKEGWIVGKPAILLHTKDAGDSWERIPLSAQLPGDMVYIQATGEQSAEMVTDEGAIYVTSNRGYNWKAAVQETVSATLNRTVSSGISGASYYTGTFNTVNRSPDGRYVAVSSRGNFYLTWEPGQLYWQPHNRAVARRIQNMGWRADGGLWLLVRGGGLFLSKGTGIVEDFEEASVQSRGFGILDVGYRSKDEAWAAGGSGVLLKTTNGGKSWVRDKAADNIPGNLYSVKFIGDNQGFVLGNDGVLLRYVG

SEQ ID NO: 9877 - protein, 382 aa, Pseudoroegneria spicata
  misc_feature (2)..(3): Xaa can be any naturally occurring amino acid
AXXLLLPTRRRGRLLAPRACQADSATTSRRGLIADTATAAVAAAAAPLLLPRLPAARAEDLSEWERVGLPIDPGVVLLDIAFVPDDPSHGFLLGTRQTILETKDGGRTWFPRSIPSAEDEDFNYRFNSVSFSGKEGWIVGKPAILLHTKDAGDSWERIPLSAQLPGDMVYIQATGEQSAEMVTDEGAIYVTSNRGYNWKAAVQETVSATLNRTVSSGISGASYYTGTFNTVNRSPDGSYVAVSSRGNFFLTWEPGQLYWQPHNRAVARRIQNMGWRADGGLWLLVRGGGLFLSKGTGIVEDFEEASVQSRGFGILDVGYRSKDEAWAAGGSGVLLKTTNGGKTWVRDRAADNIPGNLYSVKFIGDNQGFVLGNDGVLLRYVG

SEQ ID NO: 9878 - protein, 404 aa, Vitis vinifera
MATLQLSDYCNPVVALKPSLKSFFIKTDHRNCCGASRVRVVPRACLQKPSLTRRHLLAETAAISVAPLILGIEPPAKSEEPLLSEWERVYLPIDPGVVLLDIAFVPDDLSHGFLLGTRQTIMETKDGGNTWVPRSIPSAEDEDFNYRFNSISFKGKEGWIVGKPSILLYTSDAGESWERIPLSAQLPGDIVYIKATGEKSAEMVTDEGAIYVTSNRGYNWRAAVQETVSATLNRTVSSGISGASYYTGTFNTVNRSPDGSYVAVSSRGNFYLTWEPGQPYWQPHNRAVARRIQNMGWRADGGLWLLVRGGGLYLSKGTGISEDFEEIPVQSRGFGILDVGYRSKEEAWAAGGSGVLLRTTNGGKTWTRDKAADNIAANLYSVKFIDDTKGFVLGNDGVLLRFLG

SEQ ID NO: 9879 - protein, 377 aa, Vigna unguiculata
PSLHSSRTFPRNRSLVVKASSSSSDDISRSRRRFLAETAAISVSLPHFPARAEDTLSEWERVYLPIDPGVVLLDIAFVPDDPNHGFLLGTRQTILETKDGGNTWAARSIPSAEDEDFNYRFNSISFKGKEGWIVGKPAILLYTADAGESWERIPLSAELPGDMVYIKATGEKSAEMVTDEGAIYVTANRGYNWRAAVQETVSATLNRTVSSGISGASYYTGTFNTVNRSPDGRYVAVSSRGNFYLTWEPGQPFWQPHNRAVARRIQNMGWRADGGLWLLVRGGGLYLSKGTGLTEEFEEVPVQSRGFGILDVGYRSTDEAWAAGGSGILLRTTNGGQSWIRDKAADNIAANLYSVKFIDDKKGFVLGNDGVLLRYLG

SEQ ID NO: 9880 - protein, 400 aa, Aristolochia fimbriata
MSTLQLTGSSSLLLKPSLRQFLVRRSGHLGRSQSRFIPSACLQNASVNRRRFIADTAAVSVSLASLTALEQPARSDEGLSEWERVYLPIDPGVVLLDIAFVPDDMKHGFLLGTRQTILETKDGGTTWVPRSIPSAEEEDFNYRFNSISFMGKEGWIVGKPAILLHTSDAGESWERIPLSAELPGDMVYIKATGEKSAEMVTDEGAIYVTSNKGYNWRAAVQETVSATLNRTVSSGISGASYYTGTFNTVNRSPDGSYVAVSSRGNFYLTWQPGQAFWQPHNRAVARRIQNMGWRADGGLWLLVRGGGLYLSKGTGISENFEEIPVQSRGFGILDVGYRSKDEAWAAGGSGILLRTTNGGKTWLRDKAADNIAANLYSVKFIDDNKGFVLGNDGVLLRYLG

SEQ ID NO: 9881 - protein, 393 aa, Cajanus cajan
MATLQFTFTDSTSSFRSSLPSSRASSRSRTRSLIVKASSIDFSRTRRRFIAETAAISVSLPHFAPARAEEALSEWERVYLPIDPGVVLLDIAFVPDDPNHGFLLGTRQTILETKDGGNTWAPRSIPSAEDEDFNYRFNSISFKGKEGWIVGKPAILLYTADSGESWERIPLSAELPGDMVYIKATGEKSAEMVTDEGAIYVTANRGYNWRAAVQETVSATLNRTVSSGISGASYYTGTFNTVNRSPDGRYVAVSSRGNFYLTWEPGQPFWQPHNRAVARRIQNMGWRADGGLWLLVRGGGLYLSKGTGLTEEFEEVPVQSRGFGILDVGYRSSEEAWAAGGSGILLRTTNGGKSWIRDKAADNIAANLYSVKFLDDKKGFVLGNDGVLLRYLG

SEQ ID NO: 9882 - protein, 415 aa, Unknown
  Sequence found in Organisms: Gossypium hirsutum, Gossypium raimondii
MAMMTPNLQATDCSNLIPSLTSLFPPRLLHRPLSLPHSRFISKASLHHPSSPSSSSSPPSLVNRRQIISQTASLSLSLATLSSLPLPAKSEEVLSEWERVYLPIDPGVVLLDIAFVPDDLNHGFLLGTRQTILETKDGGNTWTQRSIPSAEDEDFNYRFNSISFKGKEGWIVGKPAILLYTSDAGESWERIPLSAQLPGDMVYIKATGEKSAEMVTDQGAIYVTSNRGYNWRAAVQETVSATLNRTVSSGISGASYYTGTFNTVNRSPDGRYVAVSSRGNFYLTWEPGQPFWQPHNRAIARRIQNMGWRADGGLWLLVRGGGLFLSKGTGISEDFEEVPVQSRGFGILDVGYRSEEEAWAAGGSGVLLRTTNGGKNWTRDKAADNIAANLYSVKFINDKKGFVLGNDGVLLRYLG

SEQ ID NO: 9883 - protein, 376 aa, Triticum aestivum
TRRRGRLLAPRACQADSSTTTSRRGLIADTATAAVVAAAAPLLLPRLPAARAEDLSEWERVGLPIDPGVVLLDIAFVPDDPSHGFLLGTRQTILETKDGGRTWFPRSIPSAEDEDFNYRFNSVSFSGKEGWIVGKPAILLHTKDAGDSWERIPLSAQLPGDMVYIQATGEQSAEMVTDEGAIYVTSNRGYNWKAAVQETVSATLNRTVSSGISGASYYTGTFNTVNRSPDGSYVAVSSRGNFFLTWEPGQLYWQPHNRAVARRIQNMGWRADGGLWLLVRGGGLFLSKGTGIVEDFEEASVQSRGFGILDVGYRSKDEAWAAGGSGVLLKTTNGGKTWVRDRAADNIPGNLYSVKFIGDNQGFVLGNDGVLLRYVG

SEQ ID NO: 9884 - protein, 393 aa, Solanum melongena
MASSSFSNSIFTLVKPTTTFLPHDFPPRLPLCRAANINRRQLIAETAAAIALPPLLGLSLSPLPAKADEAPLSEWERVFLPIDPGVVLLDIAFVPDDPNHGFLLGTRQTILETKDGGTTWVPRSIASAEEEDFNYRFNSISFKGKEGWIIGKPAILLHTSDAGETWERIPLSSQLPGDMVYIKATGEQSAEMVTDEGAIYITSNKGYNWRAAIQETVSATLNRTVSSGISGASYYTGTFSTVNRSPDGRYVAVSSRGNFYLTWEPGQAYWQPHNRAVARRIQSMGWRADGGLWLLVRGGGLYLSKGTGLTEDFEEVSVQSRGFGILDVGYRSQDEAWAAGGSGILLKTTNGGKTWIRDKAADNIAANLYSVKFINDNQGFVLGNDGVLLKYLG

SEQ ID NO: 9885 - protein, 416 aa, Arachis hypogaea
MATLRFTDCSNLTSTFFRPSLPSLSAAKSRHSQNPQNRNTSTSSCTFVPRASLQPHQDDQFSLSRRRFIADTAAVSLSIPQLVGFEQAARSEEALSEWERVYLPIDPGVVLLDIAFVPDDPNHGFLLGTRQTIMETKDGGNTWAPRSIPSAEDEDFNYRFNSISFKGKEGWIVGKPAILLYTSDAGESWERIPLSAQLPGDMVYIKATGEKSAEMVTDEGAIYVTSNRGYNWKAAVQETVSATLNRTVSSGISGASYYTGTFNTVNRSPDGRYVAVSSRGNFYLTWEPGQPFWQPHNRAVARRIQNMGWRADGGLWLLVRGGGLYLSKGTGLTEEFEEVPVQSRGFGILDVGYRSQEEAWAAGGSGILLRTTNGGKSWIRDKAADNIAANLYSVKFLDDKKGFVLGNDGVLLRYLG

SEQ ID NO: 9886 - protein, 393 aa, Glycine max
MATLRLTFSDSTTLFRPSLPSTRTFSRNRSLIVKASSSEDDFSRSSRRRFIAETAALSVSLPQLTARSEDALSEWERVYLPIDPGVVLLDIAFVPDDPNHGFLLGTRQTILETKDGGNTWAPRSIPSAEDEDFNYRFNSISFKGKEGWIVGKPSILLYTSDAGDSWERIPLSAELPGDMVYIKATGEKSAEMVTDEGAIYVTANRGYNWRAAVQETVSATLNRTVSSGISGASYYTGTFNTVNRSPDGRYVAVSSRGNFYLTWEPGQPFWQPHNRAVARRIQNMGWRADGGLWLLVRGGGLYLSKGKGLTEEFEEVPVQSRGFGILDVGYRSTDEAWAAGGSGILLRTTNGGKSWIRDKAADNIAANLYSVKFIDEKKGFVLGNDGVLLRYLG

SEQ ID NO: 9887 - protein, 242 aa, Saccharum officinarum
MATAISSLVTPPALHRRRLSPASVSVSTPIRISFRAAAVPQAWRRGLALRVSASSAVLEAPEVVAARKLYVGNIPRTVTNDELRDMFAAHGTVERAEVMYDKYTNRSRRFGFVTMSTAEEANAAVEALNGTEVGDRKIKVNVTESFLPNIDRSAPELEPVFVDSQYKVYVGNLAKTVTTEVLKKFFSEKGKILSATVSHIPGTSKSKGYGFVTFSSEEEVEAAVATFNNAELEGQPIRVNRA

SEQ ID NO: 9888 - protein, 244 aa, Setaria italica
MATAISSLITPPALHLRCRSPASASVSVSAPARLSFRAAAAPQAWRRGLALRVAASSAVLEAPAEVAARKLYVGNIPRTVTNDELRDMFAAHGTVERAEVMYDKYTNRSRRFGFVTMSTVEEANAAIEALNETEVGGRKIKVNVTESFLPNIDRSAPEPEPVFVDSQYKVYVGNLAKTVTTEVLKNFFAEKGQILSATVSHIPGTSKSKGYGFVTFSSEEEVEAAVATFNNAELEGQPIRVNRA

SEQ ID NO: 9889 - protein, 244 aa, Zea mays
MATAISSLVTPPTLHRRCLGPACVSVSVCTPIRISFRPAAAPQVSRRGSALRVSASSAVLEAPEAVAARKLYVGNIPRTVTNDELRDMFAAHGTVERAEVMYDKYTNRSRRFGFVTMSTAEEANAAVEALNGTEVGDRKIKVNVTESFLPNIDRSAPEPEALFVDSQYKVYVGNLAKTVTTEVLKNFFSEKGNILSATVSHIPGTSKSKGYGFVTFSSEEEVEAAVATFNNAELEGQLIRVNRA

SEQ ID NO: 9890 - protein, 242 aa, Panicum virgatum
MATAISSLITPPALHLRCRSTSSASVSVSARLSLRAVAAPQARGRGLALRVAASSALLEAPAEVAARKLYVGNIPRTVTNDELRDMFAAHGTVERAEVMYDKYTNRSRRFGFVTMSTAEEANAAIEALNGTEVGGRKIKVNVTESFLPNIDRSAPEPEPVFVDSQYKVYVGNLAKTVTTEVLKNFFSEKGQILSATVSHIPGTSKSKGYGFVTFSSEEEVEAAVATFNNAELEGQPIRVNRA

SEQ ID NO: 9891 - protein, 244 aa, Brachypodium distachyon
MATTVSSLVAPHSLHRRCFRIPASASASTRLSFRAAPPAVAAARAGRRAAVRVLASSAVLEAPEELATRKLYVGNIPRTVTNDELRAMFADHGTVLRADVMYDKYSGRSRRFGFVTMSSVEEANAAIESLNETEVGGRKIKVNVTESFLPNIDPSAPEPEPAFVDSQYKVYVGNLAKTVTTEVLKNFFSEKGEVLSATVSRIPGTPKSKGYGFVTFSSEEEVEAAVSTFNNTELEGQPIRVNRA

SEQ ID NO: 9892 - protein, 244 aa, Triticum aestivum
MATTISSLAAPPSLHRRCCRSPASASTPARVSFRAAPPAGAAARARRRAAVKVLASSAVMEAPEELATRKLYVGNIPRTVTNDELSAMFAAHGTVVRAEVMYDKYSGRSRRFGFVTMSTAEEVAAAIESLNDTEVGGRKIKVNVTESFLPNIDTSAPESEPSFVDSQYKVYVGNLAKKVTTEVLKNFFSEKGEVLSATVSRIPGTPKSKGYGFVTFSSEEEVEAAVSTFNNAELEGQTIRVNRA

SEQ ID NO: 9893 - protein, 244 aa, Triticum aestivum
MATTISSLAAPPALHRRCCRSPASASTPARVSFRAVLPAGAAARARRRAAVKVLASSAVMEAPEELATRKLYVGNIPRTVTNDELSAMFAAHGTVVRAEVMYDKYSGRSRRFGFVTMSTAEEVAAAIESLNDTEVGGRKIKVNVTESFLPNIDTSAPESEPSFVDSQYKVYVGNLAKKVTTEVLKNFFSEKGEVLSATVSRIPGTPKSKGYGFVTFSSEEEVEAAVSTFNNAELEGQTIRVNRA

SEQ ID NO: 9894 - protein, 406 aa, Zea mays
MEAAPRRQQQEEEGCPCGGPEAADHFERLHDAVLLDVLNRIGDVKALGRCALVSRRFHALVPLVDSVFVRVDCVIPDDPPSSSSAGAAPGSPPHQAPAPTARGRGALARVARALLGGVARPIHALGQILSSAAATVSRRSEPLPASPPPAPVADVSHHSPSEVLRSFRELRRLHIELPTGELGIDDGVLLKWKADFGSTLGSCVILGASSVSSKSPAGSAQAETAAADSAAAAPDTGRETEEPGSLPDSLYTNGGLKLRVVWTISSLIAASARHYLLHPIICNHGTLESLDLTDADGQGVLTMDKRQLQELRVRPVSPSGSSHRTLMPALSMRLHYAPLIELPGGTLLKGATLVAIRPSEDALREGQGVAGPAGTCWISEAFEEPYRTAAKVLLKRRAYCLEMNSF

SEQ ID NO: 9895 - protein, 401 aa, Zea mays
MEAARQQQEECPCGGAEAADQFERLHDAVLLDVLNRIGDVKALGRCALVSRRFHALVPLVDSVFVRVDCVIPDDPPPSSSSSAAPGTSPRQAPAPAARGRGALAHIARVLLGGIARPIHALGQILSPAAAAVSRRSEALPASPRAPVADVSHHSPSEVLRSFKELRRLHIELPTGELGIDDGVLLKWKADFGSTLVSCVILGASSISSKPPTGYTQAESETAAAATPDTSRETEEPGSLPDSLYTNGGLKLRVVWTISSLIAASARHYLLQPIICNHELLESLDLTDADGQGVLTMDKRQLQELRVRPVFPSGSSHRTLMPALSMRLHYAPLIELPGGTLLKGATLVAIKPSEDALREGQGAGAAGPVGTCWISEAFEEPYRTAAKVLLKRRAYCLEMNSF

SEQ ID NO: 9896 - protein, 411 aa, Setaria italica
MEAGRQQQEEAEEGCPCGGAEAEAGDQFDRLHDAVLLDVLNRIGDVKALGRCALVSRRFHALVPLVDSVFVRVDCVIPDDPPHPAPPAPGSPQHQQQQHQAPAARGRGALAHIARVLLGGIARPIHALGQILSPAAAAVSRRSEPQPASPPAPAADVSHHSPSEVLRSFKELRRLHIELPSGELGIDEGVLLKWKADFGSTLGSCVILGASSVSSKTTSPSAQPETDAADSTDTSPDPNRETEDLGSVPESLYTNGGLKLRVVWTISSLIAASARHYLLQPIISNHATLESLNLTDADGQGELTMDKRQLQELRVRPVSASASSHRTLMPALSMRLHYAPLIELPGGMLLKGATLVAIRPSEDALRGEGQGVGTAGSVGTCWVSEAFEEPYRTAAKVLLKRRPYCLEMNSF

SEQ ID NO: 9897 - protein, 283 aa, Saccharum officinarum
MDADDSSKRSRPVRRAVKKLRFKPKVPPQKPKKLSAQKPQQEDPKPIDEELMKILRTRQVAAKSSPNTKDERPTQNTPSTPPSADAVSLSPAQFGVQKQNQLPLQIPRSFPVPVNSGMFYKEDSDDDDDDNGSDNVELQETQPDSIECEALTRPAEELDLLQQQGSKERMFLFQLPKSLPLPKRSSSTSIVERQGKATGKEVKEGSNLQQLPQGYLGKMLVYKSGKIKMKLGDIMFDVSPGAETRMVQHVVALNTRDKHCCLLGEIENRHVIVTPDVDSLLNK

SEQ ID NO: 9898 - protein, 288 aa, Saccharum officinarum
MATAATASATAATRFTLLAGAGLRSRISRHPTAVRFQRQRGLTTTALLKTADLLPKAQGQPETLDYRVFLVDGGGRKVSPWHDVPLRAGDGVFHFVVEIPKESSAKMEVATDEAFTPIKQDTKKGNLRYYPYNINWNYGLLPQTWEDPTSANSDVEGAFGDNDPVDVVEIGERRANIGDVLKVKPLAALAMIDEGELDWKIVAISLDDPKASLVNDVDDVEKHFPGTLTAIRDWFRDYKIPDGKPANRFGLGNKPASKEYALKVIEETNESWEKLVKRNIPAGELSLA

SEQ ID NO: 9899 - protein, 288 aa, Setaria italica
MATAATASATAATRFTLLAGAGLRSRAARLPTAVRFQRQRGLTTTALLKTADLRPKEQGQPETLDYRVFLVDGGGRKVSPWHDVPLRAGDGVFHFIVEIPKESSAKMEVATDEAFTPIKQDTKKGNLRYYPYNINWNYGLLPQTWEDPTSANSDVEGAFGDNDPVDVVEIGERRANIGDVLKVKPLAALAMIDEGELDWKIVAISLDDPKASLVNDVDDVEKHFPGTLTAIRDWFRDYKIPDGKPANRFGLGNKPASKEYALKVIQETNESWEKLVKRNIPAGELSLA

SEQ ID NO: 9900 - protein, 288 aa, Panicum virgatum
MATVATASATAATRFTLLAGAGLRSRASRLPTAVRFQRQRGLTTTALLKTADLRPKEQGQPETLDYRVFLVDGGGRKLSPWHDVPLRAGDGAFHFIVEIPKESSAKMEVATDEAFTPIKQDTKKGNLRYYPYNINWNYGLFPQTWEDPTTANSDVEGAFGDNDPVDVVEIGERRANIGDVLKVKPLAALAMIDEGELDWKIVAISLDDPKASLVNDVDDVEKHFPGTLTAIRDWFRDYKIPDGKPANRFGLGNKPTSKEYALKVIEETNESWEKLVKRNIPAGELSLA

SEQ ID NO: 9901 - protein, 288 aa, Panicum virgatum
MATAATASATAATRFTLLAGAGLRARAGRLPTAVRFQRQRGLTTTALLKTADLRPKEQGQPETLDYRVFLVDGGGRKVSPWHDVPLRAGDGAFHFIVEIPKESSAKMEVATDEAFTPIKQDTKKGNLRYYPYNINWNYGLFPQTWEDPTTANSDVEGAFGDNDPVDVVEIGERRANIGDVLKVKPLAALAMIDEGELDWKIVAISLDDPKASLVNDVDDVEKHFPGTLTAIRDWFRDYKIPDGKPANRFGLGNKPTSKEYALKVIEETNESWEKLVKRNIPAGELSLA

SEQ ID NO: 9902 - protein, 289 aa, Pennisetum glaucum
MATAATASATAATRFTLLAGAGLRSRRVARFPTAVRFQRQRGLTTTALLKTVDLRPKEQGQPETLEYRVFLEDGGGRKVSPWHDVPLRAGDGVFHFIVEIPKESSAKMEVATDEAFTPIKQDTKKGNLRYYPYNINWNYGLLPQTWEDPTTANSEVEGAFGDNDPVDVVEIGERRANIGDVLKVKPLAALAMIDEGELDWKIVAISLDDPKASLVNDVDDVEKHFPGTLTAIRDWFRDYKIPDGKPANRFGLGNKPASKEYALKVIEETNESWEKLVKRNVPAGELSLA

SEQ ID NO: 9903 - protein, 286 aa, Oryza sativa
MATAATASATAATRFTRLAGVGLRRTARLPTAVRFQRRVLATTALLRTAELRPKEQGLPETLDYRVFLVDGGGRKVSPWHDVPLRAGDGVFHFVVEIPKESSAKMEVATDESFTPIKQDTKKGNLRYYPYNINWNYGLFPQTWEDPTLANTDVEGAFGDNDPVDVVEIGERRANIGDVLKVKPLAALAMIDEGELDWKIVAISLDDPKASLVNDVDDVEKHFPGTLTAIRDWFRDYKIPDGKPANRFGLGNKPTSKEYALKVIEETNESWEKLVKRNIPAGELSLA

SEQ ID NO: 9904 - protein, 287 aa, Hordeum vulgare
MATAVTASATAATRFTRLAGVGLRRSSYRPRTAVRFQRPGLTTTALLRPTELKPKDQGQPETLDYRVFLIDGGGRKVSPWHDVPLRAGDGAFHFIVEIPKESSAKMEVATDEAYTPIKQDTKKGNLRYYPYNINWNYGLLPQTWEDPTAANADVEGALGDNDPVDVVEIGERRANIGDVLRVKPLAALAMIDEGELDWKIVAISLDDPKASLVNDVDDVEEHFPGTLTAIRDWFRDYKIPDGKPANRFGLGDKPTSKEYALKVIEETNESWEKLVKRKIPAGELSLA

SEQ ID NO: 9905 - protein, 287 aa, Pseudoroegneria spicata
MATAVTASATAATRFTRLACVGLRRSSCRPRTAVRFQRPGLTTTALLRPTELKPKDQGQPETLDYRVFLVDGADRKVSPWHDVPLRAGDGAFHFIVEIPKESSAKMEVATDEAFTPIKQDTKKGNLRYYPYNINWNYGLLPQTWEDPTAANADVEGALGDNDPVDVVEIGERRANIGDVLRVKPLAALAMIDEGELDWKIVAISLDDPKASLVNDVDDVEEHFPGTLTAIRDWFRDYKIPDGKPANRFGLGNKPTSKEYALKVIEETNESWEKLVKRKIPAGELSLA

SEQ ID NO: 9906 - protein, 287 aa, Avena sativa
MATAVTASATAATRFTRLAGAGLLRSSCRLRTAVRFQRPGLTTTALLRPTELKPKDQGQPETLDYRVFLVDGGGRKISPWHDVPLRAGDGVFHFIVEIPKESSAKMEVATDEAFTPIKQDTKKGNLRYYPYNINWNYGLLPQTWEDPTAANADVEGALGDNDPVDVVEIGERRANIGDVLRVKPLAALAMIDEGELDWKIVAISLDDPKASLVNDVDDVEEHFPGTLTAIRDWFRDYKIPDGKPANRFGLGNKPTSKAYALKVIEETNESWEKLVKRKIPAGELSLA

SEQ ID NO: 9907 - protein, 287 aa, Triticum aestivum
MATAVTASATAATRFTRLAGVALRRSSCRPRTAVRFQRPGLTTTALLRPTELKPKDQGQPETLDYRVFLVDGADRKVSPWHDVPLRAGDGAFHFIVEIPKESSAKMEVATDEAYTPIKQDTKKGNLRYYPYNINWNYGLLPQTWEDPTAANADVEGALGDNDPVDVVEIGERRANIGDVLRVKPLAALAMIDEGELDWKIVAISLDDPKASLVNDVDDVEEHFPGTLTAIRDWFRDYKIPDGKPANRFGLGNKPTSKEYALKVIEETNESWEKLVKRKIPAGELSLA

SEQ ID NO: 9908 - protein, 289 aa, Brachypodium distachyon
MATAVTASATAATRFTRLSGVGLLRRGGRCRLPTAVRFQRPGLTTTALLRPTELKPKDLGQPETLDYRVFLVDGAGRKVSPWHDVPLRAGDGVFHFIVEIPKESSAKMEVATDEAFTPIKQDTKKGNLRYYPYNINWNYGLLPQTWEDPTAANADVEGALGDNDPVDVVEIGERRANIGDVLRVKPLAALAMIDEGELDWKIVAISMDDPKASLVNDVDDVEKHFPGTLTAIRDWFRDYKIPDGKPANRFGLGNKPTSKEYALKVIQETNESWEKLVKRNIPAGELSLA

SEQ ID NO: 9909 - protein, 266 aa, Cenchrus ciliaris
LRSRAARFPTAVRFQRQRGLTTTALLKTVDLRTPEQGQPQTLEYRVFLEDGGGRKVSPWHDVPLRAGDGVFHFIVEIPKESSAKMEVATDEAFTPIKQDTKKGNLRYYPYNINWNYGLLLQTWEDPTTANSDVEGAFGDNDPVDVVEIGERRANIGEVLKVKPLAALAMIDEGELDWKIVAISLDDPKASLVNDVDDVEKHFPGTLTAIRDWFRDYKIPDGKPANRFGLGNKPASKEYALKVIEETNESWEKLVKRNVPAGELSLA

SEQ ID NO: 9910 - protein, 150 aa, Zea mays
MHSHLACSGCKRLVQYRRGAAGVRCPSCDAFTAAANPSGPPEMSELVCGGCFTMLVHSRGAANVRCPHCGRLNSTRSGNQMGHLSCGQCRTTLAYPPGATTVGCPTCRNVNPVRDARAAPQTVLVENPRTLDEKGKLVSNVAVGVASWKR

SEQ ID NO: 9911 - protein, 146 aa, Setaria italica
MQDQLICSGCKRVLEYRRGATGVCCPGCNTFTAANPSGSEMSELVCGGCFTMLVYNRGAANIRCPHCGRVNSTRSANQIGHLSCGHCRTTLAYPPGASTVGCPTCRCVNPVRDARPQTVLVENPKTLDEKGKLVSNVAVGVTSWKR

SEQ ID NO: 9912 - protein, 207 aa, Vigna unguiculata
MKSLSVQSSTFCSFSSHETGTNPRYLPIKSSNFLCCSSKPRNSSGFLCLSTQNDGFRENSGEVGGGDAVIIVDHGSRRKESNLMLNEFVEMFKYKTGYEIVEPAHMELAEPSIRDAFQSCVQQGANRIIVSPFFLSPGRHWSQDIPSLSAEAAKEHPDVSYIVTAPLGLHELLVDVVNDRIKHCIKHVAGDADECSVCAGTGKCRLY

SEQ ID NO: 9913 - protein, 207 aa, Cajanus cajan
MKSLSLHSHALSSFSVSEIGTNPRWAPFKSSNFLCCSSKPQSLSRFVCLSSQNGGFRENSGEVGRGDAVIIVDHGSRRKESNLLLNDFVEMFKHKTGYEIVEPAHMELAEPSISDAFQSCVKQGANRVIISPFFLSPGRHWNQDIPSLSAEAAKEHPGVSYIVTAPLGLHELLVNVVNDRIKHCLKHVAGDAEECSVCAGTGKCRLY

SEQ ID NO: 9914 - protein, 214 aa, Vigna unguiculata
VVDFLLMMKSLSVQSSTFCSFSSHETGTNPRYLPIKSSNFLCCSSKPRNSSGFLCLSTQNDGFRENSGEVGGGDAVIIVDHGSRRKESNLMLNEFVEMFKYKTGYEIVEPAHMELAEPSIRDAFQSCVQQGANRIIVSPFFLSPGRHWSQDIPSLSAEAAKEHPDVSYIVTAPLGLHELLVDVVNDRIKHCIKHVAGDADECSVCAGTGKCRLY

SEQ ID NO: 9915 - protein, 207 aa, Phaseolus coccineus
MKSLSVQSHTFYSFSSCETGTKPRCLPFKSSNSLCCSSKSRNLSGFLCLSAQNGSFRENSGEVGHGDAVIIVDHGSRRKESNFMLNDFVKMFKYKTGYEIVEPAHMELAEPSIRDAFQSCVQQGANRIIVSPFFLSPGRHWSQDIPSLSAEAAKEHPDVSYIVTAPLGLHELLVDVVNDRIKHCIKHVSGDADECSVCAGTGKCRLY

SEQ ID NO: 9916 - protein, 488 aa, Glycine max
MEGDLQRALSLRLNRRGDRSNQSPAKDFEVGFFSSGRVPQDYPMKIVWKKGFVRLVLVAGILWMLLILLALLFHIWSCQTSVSFLSAMCNKDSKVFNMLDNMGLVSKPHRCPIPLSNDPDKIVIPTGRTPNETVKNLSYVMEDEVPHSEAQSSPLFGGHPSWKQREESFKLKSNMKVHCGFIQGGGAEMNRVDIKYVKKCKFVVASGIFDGYDLPHQPSNISLRSKELFCFLMVVDEVSLKFMRENGTVKEDRAGGKWVGIWRLVLLKHPPYDEPRRNGKVPKILTHRLFPQAQYSIWIDGKMELIVDPLLILERYLWRGKHTFAIAQHKHHRKRKRYARPLIDLHMKIYYYEGMKPWSSNKKTNSDVPEGAVIIREHTAINNLFSCLWFNEVHLFTPRDQLSFGYVAYRLGDAFKFFMFLNCEYNSLFVLHPHTREHSSPIEWVKQLDELKKGNLKESRGGLGLFTPYPGDLDSVVLPNVTRTSKAG

SEQ ID NO: 9917 - protein, 500 aa, Cajanus cajan
MEGGDLQKSLSLRLNRRGDRSNQSQLSKDFEEGLFPSGRVPQDYPMKIVWKKGFVRLVLVAGILWMLLILLALLFHIWSCQTSVSFLSAMCNKDSKVYTMLDTMGLVSKPHRCPIPVSNDPDKIVIPTGRTSNEIVKNLSYVMEDEVPHDGSQSSPLFGGHPSWKQREESFKLNSNMKVHCGFIHGGGAEMDPVDIKYVKKCKFVVASGIFDGYDLPHQPSNISLRSEKLFCFLMVVDEVSLKFMRENGTVKEDSAGGQWVGIWRLVLLKHPPYDEPRRNGKVPKILTHRLFPQAQYSIWIDGKMELIVDPLQMLERYLWRGKHTFAIAQHKHHRSIYEEADSNKRRKRYARPLIDLHMKIYYYEGMQPWNSNKKTISDVPEGAVIIREHTNMNDLFSCLWFNEVHLFTPRDQLSFGYVAYRLGDSFKFFMFPNCEYNSLFVLHPHTREHSSPIEWVKQIDQLKNSNLKESRGGLGLFTPYPGDLDSVVLPNVTRTSKAG

SEQ ID NO: 9918 - protein, 394 aa, Phaseolus coccineus
MEDDLQRSRSLRLSRRGDRSNQNPAKDVDVTLFSSGRVSQDYPTKIVWKKGFVRLVLVVGILWMLLILLALLFHIWSCQTSVSFLSAMCNKDSKVYTMLDTMGLVSKDSNPHRCPIPLSNDPDKIDIPTGRTPNEIVKNLSYIMKDEIPSNRDQSSPLFGGHPSWKQREESFKLKSNMKVHCGFIRGGGAEMELVDIKYVKKCKFVVASGIFDGYDLPHEPSNISFSSKKLFCFLMVVDEVSLKFMRKNGTVKEDSAGGKWVGIWRIILLKNPPYDEPRRNGKVPKILTHRLFPEAQYSIWIDGKMELIVDPLLILERYLWRGKHTFAIAQHKHHRSIYEEADANKRRKRYARPLIDLHMKIYYYEGMKPWSSNKKTISDVPEWPLRPGTYCHE

SEQ ID NO: 9919 - protein, 493 aa, Medicago truncatula
MEGDLQKSLSLRLNRRGDRTNQNPQAKGRVPQDYPMSMKIVWKKGFVRLVLVGGILWMLLILVALLFHIWSCQSSVSFLSVMCNKDSKVYSMLDTYGLVPKLHRCPIPLFDDPDKIVIPTRRTSDKIVKNLSYFTEDEIPNDSSQSSPLFGGHLSWKQREESFKLKSNMKVHCGFIQGGGAEMDPIDIKYVKKCKFVVASGIFDGYDIPHQPSNISLRSKKLFCFLMVVDEVSLKFMRENTTVEEDSAGGKWVGIWRLVLLKNQPYDEPRRNGKVPKIITHRLFPQAQYSIWIDGKMELVVDPLLILERYLWRGKHTFAIAQHKHHRSIYEEADANKRRKRYARPLIDLHMKIYYYEGMKPWSSNKKTNSDVPEGAIIIREHTAVNNLFSCLWFNEVHLFTPRDQLSFGYVAYRLGESFEFFMFPNCEYNSLFVLHPHTREHSSPIEWVKQLDQLKKNSNLKESRGGLGLFTPYPGDLKSVVLPQITRTSKAG

SEQ ID NO: 9920 - protein, 468 aa, Cicer arietinum
GIISSGRVPQDYPMKIVWKKGFVRLVLVGGILWMLLILIALLFHIWSCQSSVSFLSAMCNKESKVYTMLDTMGLVTKPHRCPIPVSNNPDKIVIPTGRTSDKIVKKLLYVTEDEIPNNSSQSSPLFGGHLSWKQREESFKLKSNMKVHCGFIQGGGAEMDPVDIKYVKKCQFVVASGIFDGYDLPHQPSNISIRSKKLFCFLMVVDEVSLKFMRENGTVKEDNAGGKWVGIWRLVLLKNQPYDEPRRNGKVPKIITHRLFPQAQYSIWIDGKMELIVDPLLILERYLWRGKHTFAIAQHKHHRSIYEEADANKRRKRYARPLIDLHMKIYYYEGMKPWSSNKNTISDVPEGAIIIREHTAVNNLFSCLWFNEVHLFTPRDQLSFGYVAYRLGDAFKFFMFPNCEYNSLFVLHPHTREHSSPIEWVKKIDELKDSNLKESRGGLGLFTPYPADLNSVVLPQITRTSKAG

SEQ ID NO: 9921 - protein, 254 aa, Glycine max
MAMSSIHTLYASSFRLCFPNSSPQFKPLNAIPLGGTKLYNNNNVKFPRERTRTRATLDDVETDQLSSTPLVENDKAKKDVDESVKVLKDAAKTRKVAAEDILSALSIIEKAKVDPSAFFETLGGKESPGRTWMLIFTAEKQLKGGRYFPLTAVQRFDAAAKRIENGVYLGPIGQLTFEGRLSFKKRILAFVFENIRIKVGPLQPLEISLGKKEDKEPSTKDPFFIWFYVDEEIAVARGRSGGTAFWCRCRRVNN

SEQ ID NO: 9922 - protein, 259 aa, Cajanus cajan
MAMSSIHMLHVSSFHLCFPNSSNFEVSKFSPQFKPLNAIPLRGAKHCIVKFPRERTRTRATLDDVETDQLSSTPLVENEKPDKEVEESVKVLKNAAKTRKVAAEEVLSALSIIEKAKLDPSGFLETLGGKESPGRTWMLIFTAEKQLKGGRYFPLTAIQRFDAAAKRIENGVYLGPIGQLTFEGRLSWKKRILAFVFENLRIKVGPLNPLQISLGKKEDKEPSTKDPFFIWFYVDEEIAVARGRSGGTAFWCRCRRVSN

SEQ ID NO: 9923 - protein, 254 aa, Vigna unguiculata
MLYVSSFSLCFLNSSPFQLSKLSQQFKPLNSIPLSGRKQHCKIVRFPRERIRTRATIDDVETDQLSSTPIVENEKAIKDVEDSVKVLKDAAKTRKVAAEEVLSALSIIEKAKIDPSVFFETLGGNKSPGRTWMLIFTAEKKLKGGRYFPLTAVQRFDATAKRIENGVYLGPIGQLTFEGRLSWKKRILAFVFENIRVKVGPFQPLQISLGKKEDREPDTKDPFFIWFYVDEEIAVARGRSGGTAFWCPCRRVNN

SEQ ID NO: 9924 - protein, 260 aa, Vigna unguiculata
  misc_feature (38)..(38): Xaa can be any naturally occurring amino acid
  misc_feature (44)..(44): Xaa can be any naturally occurring amino acid
  misc_feature (48)..(48): Xaa can be any naturally occurring amino acid
GSNSIHMLYVSSFSLCFLNSSPFQLSKLSQQFKPLNSXPLSGRXQHCXIVRFPRERIRTRATIDDVETDQLSSTPIVENEKAIKDVEDSVKVLKDAAKTRKVAAEEVLSALSIIEKAKIDPSVFFETLGGNKSPGRTWMLIFTAEKKLKGGRYFPLTAVQRFDATAKRIENGVYLGPIGQLTFEGRLSWKKRILAFVFENIRVKVGPFQPLQISLGKKEDREPDTKDPFFIWFYVDEEIAVARGRSGGTAFWCPCRRVNN

SEQ ID NO: 9925 - protein, 253 aa, Phaseolus coccineus
MLYVSSFSLCFPNSSSFQLSKLSPQFKPLNSTPLSGRKHCKVVRFPRERTRTRATLDDVETDQLSSTPLVENEKAKKDVDESVKVLKDAAKTRKVAAEDVLSALSIIEKAKLDPSGFFETLGGNKSPGRTWMLVFTAEKKLSGGRYFPLTAVQRFDATAKRIENGVYLGPIGQLTFEGRLSWKKRILAFVFENIRVKLGPFQPLEISLGKKEDREPDTKDPFFIWFYVDEEIAVARGRSGGTAFWCRCSRVNN

SEQ ID NO: 9926 - protein, 199 aa, Phaseolus coccineus
MQRLRSSVFSATNLKKKYLNSRAAIQDTFFSTKDTFERHRVVFTVGTSIASVATAWFGYSLRHLHDTKVDQRLQSIENAVKSNSNLQHAEIKDIVAGSGGCSIPACVATAGTSLVIGYALGWRGGIWYATKKFRKEQMKMLGQITPRRWQLLGKIKPKGLQFQFLRRNLTRFKVSDTVLQTSESSIKDAAITHVTGKSN

SEQ ID NO: 9927 - protein, 199 aa, Vigna unguiculata
MQRLRSSVFSAPNLKRKYLNSRAAIEDTFFSTKDTFERHRVVFTVGTSIASVATAWLGYTLRHLHDTKVDQRLQSIENAMKSNSNLHHTEIKDIVAGSGGCSIPACVATAGTSLIIGYALGWRGGSWYATKKFRKEQMKMLGQITPRRWQLLGKIKPKGLQFQFLRRNLTKFKLSDSAMKTSESSIKDAATTHVTGKSN

SEQ ID NO: 9928 - protein, 199 aa, Cajanus cajan
MQRLRGSVLSAPNLRKKYLNSWAAIQDTYFSTKDTFERHRVVFTVGTSLASVATAWFGYSLRHLHDTKVDQRLQSIENAMKNHSTLQHSELKDIVAGSGGCSIPFCVATAGTSLIIGYGLGWRGGGWYAAKKFRKEQMKLLGQITPRRWQLLGKIKPRGLQFQFLRRKFTRSKVSDTALKTSETSIKDASTTHIAGKSH

SEQ ID NO: 9929 - protein, 291 aa, Phaseolus coccineus
MASVASSSSFSTRHLLRSPTPLLGRRRCRPNFLSMVTRSCLDDSSALLHAAEYTVDNYVKSGMVVGLGSGHASGMAIQHLGRQLRTGNLKDIVGIPMSVASASEAAKAGIPLDTYQESSQIDFAFDDADAIEEGTLVAIIGRRKLQGGESIIQEKSIINASNKLVFIIEENQYKGGLEGSIPVLIQSPNWMATAEEIDDMFLGDAEVWRRPSMGQAGPLGGDFPVVTREGHNILDVIFTSPIENLAEVAKSLGKVDGVVDHGVVSKIPCTVVIASQNGLNILDKLTADIVG

SEQ ID NO: 9930 - protein, 291 aa, Lotus japonicus
MASAASSSSFSTRLLLHSPTTLLGRRRRRSNVLRMVTRSCLDDSSALLRAAQYTVDTYVKSGMVVGLGSGHASGMAIQHLGRQLRTGNLKDIVGTPMSISSASEAAKAGIPLDTYQDSSQIDLAFDDADVIEEGTLVGIIGRRKLQGEESIIQEKSILNASNKLVFIIEENQYKRGLEGSIPVLIQSINWMATAEEIDDMFLGDAEVWRRPSIGQAGPLGGNFPLVTREGHNVLDVIFTSPIVSLAEVAKSLNKVDGVVDHGVISKIPCTVVIASQKELNILDKLTADIVG

SEQ ID NO: 9931 - protein, 281 aa, Vigna unguiculata
MASVASSSSFSTRHLLCSPTPLLGRRRCRPNFLRMLTRSCLDDSSALLQAAEYTVNTYVKSGMVVGLGSGHASGMAIQHLGRQLRTGNLKDIVGIPMSVASASEAAKAGIPLDTYQESSKIDFAFDDADVIEEGTLVAIIGRRKLQSGESIIQEKSIINASNKFVFIIEENQYKGGLEGSIPVLIQSLNWMATAEEIDDMFLGDAEVWRRPTMGQAGPLGGDFPVVTREGHNILDVIFTSPIENLAEVAKSLGKVDGVVDHGVVSKIPLVFSLNFYNLLNK

SEQ ID NO: 9932 - protein, 130 aa, Phaseolus coccineus
MASVASSSSFSTRHLLRSPTPLLGRRRCRPNFLSMVTRSCLDDSSALLHAAEYTVDNYVKSGMVVGLGSGHASGMAIQHLGRQLRTGNLKDIVGIPMSVASASEAAKAGFHWIPTKKVLKLILHLMMLML

SEQ ID NO: 9933 - protein, 283 aa, Vigna unguiculata
RAMASVASSSSFSTRHLLCSPTPLLGRRRCRPNFLRMLTRSCLDDSSALLQAAEYTVNTYVKSGMVVGLGSGHASGMAIQHLGRQLRTGNLKDIVGIPMSVASASEAAKAGIPLDTYQESSKIDFAFDDADVIEEGTLVAIIGRRKLQSGESIIQEKSIINASNKFVFIIEENQYKGGLEGSIPVLIQSLNWMATAEEIDDMFLGDAEVWRRPTMGQAGPLGGDFPVVTREGHNILDVIFTSPIENLAEVAKSLGKVDGVVDHGVVSKIPLVFSLNFYNLLNK

SEQ ID NO: 9934 - protein, 293 aa, Cicer arietinum
MASIASFSSLSTWLLLHSSTAPLDGRRKTITPNFVRMPTRSCLDDTSSLLRAAQYTVDTYVKSGMIVGLGSGHASDMAIQHLGLQLRRGNLKDIVGIPMSVASASEAAKAGIPLDTYQGSSQIDFAFNDADAIEEGTFVAIIGRRKLLSEESIIQEKSILNAADKLVFIIEENQYKGGLEGSIPVLIQSLNWLATAEEIDDMFLGDAEVWRRPGIGQAGPLGGDFPLVTREGHNVLDVIFTSPIASLAEVAKIFDKVDGVVDHGVISKIPCTVVIASPNGLNILDKLTADIVS

SEQ ID NO: 9935 - protein, 270 aa, Glycine max
MASSCASSAIAAVAISTPSSQKNGSLLGSTKASFLSGRKLKVNSFTAPVGARSSTTVCAVAEPDRPLWFPGSTPPPWLDGSLPGDFGFDPLGLGSDPESLRWNVQAELVHCRWAMLGAAGIFIPEFLTKIGILNTPSWYTAGELEYFTDTTTLFVVELFFIGWAEGRRWADIIKPGCVNTDPIFPNNKLTGTDVGYPGGLWFDPLGWGSGSPEKIKELRTKEIKNGRLAMLAVMGAWFQHIYTGTGPIDNLFAHLADPGHATIFAAFTPK

SEQ ID NO: 9936 - protein, 270 aa, Cajanus cajan
MASSCASSAIAAVAISTPSSQKNGSLLGTTKASFLSGRKLKVSNFTAPVGTRSSTTVCAVADPDRPLWFPGSTPPPWLDGSLPGDFGFDPLGLGSDPESLRWNVQAELVHCRWAMLGAAGIFIPEFLTKIGILNTPSWYTAGELEYFTDTTTLFVVELFFIGWAEGRRWADIIKPGCVNTDPIFPNNKLTGTDVGYPGGLWFDPLGWGSGSPEKIKELRTKEIKNGRLAMLAVMGAWFQHIYTGTGPIDNLFAHLADPGHATIFAAFTPK

SEQ ID NO: 9937 - protein, 269 aa, Vigna unguiculata
MASSCASSAIAAVAISTPSSKNGSLLGTAKASFLSGRKLKMNSFTAPVGARSSTTVCAVADPDRPLWFPGSTPPPWLDGSLPGDFGFDPLGLGSDPESLRWNVQAELVHCRWAMLGAAGIFIPEFLTKIGILNTPSWYTAGELEYFTDTTTLFIVELFFIGWAEGRRWADIIKPGCVNTDPIFPNNKLTGTDVGYPGGLWFDPLGWGSGSPEKIKELRTKEIKNGRLAMLAVMGAWFQHIYTGTGPIDNLFAHLADPGHATIFAAFTPK

SEQ ID NO: 9938 - protein, 269 aa, Phaseolus coccineus
MASSCASSAIAAVAISTPSSKNGSLLGTAKASFLSGRKLKVNSFTAPVGARSSTTVCAVADPDRPLWFPGSTPPPWLDGSLPGDFGFDPLGLSSDPESLRWNVQAELVHCRWAMLGAAGIFIPEFLTKIGVLNTPSWYTAGELEYFTDTTTLFVVELFFIGWAEGRRWADIIKPGSVNTDPIFPNNKLTGTDVGYPGGLWFDPLGWGSGSPEKLKELRTKEIKNGRLAMLAVMGAWFQHIYTGTGPIDNLFAHLADPGHATIFAAFTPK

SEQ ID NO: 9939 - protein, 271 aa, Arachis hypogaea
MASACASSAIAAVAISSPSSQKNGSQLGTTKASFLSGRKLKLNNFTAPTTGARSSTTVCVAADPDRPLWFPGSTPPPWLDGSLPGDFGFDPLGLGSDPESLRWNVQAELVHCRWAMLGAAGIFIPEFLTKIGILNTPSWYTAGEQEYFTDTTTLFIVELIFIGWAEGRRWADIIKPGCVNTDPIFPNNKLTGTDVGYPGGLWFDPLGWGSGSPEKIKELRTKEIKNGRLAMLAVMGAWFQHIYTGTGPIDNLFAHLADPGHATVFAAFTPK

SEQ ID NO: 9940 - protein, 269 aa, Lotus japonicus
MASACASSAIATLAISTPSSQKNGSPLGTTKAFLSGRKLKVNTFTAPVGARSTTTVCAAAEPDRPLWFPGSTPPPWLDGSLPGDFGFDPLGLSSDPESLRWNVQAELVHCRWAMLGAAGIFIPEFLTKIGILNTPSWYTAGEQEYFTDTTTLFIVELIFIGWAEGRRWADILKPGSVNTDPIFPNNKLTGTDVGYPGGLWFDPLGWGSGSPQKLKELRTKEIKNGRLAMLAVMGAWFQHIYTGTGPIDNLFAHLADPGHATVFAAFTPK

SEQ ID NO: 9941 - protein, 270 aa, Cajanus cajan
MASACASSAIASAAISTPSSQKNGSSLGTPKASFLSGRKLRMNKYTTAVGGRSSTTVCAVADPDRPLWFPGSTPPPWLDGTLPGDFGFDPLGLGSDPESLRWNVQAELVHCRWAMLGAAGIFIPEFLTKIGILNTPSWYTAGELEYFTDTTTLFVVELFFIGWAEGRRWADIIKPGCVNTDPIFPNNKLTGTDVGYPGGLWFDPLGWGSGSPEKIKELRTKEIKNGRLAMLAVMGAWFQHIYTGTGPIDNLFAHLADPGHATIFAAFTPK

SEQ ID NO: 9942 - protein, 270 aa, Cyamopsis tetragonoloba
MASACASSAIAAVAISTPSSQKNGSSLGTPKACFLSGRKLRVNKQTASVGVRSSSTVCAVADPDRPLWFPGSTPPPWLDGSLPGDFGFDPLGLGSDPESLRWNVQAELVHCRWAMLGAAGIFIPEFLTKIGILNTPSWYTAGELEYFTDTTTLFVIELILIGWAEGRRWADIIKPGSVNTDPIFPNNKLTGTDVGYPGGLWFDPLGWGSGSPEKIKELRTKEIKNGRLAMLAVMGAWFQHIYTGTGPIDNLFAHLADPGHATIFAAFTPK

SEQ ID NO: 9943 - protein, 270 aa, Phaseolus coccineus
MASACASSAIAAVSISTPSSQKNGSALGTPKASFLGGRKLRVNKYTAAVGGRSSTTVCAVAEPDRPLWFPGSTPPPWLDGTLPGDFGFDPLGLGSDPESLRWNVQAEIVHCRWAMLGAAGIFIPEFLTKIGVLNTPSWYSAGEQEYFTDTTTLFIVELFFIGWAEGRRWADIIKPGCVNTDPIFPNNKLTGTDVGYPGGLWFDPLGWGSGSPQKIKELRTKEIKNGRLAMLAVMGAWFQHIYTGTGPIDNLFAHLSDPGHATIFAAFTPK

SEQ ID NO: 9944 - protein, 270 aa, Vigna unguiculata
MASACASSAIAAVSISTPSSQKNGSVLGTPKASFLGGRKLRVKKYTAAVGGGSSTTVCAVADPDRPLWFPGSTPPPWLDGSLPGDFGFDPLGLGSDPESLRWNVQAELVHCRWAMLGAAGIFIPEFLTKIGVLNTPSWYSAGEQEYFTDTTTLFIVELFFIGWAEGRRWADIIKPGCVNTDPIFPNNKLTGTDVGYPGGLWFDPLGWGTGSPEKLKELRTKEIKNGRLAMLAVMGAWFQHIYTGTGPIDNLFAHLADPGHATIFAAFTPK

SEQ ID NO: 9945 - protein, 268 aa, Medicago truncatula
MASACASSAIAAVAISPSSQKNGSPMGTSKAFLGRKLKVNSNIAAPVRVRSTTTVCAAAEPDRPLWFPGSTPPPWLDGSLPGDFGFDPLGLSSDPESLKWNVQAELVHCRWAMLGAAGIFIPEFLTKIGILNTPSWYTAGEQEYFTDTTTLFIVELIFIGWAEGRRWADILNPGCVNTDPIFPNNKLTGTDVGYPGGLWFDPLGWGSGSPQKLKELRTKEIKNGRLAMLAVMGAWFQHIYTGTGPIDNLFAHLADPGHATIFAAFTPK

SEQ ID NO: 9946 - protein, 268 aa, Medicago truncatula
MASACASSAIAAVAISPSSQKNGSPMGTSKAFLGRKLKVNSNTAAPVRVRSTTTVCAAAEPDRPLWFPGSTPPPWLDGSLPGDFGFDPLGLSSDPESLKWNVQAELVHCRWAMLGAAGIFIPEFLTKIGILNTPSWYTAGEQEYFTDTTTLFIVELIFIGWAEGRRWADILNPGCVNTDPIFPNNKLTGTDVGYPGGLWFDPLGWGSGSPQKLKELRTKEIKNGRLAMLAVMGAWFQHIYTGTGPIDNLFAHLADPGHATIFAAFTPK

SEQ ID NO: 9947 - protein, 268 aa, Cicer arietinum
MASACASSAIAAIAISTPSSQKNGSALGITKAFLGRKLKVNNNTSVRVRSAATTKCAVAEPDRPIWFPGSTPPAWLDGSLPGDFGFDPLGLGSDPESLRWNVQAELVHCRWAMLGAAGIFIPEFLTKIGILNTPSWYTAGEQEYFTDTTTLFIIELLFIGWAEGRRWADIINPGCVNTDPIFPNNKLTGTDVGYPGGLWFDPLGWGSGSPKKLKELRTKEIKNGRLAMLAVMGAWFQHIYTGTGPIDNLFAHLADPGHATIFAAFTPK

SEQ ID NO: 9948 - protein, 269 aa, Trifolium pratense
MASACASSAIAAVAISTPSSQKNGSSLGASKAFFGRKLRVNNNTSAPLRVRSTTTVCAAAEPDRPLWFPGSVPPPWLDGSLPGDFGFDPLGLSSDPESLRWNVQAELVHCRWAMLGAAGIFIPEFLTKIGILNTPSWYTAGEQEYFTDTTTLFIVELIFIGWAEGRRWADILKPGSVNTDPIFPNNKLTGTDVGYPGGLWFDPLGWGSGSPQKLKELRTKEIKNGRLAMLAVMGAWFQHIYTGTGPIDNLFAHLADPGHATIFAAFTPK

SEQ ID NO: 9949 - protein, 268 aa, Manihot esculenta
MASACASSAIAAVAISPSSQKSGSIVGATKASFLSGKKLRLRNYTSPVASRSVTVCAAADPDRPLWFPGSTPPPWLDGSLPGDFGFDPLGLGSDPETLRWNVQAELVHCRWAMLGAAGIFIPEFLTKIGILNTPSWYDAGKLEYFTDTTTLFIIELIFIGWAEGRRWADILKPGCVNTDPIFPNNKLTGTDVGYPGGLWFDPLGWGSGSPEKIKELRTKEIKNGRLAMLAVMGAWFQHIYTGTGPIDNLFAHLADPGHATIFAAFTPK

SEQ ID NO: 9950 - protein, 269 aa, Populus trichocarpa
MASVCASSAIAAVSISSSSSQKTGFLVGSTKASFLSGKKLRLKKYTAPTAARSVTVCVAADPDRPLWFPGSTPPPWLDGSLPGDFGFDPLGLGSDPETLRWNVQAELVHCRWAMLGAAGIFIPEFLTKIGILNTPSWYTAGELEYFTDTTTLFIVELFFIGWAEGRRWADILKPGCVNTDPIFPNNKLTGTDVGYPGGLWFDPLGWGSGSPEKIKELRTKEIKNGRLAMLAVMGAWFQHIYTGTGPIDNLFAHLADPGHATVFSAFTPK

SEQ ID NO: 9951 - protein, 269 aa, Manihot esculenta
MASVCASSAIAAVAISSPSSQKTGSIVGATKASFLNGKKLRLRNHTSPVASRSVTVCVAAEPDRPLWFPGSTPPPWLDGSLPGDFGFDPLGLGSDPETLRWNVQAELVHCRWAMLGAAGIFIPEFLTKIGILNTPSWYDAGKLEYFTDTTTLFIIELIFIGWAEGRRWADILKPGCVNTDPIFPNNKLTGTDVGYPGGLWFDPLGWGSGSPEKIKELRTKEIKNGRLAMLAVMGAWFQHIYTGTGPIDNLFAHLADPGHATIFAAFTPK

SEQ ID NO: 9952 - protein, 269 aa, Platanus occidentalis
MASVCASSAIAAVAISSSSSQKSGSVVGATKASFLGGRKLRQKKFTAPSGPRSQAVCAAADPDRPLWFPGSTPPPWLDGSLPGDFGFDPLGLGSDPESLRWNQQAELVHCRWAMLGAAGIFIPEFLTKIGILNTPSWYTAGELEYFTDKTTLFVVELIFIGWAEGRRWADILKPGCVNTDPIFPNNKLTGTDVGYPGGLWFDPLGWGSGSPEKIKELRTKEIKNGRLAMLAVMGAWFQAIYTGTGPIDNLFAHLADPGHATIFAAFTPK

SEQ ID NO: 9953 - protein, 271 aa, Humulus lupulus
MASACASSAIAAVAISSPSSQKSVTSLGVTKGSFLGGRKLRVKSLTAPIRSRSSSATVCAAADPDRPLWFPGSVPPPWLDGSLPGDFGFDPLGLSSDPDSLRWNVQAELVHCRWAMLGAAGIFIPEFLTKIGILNTPSWYTAGEQEYFTDTTTLFIVELIFIGWAEGRRWADILKPGCVNTDPIFPNNKLTGTDVGYPGGLWFDPLGWGSGSPEKLKELRTKEIKNGRLAMLAVMGAWFQHIYTGTGPIDNLFAHLADPGHATVFAAFTPK

SEQ ID NO: 9954 - protein, 267 aa, Glycine max
MASACASSAITAVAISTPSSGQKNGSGGCFLSGRKLRVKKERAAIGGRSMGTTVCAVAEPDRPLWFPGSTPPPWLDGTLPGDFGFDPLGLGSDPESLRWNVQAELVHCRWAMLGAAGIFIPEFLTKIGVLNTPSWYSAGELEYFTDTTTLFIVELFFIGWAEGRRWADIIKPGCVNTDPIFPNNKLTGTDVGYPGGLWFDPLGWGTGSPQKIKDLRTKEIKNGRLAMLAVMGAWFQHIYTATGPIDNLFAHLADPGHATIFAAFTPK

SEQ ID NO: 9955 - protein, 270 aa, Ricinus communis
MASVCASSAIAAVAISSPSSQINGSTVGATKASFLSGKRLTVRKHTSPVVASRSVTVCAVADPDRPLWFPGSTPPPWLDGSLPGDFGFDPLGLGSDPETLRWNVQAELVHCRWAMLGAAGIFIPEFLTKIGILNTPSWYDAGKLEYFTDTTTLFIIELIFIGWAEGRRWADILKPGCVNTDPIFPNNRLTGTDVGYPGGLWFDPLGWGSGSPEKIKELRTKEIKNGRLAMLAVMGAWFQHIYTGTGPIDNLFAHLADPGHATVFAAFSPK

SEQ ID NO: 9956 - protein, 270 aa, Platanus occidentalis
MASVCASSAIAAVSISSSSSQKSGSVVGATKASFLGGRKLRQKQFTAPAGARSFSVCAAAADPDRPLWFPGSTPPPWLDGSLPGDFGFDPLGLGSDPESLRWNQQAELVHCRWAMLGAAGIFIPEFLTKIGILNTPSWYTAGEQEYFTDTTTLFIVELIFIGWAEGRRWADIIKPGCVNTDPIFPNNKLTGTDVGYPGGLWFDPLGWGTGSPEKLKELRTKEIKNGRLAMLAVMGAWFQAIYTGTGPIDNLFAHLADPGHATIFAAFTPK

SEQ ID NO: 9957 - protein, 269 aa, Populus trichocarpa
MAAVCASSAIAAVSISSSSSQKTGSLVGSTKASFLRGEKLRLRTYTSPTAARSVTVCVAADPDRPLWFPGSTPPPWLDGSLPGDFGFDPLGLGSDPETLRWNVQAELVHCRWAMLGAAGIFIPEFLTKIGILNTPSWYSAGEVEYFTDTTTLFIVELFFIGWAEGRRWADILKPGCVNTDPIFPNNKLTGTDVGYPGGLWFDPLGWGSGSPEKIKELRTKEIKNGRLAMLAVMGAWFQHIYTGTGPIDNLFAHLADPGHATVFAAFTPK

SEQ ID NO: 9958 - protein, 270 aa, Juglans hindsii x Juglans regia
MASACASSVIAAVAISSPSSQKTGSALGATKACFLGGRKLRVRNNTAPRGTRSLSVCAAAADPDRPLWFPGSTPPPWLDGSLPGDFGFDPLGLSSDPESLRWNVQSELVHCRWAMLGAAGIFIPELLTKIGILNTPSWYTAGELEYFTDTTTLFIIELILIGWAEGRRWADIIKPGSVNTDPIFPNNKLTGTDVGYPGGLWFDPLGWGSGSPEKIKELRTKEIKNGRLAMLAVMGAWFQHIYTGTGPIDNLFAHLADPGHATVFAAFTPK

SEQ ID NO: 9959 - protein, 270 aa, Unknown
  Sequence found in Organisms: Gossypium hirsutum, Gossypium raimondii
MASVCASSAIAAVAISSPSSQKTGSVVGTTKASFLSGKKLRSVRKYTKPAAGPTFPVCAAADPDRPLWFPGSTPPPWLDGSLPGDFGFDPLGLGSDPETLRWNVQAELVHCRWAMLGAAGIFIPEFLTKIGILNTPSWYSAGTEEYFTDTTTLFIVELIFIGWAEGRRWADILKPGCVNTDPIFPNNKLTGTDVGYPGGLWFDPLGWGSGSPEKIKELRTKEIKNGRLAMLAVMGAWFQHIYTGTGPIDNLFAHLADPGHATIFAAFTPK

SEQ ID NO: 9960 - protein, 271 aa, Sesamum indicum
MASACASSTIAAAAVAFSSPSSQKSGSIVGATKASFFGGRKLRVSKFAAPSGTRSVTVCAAADPDRPLWFPGSTPPPWLDGSLPGDFGFDPLGLGSDPESLKWNQQAELVHCRWAMLGAAGIFIPEFLTKIGILNTPSWYTAGELEYFTDTTTLFIIELILIGWAEGRRWADIIKPGCVNTDPIFPNNKLTGTDVGYPGGLWFDPLGWGSGSPEKVKELRTKEIKNGRLAMLAVMGAWFQHIYTGTGPIDNLFAHLADPGHATIFAAFSPK

SEQ ID NO: 9961 - protein, 271 aa, Catharanthus roseus
MASACASSTIAAVAFSSSPSSQKNGSIVGATKASFLGGRKVRVSKFTSAPAGGRSVTVCAAADPDRPLWFPGSTPPPWLDGSLPGDFGFDPLGLGSDPETLRWNVQAELVHCRWAMLGAAGIFIPEFLTKIGILNTPSWYTAGEQEYFTDTTTLFVVELVLIGWAEGRRWADILKPGSVNTDPIFPNNKLTGTDVGYPGGLWFDPLGWGSGSPEKIKELRTKEIKNGRLAMLAVMGAWFQHIYTGTGPIDNLFAHLADPGHATVFAAFTSK

SEQ ID NO: 9962 - protein, 271 aa, Cannabis sativa
MASACASSAIAAVAISSPSSQKSVTSLGVSKGSFLGGRKLRVKSFTAPTRSNSSSATVCAAADPDRPLWFPGSVPPPWLDGSLPGDFGFDPLGLSSDPDSLKWNQQAELVHCRWAMLGAAGIFIPEFLTKIGILNTPSWYTAGEQEYFTDTTTLFIVELIFIGWAEGRRWADILKPGCVNTDPIFPNNKLTGTDVGYPGGLWFDPLGWGSGSPEKIKELRTKEIKNGRLAMLAVMGAWFQHIYTGTGPIDNLFAHLADPGHATVFAAFTPK

SEQ ID NO: 9963 - protein, 270 aa, Castanea mollissima
MASVCASSAIAAVAISSPSSQKNRSILGGTKASFLSGGKLRVVRKYTAPNAKRSVSVCAVADPDRPLWFPGSVPPPWLDGSLPGDFGFDPLGLGSDPETLRWNVQSELVHCRWAMLGAAGIFIPEFLTKIGILNTPSWYTAGELEYFTDTTTLFVIEMILIGWAEGRRWADILKPGSVNTDPIFPNNKLTGTDVGYPGGLWFDPLGWGSGSPEKIKELRTKEIKNGRLAMLAVMGAWFQHIYTGTGPIDNLFAHLADPGHATVFAAFTPK

SEQ ID NO: 9964 - protein, 267 aa, Cleome gynandra
MASLCASSAIAAISSPSSQKSGSIVGSTKSAFLGGKKLRLKKYEAPVAARSVTYCAAADPDRPLWFPGSTPPPWLDGSLPGDFGFDPLGLGSDPESLRWNQQAELVHCRWAMLGAAGIFIPEFLTKIGILNTPSWYTAGEQEYFTDTTTLFIVELIFIGWAEGRRWADIIKPGCVNTDPIFPNNKLTGTDVGYPGGLWFDPLGWGSGNPAKIKELRTKEIKNGRLAMLAVMGAWFQHIYTGTGPIDNLFAHLADPGHATVFAAFTPK

SEQ ID NO: 9965 - protein, 270 aa, Gossypium hirsutum
MASVCASSAIAAVAISSPSSQKTGSVVGTTKASFLTGKKLRSVRKYTKPAAGPTFPVCAAADPDRPLWFPGSTPPPWLDGSLPGDFGFDPLGLGSDPETLRWNVQAELVHCRWAMLGAAGIFIPEFLTKIGILNTPSWYSAGTEEYFTDTTTLFIVELIFIGWAEGRRWADILKPGCVNTDPIFPNNKLTGTDVGYPGGLWFDPLGWGSGSPEKIKELRTKEIKNGRLAMLAVMGAWFQHIYTGTGPIDNLFAHLADPGHATIFAAFTPK

SEQ ID NO: 9966 - protein, 270 aa, Quercus alba
MASVCASSAIAAVAISSPSSQKNGSILGGTKASFLSGGKLRVVRKYTAPNAKRSVSVCAVADPDRPLWFPGSVPPPWLDGSLPGDFGFDPLGLGSDPETLRWNVQSEIVHCRWAMLGAAGIFIPEFLTKIGILNTPSWYSAGELEYFTDTTTLFIIELILIGWAEGRRWADILKPGSVNTDPIFPNNKLTGTDVGYPGGLWFDPLGWGSGSPEKVKELRTKEIKNGRLAMLAVMGAWFQHIYTGTGPIDNLFAHLADPGHATVFAAFTPK

SEQ ID NO: 9967 - protein, 269 aa, Carica papaya
MASLCASSPFAAISSPSSQKNGSVVGAPKASFLSGKKLRSVRKYTAPQAQTSSVTVCAVADPERPLWFPGSTPPPWLDGSLPGDFGFDPLGLGSDPDSLRWNQQAEIVHCRWAMLGAAGIFIPEFLTKIGILNTPSWYTAGEQEYFTDTTTLFIVELIFIGWAEGRRWADIIKPGCVNTDPIFPNNKLTGTDVGYPGGLWFDPLGWGSGSPEKVKELRTKEIKNGRLAMLAVMGAWFQHIYTGTGPIDNLFAHLADPGHATIFAAFTPK

SEQ ID NO: 9968 - protein, 270 aa, Tripterygium wilfordii
MASVCASSAIAAVAVSSPSSQKSGSIVGATKTAFLGGKKLRSGKKYTAPVARSSVAVCAVAESERPLWFPGSTPPPWLDGSLPGDFGFDPLGLSSDPDSLRWNVQSEIVHCRWAMLGAAGIFIPEFLTKIGILNTPSWYTAGEQEYFTDTTTLFIVELIFIGWAEGRRWADIIKPGCVNTDPIFPNNKLTGTDVGYPGGLWFDPLGWGSGSPEKVKELRTKEIKNGRLAMLAVMGAWFQHIYTGTGPIDNLFAHLADPGHATVFAAFTPK

SEQ ID NO: 9969 - protein, 186 aa, Cajanus cajan
MAVCQEILGLILSVGSDPESLRWNVQAELVHCRWAMLGAAGIFIPEFLTKIGILNTPSWYTAGELEYFTDTTTLFVVELFFIGWAEGRRWADIIKPGCVNTDPIFPNNKLTGTDVGYPGGLWFDPLGWGSGSPEKIKELRTKEIKNGRLAMLAVMGAWFQHIYTGTGPIDNLFAHLADPGHATIFA

SEQ ID NO: 9970 - protein, 264 aa, Eucalyptus grandis
MASVCASSAIAAVAISSPSGQKNGSSFLTGKRLRVSKYTAPAAAAGRLATVCAVADPDRPLWFPGSTPPPWLDGSLPGDFGFDPLGLGSDPESLRWNQQAELVHCRWAMLGAAGIFIPEFLTKIGILNTPSWYTAGEQEYFTDTTTLFIIELIFIGWAEGRRWADIIKPGCVNTDPIFPNNKLTGTDVGYPGGLWFDPLGWGSGSPEKIKELRTKEIKNGRLAMLAVMGAWFQHIYTGTGPIDNLFAHLADPGHATVFAAFTPK

SEQ ID NO: 9971 - protein, 260 aa, Trigonella foenum-graecum
AIAAVAISPSSQKNGSPMGTSKAFIGRKLKVNSNTAAPVRVRSTTTVCTVAEPDRPLWFPGSTPPPWLDGSLPGDFGFDPLGLSSDPESLKWNVQAELVHCRWAMLGAAGIFIPEFLTKIGILNTPSWYTAGEQEYFTDTTTLFIVELLFIGWAEGRRWADILNPGCVNTDPIFPNNKLTGTDVGYPGGLWFDPLGWGSGSPQKLKELRTKEIKNGRLAMLAVMGAWFQHIYTGTGPIDNLFAHLADPGHATIFAAFTPK

SEQ ID NO: 9972 - protein, 156 aa, Euonymus alatus
MLGAAGIFIPEFLTKIGILNTPSWYTAGEQEYFTDTTTLFIVEMIFIGWAEGRRWADIIKPGCVNTDPIFPNNKLTGTDVGYPGGLWFDPLGWGSGSPEKLKELRTKEIKNGRLAMLAVMGAWFQHIYTGTGPIDNLFAHLADPGHATVFAAFTPK

SEQ ID NO: 9973 - protein, 270 aa, Solanum lycopersicum
MASACASSTIAAVAFSSPSSRRNGSIVGTTKASFLGGRRLRVSKYSTTPTARSATTVCVAADPDRPLWFPGSTPPPWLDGSLPGDFGFDPLGLASDPESLRWNQQAELVHCRWAMLGAAGIFIPELLTKIGILNTPSWYTAGEQEYFTDTTTLFIVELVLIGWAEGRRWADIIKPGCVNTDPIFPNNKLTGTDVGYPGGLWFDPLGWGSGSPAKIKELRTKEIKNGRLAMLAVMGAWFQHIYTGTGPIDNLFAHLADPGHATIFAAFSPK

SEQ ID NO: 9974 - protein, 270 aa, Gossypium hirsutum
MASVCASSAIAAVAISSPSSQRSGSVVRTTKASFLTGKKLRSVKKYTKPAAARTVPVCAVADPDRPLWFPGSTPPPWLDGSLPGDFGFDPLGLGSDPETLRWNVQAELVHCRWAMLGAAGIFIPEFLTKIGILNTPSWYSAGTEEYFTDTTTLFIVELIFIGWAEGRRWADILKPGCVNTDPIFPNNKLTGTDVGYPGGLWFDPLGWGTGSPEKIKELRTKEIKNGRLAMLAVMGAWFQHIYTGTGPIDNLFDHLADPGHATIFAAFTPK

SEQ ID NO: 9975 - protein, 271 aa, Pteridium aquilinum
MASVCASSAIAAVAISSPSSQKTGSVVGATKASFLSGKKLRSARKYSAAPAGARPVAVCAAADPNRPLWFPGSTPPPWLDGSLPGDFGFDPLGLGSDPETLRWNVQAELVHCRWAMLGAAGIFIPEFLTKIGILNTPSWYSAGTEEYFTDPTTLFIVELLFIGWAEGRRWADILKPGCVNTDPIFPNNKLTGTDVGYPGGLWFDPLGWGSGSPEKIKELRTKEIKNGRLAMLAVMGAWFQHIYTGTGPIDNLFAHLADPGHATVFAAFTPK

SEQ ID NO: 9976 - protein, 201 aa, Tripterygium wilfordii
GFCLCFFCHCSCCCLFSQLPEKWIHCGATKTAFLGGKKLRSAKKFTAPAARSSVAVCAVADPDRPLWFPGSTPPPWLDGSLPGDFGFDPLGLSSDPDSLRWNVQSEIVHCRWAMLGAAGIFIPEFLTKIGILNTPSWYTAGEQEYFTDTTTLFVVEMIFIGWAEGRRWADIIKPGCVNTDPIFPNNKLTGTDVGYPGGLVV

SEQ ID NO: 9977 - protein, 270 aa, Solanum melongena
MASACGSSTIAAVAFSSPSSRRNGSIVGATKASFLGGRRLRVSKYTSSPAARAVTTVCVAADPDRPLWFPGSTPPPWLDGSLPGDFGFDPLGLGSDPESLRWNQQAELVHCRWAMLGAAGIFIPELLTKIGILNTPSWYTAGELEYFTDTTTLFIIELILIGWAEGRRWADIIKPGCVNTDPIFPNNKLTGTDVGYPGGLWFDPLGWGSGSPEKIKELRTKEIKNGRLAMLAVMGAWFQHIYTGTGPIDNLFAHLADPGHATIFAAFSPK

SEQ ID NO: 9978 - protein, 270 aa, Solanum tuberosum
MASACASSTIAAVAFSSPSSKRNGSIVGATKASFLGGRRLRVSKYSTTPAARSATTVCVAAEPDRPLWFPGSTPPPWLDGSLPGDFGFDPLGLGSDPESLRWNQQAEIVHCRWAMLGAAGIFIPELLTKIGILNTPSWYTAGEQEYFTDTTTLFIVELVLIGWAEGRRWADIIKPGCVNTDPIFPNNKLTGTDVGYPGGLWFDPLGWGSGSPAKIKELRTKEIKNGRLAMLAVMGAWFQHIYTGTGPIDNLFAHLADPGHATIFAAFSPK

SEQ ID NO: 9979 - protein, 270 aa, Solanum phureja
MASACASSTIAAVAFSSPSSRRNGSIVGATKASFLGGRRLRVSKYSTTPAARSATTVCVAAEPDRPLWFPGSTPPPWLDGSLPGDFGFDPLGLGSDPESLRWNQQAEIVHCRWAMLGAAGIFIPELLTKIGILNTPSWYTAGEQEYFTDTTTLFIVELVLIGWAEGRRWADIIKPGCVNTDPIFPNNKLTGTDVGYPGGLWFDPLGWGSGSPAKIKELRTKEIKNGRLAMLAVMGAWFQHIYTGTGPIDNLFAHLADPGHATIFAAFSPK

SEQ ID NO: 9980 - protein, 270 aa, Nicotiana tabacum
MASACASSAIAAVAFSSPSSQKNGSIVGATKASFLGGKRLRVSKYVAPAGSRSVAVSAVAADPDRPLWFPGSTPPPWLDGSLPGDFGFDPLGLASDPESLKWNQQAELVHCRWAMLGAAGIFIPEFLTKIGILNTPSWYTAGEQEYFTDTTTLFVIELVLIGWAEGRRWADIIKPGCVNTDPIFPNNKLTGTDVGYPGGLWFDPLGWGSGSPEKIKELRTKEIKNGRLAMLAVMGAWFQHIYTGTGPIDNLFAHLADPGHATIFAAFSPK

SEQ ID NO: 9981 - protein, 271 aa, Amsonia hubrichtii
MASACASSTIAAVSFSSSPSSQKNGSIVGATKASFLGGRKVRVSKFTTAPAGGRSLTVCAAADPDRPLWFPGSTPPPWLDGSLPGDFGFDPLGLGSDPETLKWNVQSELVHCRWAMLGAAGIFIPEFLTKIGILNTPSWYTAGEQEYFTDTTTLFIIELLLIGWAEGRRWADILKPGSVNTDPIFPNNKLTGTDVGYPGGLWFDPLGWGSGSPEKIKELRTKEIKNGRLAMLAVMGAWFQHIYTGTGPIDNLFAHLADPGHATVFAAFTSK

SEQ ID NO: 9982 - protein, 271 aa, Amsonia hubrichtii
MASACASSTIAAVSFSSSPSSQKNGSIVGATKASFLGGRKVRVSKFTTAPAGGRSVTVCAAADPDRPLWFPGSTPPPWLDGSLPGDFGFDPLGLGSDPETLKWNVQSELVHCRWAMLGAAGIFIPEFLTKIGILNTPSWYTAGEQEYFTDTTTLFIIELLLIGWAEGRRWADILKPGSVNTDPIFPNNKLTGTDVGYPGGLWFDPLGWGSGSPEKIKELRTKEIKNGRLAMLAVMGAWFQHIYTGTGPIDNLFAHLADPGHATVFAAFTSK

SEQ ID NO: 9983 - protein, 272 aa, Prunus persica
MASAWASSSAIAAVAISSPSSQKAGSTLAATKASFFGGRKLRVRNLTASSGSSTSFTVRAAAADPDRPLWFPGSTPPPWLDGSLPGDFGFDPLGLSSDPDSLRWNQQAELVHCRWAMLGAAGIFIPEFLTKIGILNTPSWYTAGEQEYFTDTTTLFVVELVLIGWAEGRRWADILKPGSVNTDPIFPNNKLTGTDVGYPGGLWFDPLGWGSGSPEKVKELRTKEIKNGRLAMLAVMGAWFQHIYTGTGPIDNLFAHLADPGHATIFAAFTPK

SEQ ID NO: 9984 - protein, 275 aa, Flaveria ramosissima
SLSSQWLQLLVLLLPLQLLLSLPQVHRKWIYCWINKGLSFLGGKKLKVSKLGAPSGSRSFATVCAAADPDRPIWFPGSTPPEWLDGSLPGDFGFDPLGLGSDPETLRWNVQAELVHCRWAMLGAAGIFIPEFLTKIGILNTPSWYTAGEQEYFTDKTTLFIIELIFIGWAEGRRWADIIKPGCVNTDPIFPNNKLTGTDVGYPGGLWFDPLGWGSGSPAKLKELRTKEIKNGRLAMLAVMGAWFQAIYTGTGPIDNLFAHLADPGHATIFAAFKG

SEQ ID NO: 9985 - protein, 270 aa, Flaveria ramosissima
MASTACASSAIAAVAFSSPSSQKSGSTVGSTKASFLGGKKLKVSKLGAPSGSRSFATVCAAADPDRPIWFPGSTPPEWLDGSLPGDFGFDPLGLGSDPETLRWNVQAELVHCRWAMLGAAGIFIPEFLTKIGILNTPSWYTAGEQEYFTDKTTLFIIELIFIGWAEGRRWADIIKPGCVNTDPIFPNNKLTGTDVGYPGGLWFDPLGWGSGSPAKLKELRTKEIKNGRLAMLAVMGAWFQAIYTGTGPIDNLFAHLADPGHATIFAAFKG

SEQ ID NO: 9986 - protein, 270 aa, Nicotiana benthamiana
MASACASSAIAAVAFSSPSSKKNGSIVGATKASFLGGKRLRVSKYVAPAGSRSVAVSAVAADPDRPLWFPGSTPPPWLDGSLPGDFGFDPLGLASDPESLKWNQQAELVHCRWAMLGAAGIFIPEFLTKIGILNTPSWYTAGEQEYFTDTTTLFVIELVLIGWAEGRRWADIIKPGCVNTDPIFPNNKLTGTDVGYPGGLWFDPLGWGSGSPEKIKELRTKEIKNGRLAMLAVMGAWFQHIYTGTGPIDNLFAHLADPGHATIFAAFSPK

SEQ ID NO: 9987 - protein, 270 aa, Capsicum annuum
MASACASSTIAAVAFSSPSSRRNGSIVGATKASFLGGRRLRVSNVPVAGSPRAATTVCVAADPDRPLWFPGSVPPPWLDGSLPGDFGFDPLGLGSDPESLRWNQQAEIVHCRWAMLGAAGIFIPEFLTKLGILNTPSWYTAGELEYFTDTTTLFIIELILIGWAEGRRWADIIKPGCVNTDPIFPNNKLTGTDVGYPGGLWFDPLGWGSGSPEKIKELRTKEIKNGRLAMLAVMGAWFQHIYTGTGPIDNLFAHLADPGHATIFAAFTPK

SEQ ID NO: 9988 - protein, 269 aa, Cleome spinosa
MASLCASSAITAVSSPSSQKSGSIVGTTRAGFLGGKKLRVKKNAAAEVAAGRSATVAAAVDPDRPLWFPGSTPPPWLDGSLPGDFGFDPLGLGSDPESLRWNQQAELVHCRWAMLGAAGIFIPEFLTKIGILNTPSWYTAGEQEYFTDTTTLFIVELIFIGWAEGRRWADIIKPGCVNTDPIFPNNKLTGTDVGYPGGLWFDPLGWGSGDPAKIKELRTKEIKNGRLAMLAVMGAWFQHIYTGTGPIDNLFAHLADPGHATIFSAFTPK

SEQ ID NO: 9989 - protein, 270 aa, Flaveria ramosissima
MASTACASSAIAAVAFSSPSSQKSGCTVGSTKASFLGGKKLKVSKLGAPSGSRSFATVCAAADPDRPIWFPGSTPPEWLDGSLPGDFGFDPLGLGSDPETLRWNVQAELVHCRWAMLGAAGIFIPEFLTKIGILNTPSWYTAGEQEYFTDKTTLFIIELIFIGWAEGRRWADIIKPGCVNTDPIFPNNKLTGTDVGYPGGLWFDPLGWGSGSPAKLKELRTKEIKNGRLAMLAVMGAWFQAIYTGTGPIDNLFAHLADPGHATIFAAFKG

SEQ ID NO: 9990 - protein, 270 aa, Flaveria ramosissima
MASTACASSAIAAVSFSSPSSQKSGSTVGSTKASFLGGKKLKVSKLGAPSGSRSFATVCAAADPDRPIWFPGSTPPEWLDGSLPGDFGFDPLGLGSDPETLRWNVQAELVHCRWAMLGAAGIFIPEFLTKIGILNTPSWYTAGEQEYFTDKTTLFIIELIFIGWAEGRRWADIIKPGCVNTDPIFPNNKLTGTDVGYPGGLWFDPLGWGSGSPAKLKELRTKEIKNGRLAMLAVMGAWFQAIYTGTGPIDNLFAHLADPGHATIFAAFKG

SEQ ID NO: 9991 - protein, 270 aa, Flaveria ramosissima
MASTACASSAIAAVAFSSPSSQKSGSTVGSTKASFLGGKKLKVSKLGAPSGSRSFATVCAAADPDRPIWFPGSTPPEWLDGSLPGDFGFDPLGLGSDPETLRWNVQAELVHCRWAMLGAAGIFIPEFLTKIGILNTPSWYTAGEQEYFTDKTTLFIIELIFIGWAEGRRWADIIKPGCVNTDPIFPNNKLTGTDVGYPGGLWFDPLGWGSSSPAKLKELRTKEIKNGRLAMLAVMGAWFQAIYTGTGPIDNLFAHLADPGHATIFAAFKG

SEQ ID NO: 9992 - protein, 270 aa, Flaveria ramosissima
MASTACASSAIAAVAFSSPSSQKSGTTVGSTKASFLGGKKLKVSKLGAPSGSRSFATVCAAADPDRPIWFPGSTPPEWLDGSLPGDFGFDPLGLGSDPETLRWNVQAELVHCRWAMLGAAGIFIPEFLTKIGILNTPSWYTAGEQEYFTDKTTLFIIELIFIGWAEGRRWADIIKPGCVNTDPIFPNNKLTGTDVGYPGGLWFDPLGWGSGSPAKLKELRTKEIKNGRLAMLAVMGAWFQAIYTGTGPIDNLFAHLADPGHATIFAAFKG

SEQ ID NO: 9993 - protein, 269 aa, Cucumis melo
MASACASSAIAAVAISSSSSSKNGCPKLASNFLAGKKLRLRNLNAAAVVAPRSAPVCAAADPDRPLWFPGSTPPPWLDGSLPGDFGFDPLGLASDPESLRWNQQAELVHCRWAMLGAAGIFIPEFLTKIGILNTPSWYSAGELEYFTDTTTLFIVELIFIGWAEGRRWADILKPGCVNTDPIFPNNKLTGTDVGYPGGLWFDPLGWGSGSPEKIKELRTKEIKNGRLAMLAVMGAWFQHIYTGTGPIDNLFAHLADPGHATVFAAFTPK

SEQ ID NO: 9994 - protein, 270 aa, Nicotiana benthamiana
MASAFASSAIAAVAFSSPSSQKNGSIVGATKASFLGGKRLRVSKYVAPAGSRSVAVSAVAADPDRPLWFPGSTPPPWLDGSLPGDFGFDPLGLASDPESLKWNQQAEIVHCRWAMLGAAGIFIPEFLTKIGILNTPSWYTAGEQEYFTDTTTLFVIELVLIGWAEGRRWADIIKPGCVNTDPIFPNNKLTGTDVGYPGGLWFDPLGWGSGSPEKIKELRTKEIKNGRLAMLAVMGAWFQHIYTGTGPIDNLFAHLADPGHATIFAAFSPK

SEQ ID NO: 9995 - protein, 270 aa, Triphysaria pusilla
MASACASSAIAAVSLSSPSSQKSGSIVGATKASFFGGRKLRVSKLAAPKSSRSSVAVCVAAEPDRPLWFPGSTPPAWLDGSLPGDFGFDPLGLASDPDSLKWNQQAEIVHCRWAMLGAAGIFIPEFLTKIGILNTPSWYTAGEQEYFTDTTTLFVVELVLIGWAEGRRWADIIKPGCVNTDPIFPNNKLTGTDVGYPGGLWFDPLGWGSGSPAKLKELRTKEIKNGRLAMLAVMGAWFQHIYTGTGPIDNLFAHLADPGHATIFAAFSPK

SEQ ID NO: 9996 - protein, 271 aa, Lippia dulcis
MASACASSAIAAVAFSSPSCQKSGSIMGAPKASFFGGRKLRVSKLKPATSPTRSVAVSAAAADPDRPLWFPGSIPPPWLDGSLPGDFGFDPLGLGSDPDSLRWNVQAELVHCRWAMLGAAGIFIPEFLTKLGILNTPSWYTAGEQEYFTDTTTLFIVELFFIGWAEGRRWADIIKPGCVNTDPIFPNNKLTGTDVGYPGGLWFDPLGWGSGSPEKIKELRTKEIKNGRLAMLAVMGAWFQHIYTGTGPIDNLFAHLADPGHATIFAAFSPK

SEQ ID NO: 9997 - protein, 270 aa, Unknown
  Sequence found in Organisms: Gossypium hirsutum, Gossypium raimondii
MATVCASSAVAAVAISSPSSQRSGSVVRTTKASFLTGKKLRSVKKYTKPAAVRTVPVCAVADPDRPLWFPGSTPPPWLDGSLPGDFGFDPLGLGSDPETLRWNVQAELVHCRWAMLGAAGIFIPEFLTKIGILNTPSWYSAGTEEYFTDTTTLFIVELIFIGWAEGRRWADILKPGCVNTDPIFPNNKLTGTDVGYPGGLWFDPLGWGTGSPEKIKELRTKEIKNGRLAMLAVMGAWFQHIYTGTGPIDNLFDHLADPGHATIFAAFTPK

SEQ ID NO: 9998 - protein, 270 aa, Helianthus annuus
MASTACASSAIAAVAFSSPSSQKSGSIVGSTKASFLGGKKLRVSKLGAPSGSRSFGTVCAAADPDRPIWFPGSTPPEWLDGSLPGDFGFDPLGLGSDPETLRWNVQAELVHCRWAMLGAAGIFIPEFLTKIGILNTPSWYTAGEQEYFTDKTTLFIIELIFIGWAEGRRWADIIKPGCVNTDPIFPNNKLTGTDVGYPGGLWFDPLGWGTGSPAKLKELRTKEIKNGRLAMLAVMGAWFQAIYTGTGPIDNLFAHLADPGHATIFAAFKG

SEQ ID NO: 9999 - protein, 267 aa, Cucurbita pepo
MASACASSAIATVAISSSSSQKNGCPKASNFVTGKKLRLRKYTTAAVAPRSAPVCAAADPNRPLWFPGSTPPPWLDGSLPGDFGFDPLGLSSDPESLRWNQQAELVHCRWAMLGAAGIFIPEFLTKIGILNTPSWYTAGELEYFTDTTTLFVVELIFIGWAEGRRWADILKPGCVNTDPIFPNNKLTGTDVGYPGGLWFDPLGWGSGSPEKIKELRTKEIKNGRLAMLAVMGAWFQHIYTGTGPIDNLFAHLADPGHATIFAAFTPK

SEQ ID NO: 10000 - protein, 270 aa, Flaveria ramosissima
MASTACASSAIAAVAFSSPSSQKSGTTVGSTKASFLGGKKLKVSKLGAPSGSRSFATVSAAADPDRPIWFPGSTPPEWLDGSLPGDFGFDPLGLGSDPETLRWNVQAELVHCRWAMLGAAGIFIPEFLTKIGILNTPSWYTAGEQEYFTDKTTLFIIELIFIGWAEGRRWADIIKPGCVNTDPIFPNNKLTGTDVGYPGGLWFDPLGWGSGSPAKLKELRTKEIKNGRLAMLAVMGAWFQAIYTGTGPIDNLFAHLADPGHATIFAAFKG

SEQ ID NO: 10001 - protein, 270 aa, Lactuca sativa
MASTVCASSAIAAVAFSSPASQKNGSFVGSTKASFLCGKKLRVSKVTAPTVARSSGTVCVTADPERPIWFPGSTPPEWLDGSLPGDFGFDPLGLGSDPETLRWNVQAEIVHCRWAMLGAAGIFIPEFLTKIGILNTPSWYTAGEQEYFTDKTTLFIVELIFIGWAEGRRWADILKPGCVNTDPIFPNNKLTGTDVGYPGGLWFDPLGWGSGSPAKLKELRTKEIKNGRLAMLAVMGAWFQAIYTGTGPIDNLFAHLADPGHATIFAAFKG

SEQ ID NO: 10002 - protein, 270 aa, Helianthus annuus
MASTACASSAIAAVAFSSPSSQKSGSIVGSAKASFLGGKKLRVSKLGAPSGSRSFGTVCAVADPDRPIWFPGSTPPEWLDGSLPGDFGFDPLGLGSDPETLRWNVQAELVHCRWAMLGAAGIFIPEFLTKIGILNTPSWYTAGEQEYFTDKTTLFIIELIFIGWAEGRRWADIIKPGCVNTDPIFPNNKLTGTDVGYPGGLWFDPLGWGTGSPAKLKELRTKEIKNGRLAMLAVMGAWFQAIYTGTGPIDNLFAHLADPGHATIFAAFKG

SEQ ID NO: 10003 - protein, 93 aa, Flaveria ramosissima
MASTACASSAIAAVAFSSPSSQKSGSIVGSTKASFLGGKKLRVSNWVHHPVHDRSEPCALRLTPIDPFGSPVAPHPNGSMAAYLETSGSILLA

SEQ ID NO: 10004 - protein, 268 aa, Rosa hybrid cultivar
MASAWASSAIAAVSSPSSQKAGSALAATKASFFGGRKLRVRNVAAPSGSSSTSFRVCATAADPDRPLWFPGSTPPPWLDGSLPGDFGFDPLGLSSDPDSLKWNTQAELVHCRWAMLGAAGIFIPEFLTKIGILNTPSWYTAGEQEYFTDTTTLFIVELIFIGWAEGRRWADILKPGSVNTDPIFPNNKLTGTDVGYPGGLWFDPLGWGSGSPEKIKELRTKEIKNGRLAMLAVMGAWFQHIYTGTGPIDNLFAHLADPGHATVFAAFK

SEQ ID NO: 10005 - protein, 271 aa, Cucumis sativus
MASACASSAIAAVAISSSSSSKNGCPKLASNFLTGKKLRLRNLNAAATAVVAPRTVPVCAAADPDRPLWFPGSTPPPWLDGSLPGDFGFDPLGLASDPESLRWNQQAELVHCRWAMLGAAGIFIPEFLTKIGILNTPSWYTAGELEYFTDTTTLFIVELIFIGWAEGRRWADILKPGCVNTDPIFPNNKLTGTDVGYPGGLWFDPLGWGSGSPEKIKELRTKEIKNGRLAMLAVMGAWFQHIYTGTGPIDNLFAHLADPGHATVFAAFTPK

SEQ ID NO: 10006 - protein, 262 aa, Arachis hypogaea
MASAYASSAIAAVGISSPNTKASFLSGRKLKRAAKQAAGVRGVSSTRVCAAAADPERPLWFPGSTPPPWLDGTLPGDFGFDPLGLGSDPESLRWNVQAELVHCRWAMLGAAGIFIPEFLTKIGVLNTPSWYTAGEQEYFTDTTTLFIVELIFIGWAEGRRWADIIKPGCVNTDPIFPNNKLTGTDVGYPGGLWFDPLGWGTGSPEKIKELRTKEIKNGRLAMLAVMGAWFQHIYTGTGPIDNLFAHLADPGHATIFAAFTPK

SEQ ID NO: 10007 - protein, 288 aa, Flaveria ramosissima
ILFLHHQIFNPKLFTQQQWLPLLVHLLPLQLLLSLLQVHRRVDLLLDQQRASFLGGKKLRVSKLGAPSGSRSFGTVCVAADPDRPIWFPGSTPPEWLDGSLPGDFGFDPLGLGSDPETLKWNVQAELVHCRWAMLGAAGIFIPEFLTKIGILNTPSWYTAGEQEYFTDKTTLFIIELIFIGWAEGRRWADIIKPGCVNTDPIFPNNKLTGTDVGYPGGLWFDPLGWGTGSPAKLKELRTKEIKNGRLAMLAVMGAWFQAIYTGTGPIDNLFAHLADPGHATIFAAFKG

SEQ ID NO: 10008 - protein, 267 aa, Ambrosia trifida
MACASSAIAAVAFSSPSSQKSGSIVGSTKASFLGGKKLRVSKVGAPSGSRSFGTVCAAADPDRPIWFPGSTPPEWLDGSLPGDFGFDPLGLGSDPETLRWNVQAELVHCRWAMLGAAGIFIPEFLTKIGILNTPSWYTAGEQEYFTDKTTLFIIELIFIGWAEGRRWADIIKPGCVNTDPIFPNNKLTGTDVGYPGGLWFDPLGWGSGSPAKLKELRTKEIKNGRLAMLAVMGAWFQAIYTGTGPIDNLFAHLADPGHATIFAAFKG

SEQ ID NO: 10009 - protein, 268 aa, Flaveria ramosissima
STACASSAIAAVAFSSPSSQKSGSTVGSTKASFLGGKKLKVSRLGAPSGSQSFATVCAAADPDRPIWFPGSTPPEWLDGSLPGDFGFDPLGLGSDPETLRWNVQAELVHCRWAMLGAAGIFIPEFLTKIGILNTPSWYTAGEQEYFTDKTTLFIIELIFIGWAEGRRWADIIKPGCVNTDPIFPNNKLTGTDVGYPGGLWFDPLGWGSGSPAKLKELRTKEIKNGRLAMLAVMGAWFQAIYTGTGPIDNLFAHLADPGHATIFAAFKG

SEQ ID NO: 10010 - protein, 262 aa, Ipomoea nil
MVSACAASSTIAAAAFSSPSSQTKASFLSGRKLRVSKYSAPATSRSFTVCATAEPNRPLWFPGSTPPPWLDGSLPGDFGFDPLGLASDPESLKWNQQAEIVHCRWAMLGAAGIFIPEFLTKIGILNTPSWYTAGEQEYFTDTTTLFVIELILIGWAEGRRWADIIKPGCVNTDPIFPNNKLTGTDVGYPGGLWFDPLGWGSGSPEKIKELRTKEIKNGRLAMLAVMGAWFQHIYTGTGPIDNLFAHLADPGHATVFAAFTPK

SEQ ID NO: 10011 - protein, 270 aa, Petunia hybrida
MASACASSTIAAVAFSSPSSQKNGSIVGATKASFLGGKRLRVSKFIAPVGSRSVAVSAVAADPDRPLWFPGSTPPEWLDGSLPGDFGFDPLGLGSDPESLKWNAQAELVHSRWAMLGAAGIFIPEFLTKIGVLNTPSWYTAGEQEYFTDTTTLFVIELVLIGWAEGRRWADIIKPGCVNTDPIFPNNKLTGTDVGYPGGLWFDPLGWGSGSPAKIKELRTKEIKNGRLAMLAVMGAWFQHIYTGTGPIDNLFAHLADPGHATIFAAFSPK

SEQ ID NO: 10012 - protein, 220 aa, Ambrosia trifida
MACASSAIAAVAFSSPSSQKSGSIVGSTKASFLGGKKLRVSKVGAPSGSRSFGTVCAAADPDRPIWFPGSTPPEWLDGSLPGDFGFDPLGLGSDPETLRWNVQAELVHCRWAMLGAAGIFIPEFLTKIGILNTPSWYTAGEQEYFTDKTTLFIIELIFIGWAEGRRWADIIKPGCVNTDPIFPNNKLTGTDVGYPGGLWFDPLGWGSGSPAKLKELRQKR

SEQ ID NO: 10013 - protein, 185 aa, Flaveria ramosissima
ACASSAIAAVAFSSPSSQKSGSTVGSTKASFLGGKKLKVSKLGAPSGSRSFATVCAAADPDRPIWFPGSTPPEWLDGSLPGDFGFDPLGLGSDPETLRWNVQAELVHCRWAMLGAAGIFIPEFLTKSESLTLRRGTPLVNKNTSQTKPHSSSLSLFSLVGLKEEDGLTSSNLGALTRTPSSPTTS

SEQ ID NO: 10014 - protein, 271 aa, Malus domestica
MASAWATSSAIAAVAVSSRSQKGGSSLAATKASFFGGRKLRVRSFTATKGSSSSFTVRAAAADPDRPLWFPGSTPPPWLDGSLPGDFGFDPLGLSSDPDSLKWNQQAELVHCRWAMLGAAGIFIPEFLTKIGILNTPSWYTAGEQEYFTDTTTLFVVELVLIGWAEGRRWADILKPGSVNTDPIFPNNKLTGTDVGYPGGLWFDPLGWGSGSPEKIKELRTKEIKNGRLAMLAVMGAWFQHIYTGTGPIDNLFAHLADPGHATIFASFSPK

SEQ ID NO: 10015 - protein, 272 aa, Coffea canephora
MASACASSAIAAVAFSSSPSSQKNGSILGATKASFLSGRKLRVSQYTSPPAGARSLTICAAAADLERPIWFPGSTPPPWLDGSLPGDFGFDPLGLGSDPETLRWNVQSEIVHCRWAMLGAAGIFIPEFLTKIGILNTPSWYSAGELEYFTDTTTLFVVEMILIGWAEGRRWADIIKPGCVNTDPIFPNNKLTGTDVGYPGGLWFDPLGWGTGSPEKVKELRTKEIKNGRLAMLAVMGAWFQHIYTGTGPIDNLFAHLADPGHNNVFAAFTNK

SEQ ID NO: 10016 - protein, 272 aa, Quercus alba
MASVCASSAIAAVAISSPSSQKNGSILGGTKASFLSGGKLRVVRKYTAPNAKRSVSVCAVADPDRPLWFPGSVPPPWLDGSLPGDFGFDPLGLGSDPETLRWNVQSEIVHCRWAMLGAAGIFIPEFLTKIGILNTPSWYSAGELEYFTDTTTLFIIELILIGWAEGRRWADILKPGSVNTDPIFPNNKLTGTDVGYPGGLWFDPLGWGSGSPEKVKELRTKEIKNGRLAMLAVMGAWFQHIYTGTGPIDNLFAHLADPGHATVFAVSEALKS

SEQ ID NO: 10017 - protein, 273 aa, Vinca minor
MASAFASSTIAAAVAFSSSPSSQKNGSIIGATKASFLGGRKVRVSKFTSSPAGGRSVTTVCAAAEPDRPLWFPGSSPPPWLDGSLPGDFGFDPLGLGSDPETLKWNVQSELVHCRWAMLGAAGIFIPEFLTKIGILNTPSWYTAGEQEYFTDTTTLFVIELILIGWAEGRRWADILKPGSVNTDPIFPNNKLTGTDVGYPGGLWFDPLGWGSGSPQKLKELRTKEIKNGRLAMLAVMGAWFQHIYTGTGPIDNLFAHLADPGHATVFAAFTSK

SEQ ID NO: 10018 - protein, 288 aa, Flaveria ramosissima
ETTYFSIIKSTPKYLHNNNGFHCLCISAIAAVAFSSPSSQKSGSIVGSTKASFLGGKKLRVSKLGAPSGSRSFGTVCVAADPDRPIWFPGSTPPEWLDGSLPGDFGFDPLGLGSDPETLKWNVQAELVHCRWAMLGAAGIFIPEFLTKIGILNTPSWYTAGEQEYFTDKTTLFIIELIFIGWAEGRRWADIIKPGCVNTDPIFPNNKLTGTDVGYPGGLWFDPLGWGTGSPAKLKELRTKEIKNGRLAMLAVMGAWFQAIYTGTGPIDNLFAHLADPGHATIFAAFKG

SEQ ID NO: 10019 - protein, 270 aa, Arnica chamissonis
MASTACASSAIAAVAFSSPSSQKSGSIVGSTKASFLGGKKLRVSKLGASSGSRSFGTVCVAADPDRPIWFPGSTPPEWLDGSLPGDFGFDPLGLGSDPETLKWNVQAELVHCRWAMLGAAGIFIPEFLTKIGILNTPSWYTAGEQEYFTDKTTLFIVELIFIGWAEGRRWADIIKPGCVNTDPIFPNNKLTGTDVGYPGGLWFDPLGWGSGSPAKLKELRTKEIKNGRLAMLAVMGAWFQAEYTGTGPIDNLFAHLADPGHATIFAAFKG

SEQ ID NO: 10020 - protein, 86 aa, Cicer arietinum
MASACASSAIAAIAISTPSSQKNGSALGITKAFLGRKLKVNNNTSVRVRSAATTKCAVAEPDRPIWFPGSTPPAWLDGSLPGVFWV

SEQ ID NO: 10021 - protein, 270 aa, Flaveria ramosissima
MASTACASSAIAAVAFSSPSSQKSGSIVGSTKASFLGGKKLRVSKLSAPSGSRSFGTVCVAADPDRPIWFPGSTPPEWLDGSLPGDFGFDPLGLGSDPETLKWNVQAELVHCRWAMLGAAGIFIPEFLTKIGILNTPSWYTAGEQEYFTDKTTLFIIELIFIGWAEGRRWADIIKPGCVNTDPIFPNNKLTGTDVGYPGGLWFDPLGWGTGSPAKLKELRTKEIKNGRLAMLAVMGAWFQAIYTGTGPIDNLFAHLADPGHATIFAAFKG

SEQ ID NO: 10022 - protein, 270 aa, Flaveria ramosissima
MASTACASSAIAAVAFSSPSSQKSGSIVGSTKASFLGGKKLRVSKLGAPSGSRSFGTVCVAADPDRPIWFPGSTPPEWLDGSLPGDFGFDPLGLGSDPETLKWNVQAELVHCRWAMLGAAGIFIPEFLTKIGILNTPSWYTAGEQEYFTDKTTLFIIELIFIGWAEGRRWADIIKPGCVNTDPIFPNNKLTGTDVGYPGGLWFDPLGWGTGSPAKLKELRTKEIKNGRLAMLAVMGAWFQAIYTGTGPIDNLFAHLADPGHATIFAAFKG

SEQ ID NO: 10023 - protein, 271 aa, Vitis vinifera
MASVCASSAMAAVATISPSSQKTGSVVGATKASFLGGKRLSLKKFTAPAAGTRSFTVSAAAADPNRPLWFPGSTPPPWLDGSLPGDFGFDPLGLGSDPETLKWMVQSEIVHCRWAMLGAAGIFIPEFLTKIGILNTPSWYTAGELEYFTDKTTLFIVEMIFIGWAEGRRWADIIKPGCVNTDPIFPNNKLTGTDVGYPGGLWFDPLGWGSGSPDKIKELRTKEIKNGRLAMLAVMGAWFQAIYTGTGPIDNLFAHLADPGHATIFAAFTPK

SEQ ID NO: 10024 - protein, 270 aa, Lactuca sativa
MASTVCASSAIAAVAFSSPTSQKNGSFVGSTKASFLCGKKLRVSKVTAPTVARSSGTVCVTADPERPIWFPGSTPPEWLDGSLPGDFGFDPLGLGSDPETLRWNVQAELVHCRWAMLGAAGIFIPEFLTKIGILNTPSWYTAGEQEYFTDKTTLFIVELIFIGWAEGRRWADILKPGCVNTDPIFPNNKLTGTDVGYPGGLWFDPFGWGNASPAKLKELRTKEIKNGRLAMLAVMGAWFQAIYTGTGPIDNLFAHLADPGHATIFAAFKG

SEQ ID NO: 10025 - protein, 266 aa, Elaeis guineensis
MASVCASSSAVAAVASSQKTGNGLGATKASFLGGTKLRQKKWTAPTARRALSVSAEAISERPLWFPGSTPPPWLDGSLPGDFGFDPLGLGSDPESLRWNQQAELVHCRWAMLGAAGIFIPEFLTKIGILNTPSWYTAGELEYFTDTTTLFVIELIFIGWAEGRRWADIIKPGCVNTDPIFPNNKLTGTDVGYPGGFWFDPLGWGSGSPEKVKELRTKEIKNGRLAMLAVMGAWFQAIYTGTGPIDNLFAHLADPGHATIFAAFTPK

SEQ ID NO: 10026 - protein, 261 aa, Olea europaea
MAAPACASSTIAAVALSSTRATKASFLSGRKLRVSKNVTSTGVRSVTVCAAADPDRPLWFPGSTPPPWLDGSLPGDFGFDPLGLASDPESLKWNQQAELVHCRWAMLGAAGIFIPEFLTKIGILNTPSWYTAGEQEYFTDTTTLFIVELIFIGWAEGRRWADIIKPGCVNTDPIFPNNKLTGTDVGYPGGLWFDPLGWGSGSPEKVKELRTKEIKNGRLAMLAVMGAWFQHIYTGTGPIDNLFAHLADPGHATIFAAFSPK

SEQ ID NO: 10027 - protein, 270 aa, Flaveria ramosissima
MASTACASSAIAAVAFSSPSSQKSGSIVGSTKASFLGGKKLRVSKLSAPSGSRSFGTACVAADPDRPIWFPGSTPPEWLDGSLPGDFGFDPLGLGSDPETLKWNVQAELVHCRWAMLGAAGIFIPEFLTKIGILNTPSWYTAGEQEYFTDKTTLFIIELIFIGWAEGRRWADIIKPGCVNTDPIFPNNKLTGTDVGYPGGLWFDPLGWGTGSPAKLKELRTKEIKNGRLAMLAVMGAWFQAIYTGTGPIDNLFAHLADPGHATIFAAFKG

SEQ ID NO: 10028 - protein, 270 aa, Mimulus guttatus
MASACASSAIAAVVAVSSPSSQKNGAIVGATKASFFGGRKLRVSKFAAPSNTRSVAVCVAADPDRPIWFPGSTPPEWLDGSLPGDFGFDPLGLGSDPDSLKWNAQAELVHCRWAMLGAAGIFIPEFLTKIGILNTPSWYTAGEQEYFTDTTTLFIVELVLIGWAEGRRWADIIKPGSVNTDPIFPNNKLTGTDVGYPGGLWFDPLGYGSGSPAKIKEIRTKEIKNGRLAMLAVMGAWFQHIYTGTGPIDNLFAHLADPGHATIFSAFSPK

SEQ ID NO: 10029 - protein, 269 aa, Fragaria vesca
MASAWASSAIAAVSSPSSQKAGSALAATKASFFGGRKLRVRNVAAPSGSSSTSFRVCAAAADPDRPLWFPGSTPPPWLDGSLPGDFGFDPLGLSSDPDSLKWNTQAEIVHCRWAMLGAAGIFIPEFLTKIGILNTPSWYTAGEQEYFTDTTTLFIVELIFIGWAEGRRWADILKPGSVNTDPIFPNNKLTGTDVGYPGGLWFDPLGWGSGSPEKIKELRTKEIKNGRLAMLAVMGAWFQHIYTGTGPIDNLFAHLADPGHATVFSAFKG

SEQ ID NO: 10030 - protein, 126 aa, Carpinus betulus
MASACASSAVAAVAISSPSSQKAGCLVGATKACFLSGRKLRVRSYTAATGRRSLSVCAAVAEPDRPIWFPGSVPPPWLDGSLPADFGFDPLGLGSDPETLRWNVQSEIVHCRWAMLGPRVFSFQSC

SEQ ID NO: 10031 - protein, 269 aa, Ambrosia trifida
KTMACASSAIAAVAFSSPSSQKSGSIVGSTKASFLGGKKLRVSKVCAPSGSRSFGTVCVAADPDRPIWFPGSTPPEWLDGSLPGDFGFDPLGLGSDPETLRWNVQAELVHCRWAMLGAAGIFIPEFLTKIGILNTPSWYTAGEQEYFTDKTTLFIIELIFIGWAEGRRWADIIKPGCVNTDPIFPNNKLTGTDVGYPGGLWFDPLGWGSGSPAKLKELRTKEIRNGRLAMLAVMGAWFQAIYTGTGPIDNLFAHLADPGHATIFAAFKG

SEQ ID NO: 10032 - protein, 265 aa, Tragopogon dubius
MASCASSAIAFSSPSSQKSGSVVGATKASFLGGKKLKVSKFAAPAGARSVSPVCVAADPERPIWFPGSTPPEWLDGSLPGDFGFDPLGLGSDPETLKWNVQAEIVHCRWAMLGAAGIFIPEFLTKIGILNTPSWYTAGEQEYFTDKTTLFIVELIFIGWAEGRRWADILKPGCVNTDPIFPNNKLTGTDVGYPGGLWFDPLGWGSGSPAKIKELRTKEIKNGRLAMLAVMGAWFQAIYTGTGPIDNLFAHLADPGHATIFAAFKG

SEQ ID NO: 10033 - protein, 268 aa, Linum usitatissimum
MASVCASSAITAVSSPSSQKNGSSAGFLSGKRLTGVNRFSSPSISGRRRGGLTAVCAVADPERPIWFPGSTPPVWLDGTLPGDFGFDPLGLGSDPETLRWNVQAELVHCRWAMLGAAGIFIPEFLTKIGILNTPSWYTAGEQEYFTDTTTLFIVELIFIGWAEGRRWADILKPGCVNTDPIFPNNKLTGTDVGYPGGLWFDPLGWGSGSPEKLKELRTKEIKNGRLAMLAVMGAWFQHIYTGTGPIDNLFAHLADPGHATIFAAFTPK

SEQ ID NO: 10034 - protein, 268 aa, Linum usitatissimum
MASVCASSAITAVSSPSSQKNGSPAGFLSGKRLTGVNRFSSPAISGRRRGGLTAVCAVADPERPIWFPGSTPPVWLDGTLPGDFGFDPLGLGSDPETLRWNVQAELVHCRWAMLGAAGIFIPEFLTKIGILNTPSWYTAGEQEYFTDTTTLFIVELIFIGWAEGRRWADILKPGCVNTDPIFPNNKLTGTDVGYPGGLWFDPLGWGSGSPEKLKELRTKEIKNGRLAMLAVMGAWFQHIYTGTGPIDNLFAHLADPGHATIFAAFTPK

SEQ ID NO: 10035 - protein, 271 aa, Malus domestica
MASAWASSSAIATFAVSSRSQKGGATLAVTKASFFGGRKLRVRSFTAPTGSSSSFTVRAAAADPDRPLWFPGSTPPPWLDGSLPGDFGFDPLGLSSDPDSLKWNQQAELVHCRWAMLGAAGIFIPEFLTKIGILNTPSWYTAGEQEYFTDTTTLFVVELVLIGWAEGRRWADILKPGSVNTDPIFPNNKLTGTDVGYPGGLWFDPLGWGSGSPEKIKELRTKEIKNGRLAMLAVMGAWFQHIYTGTGPIDNLFAHLADPGHATIFASFSPK

SEQ ID NO: 10036 - protein, 270 aa, Vinca minor
SACASSTIAAVAFSSSPSSQKNGSIIGASKASFLGGRKVRVSKFRSSRAGGRSLTTVCAAAEPDRPLWFPGSTPPPWLDGSLPGDFGFDPLGLGSDPETLRWNVQSEIVHCRWAMLGAAGIFIPEFLTKIGILNTPSWYTAGEQEYFTDTTTLFVVELILIGWAEGRRWADILKPGSVNTDPIFPNNKLTGTDVGYPGGLWFDPLGWGSGSPQKVKELRTKEIKNGRLAMLAVFGAWFQHIYTGTGPIDNLFAHLADPGHATVFAAFTSK

SEQ ID NO: 10037 - protein, 284 aa, Vaccinium corymbosum
KTANCKQEKTAHKWPPLFVLLQLLQQQASLPPSSQKSGSIVGATKASFFGGRKLSLRTYTAPARTRSVTVRAAAADPERPLWFPGSTPPPWLDGSLPGDFGFDPLGLGSDPETLKWMVQSEIVHCRWAMLGAAGIFIPEFLTKIGILNTPSWYTAGELEYFTDKTTLFIVELIFIGWAEGRRWADILKPGCVNTDPIFPNNKLTGTDVGYPGGLWFDPLGWGSGSPEKVRELRTKEIKNGRLAMLAVMGAWFQAIYTGTGPIDNLFAHLADPGHATIFAAFSPK

SEQ ID NO: 10038 - protein, 271 aa, Aquilegia formosa
MASLCASSALATVAITSSSSQKSGGSCLGATKASFLVGRKLRERKFIAYTGQGGFSVRAAAADAERPLWFPGSTPPAWLDGSLPGDFGFDPLGLGSDPESLRWNAQAELVHCRWAMLGAAGIFIPEFLTKIGILNTPSWYTAGEQEYFTDTTTLFIVELIFIGWAEGRRWADIIKPGCVNTDPIFPNNKLTGTDVGYPGGLWFDPLGYGKGSPEKIMELRTKEIKNGRLAMLAVMGAWFQHIYTGTGPIDNLFAHLADPGHATIFQAFTPK

SEQ ID NO: 10039 - protein, 271 aa, Vaccinium corymbosum
MASSVCASSAIAATGLSSPSSQKSGSIVGATKASFFGGRKLSLRTYTAPARTRSVTVRAAAADPERPLWFPGSTPPPWLDGSLPGDFGFDPLGLGSDPETLKWMVQSEIVHCRWAMLGAAGIFIPEFLTKIGILNTPSWYTAGELEYFTDKTTLFIVELIFIGWAEGRRWADILKPGCVNTDPIFPNNKLTGTDVGYPGGLWFDPLGWGSGSPEKVRELRTKEIKNGRLAMLAVMGAWFQAIYTGTGPIDNLFAHLADPGHATIFAAFSPK

SEQ ID NO: 10040 - protein, 269 aa, Arnica chamissonis
ASTACASSAIAAVAFSSPSAQKSGSIVGSTKASFLGGKKLRVSKLGAPSGSRSFGTVCVAADPDRPIWFPGSTPPEWLDGSLPGDFGFDPLGLGSDPETLKWNVQAELVHCRWAMLGAAGIFIPEFLTKIGILNTPSWYTAGEQEYFTDKTTLFIVELIFIGWAEGRRWADIIKPGCVNTDPIFPNNKLTGTDVGYPGGLWFDPLGWGSGSPAKLKELRTKEIKNGRLAMLAVMGAWFQAEYTGTGPIDNLFAHLADPGHATIFAAFKG

SEQ ID NO: 10041 - protein, 260 aa, Flaveria ramosissima
ASSAIAAVAFSSPSSQKSGSTVGSTKASFFGGKKLKVSKLGAPSGSRSFATVCAAADPDRPIWFPGSTPPEWLDGSLPGDFGFDPLGLGSDPETLRWNVQAELVHCRWAMLGAAGIFIPEFLTKIGILNTPSWYTAGEQEYFTDKTTLFIIELIFIGWAEGRRWADIIKPGCVNTDPIFPNNKLTGTDVGYPGGLWFDPLGWGSGSPAKLKELRTKEIKNGRLAMLAVMGAWFQAIYTGTGPIDNLFAHLADPGHATIFA

SEQ ID NO: 10042 - protein, 265 aa, Flaveria ramosissima
CASSAIAAVAFSSPSSQKSGSIVGSTKASFLGGKKLRVSKLGAPSGSRSFGTVCVAADPDRPIWFPGSTPPEWLDGSLPGDFGFDPLGLGSDPETLKWNVQAELVHCRWAMLGAAGIFIPEFLTKIGILNTPSWYTAGEQEYFTDKTTLFIIELIFIGWAEGRRWADIIKPGCVNTDPIFPNNKLTGTDVGYPGGLWFDPLGWGTGSPAKLKELRTKEIKNGRLAMLAVMGAWFQAIYTGTGPIDNLFAHLADPGHATIFAAFKG

SEQ ID NO: 10043 - protein, 272 aa, Scabiosa columbaria
MASVCASSAIAAAAAAFSSPRTQKNGSVLGATKAFFLGGGKLKVAKSARTFGARSTATVCTVADPERPIWFPGSTPPPWLDGSLPGDFGFDPLGLGSDPETLKWNVQAEIVHCRWAMLGAAGIFIPEFLTKIGVLNTPSWYTAGEQEYFTDKTTLFIVELVLIGWAEGRRWADILKPGSVNTDPIFPNNKLTGTDVGYPGGLWFDPLGWGSGSPEKIKELRTKEIKNGRLAMLAVMGAWFQANYTGTGPIDNLFAHLADPGHATIFAAFSPK

SEQ ID NO: 10044 - protein, 264 aa, Helianthus annuus
MACASSAIAAVAFSSPSSQKSVGSTKASFLGGKKLRVSKVGAPSGSRSFGTVCVAADPDRPIWFPGSTPPEWLDGSLPGDFGFDPLGLGSDPETLRWNVQAELVHCRWAMLGAAGIFIPEFLTKIGILNTPSWYTAGEQEYFTDKTTLFIIELIFIGWAEGRRWADIIKPGCVNTDPIFPNNKLTGTDVGYPGGLWFDPLGWGTGSPAKLKELRTKEIKNGRLAMLAVMGAWFQAIYTGTGPIDNLFAHLADPGHATIFAAFKG

SEQ ID NO: 10045 - protein, 271 aa, Aristolochia fimbriata
MASVCASSSAIAAVAISSSSSQKSGNGLSATKASFLGGRKLRRGKVTKSGAAPRSFTVSAAAASERPLWFPGSTPPPWLDGSLPGDFGFDPLGLGSDPETLRWNQQAELVHCRWAMLGAAGIFIPELLTKLGILNTPSWYTAGELEYFTDTTTLFIIELIFIGWAEGRRWADIIKPGCVNTDPIFPNNKLTGTEVGYPGGLWFDPLGWGTGSPEKLKELRTKEIKNGRLAMLAVMGAWFQAIYTGTGPIDNLFAHLADPGHNTIFSAFTPK

SEQ ID NO: 10046 - protein, 271 aa, Gerbera hybrid cultivar
MASTACASSAIAAVAFSSPSSQKSGSIVGSTKASFLGGKKLRVSKFSAPSGARTVSTACVAADPDRPIWFPGSVPPPWLDGSLPGDFGFDPLGLGSDPETLKWFVQSEIVHCRWAMLGAAGIFIPEFLTKLGILNTPSWYTAGELEYFTDKTTLFIVELIFIGWAEGRRWADIIKPGCVNTDPIFPNNKLTGTDVGYPGGLWFDPLGWGSGSPAKVKELRTKEIKNGRLAMLAVMGAWFQAIYTKTGPIDNLFAHLADPGHATVFAAFKGE

SEQ ID NO: 10047 - protein, 261 aa, Olea europaea
MAASAFASSTIAAVALSPTRATKASFLSGRKLRVSKNATSTRVQSVTVCAAADPDRPLWFPGSTPPPWLDGSLPGDFGFDPLGLSSDPESLKWNQQAELVHCRWAMLGAAGIFIPEFLTKIGILNTPSWYTAGEQEYFTDTTTLFVVELIFIGWAEGRRWADIIKPGCVNTDPIFPNNKLTGTDVGYPGGLWFDPLGWGSGSPEKVKELRTKEIKNGRLAMLAVMGAWFQHIYTGTGPIDNLFAHLADPGHATIFAAFSPK

SEQ ID NO: 10048 - protein, 270 aa, Senecio madagascariensis
MASTACASSAIAPVAFSSPSAQKSGSIVGSTKASFFGGKKLRVSKFAAPTGARSLSTVCVAADPDRPIWFPGSTPPEWLDGSLPGDFGFDPLGLGSDPETLRWNVQAELVHCRWAMLGAAGIFIPEFLTKIGILNTPSWYTAGEQEYFTDKTTLFIVELIFIGWAEGRRWADIINPGCVNTDPIFPNNKLTGTDVGYPGGLWFDPLGYGNASPAKLKELRTKEIKNGRLAMLAVMGAWFQAEYTGTGPIDNLFAHLADPGHATIFAAFKG

SEQ ID NO: 10049 - protein, 265 aa, Antirrhinum majus
MATTCASSAIAFSSPSSQKNGGIVGATKASFFGARKLRVSKFSAKRSVAVCAAADPERPIWFPGSTPPPWLDGSLPGDFGFDPLGLASDPDSLKWNAQAELVHCRWAMLGAAGIFIPEFLTKIGILNTPSWYTAGEQEYFTDTTTLFIVELVLIGWAEGRRWADIIKPGSVNTDPIFPNNKLTGTDVGYPGGLWFDPLGWGSGSPAKIKELRTKEIKMGGWLCWRLWERGSNTFTRVLGLLITSSPTLQIRVMPPFLLLSVPSER

SEQ ID NO: 10050 - protein, 273 aa, Ambrosia trifida
NNISKTMACASSAIAAVAFSSPSSQKSGSIVGSTKASFLGGKKLRVSKVCAPSGSRSFGTVCVAADPDRPIWFPGSTPPEWLDGSLPGDFGFDPLGLGSDPETLRWNVQAELVHCRWAMLGAAGIFIPEFLTKIGILNTPSWYTAGEQEYFTDKTTLFIIELIFIGWAEGRRWADIIKPGCVNTDPIFPNNKLTGTDVGYPGGLWFDPLGWGSGSPAKLKELRTKEIKNGRLAMLAVMGAWFQAIYTGTGPIDNLFAHLADPGHATIFAAFKG

SEQ ID NO: 10051 - protein, 261 aa, Flaveria ramosissima
MASTACASSAIAAVAFSSPSSQKSGSTVGSTKASFLGGKKLKVSKLGAPSGSQSFATVCAAADPDRPIWFPGSTPPEWLDGSLPGDFGFDPLGLGSDPETLRWNVQAELVHCRWAMLGAAGIFIPEFLTKIGILNTPSWYTAGEQEYFTDKTTLFIIELIFIGWAEGRRWADIIKPGCVNTDPIFPNNKLTGTDVGYPGGLWFDPLGWGSGSPAKLKELRTKEIKNGRLAMLAVMGAWFQAIYTGTGPIDNLFAHLADPGH

SEQ ID NO: 10052 - protein, 272 aa, Scabiosa columbaria
MASACASSAIAAAFSSASSSSQKNGAIVGATKTSFLGGRKLRVTKYKSAATGARSVGPVCTLADPDRPIWFPGSTPPPWLDGSLPGDFGFDPLGLGSDPETLKWNQQAELVHCRWAMLGAAGIFIPEFLTKIGILNTPSWYTAGEQEYFTDKTTLFIVELIFIGWAEGRRWADILKPGCVNTDPIFPNNKLTGTDVGYPGGLWFDPLGWGSGSPAKIKELRTKEIKNGRLAMLAVMGAWFQANYTGTGPIDNLFAHLADPGHATIFAAFSPK

SEQ ID NO: 10053 - protein, 289 aa, Flaveria ramosissima
PLRQYEPNGNETLHSSISIIGFNCLFLLCYCSCCLSPPQVQQKWIYCWINKGFFLGGKKLKVSKLGAPSGSRSFATVCAAADPDRPIWFPGSTPPEWLDGSLPGDFGFDPLGLGSDPETLRWNVQAELVHCRWAMLGAAGIFIPEFLTKIGILNTPSWYTAGEQEYFTDKTTLFIIELIFIGWAEGRRWADIIKPGCVNTDPIFPNNKLTGTDVGYPGGLWFDPLGWGSGSPAKLKELRTKEIKNGRLAMLAVMGAWFQAIYTGTGPIDNLFAHLADPGHATIFAAFKG

SEQ ID NO: 10054 - protein, 262 aa, Cirsium arvense
SAIAAVAFSSPSTQKSGSIVGSTKASFLGGKKLRVSKFSAPTGARSVGTVCVAADPDRPLWFPGSTPPEWLDGSLPGDFGFDPLGLGSDPDTLKWNQQAELVHCRWAMLGAAGIFIPEFLTKIGILNTPSWYTAGEQEYFTDKTTLFIVELIFIGWAEGRRWADIINPGCVNTDPIFPNNKLTGTDVGYPGGLWFDPLGWGSGSPQKLKELRTKEIKNGRLAMLAVMGAWFQAIYTGTGPIDNLFAHLADPGHATIFAAFKG

SEQ ID NO: 10055 - protein, 268 aa, Unknown
  Sequence found in Organisms: Citrus sinensis, Citrus clementina, Citrus sinensis
MASVCASPAVAAISSPSSQKSRSVAGATKASFLGGKKLKLRKNGATAGTRSVSVSAAAADPNRPLWFPGSTPPEWLDGSLPGDFGFDPLGLGSDPETLRWNVQSEIVHCRWAMLGAAGIFIPELLTKLGILNTPSWYTAGELEYFTDTTTLFIVEMIFIGWAEGRRWADIIKPGCVNTDPIFPNNKLTGTDVGYPGGLWFDPLGWGSGSPEKVKELRTKEIKNGRLAMLAVMGAWFQHIYTGTGPIDNLIAHLADPGHATVFAAFTPK

SEQ ID NO: 10056 - protein, 269 aa, Taraxacum officinale
  misc_feature (267)..(267): Xaa can be any naturally occurring amino acid
GFTACASSAIAAVAFSSPTSQKNGSFVGSTKASFLGGKKLRVSKFTAPAVTRSAGAVCVAADPDRPIWFPGSTPPEWLDGSLPGDFGFDPLGLGSDPETLKWNVQAEIVHCRWAMLGAAGIFIPEFLTKIGILNTPSWYTAGEQEYFTDKTTLFIVELIFIGWAEGRRWADILKPGSVNTDPIFPNNKLTGTDVGYPGGLWFDPLGWGSGSPAKLKELRTKEIKNGRLAMLAVMGAWFQAIYTGTGPIDNLFAHLADPGHATIFAAXQG

SEQ ID NO: 10057 - protein, 267 aa, Euphorbia peplus
MASVCASSAIAISSPSSQKCGAIVGTTKASFLSGKRLKCRQTSSSVVSSRCVTVCAVADPDRPLWFPGSSPPEWLDGSLPGDFGFDPLGLGSDPETLRWNVQAELVHCRWAMLGAAGIFIPEFLTKIGILNTPSWYEAGTQEYFTDTTTLFVIELIFIGWAEGRRWADILKPGCVNTDPIFPNNKLTGTDVGYPGGLWFDPLGWGSGSPAKLKELRTKEIKNGRLAMLAVMGAWFQHIYTGTGPIDNLFAHLADPGHATVFQAFTPK

SEQ ID NO: 10058 - protein, 263 aa, Flaveria ramosissima
SSAIAAVAFSSPSSQKSGSIVGSTKASFLGGKKLRVSKLGAPSGSRSFGTVCVAADPDRPIWFPGSTPPEWLDGSLPGDFGFDPLGLGSDPETLKWNVQAELVHCRWAMLGAAGIFIPEFLTKIGILNTPSWYTAGEQEYFTDKTTLFIIELIFIGWAEGRRWADIIKPGCVNTDPIFPNNKLTGTDVGYPGGLWFDPLGWGTGSPAKLKELRTKEIKNGRLAMLAVMGAWFQAIYTGTGPIDNLFAHLADPGHATIFAAFKG

SEQ ID NO: 10059 - protein, 170 aa, Flaveria ramosissima
MASTACASSAIAAVAFSSPSSQKSGSIVGSTKASFLGGKKLRVSKLSAPSGSRSFGTACVAADPDRPIWFPGSTPPEWLDGSLPGDFGFDPPGLGSDPETLKWNVQAELVHCRWAMLGAAGIFIPEFLTKIGILNTPSWYTAGEQEYFTDKPPSSSSSLFSSLGRRQKMG

SEQ ID NO: 10060 - protein, 304 aa, Flaveria ramosissima
RRVSLRPRSNRLGNRTIYVYASNTVPKLLLHYNGFPLLVSSLLPLPAVAFSSPSSQKSGSIVGSTKASFLGGKKLRVSKLGAPSGSRSFGTVCVAADPDRPIWFPGSTPPEWLDGSLPGDFGFDPLGLGSDPETLKWNVQAELVHCRWAMLGAAGIFIPEFLTKIGILNTPSWYTAGEQEYFTDKTTLFIIELIFIGWAEGRRWADIIKPGCVNTDPIFPNNKLTGTDVGYPGGLWFDPLGWGTGSPAKLKELRTKEIKNGRLAMLAVMGAWFQAIYTGTGPIDNLFAHLADPGHATIFAAFKG

SEQ ID NO: 10061 - protein, 271 aa, Actinidia deliciosa
MASSVCASSAIAAVGLSSTSAQKTGSIVGATKASFLGGRNLRLTKYTTRKSGPRSVTVCAAADPDRPIWFPGSIPPPWLDGSLPGDFGFDPLGLGSDPETLKWMVQSEIVHCRWAMLGAAGIFIPEFLTKLGILNTPSWYTAGELEYFTDKTTLFIIELIFIGWAEGRRWADILKPGCVNTDPIFPNNKLTGTDVGYPGGLWFDPLGWGSGSPEKIKELRTKEIKNGRLAMLAVMGAWFQANYTGTGPIDNLFAHLADPGHATIFAAFTPK

SEQ ID NO: 10062 - protein, 271 aa, Actinidia deliciosa
MASSVCASSAIAAVGLSSTSSQKTGSIVGARKASFLGGRNLRPTKYTTRKSGPRSVTVCAAADPDRPIWFPGSIPPPWLDGSLPGDFGFDPLGLGSDPDTLKWMVQSEIVHCRWAMLGAAGIFIPEFLTKLGILNTPSWYTAGELEYFTDKTTLFIVELIFIGWAEGRRWADILKPGCVNTDPIFPNNKLTGTDVGYPGGLWFDPLGWGSGSPEKIKELRTKEIKNGRLAMLAVMGAWFQANYTGTGPIDNLFAHLADPGHATIFAAFTPK

SEQ ID NO: 10063 - protein, 280 aa, Tripterygium wilfordii
HLRITKEKKWDFRVCASSAIAAVAVSSPSSQKSGSIVGATKTAFLGGKKLRSAKKFTAPAARSSVAVCAVADPDRPLWFPGSTPPPWLDGSLPGDFGFDPLGLSSDPDSLRWNVQSEIVHCRWAMLGAAGIFIPEFLTKIGILNTPSWYTAGEQEYFTDTTTLFVVEMIFIGWAEGRRWADIIKPGCVNTDPIFPNNKLTGTDVGYPGGLWFDPLGWGSGSPEKVKELRTKEIKNGRLAMLAVMGAWFQHIYTGTGPIDNLFAHLADPGHATVFAAFTPK

SEQ ID NO: 10064 - protein, 267 aa, Musa acuminata
MASVCASSSAVAAVASSQKNGAALAATKASFLGGGRKVRQGKWATKTARRAFSVSAAAVPERPLWFPGSTPPPWLDGSLPGDFGFDPLGLGSDPESLRWNQQAEIVHCRWAMLGAAGIFIPEFLTKIGILNTPSWYTAGQLEYFTDTTTLFVIELILIGWAEGRRWADIIKPGCVNTDPIFPNNKLTGTDVGYPGGFWFDPLGWGSGSPEKVKELRTKEIKNGRLAMLAVMGAWFQAIYTGTGPIDNLFAHLADPGHATVFAAFTPK

SEQ ID NO: 10065 - protein, 274 aa, Lippia dulcis
TFLHTQTASACASSAIAAAAFSQSSQKNGSIVGATKASFFGRKTLRVSKLTAPSDKRSVAVCAAADPDRPLWFPGSIPPPWLDGSLPGDFGFDPLGLASDPESLKWNQQAELVHCRWAMLGAAGIFIPEFLTKIGILNTPSWYTAGEQDYFTDTTTLFVVELILIGWAEGRRWADILKPGSVNTDPIFPNNKLTGTDVGYPGGLWFDPLGWGTGSPEKLKELRTKEIKNGRLAMLAVMGAWFQHIYTGTGPIDNLFAHLADPGHATIFASFSPK

SEQ ID NO: 10066 - protein, 156 aa, Amborella trichopoda
MLGAAGIFIPEFLTKLGILNTPSWYTAGEQEYFTDTTTLFVVELIFIGWAEGRRWADIIKPGCVNTDPIFPNNKLTGTDVGYPGGLWFDPLGWGSGSPEQLKELRTKEIKNGRLAMLAVMGAWFQAVYTGTGPIDNLFAHLADPGHATIFSAFTPK

SEQ ID NO: 10067 - protein, 262 aa, Epimedium sagittatum
MASVCASSAISTISISSSSQKSGSLGGIKNSFLLGKKPSRRSRSLTLVRAAATGADRPIWFPGSTPPPWLDGSLPGDFGFDPLGLSSDPDSLKWNVQSEIVHCRWAMLGAAGIFIPEFLTKIGILNTPSWYSAGELDYFTDKTTLFIVELIFIGWAEGRRWADIIKPGCVNTDPIFPNNKLTGTDVGYPGGLWFDPLGWGSGSPEKIKELRTKEIKNGRLAMLAVMGAWFQHIYTGTGPIDNLFAHLADPGHATIFSAFTPK

SEQ ID NO: 10068 - protein, 271 aa, Helianthus annuus
SSCRQNTMACASSAIAAVAFSSPSSQKSVGSTKASFLGGKKLRVSKVGAPSGSRSFGTVCVAADPDRPIWFPGSTPPEWLDGSLPGDFGFDPLGLGSDPETLRWNVQAELVHCRWAMLGAAGIFIPEFLTKIGILNTPSWYTAGEQEYFTDKTTLFIIELIFIGWAEGRRWADIIKPGCVNTDPIFPNNKLTGTDVGYPGGLWFDPLGWGTGSPAKLKELRTKEIKNGRLAMLAVMGAWFQAIYTGTGPIDNLFAHLADPGHATIFAAFKG

SEQ ID NO: 10069 - protein, 264 aa, Amborella trichopoda
MASVCASSSTIAAATISASSSQKNVKASFLGGRSLRQGKVWVPVSRRSLTVSAAVASERPLWFPGSTPPEWLDGSLPGDFGFDPLGLGSDPESLRWNQQAELVHCRWAMLGAAGIFIPEFLTKLGILNTPSWYTAGEQEYFTDTTTLFVVELIFIGWAEGRRWADIIKPGCVNTDPIFPNNKLTGTDVGYPGGLWFDPLGWGSGSPEQLKELRTKEIKNGRLAMLAVMGAWFQAVYTGTGPIDNLFAHLADPGHATIFSAFTPK

SEQ ID NO: 10070 - protein, 269 aa, Flaveria ramosissima
MASTACASSAIAAVASLPQVHRKWMYCWINKGFFLGGKKLKVSKLGAPSGSRSFATVCAAADPDRPIWFPGSTPPEWLDGSLPGDFGFDPLGLGSDPETLRWNVQAELVHCRWAMLGAAGIFIPEFLTKIGILNTPSWYTAGEQEYFTDKTTLFIIELIFIGWAEGRRWADIIKPGCVNTDPIFPNNKLTGTDVGYPGGLWFDPLGWGSGSPAKLKELRTKEIKNGRLAMLAVMGAWFQAIYTGTGPIDNLFAHLADPGHATIFAAFKG

SEQ ID NO: 10071 - protein, 268 aa, Phalaenopsis aphrodite
MACVCAPSAVAAVAIVSSNVQKNGNGLCATKEHFLVGKGVRQSTAVVAGKRRSFSVSAAAIERPLWFPGSTPPPWLDGSLPGDFGFDPLGLGSDPESLRWNVQSELVHCRWAMLGAAGIFVPEFLTKIGILNTPSWYSAGELEYFTDTTTLFIIELILIGWAEGRRWADIIKPGCVNTDPIFPNNKLTGTDVGYPGGLWFDPLGWGSGSPERVKELRTKEIKNGRLAMLAVIGAWFQHIYTGTGPIDNLFAHLADPGHATIFAAFTPK

SEQ ID NO: 10072 - protein, 81 aa, Sarracenia psittacina
IKHKVPRKKSRPQKWTSCACASSAIAAVALSSSPSSQKSGSIVGATKASFLGGRQLRVRKYRAQAGTQRVSAGTRSVTVVP

SEQ ID NO: 10073 - protein, 266 aa, Antirrhinum majus
MASACASSAVAFSSSSSQKIESIVGSTKASFFGARKLRVSKYTAPSSSRSVAVCVAADADRPLWFPGSTPPQWLDGSLPGDFGFDPLGLGSDPESLKWNQQAELVHCRWAMLGAAGIFIPEFLTKIGILDTPSWYAAGEQEYFTDTTTLFIVELVLIGWAEGRRWADIIKPGSVNTDPIFPNNKLTGTEVGYPGGLWFDPLGWGAGSPQKVKELKTKEIKNGRLAMLAVMGAWFQHIYTGTGPIDNLFAHLADPGHATIFAAFSPK

SEQ ID NO: 10074 - protein, 256 aa, Flaveria ramosissima
AFSSPSSQKSGSTVASTKASFLGGKKLKVSKLGAPSGSRSFATVCAAADPDRPIWFPGSTPPEWLDGSLPGDFGFDPLGLGSDPETLRWNVQAELVHCRWAMLGAAGIFIPEFLTKIGILNTPSWYTAGEQEYFTDKTTLFIVELIFIGWAEGRRWADIIKPGCVNTDPIFPNNKLTGTDVGYPGGLWFDPLGWGSGSPAKLKELRTKEIKNGRLAMLAVMGAWFQAIYTGTGPIDNLFAHLADPGHATIFAAFKG

SEQ ID NO: 10075 - protein, 274 aa, Papaver somniferum
MASVCASSAVAAVAISSSSQKSSGAILGATKTSFLVGRKLSQRKAITASPVRGSNSFSVSAAATPDSERPLWFPGSVPPPWLDGSLPGDFGFDPLGLSSDPESLKWNQQSELVHCRWAMLGAAGIFIPEFLTKIGILNTPSWYTAGEQEYFTDTTTLFIVELIFIGWAEGRRWADIIKPGSVNTDPIFPNNKLTGTDVGYPGGLWFDPLGWGNASGEKLKELRTKEIKNGRLAMLAVMGAWFQAIYTGTGPIDNLFAHLADPGHATIFQAFTPK
